US006476212B1

United States Patent
Lalgudi et al.

(10) Patent No.: US 6,476,212 B1
(45) Date of Patent: Nov. 5, 2002

(54) POLYNUCLEOTIDES AND POLYPEPTIDES DERIVED FROM CORN EAR

(75) Inventors: Raghunath V. Lalgudi, Clayton, MO (US); Laura Y. Ito, Pleasanton; Bradley K. Sherman, Oakland, both of CA (US)

(73) Assignee: Incyte Genomics, Inc., Palo Alto, CA (US)

( * ) Notice: Subject to any disclaimer, the term of this patent is extended or adjusted under 35 U.S.C. 154(b) by 0 days.

(21) Appl. No.: 09/313,294

(22) Filed: May 14, 1999

Related U.S. Application Data
(60) Provisional application No. 60/086,722, filed on May 26, 1998.

(51) Int. Cl.[7] .......................... C07H 21/00; C12Q 1/68
(52) U.S. Cl. ....................... 536/23.6; 536/24.3; 435/6
(58) Field of Search .............................. 536/23.6, 24.3; 530/370; 435/6

(56) References Cited

PUBLICATIONS

Sundberg, M.D et al., "Inflorescence Development in the 'Standard Exotic' Maize, Argentine Popcorn (Poaceae)," *Amer. J. Bot.*, 82(1):64–74 (1995).

Cheng, P.C. et al., "Organ Initiation and the Development of Unisexual Flowers in the Tassel and Ear of Zea Mays," *Amer. J. Bot.*, 70(3):450–462 (1983).

Johri, M.M. and E.H. Coe, Jr., "Clonal Analysis of Corn Plant Development," *Dev. Biol.*, 97:154–172 (1983).

Marivet, J. et al., "DNA sequence analysis of a cyclophilin gene from maize: developmental expression and regulation by salicylic acid," *Mol. Gen. Genet.*, 247:222–228 (1995).

Marivet, J. et al., "Bean cyclophilin gene expression during plant development and stress conditions," *Plant Mol. Biol.*, 26:1181–1189 (1994).

*Primary Examiner*—John S. Brusca
*Assistant Examiner*—Marjorie A. Moran
(74) *Attorney, Agent, or Firm*—Incyte Genomics, Inc.; Lynn E. Murry

(57) ABSTRACT

The present invention provides purified, corn ear-derived polynucleotides (cdps) which encode corn ear-derived polypeptides (CDPs). The invention also provides for the use of cdps or their complements, oligonucleotides, or fragments in methods for determining altered gene expression, to recover regulatory elements, and to follow inheritance of desirable characteristics through hybrid breeding programs. The invention further provides for vectors and host cells containing cdps for the expression of CDPs. The invention additionally provides for (i) use of isolated and purified CDPs to induce antibodies and to screen libraries of compounds and (ii) use of anti-CDP antibodies in diagnostic assays.

5 Claims, No Drawings

POLYNUCLEOTIDES AND POLYPEPTIDES DERIVED FROM CORN EAR

This application claims the benefit of U.S. Provisional Application No. 60/086,722, filed on May 26, 1998.

A portion of the disclosure of this patent document contains material which is subject to copyright protection. The copyright owner has no objection to the facsimile reproduction by anyone of the patent document or the patent disclosure, as it appears in the Patent and Trademark Office patent file or records, but otherwise reserves all copyright rights whatsoever.

DESCRIPTION OF THE COMPACT DISK-RECORDABLE (CD-R)

CD-R 1 contains the Sequence Listing formatted in plain ASCII text. CD-R 1 is labeled with Identification No. PL-0017 US, 1 of 3, Copy 1. The file containing the Sequence Listing is entitled p10017.txt, created on Nov. 22, 2000, and is 3,929 KB in size.

CD-R 2 is an exact copy of CD-R 1. CD-R 2 is labeled with Identification No. PL-0017 US, 2 of 3, Copy 2.

CD-R 3 contains the Computer Readable Form of the Sequence Listing in compliance with 37 C.F.R. §1.821(e), and specified by 37 C.F.R. §1.824. CD-R 3 is labeled with Identification No. PL-0017 US, 3 of 3, Copy 3. The file containing the Sequence Listing is entitled pl0017.txt, created on Nov. 22, 2000, and is 3,929 KB in size.

The disclosure of the Sequence Listing submitted as an electronic document on compact disc as described above are to be part of the permanent USPTO record of this patent application and are hereby expressly incorporated by reference.

FIELD OF THE INVENTION

The present invention relates to nucleic and amino acid sequences derived from corn ear and to the use of these sequences in the identification, evaluation, and alteration of desired characteristics associated with growth and development, disease resistance, environmental adaptability, quality, and yield.

BACKGROUND OF THE INVENTION

The field of plant breeding deals with the manipulation of plant genomes with the purpose of improving characteristics of the plant. Plant breeders use data and methodology from plant physiology, genetics, biochemistry, pathology, statistics, and molecular biology. One of the most improved hybrid crops is corn, *Zea mays* (L.). Corn is presently the second-most economically important crop in the United States. Acreage of field corn (used for livestock feed, corn starch, corn syrup, fuel ethanol, and oil) and sweet corn (used fresh or processed for human consumption) exceeds that of any other agronomic crop. Annual losses, reduction in quality and yield, due to diseases and infestation may range from 7 to 17%. Studies of corn may be used as a model for other economically important agronomic grasses.

Corn is a monocotyledonous plant which has one seed leaf, uses the $C_4$ photosynthetic pathway, and has scattered vascular bundles. The mature plant is made up of roots, stem, leaves, and reproductive structures. The root system functions to anchor the plant and to absorb water and nutrients. The corn stem consists of a series of nodes, each bearing one bladelike leaf with parallel veins, and internodes, elongated stem sections. The stem and its leaves are commonly referred to as a stalk. Leaves arise alternately and are arranged in two rows along either side of the stem. The male reproductive structure is the tassel, and its flowers produce pollen. The female reproductive structure is the ear, and its flowers each have a silk for pollination. When a pollen grain is shed onto a silk and germinates, a pollen tube grows down the silk and delivers two sperm to the female gametophyte. Within the gametophyte, one sperm fertilizes the egg, and the other, two polar nuclei. The embryo and endosperm produced by this double fertilization develop into the seed which matures in about two months.

The vegetative (V) and reproductive (R) stages of growth for a corn plant are as follows: VE-emergence from the soil of the seedling leaf; V1-first true leaf; V2-second leaf; . . . V(n)-nth leaf; VT-tasseling stage; and reproductive stages, R1-silking; R2-blister; R3-milk; R4-dough; R5-dent; and R6-physiological maturity (Ritchie, S. W. et al. (1986) *How a Corn Plant Develops*, Iowa State University Cooperative Extension Service, Ames IA 48:1–21).

Corn Ear

Ear shoots are initiated at V3. As the primary apical meristem makes the transition from vegetative growth to tassel formation, the plant also begins to initiate buds in the axils of vegetative leaves. Ear primordia arise beginning at about the sixth node and proceed upward until about two nodes below the developing tassel. The earliest anatomical indications of ear development are periclinal divisions in the second and third cell layers of the shoot meristem followed by divisions in the outermost layer. This axillary floral meristem becomes organized and elongates to produce 8–14 husks which surround the developing cob. The husks remain shorter, and the sheaths become thinner and broader than those of ordinary leaves. Although the outer husks are arranged in two rows, the inner ones can be in several rows. During cob development, the floral meristem elongates and bifurcates one or more times; each bifurcation produces bracts in two ranks and eventually determines the number of rows of kernels on the cob. Each bract produces two spikelets, and each spikelet ultimately produces a single floret. Spikelet development parallels that of other gramineous flowers and produces the following succession of flower parts (from the outside to inside): glumes, lemma, palea, stamen primordia which abort, and a terminal gynoecium. Gyonecial development begins with the enlargement of the ovary wall around the ovule followed by terminal elongation to form the silk (Sundberg, M. D., et al. (1995) Amer J Bot 82:64–74; Cheng, P. C., et al. (1983) Amer J Bot 70:450–462; and Johri, M. M. and Coe, Jr., E. H. (1983) Dev Biol 97:154–172).

Ear shoots are often visible at V6, and by V9, many ear shoots can be seen with appropriate dissection. An ear shoot may develop at every above-ground node with the exception of the last six to eight nodes below the tassel. Consistent with the age of each node and determined apical development, each ear develops faster than the ear originating above it on the stalk. However, growth of most lower ears eventually slows, and only the upper one or two ears ever mature and are harvested. At V12, the number of potential kernels on each ear and the size of the ear are determined. Although the number of rows of kernels per ear has already been established, cob elongation and the determination of the number of kernels per row will not be complete until about one week before silking, about V17.

By V15, upper ear development has surpassed that of lower ears, and silks are just beginning to grow from the ovules. Between V18 and R1, the silks grow acropetally from the basal ovules to those at the ear tip. R1 begins when any silks are visible outside the husks. Pollination occurs when wind borne pollen grains fall on these new, moist silks. Germination and growth of the pollen grain down the silk to the ovule where fertilization occurs takes about 24 hours. Generally two to three days are required for all silks on a single ear to be exposed and pollinated. The silks continue to elongate until they are fertilized or environmental or biological conditions cause their demise. The fertilized ovules immediately begin kernel development (Ritchie, S. W. et al. (1986) *How a Corn Plant Develops*, Iowa State University Cooperative Extension Service, Ames IA 48:1–21).

Problems of Corn Ears

All parts of the corn plant are susceptible to diseases, insect infestations, and stress. These conditions are usually diagnosed by their above-ground leaf, stalk, fruit and/or seed symptoms and are caused by fungi, bacteria, mycoplasmas and related organisms, viruses, nematodes, parasitic seed plants, insects and mites, and abnormal environmental conditions.

Fungal diseases are spread by spores that germinate under favorable conditions of temperature and moisture. Spores germinate to produce branched threads called hyphae that infect plants by direct penetration of the epidermis or through natural openings or wounds. Resting bodies (chlamydospores, sclerotia) allow fungi to survive under unfavorable conditions for long periods in the soil or in plant debris.

Head smut, caused by the fungus, *Sphacelotheca reiliana*, occurs in the deltas and mountain valleys of the Pacific Coast states, in the high plains of Texas, and in southeastern Europe. This soil-borne fungus appears in fields where nitrogen is deficient at the time of ear and tassel formation. Galls containing masses of brownish-black spores replace tassels and ears. When infection of the tassel is confined to individual spikelets, it can result in shoot-like growth on the tassel. Smutted ears are small and either are entirely replaced by a black powdery mass of spores or are aborted with shoot-like growth replacing the normal ear. Although tassels may appear healthy when smut forms in the ears, the plants do not produce pollen. Head smut galls form around heavy strands of vascular tissue which remain as the gall disintegrates. Infected plants are stunted and produce no grain. The fungal spores are dispersed by wind and persist in the soil where they infect germinating seedlings. In such situations, the mycelium systematically infects the young plant and invades the reproductive tissues. Other fungal diseases of ears include common and false smuts, and Gibberella and gray ear rots.

Plant-pathogenic bacteria are unicellular non-spore-forming rods with or without flagella which are spread by cultural practices, animals, water, and soil. Bacteria enter plants through wounds or natural openings and multiply rapidly inside the plant where they cause death of cells; abnormal growths; block water-conducting tissue; or break down the tissue structure. They can remain dormant on or within plant tissue, insects, soil, or equipment.

Stewart's bacterial wilt caused by *Erwinia stewartii*, is common in eastern North America and has been reported in Europe. In susceptible corn varieties, leaves die prematurely, yield is reduced, and the plant becomes more susceptible to stalk rots. The bacteria can spread to all parts of the plant including the kernels. *E. stewartii* is identified in the field by plant symptoms and the yellow ooze which comes from cut ends of infected stalks or leaves. *E. stewartii* is spread by beetles; however, only the corn flea beetle (*Chaetocnema pulicaria*) overwinters and spreads the bacteria the next growing season. Mineral nutrition also influences susceptibility to infection: nitrogen in the form of ammonium and phosphorus increase susceptibility, and high calcium and potassium levels decrease susceptibility. Disease severity may also be aggravated by high temperatures.

Viruses are submicroscopic particles composed of nucleic acid and protein which are transmitted by biological vectors, e.g., aphids, leafhoppers, planthoppers, beetles, and other insects. A few corn viruses are seed-transmitted or overwinter in weed and crop plants or insect bodies. Viruses induce a variety of local or systematic symptoms (e.g., mosaic patterns, yellowing or reddening of the foliage, stunting, ringspots, and necrosis) which may be exacerbated by environmental conditions. Viruses which affect field and sweet corn include maize chlorotic dwarf; maize chlorotic mottle; maize dwarf mosaic; and corn lethal necrosis (a complex of maize chlorotic mottle virus and maize dwarf mosaic).

Maize Dwarf Mosaic Virus (MDMV) is a long, flexuous, rod-shaped virus. It is transmitted on seed or by over 20 species of aphids which acquire the virus from other grasses and transmit it to corn. Plants may be slightly stunted, and reduction in ear size and seed set may occur. MDMV symptoms are highly variable and include narrow, light green or yellowish streaks along the leaf veins and/or dark green "islands" on a yellow background. Symptoms may be present on all leaves and husks that develop following infection. Both environmental conditions and the developmental stage at which the plant is infected may cause a reduction in yield; infection of young plants early in the season causes the most significant losses. In addition, early infection may predispose corn to root and stalk rots and premature death.

Corn lethal necrosis, found in Kansas and Nebraska, results from the synergistic interaction of maize chlorotic mottle virus (MCMV) in combination with either MDMV strain-A or -B or wheat streak mosaic virus (WSMV). Yield loss greatly exceeds that predicted from the cumulative effects of the individual viruses and may approach 100%. Symptoms include severe mottling, browning of the tassel and leaves, and early death of the plant. Late infections cause ears to fill incompletely and husks to dry prematurely. Potential vectors of these viruses may be: corn rootworm beetles (Diabrotica spp.) for MCMV, greenbug (*Schizaphi graminum*) and aphids (*Rhopalosiphum maidis*) for MDMV, and wheat curl mite (*Eriophyes tulipae*) for WSMV.

Important pests of corn include European corn, southwestern corn, and common stalk borers; corn rootworm; chinch bug; corn ear worm; armyworms; grasshoppers; corn leaf aphid; corn flea, dusky sap, and Japanese beetles; and spider mites. The European corn borer (*Ostrinia nubilalis*), introduced into the U.S. from Europe in 1909, has spread throughout the United States and into Canada. The European corn borer infests over 200 plants, but corn is a preferred host. The borer's yearly life cycle varies from one generation in the northern areas to three in the south. The adult female is pale yellow brown with irregular darker bands on her wings; the male is darker with olive brown wings. The larva has flesh-color body with small, round, brown spots and a black head. Before pupating, it is about 25 mm. The early instars tunnel all parts of stalks and ears.

In corn, the larvae first feed in the whorl then bore down midribs of leaves into the stalk leaving frass and silk near their entrance holes. Borers weaken stalks and interfere with the movement of plant nutrients thus reducing yields. In infested corn plants, ears develop poorly or drop, and tassels and stalks may break.

Environmental conditions also affect growth, development, and yield by altering pathogen activity or host physiology. The severity of the excess, deficiency, or imbalance of soil nutrients or water; extreme soil acidity or alkalinity; very high or low temperatures; air pollutants; or mechanical, pesticide, or other injury varies with the stage of plant maturity during which the disturbance occurs and the plant organ involved. Phosphorus deficiency in young corn plants causes small ears which are often twisted with irregular kernel rows and imperfectly developed ear tips. Potassium deficiency also causes ears to be small, chaffy, and dull with pointed, poorly developed tips. (Shurtleff, M. C. et al. (1980) *Compendium of Corn Diseases*, APS Press, St. Paul Minn., 105 pp.).

Corn Disease Control

To control corn diseases, it is necessary to disrupt disease development. Intervention requires understanding the pathogens, the spread of pathogens, disease cycles, and plant resistance. Disease control may be achieved by a single procedure (chemical sprays) or by the integrated use of environmental, genetic, and chemical factors. Successful, long-term disease control generally includes planting disease-resistant varieties, applying chemical control, and implementing sanitary cultural methods.

SUMMARY OF THE INVENTION

The present invention provides nucleic acid sequences comprising corn ear-derived polynucleotides (cdps) as presented in the Sequence Listing. Some of the cdps uniquely identify structural, functional, and regulatory genes of the corn ear. The invention encompasses oligonucleotides, fragments, and derivatives of the cdps and provides nucleic acid sequences complementary to the nucleic acid sequences listed in the Sequence Listing.

The present invention further provides the following cdps of particular interest as identified by SEQ ID NO: 3250 (700611189H1), SEQ ID NO: 3392 (700611501H1), SEQ ID NO: 2031 (700551933H1), SEQ ID NO: 1954 (700551804H1), SEQ ID NO: 2582 (700552928H1), SEQ ID NO: 2016 (700551910H1), SEQ ID NO: 2311 (700552464H1), SEQ ID NO: 2238 (700552317H1), SEQ ID NO: 2096 (700552062H1), SEQ ID NO: 2152 (700552161H1), SEQ ID NO: 636 (700549563H1), SEQ ID NO: 1359 (700550807H1), SEQ ID NO: 811 (700549876H1), SEQ ID NO: 1817 (700551570H1), SEQ ID NO: 2648 (700553058H1), SEQ ID NO: 1460 (700550984H1), SEQ ID NO: 2983 (700282115H1), SEQ ID NO: 2061 (700551985H1), SEQ ID NO: 3095 (700610867H1), SEQ ID NO: 100 (700548530H1), SEQ ID NO: 2 (700548303H1), SEQ ID NO: 3307 (700611293H1), SEQ ID NO: 2160 (700552173H1), SEQ ID NO: 2104 (700552073H1), SEQ ID NO: 2058 (700551981H1), SEQ ID NO: 2177 (700552202H1), SEQ ID NO: 1190 (700550523H1), SEQ ID NO: 2665 (700553084H1), SEQ ID NO: 2510 (700552784H1), SEQ ID NO: 1406 (700550886H1), SEQ ID NO: 1196 (700550530H1), SEQ ID NO: 1127 (700550431H1), SEQ ID NO: 271 (700548896H1), SEQ ID NO: 1126 (700550430H1), SEQ ID NO: 738 (700549740H1), SEQ ID NO: 548 (700549421H1), SEQ ID NO: 542 (700549412H1), SEQ ID NO: 547 (700549420H1), SEQ ID NO: 2114 (700552089H1), SEQ ID NO: 3321 (700611324H1), SEQ ID NO: 2416 (700552643H1), SEQ ID NO: 2430 (700552661H1), SEQ ID NO: 830 (700549908H1), SEQ ID NO: 2182 (700552213H1), SEQ ID NO: 1135 (700550444H1), SEQ ID NO: 1742 (700551432H1), SEQ ID NO: 1633 (700551252H1), SEQ ID NO: 880 (700549994H1), SEQ ID NO: 2234 (700552312H1), SEQ ID NO: 1608 (700551216H1), SEQ ID NO: 2985 (700282117H1), SEQ ID NO: 234 (700548810H1), SEQ ID NO: 1273 (700550651H1), SEQ ID NO: 349 (700549051H1), SEQ ID NO: 3553 (700611877H1), SEQ ID NO: 364 (700549083H1), SEQ ID NO: 2014 (700551904H1), SEQ ID NO: 2962 (700282075H1), SEQ ID NO: 2390 (700552590H1), SEQ ID NO: 1814 (700551565H1), SEQ ID NO: 2892 (700553450H1), SEQ ID NO: 959 (700550142H1), SEQ ID NO: 3069 (700610808H1), SEQ ID NO: 3543 (700611844H1), SEQ ID NO: 3414 (700611544H1), SEQ ID NO: 1097 (700550384H1), SEQ ID NO: 1197 (700550531H1), SEQ ID NO: 1230 (700550584H1), SEQ ID NO: 1648 (700551276H1), SEQ ID NO: 2077 (700552025H1), SEQ ID NO: 3637 (700612029H1), SEQ ID NO: 2429 (700552659H1), SEQ ID NO: 2308 (700552459H1), SEQ ID NO: 2402 (700552620H1), SEQ ID NO: 1278 (700550659H1), SEQ ID NO: 1279 (700550660H1), SEQ ID NO: 1083 (700550360H1), SEQ ID NO: 485 (700549323H1), SEQ ID NO: 645 (700549585H1), SEQ ID NO: 222 (700548774H1), SEQ ID NO: 344 (700549039H1), SEQ ID NO: 879 (700549992H1), SEQ ID NO: 697 (700549667H1), SEQ ID NO: 1257 (700550630H1), SEQ ID NO: 902 (700550036H1), SEQ ID NO: 956 (700550134H1), SEQ ID NO: 67 (700548448H1), SEQ ID NO: 32 (700548366H1), SEQ ID NO: 144 (700548623H1), SEQ ID NO: 1074 (700550338H1), SEQ ID NO: 1201 (700550538H1), SEQ ID NO: 339 (700549027H1), SEQ ID NO: 2115 (700552091H1), SEQ ID NO: 2171 (700552190H1), 40 SEQ ID NO: 2172 (700552191H1), SEQ ID NO: 3108 (700610893H1), SEQ ID NO: 3160 (700610993H1), SEQ ID NO: 3207 (700611093H1), SEQ ID NO: 239 (700548820H1), SEQ ID NO: 2247 (700552332H1), SEQ ID NO: 279 (700548915H1), SEQ ID NO: 3806 (700612280H1), SEQ ID NO: 3732 (700612174H1), SEQ ID NO: 3814 (700612292H1), SEQ ID NO: 2158 (700552171H1), SEQ ID NO: 1184 (700550516H1), SEQ ID NO: 1870 (700551656H1), SEQ ID NO: 2324 (700552483H1), SEQ ID NO: 2375 (700552569H1), SEQ ID NO: 2454 (700552691H1), SEQ ID NO: 1621 (700551231H1), SEQ ID NO: 3735 (700612180H1), SEQ ID NO: 3566 (700611907H1), SEQ ID NO: 264 (700548874H1), SEQ ID NO: 1025 (700550257H1), SEQ ID NO: 535 (700549401H1), SEQ ID NO: 951 (700550126H1), SEQ ID NO: 354 (700549060H1), SEQ ID NO: 332 (700549012H1), SEQ ID NO: 936 (700550089H1), SEQ ID NO: 781 (700549822H1), SEQ ID NO: 1326 (700550749H1), SEQ ID NO: 3564 (700611904H1), SEQ ID NO: 3565 (700611905H1), SEQ ID NO: 1444 (700550962H1), SEQ ID NO: 1994 (700551863H1), SEQ ID NO: 3781 (700612249H1), SEQ ID NO: 2221 (700552281H1), SEQ ID NO: 3313 (700611306H1), SEQ ID NO: 3213 (700611106H1), SEQ ID NO: 3354 (700611405H1), SEQ ID NO: 213 (700548752H1), SEQ ID NO: 99 (700548523H1), SEQ ID NO: 359 (700549072H1), SEQ ID NO: 356 (700549067H1), SEQ ID NO: 992 (700550195H1), SEQ ID NO: 1228 (700550580H1), SEQ ID NO: 3333 (700611357H1), SEQ ID NO: 3381 (700611465H1), SEQ ID NO: 3699 (700612123H1), SEQ ID NO: 3634 (700612024H1), SEQ ID NO: 1432 (700550935H1), SEQ ID NO: 1327 (700550750H1), SEQ ID NO: 1256 (700550629H1), SEQ ID NO: 1068 (700550330H1), SEQ ID NO: 744 (700549752H1), SEQ ID NO: 892 (700550022H1), SEQ ID NO: 2697 (700553128H1), SEQ ID NO: 1708 (700551374H1), SEQ ID NO: 3347 (700611392H1), SEQ ID NO: 3560 (700611894H1), SEQ ID NO: 2036 (700551941H1), SEQ ID NO: 2028 (700551929H1), SEQ ID NO: 3703 (700612129H1), SEQ ID NO: 3767 (700612229H1), SEQ ID NO: 1008 (700550233H1), SEQ ID NO: 997 (700550214H1), SEQ ID NO: 472 (700549301H1), SEQ ID NO: 477 (700549309H1), SEQ ID NO: 2290 (700552436H1), SEQ ID NO: 2313 (700552468H1), SEQ ID NO: 3172 (700611010H1), SEQ ID NO: 2450 (700552686H1), SEQ ID NO: 524 (700549380H1), SEQ ID NO: 1417 (700550911H1), SEQ ID NO: 1383 (700550848H1), SEQ ID NO: 619 (700549540H1), SEQ ID NO: 1551 (700551129H1), SEQ ID NO: 1577 (700551161H1), SEQ ID NO: 250 (700548841H1), SEQ ID NO: 146 (700548625H1), SEQ ID NO: 1711 (700551380H1), SEQ ID NO: 1765 (700551476H1), SEQ ID NO: 1720 (700551391H1), SEQ ID NO: 905 (700550041H1), SEQ ID NO: 3391 (700611496H1), SEQ ID NO: 3349 (700611396H1), SEQ ID NO: 2126 (700552124H1), SEQ ID NO: 2030 (700551932H1), SEQ ID NO: 998 (700550215H1), SEQ ID NO: 1526 (700551091H1), SEQ ID NO: 1756 (700551460H1), SEQ ID NO: 474 (700549303H1), SEQ ID NO: 1177 (700550507H1), SEQ ID NO: 939 (700550093H1), SEQ ID NO: 2848 (700553376H1), SEQ ID NO: 1794 (700551534H1), SEQ ID NO: 2460 (700552701H1), SEQ ID NO: 2621 (700553001H1), SEQ ID NO: 216 (700548758H1), SEQ ID NO: 1213 (700550558H1), SEQ ID NO: 1733 (700551417H1), SEQ ID NO: 1669 (700551309H1), SEQ ID NO: 19 (700548332H1), SEQ ID NO: 614 (700549532H1), SEQ ID NO: 748 (700549762H1), SEQ ID NO: 2644 (700553051H1), SEQ ID NO: 2876 (700553418H1), SEQ ID NO: 3490 (700611717H1), SEQ ID NO: 106 (700548542H1), SEQ ID NO: 94 (700548510H1), SEQ ID NO: 2767 (700553233H1), SEQ ID NO: 1854 (700551635H1), SEQ ID NO: 2033 (700551937H1), SEQ ID NO: 2034 (700551938H1), SEQ ID NO: 1360 (700550808H1), SEQ ID NO: 3280 (700611242H1), SEQ ID NO: 629 (700549550H1), SEQ ID NO: 678 (700549642H1), SEQ ID NO: 491 (700549330H1), SEQ ID NO: 1620 (700551230H1), SEQ ID NO: 1456 (700550980H1), SEQ ID NO: 1524 (700551088H1), SEQ ID NO: 2631 (700553025H1), SEQ ID NO: 2639 (700553042H1), SEQ ID NO: 3546 (700611857H1), SEQ ID NO: 3510 (700611757H1), SEQ ID NO: 1301 (700550707H1), SEQ ID NO: 1063 (700550324H1), SEQ ID NO: 2255 (700552366H1), SEQ ID NO: 1738 (700551424H1), SEQ ID NO: 3419 (700611551H1), SEQ ID NO: 3468 (700611651H1), SEQ ID NO: 112 (700548554H1), SEQ ID NO: 162 (700548655H1), SEQ ID NO: 3756 (700612213H1), SEQ ID NO: 3692 (700612113H1), SEQ ID NO: 2049 (700551960H1), SEQ ID NO: 3522 (700611784H1), SEQ ID NO: 2181 (700552212H1), SEQ ID NO: 3378 (700611461H1), SEQ ID NO: 478 (700549312H1), SEQ ID NO: 845 (700549929H1), SEQ ID NO: 1416 (700550910H1), SEQ ID NO: 1362 (700550810H1), SEQ ID NO: 2769 (700553235H1), SEQ ID NO: 2323 (700552482H1), SEQ ID NO: 2677 (700553107H1), SEQ ID NO: 2867 (700553406H1), SEQ ID NO: 1612 (700551220H1), SEQ ID NO: 1459 (700550983H1), SEQ ID NO: 1622 (700551232H1), SEQ ID NO: 1613 (700551222H1), SEQ ID NO: 149 (700548632H1), SEQ ID NO: 314 (700548972H1), SEQ ID NO: 2129 (700552132H1), SEQ ID NO: 1863 (700551648H1), SEQ ID NO: 919 (700550063H1), SEQ ID NO: 924 (700550072H1), SEQ ID NO: 3218 (700611112H1), SEQ ID NO: 3262 (700611212H1), SEQ ID NO: 3424 (700611560H1), SEQ ID NO: 3548 (700611860H1), SEQ ID NO: 2052 (700551963H1), SEQ ID NO: 2223 (700552283H1), SEQ ID NO: 2184 (700552217H1), SEQ ID NO: 3794 (700612265H1), SEQ ID NO: 1293 (700550690H1), SEQ ID NO: 1246 (700550611H1), SEQ ID NO: 1465 (700550992H1), SEQ ID NO: 479 (700549313H1), SEQ ID NO: 771 (700549807H1), SEQ ID NO: 46 (700548403H1), SEQ ID NO: 2682 (700553112H1), SEQ ID NO: 2678 (700553108H1), SEQ ID NO: 3222 (700611121H1), SEQ ID NO: 800 (700549855H1), SEQ ID NO: 1498 (700551048H1), SEQ ID NO: 1395 (700550868H1), SEQ ID NO: 922 (700550068H1), SEQ ID NO: 1003 (700550224H1), SEQ ID NO: 488 (700549327H1), SEQ ID NO: 754 (700549776H1), SEQ ID NO: 147 (700548630H1), SEQ ID NO: 167 (700548662H1), SEQ ID NO: 3529 (700611796H1), SEQ ID NO: 3507 (700611748H1), SEQ ID NO: 1250 (700550617H1), SEQ ID NO: 1255 (700550626H1), SEQ ID NO: 1052 (700550309H1), SEQ ID NO: 1053 (700550310H1), SEQ ID NO: 2884 (700553429H1), SEQ ID NO: 2679 (700553109H1), SEQ ID NO: 1487 (700551033H1), SEQ ID NO: 1482 (700551025H1), SEQ ID NO: 3759 (700612216H1), SEQ ID NO: 3655 (700612057H1), SEQ ID NO: 401 (700549145H1), SEQ ID NO: 2790 (700553265H1), SEQ ID NO: 3224 (700611125H1), SEQ ID NO: 3265 (700611217H1), SEQ ID NO: 1020 (700550247H1), SEQ ID NO: 41 (700548389H1), SEQ ID NO: 3045 (700610749H1), SEQ ID NO: 1934 (700551766H1), SEQ ID NO: 1627 (700551242H1), SEQ ID NO: 1398 (700550876H1), SEQ ID NO: 2203 (700552255H1), SEQ ID NO: 3786 (700612255H1), SEQ ID NO: 97 (700548517H1), SEQ ID NO: 253 (700548853H1), SEQ ID NO: 1687 (700551338H1), SEQ ID NO: 1704 (700551367H1), SEQ ID NO: 166 (700548661H1), SEQ ID NO: 946 (700550114H1), SEQ ID NO: 2791 (700553267H1), SEQ ID NO: 2870 (700553410H1), SEQ ID NO: 1652 (700551283H1), SEQ ID NO: 1632 (700551251H1), SEQ ID NO: 2704 (700553141H1), SEQ ID NO: 2920 (700553491H1), SEQ ID NO: 1939 (700551773H1), SEQ ID NO: 3516 (700611770H1), SEQ ID NO: 291 (700548928H1), SEQ ID NO: 1105 (700550393H1), SEQ ID NO: 923 (700550070H1), SEQ ID NO: 1470 (700551001H1), SEQ ID NO: 3235 (700611152H1), SEQ ID NO: 3373 (700611452H1), SEQ ID NO: 3788 (700612257H1), SEQ ID NO: 2204 (700552257H1), SEQ ID NO: 578 (700549468H1), SEQ ID NO: 3188 (700611049H1), SEQ ID NO: 79 (700548474H1), SEQ ID NO: 202 (700548728H1), SEQ ID NO: 1495 (700551045H1), SEQ ID NO: 1512 (700551065H1), SEQ ID NO: 652 (700549593H1), SEQ ID NO: 837 (700549919H1), SEQ ID NO: 930 (700550082H1), SEQ ID NO: 1291 (700550685H1), SEQ ID NO: 487 (700549326H1), SEQ ID NO: 1123 (700550425H1), SEQ ID NO: 133 (700548604H1), SEQ ID NO: 84 (700548484H1), SEQ ID NO: 2208 (700552264H1), SEQ ID NO: 2793 (700553271H1), SEQ ID NO: 580 (700549471H1), SEQ ID NO: 1662 (700551295H1), SEQ ID NO: 5 (700548309H1), SEQ ID NO: 681 (700549646H1), SEQ ID NO: 1499 (700551049H1), SEQ ID NO: 3004 (700282149H1), SEQ ID NO: 2742 (700553201H1), SEQ ID NO: 3316 (700611312H1), SEQ ID NO: 1646 (700551273H1), SEQ ID NO: 1707 (700551373H1), SEQ ID NO: 2146 (700552153H1), SEQ ID NO: 505 (700549350H1), SEQ ID NO: 1617 (700551227H1), SEQ ID NO: 819

(700549890H1), SEQ ID NO: 87 (700548490H1), SEQ ID NO: 1307 (700550714H1), SEQ ID NO: 1654 (700551286H1), SEQ ID NO: 49 (700548408H1), SEQ ID NO: 933 (700550086H1), SEQ ID NO: 943 (700550109H1), SEQ ID NO: 3602 (700611959H1), SEQ ID NO: 3591 (700611944H1), SEQ ID NO: 2220 (700552280H1), SEQ ID NO: 2673 (700553095H1), SEQ ID NO: 207 (700548736H1), SEQ ID NO: 1040 (700550285H1), SEQ ID NO: 2570 (700552903H1), SEQ ID NO: 2671 (700553092H1), SEQ ID NO: 588 (700549482H1), SEQ ID NO: 728 (700549718H1), SEQ ID NO: 2750 (700553211H1), SEQ ID NO: 3192 (700611057H1), SEQ ID NO: 198 (700548717H1), SEQ ID NO: 1988 (700551854H1), SEQ ID NO: 1503 (700551055H1), SEQ ID NO: 1619 (700551229H1), SEQ ID NO: 1815 (700551566H1) SEQ ID NO: 2226 (700552292H1), SEQ ID NO: 3245 (700611178H1), SEQ ID NO: 3340 (700611377H1), SEQ ID NO: 3772 (700612237H1), SEQ ID NO: 3792 (700612263H1), SEQ ID NO: 1082 (700550355H1), SEQ ID NO: 1099 (700550387H1), SEQ ID NO: 3577 (700611923H1), SEQ ID NO: 3694 (700612115H1), SEQ ID NO: 2249 (700552337H1), SEQ ID NO: 2337 (700552512H1), SEQ ID NO: 2622 (700553003H1), SEQ ID NO: 2564 (700552891H1), SEQ ID NO: 2755 (700553217H1), SEQ ID NO: 2875 (700553417H1), SEQ ID NO: 1401 (700550879H1), SEQ ID NO: 1523 (700551087H1), SEQ ID NO: 3087 (700610851H1), SEQ ID NO: 3193 (700611058H1), SEQ ID NO: 3286 (700611260H1), SEQ ID NO: 3270 (700611227H1), SEQ ID NO: 2143 (700552149H1), SEQ ID NO: 1972 (700551829H1), SEQ ID NO: 1694 (700551351H1), SEQ ID NO: 1751 (700551451H1), SEQ ID NO: 1104 (700550392H1), SEQ ID NO: 2426 (700552656H1), SEQ ID NO: 50 (700548409H1), SEQ ID NO: 76 (700548466H1), SEQ ID NO: 2353 (700552535H1), SEQ ID NO: 2251 (700552352H1), SEQ ID NO: 537 (700549403H1), SEQ ID NO: 293 (700548931H1), SEQ ID NO: 2585 (700552936H1), SEQ ID NO: 2583 (700552933H1), SEQ ID NO: 1656 (700551288H1), SEQ ID NO: 1428 (700550928H1), SEQ ID NO: 1544 (700551120H1), SEQ ID NO: 1540 (700551115H1), SEQ ID NO: 895 (700550027H1), SEQ ID NO: 888 (700550015H1), SEQ ID NO: 3106 (700610887H1), SEQ ID NO: 3094 (700610863H1), SEQ ID NO: 853 (700549944H1), SEQ ID NO: 844 (700549928H1), SEQ ID NO: 463 (700549278H1), SEQ ID NO: 121 (700548569H1), SEQ ID NO: 3721 (700612158H1), SEQ ID NO: 3742 (700612193H1), SEQ ID NO: 1124 (700550426H1), SEQ ID NO: 1128 (700550433H1), SEQ ID NO: 436 (700549224H1), SEQ ID NO: 486 (700549324H1), SEQ ID NO: 1504 (700551056H1), SEQ ID NO: 1435 (700550941H1), SEQ ID NO: 2590 (700552944H1), SEQ ID NO: 2584 (700552935H1), SEQ ID NO: 598 (700549505H1), SEQ ID NO: 817 (700549885H1), SEQ ID NO: 1710 (700551376H1), SEQ ID NO: 189 (700548705H1), SEQ ID NO: 1696 (700551354H1), SEQ ID NO: 890 (700550018H1), SEQ ID NO: 1823 (700551582H1), SEQ ID NO: 2859 (700553390H1), SEQ ID NO: 2116 (700552093H1), SEQ ID NO: 2371 (700552565H1), SEQ ID NO: 1374 (700550830H1), SEQ ID NO: 606 (700549518H1), SEQ ID NO: 3110 (700610896H1), SEQ ID NO: 3162 (700610995H1), SEQ ID NO: 3294 (700611273H1), SEQ ID NO: 896 (700550028H1), SEQ ID NO: 2598 (700552959H1), SEQ ID NO: 6 (700548311H1), SEQ ID NO: 3648 (700612048H1), SEQ ID NO: 2089 (700552048H1), SEQ ID NO: 3610 (700611975H1), SEQ ID NO: 3601 (700611958H1), SEQ ID NO: 609 (700549523H1), SEQ ID NO: 2195 (700552240H1), SEQ ID NO: 363 (700549082H1), SEQ ID NO: 368 (700549092H1), SEQ ID NO: 177 (700548676H1), SEQ ID NO: 1289 (700550678H1), SEQ ID NO: 2124 (700552120H1), SEQ ID NO: 2123 (700552119H1), SEQ ID NO: 2592 (700552949H1), SEQ ID NO: 2595 (700552954H1), SEQ ID NO: 1438 (700550950H1), SEQ ID NO: 3166 (700611003H1), SEQ ID NO: 758 (700549782H1), SEQ ID NO: 764 (700549793H1), SEQ ID NO: 512 (700549363H1), SEQ ID NO: 638 (700549570H1), SEQ ID NO: 1312 (700550720H1), SEQ ID NO: 298 (700548940H1), SEQ ID NO: 862 (700549958H1), SEQ ID NO: 1485 (700551030H1), SEQ ID NO: 2032 (700551936H1), SEQ ID NO: 1831 (700551602H1), SEQ ID NO: 900 (700550034H1), SEQ ID NO: 2380 (700552574H1), SEQ ID NO: 3161 (700610994H1), SEQ ID NO: 3138 (700610946H1), SEQ ID NO: 1001 (700550222H1), SEQ ID NO: 2599 (700552960H1), SEQ ID NO: 3770 (700612232H1), SEQ ID NO: 1684 (700551335H1), SEQ ID NO: 2596 (700552955H1), SEQ ID NO: 2495 (700552757H1), SEQ ID NO: 612 (700549527H1), SEQ ID NO: 621 (700549542H1), SEQ ID NO: 1706 (700551371H1), SEQ ID NO: 1698 (700551356H1), SEQ ID NO: 759 (700549785H1), SEQ ID NO: 1424 (700550921H1), SEQ ID NO: 1010 (700550236H1), SEQ ID NO: 864 (700549961H1), SEQ ID NO: 1842 (700551614H1), SEQ ID NO: 1843 (700551615H1), SEQ ID NO: 3163 (700610996H1), SEQ ID NO: 3210 (700611096H1), SEQ ID NO: 372 (700549101H1), SEQ ID NO: 377 (700549107H1), SEQ ID NO: 1691 (700551344H1), SEQ ID NO: 319 (700548981H1), SEQ ID NO: 2816 (700553311H1), SEQ ID NO: 2836 (700553355H1), SEQ ID NO: 3605 (700611966H1), SEQ ID NO: 2053 (700551966H1), SEQ ID NO: 733 (700549726H1), SEQ ID NO: 1344 (700550773H1), SEQ ID NO: 705 (700549679H1), SEQ ID NO: 2715 (700553157H1), SEQ ID NO: 2497 (700552760H1), SEQ ID NO: 3097 (700610872H1), SEQ ID NO: 791 (700549838H1), SEQ ID NO: 554 (700549428H1), SEQ ID NO: 2619 (700552995H1), SEQ ID NO: 2618 (700552994H1), SEQ ID NO: 1762 (700551470H1), SEQ ID NO: 3337 (700611364H1), SEQ ID NO: 3283 (700611254H1), SEQ ID NO: 2943 (700282042H1), SEQ ID NO: 3199 (700611081H1), SEQ ID NO: 3472 (700611660H1), SEQ ID NO: 1845 (700551620H1), SEQ ID NO: 1964 (700551820H1), SEQ ID NO: 225 (700548780H1), SEQ ID NO: 28 (700548353H1), SEQ ID NO: 1147 (700550461H1), SEQ ID NO: 1012 (700550238H1), SEQ ID NO: 3640 (700612035H1), SEQ ID NO: 3777 (700612243H1), SEQ ID NO: 27 (700548352H1), SEQ ID NO: 48 (700548407H1), SEQ ID NO: 2500 (700552764H1), SEQ ID NO: 2653 (700553066H1), SEQ ID NO: 2627 (700553015H1), SEQ ID NO: 2630 (700553022H1), SEQ ID NO: 1397 (700550875H1), SEQ ID NO: 1952 (700551802H1), SEQ ID NO: 1777 (700551508H1), SEQ ID NO: 1955 (700551808H1), SEQ ID NO: 3757 (700612214H1), SEQ ID NO: 3029 (700282195H1), SEQ ID NO: 2084 (700552041H1), SEQ ID NO: 348 (700549049H1), SEQ ID NO: 1115 (700550416H1), SEQ ID NO: 1028 (700550260H1), SEQ ID NO: 2445 (700552678H1), SEQ ID NO: 2059 (700551982H1), SEQ ID NO: 392 (700549129H1), SEQ ID NO: 405 (700549161H1), SEQ ID NO: 2179 (700552210H1), SEQ ID NO: 2801 (700553281H1), SEQ ID NO: 558

(700549433H1), SEQ ID NO: 575 (700549465H1), SEQ ID NO: 1496 (700551046H1), SEQ ID NO: 1382 (700550846H1), SEQ ID NO: 3170 (700611007H1), SEQ ID NO: 2553 (700552869H1), SEQ ID NO: 3627 (700612015H1), SEQ ID NO: 3628 (700612017H1), SEQ ID NO: 955 (700550133H1), SEQ ID NO: 36 (700548376H1), SEQ ID NO: 399 (700549142H1), SEQ ID NO: 1046 (700550296H1), SEQ ID NO: 2455 (700552692H1), SEQ ID NO: 2440 (700552672H1), SEQ ID NO: 3616 (700611993H1), SEQ ID NO: 2064 (700551993H1), SEQ ID NO: 573 (700549463H1), SEQ ID NO: 1748 (700551447H1), SEQ ID NO: 514 (700549365H1), SEQ ID NO: 739 (700549742H1), SEQ ID NO: 2837 (700553358H1), SEQ ID NO: 7587 (700381977H1), SEQ ID NO: 5347 (700350007H1), SEQ ID NO: 5462 (700350186H1), SEQ ID NO: 6027 (700351106H1), SEQ ID NO: 5829 (700350746H1), SEQ ID NO: 5628 (700350442H1), SEQ ID NO: 5761 (700350638H1), SEQ ID NO: 6144 (700351311H1), SEQ ID NO: 4713 (700348913H1), SEQ ID NO: 6689 (700352239H1), SEQ ID NO: 5287 (700349905H1), SEQ ID NO: 6130 (700351281H1), SEQ ID NO: 7119 (700381151H1), SEQ ID NO: 4430 (700348418H1), SEQ ID NO: 7215 (700381331H1), SEQ ID NO: 4473 (700348481H1), SEQ ID NO: 7082 (700381096H1), SEQ ID NO: 5600 (700350402H1), SEQ ID NO: 5271 (700349875H1), SEQ ID NO: 6505 (700351918H1), SEQ ID NO: 6731 (700352307H1), SEQ ID NO: 4836 (700349114H1), SEQ ID NO: 4665 (700348817H1), SEQ ID NO: 7210 (700381325H1), SEQ ID NO: 5970 (700350990H1), SEQ ID NO: 4835 (700349113H1), SEQ ID NO: 5524 (700350292H1), SEQ ID NO: 5482 (700350231H1), SEQ ID NO: 4591 (700348683H1), SEQ ID NO: 5490 (700350244H1), SEQ ID NO: 5883 (700350843H1), SEQ ID NO: 4399 (700348360H1), SEQ ID NO: 5068 (700349538H1), SEQ ID NO: 4116 (700347737H1), SEQ ID NO: 5074 (700349547H1), SEQ ID NO: 4590 (700348682H1), SEQ ID NO: 6023 (700351094H1), SEQ ID NO: 7528 (700381886H1), SEQ ID NO: 7071 (700381079H1), SEQ ID NO: 6316 (700351590H1), SEQ ID NO: 6424 (700351780H1), SEQ ID NO: 5862 (700350801H1), SEQ ID NO: 6369 (700351676H1), SEQ ID NO: 5411 (700350101H1), SEQ ID NO: 6850 (700352516H1), SEQ ID NO: 6546 (700351988H1), SEQ ID NO: 7562 (700381943H1), SEQ ID NO: 6211 (700351417H1), SEQ ID NO: 6659 (700352179H1), SEQ ID NO: 6950 (700380888H1), SEQ ID NO: 4047 (700347589H1), SEQ ID NO: 4934 (700349303H1), SEQ ID NO: 6137 (700351296H1), SEQ ID NO: 7372 (700381626H1), SEQ ID NO: 5192 (700349751H1), SEQ ID NO: 6089 (700351218H1), SEQ ID NO: 5515 (700350279H1), SEQ ID NO: 6795 (700352418H1), SEQ ID NO: 5638 (700350457H1), SEQ ID NO: 6192 (700351380H1), SEQ ID NO: 6199 (700351396H1), SEQ ID NO: 5773 (700350657H1), SEQ ID NO: 7141 (700381192H1), SEQ ID NO: 6748 (700352335H1), SEQ ID NO: 4070 (700347635H1), SEQ ID NO: 7447 (700381743H1), SEQ ID NO: 5802 (700350708H1), SEQ ID NO: 6509 (700351926H1), SEQ ID NO: 5131 (700349632H1), SEQ ID NO: 7116 (700381144H1), SEQ ID NO: 6820 (700352453H1), SEQ ID NO: 7515 (700381865H1), SEQ ID NO: 6911 (700380828H1), SEQ ID NO: 6718 (700352284H1), SEQ ID NO: 4557 (700348625H1), SEQ ID NO: 6862 (700352545H1), SEQ ID NO: 5856 (700350789H1), SEQ ID NO: 6982 (700380949H1), SEQ ID NO: 5556 (700350341H1), SEQ ID NO: 4905 (700349240H1), SEQ ID NO: 6124 (700351269H1), SEQ ID NO: 5816 (700350730H1), SEQ ID NO: 5823 (700350738H1), SEQ ID NO: 5680 (700350524H1), SEQ ID NO: 5388 (700350066H1), SEQ ID NO: 6669 (700352201H1), SEQ ID NO: 5703 (700350553H1), SEQ ID NO: 4103 (700347712H1), SEQ ID NO: 3943 (700347412H1), SEQ ID NO: 7252 (700381415H1), SEQ ID NO: 6019 (700351084H1), SEQ ID NO: 4690 (700348868H1), SEQ ID NO: 4718 (700348921H1), SEQ ID NO: 5320 (700349953H1), SEQ ID NO: 7105 (700381128H1), SEQ ID NO: 5742 (700350611H1), SEQ ID NO: 5923 (700350910H1), SEQ ID NO: 6004 (700351058H1), SEQ ID NO: 6574 (700352039H1), SEQ ID NO: 6600 (700352077H1), SEQ ID NO: 5167 (700349712H1), SEQ ID NO: 6356 (700351655H1), SEQ ID NO: 4672 (700348831H1), SEQ ID NO: 4394 (700348354H1), SEQ ID NO: 5660 (700350492H1), SEQ ID NO: 6163 (700351338H1), SEQ ID NO: 5534 (700350311H1), SEQ ID NO: 6738 (700352316H1), SEQ ID NO: 5725 (700350581H1), SEQ ID NO: 4760 (700348993H1), SEQ ID NO: 7480 (700381806H1), SEQ ID NO: 7288 (700381486H1), SEQ ID NO: 6516 (700351934H1), SEQ ID NO: 6512 (700351930H1), SEQ ID NO: 4136 (700347771H1), SEQ ID NO: 4115 (700347736H1), SEQ ID NO: 5477 (700350220H1), SEQ ID NO: 6522 (700351954H1), SEQ ID NO: 4158 (700347835H1), SEQ ID NO: 4619 (700348737H1), SEQ ID NO: 4676 (700348837H1), SEQ ID NO: 6420 (700351774H1), SEQ ID NO: 5181 (700349734H1), SEQ ID NO: 6403 (700351739H1), SEQ ID NO: 5549 (700350329H1), SEQ ID NO: 3834 (700282233H2), SEQ ID NO: 7132 (700381176H1), SEQ ID NO: 4420 (700348387H1), SEQ ID NO: 6343 (700351632H1), SEQ ID NO: 6105 (700351241H1), SEQ ID NO: 6064 (700351163H1), SEQ ID NO: 5396 (700350077H1), SEQ ID NO: 5006 (700349420H1), SEQ ID NO: 7488 (700381818H1), SEQ ID NO: 7416 (700381688H1), SEQ ID NO: 5031 (700349468H1), SEQ ID NO: 6746 (700352333H1), SEQ ID NO: 5616 (700350427H1), SEQ ID NO: 4484 (700348505H1), SEQ ID NO: 4890 (700349220H1), SEQ ID NO: 4892 (700349224H1), SEQ ID NO: 5550 (700350330H1), SEQ ID NO: 6404 (700351740H1), SEQ ID NO: 4764 (700349002H1), SEQ ID NO: 7266 (700381438H1), SEQ ID NO: 4003 (700347516H1), SEQ ID NO: 4097 (700347694H1), SEQ ID NO: 5176 (700349729H1), SEQ ID NO: 4630 (700348755H1), SEQ ID NO: 6652 (700352168H1), SEQ ID NO: 4321 (700348229H1), SEQ ID NO: 6113 (700351254H1), SEQ ID NO: 5064 (700349532H1), SEQ ID NO: 5415 (700350106H1), SEQ ID NO: 6304 (700351573H1), SEQ ID NO: 6577 (700352043H1), SEQ ID NO: 7582 (700381971H1), SEQ ID NO: 3853 (700282260H2), SEQ ID NO: 6876 (700352570H1), SEQ ID NO: 6796 (700352419H1), SEQ ID NO: 4709 (700348907H1), SEQ ID NO: 5528 (700350303H1), SEQ ID NO: 6833 (700352475H1), SEQ ID NO: 5653 (700350481H1), SEQ ID NO: 6910 (700380827H1), SEQ ID NO: 3944 (700347413H1), SEQ ID NO: 6696 (700352248H1), SEQ ID NO: 7122 (700381160H1), SEQ ID NO: 7274 (700381453H1), SEQ ID NO: 7087 (700381106H1), SEQ ID NO: 4858 (700349153H1), SEQ ID NO: 4335 (700348255H1), SEQ ID NO: 5372 (700350040H1), SEQ ID NO: 4500 (700348526H1), SEQ ID NO: 5133 (700349636H1), SEQ ID NO: 5003 (700349411H1), SEQ ID NO: 3938 (700282394H2), SEQ ID NO: 7330 (700381549H1), SEQ ID NO: 6639 (700352150H1), SEQ ID NO: 4170 (700347868H1), SEQ ID NO: 4351

(700348279H1), SEQ ID NO: 4907 (700349243H1), SEQ ID NO: 7145 (700381201H1), SEQ ID NO: 5659 (700350491H1), SEQ ID NO: 4535 (700348590H1), SEQ ID NO: 6198 (700351390H1), SEQ ID NO: 6191 (700351374H1), SEQ ID NO: 5156 (700349691H1), SEQ ID NO: 6481 (700351876H1), SEQ ID NO: 4199 (700347944H1), SEQ ID NO: 4569 (700348646H1), SEQ ID NO: 7165 (700381227H1), SEQ ID NO: 4945 (700349322H1), SEQ ID NO: 4555 (700348623H1), SEQ ID NO: 4937 (700349308H1), SEQ ID NO: 4944 (700349320H1), SEQ ID NO: 4885 (700349205H1), SEQ ID NO: 5244 (700349839H1), SEQ ID NO: 6164 (700351339H1), SEQ ID NO: 4649 (700348787H1), SEQ ID NO: 4546 (700348611H1), SEQ ID NO: 6288 (700351544H1), SEQ ID NO: 5445 (700350153H1), SEQ ID NO: 3839 (700282240H1), SEQ ID NO: 4543 (700348607H1), SEQ ID NO: 5378 (700350051H1), SEQ ID NO: 4652 (700348795H1), SEQ ID NO: 5896 (700350862H1), SEQ ID NO: 7106 (700381129H1), SEQ ID NO: 4742 (700348966H1), SEQ ID NO: 5817 (700350731H1), SEQ ID NO: 6260 (700351502H1), SEQ ID NO: 4648 (700348785H1), SEQ ID NO: 4211 (700347970H1), SEQ ID NO: 6930 (700380858H1), SEQ ID NO: 4560 (700348628H1), SEQ ID NO: 4565 (700348638H1), SEQ ID NO: 6687 (700352237H1), SEQ ID NO: 4949 (700349329H1), SEQ ID NO: 5577 (700350369H1), SEQ ID NO: 6140 (700351304H1), SEQ ID NO: 6359 (700351660H1), SEQ ID NO: 5259 (700349861H1), SEQ ID NO: 7118 (700381149H1), SEQ ID NO: 3957 (700347434H1), SEQ ID NO: 4758 (700348990H1), SEQ ID NO: 4001 (700347514H1), SEQ ID NO: 6704 (700352261H1), SEQ ID NO: 6892 (700380802H1), SEQ ID NO: 5232 (700349813H1), SEQ ID NO: 7337 (700381559H1), SEQ ID NO: 4121 (700347749H1), SEQ ID NO: 4331 (700348249H1), SEQ ID NO: 6350 (700351645H1), SEQ ID NO: 5235 (700349820H1), SEQ ID NO: 5609 (700350414H1), SEQ ID NO: 6720 (700352288H1), SEQ ID NO: 7406 (700381678H1), SEQ ID NO: 5504 (700350265H1), SEQ ID NO: 4383 (700348334H1), SEQ ID NO: 4131 (700347763H1), SEQ ID NO: 4423 (700348396H1), SEQ ID NO: 7329 (700381547H1), SEQ ID NO: 4093 (700347688H1), SEQ ID NO: 4310 (700348209H1), SEQ ID NO: 6681 (700352229H1), SEQ ID NO: 5263 (700349865H1), SEQ ID NO: 6254 (700351489H1), SEQ ID NO: 6442 (700351811H1), SEQ ID NO: 5226 (700349807H1), SEQ ID NO: 5308 (700349935H1), SEQ ID NO: 6730 (700352306H1), SEQ ID NO: 7499 (700381835H1), SEQ ID NO: 5902 (700350873H1), SEQ ID NO: 7531 (700381889H1), SEQ ID NO: 4371 (700348314H1), SEQ ID NO: 7600 (7b0381994H1), SEQ ID NO: 6354 (700351650H1), SEQ ID NO: 4653 (700348801H1), SEQ ID NO: 3941 (700347405H1), SEQ ID NO: 4206 (700347960H1), SEQ ID NO: 6832 (700352474H1), SEQ ID NO: 4337 (700348259H1), SEQ ID NO: 4193 (700347929H1), SEQ ID NO: 6220 (700351433H1), SEQ ID NO: 5511 (700350274H1), SEQ ID NO: 6337 (700351625H1), SEQ ID NO: 6900 (700380811H1), SEQ ID NO: 7547 (700381923H1), SEQ ID NO: 5525 (700350293H1), SEQ ID NO: 4474 (700348485H1), SEQ ID NO: 6498 (700351910H1), SEQ ID NO: 4968 (700349359H1), SEQ ID NO: 6295 (700351554H1), SEQ ID NO: 7584 (700381973H1), SEQ ID NO: 4750 (700348978H1), SEQ ID NO: 5355 (700350018H1), SEQ ID NO: 4464 (700348467H1), SEQ ID NO: 6755 (700352345H1), SEQ ID NO: 4106 (700347718H1), SEQ ID NO: 4886 (700349211H1), SEQ ID NO: 5553 (700350334H1), SEQ ID NO: 4396 (700348356H1), SEQ ID NO: 5939 (700350936H1), SEQ ID NO: 6189 (70035137H1), SEQ ID NO: 5803 (700350709H1), SEQ ID NO: 4655 (700348803H1), SEQ ID NO: 6120 (700351265H1), SEQ ID NO: 4799 (700349054H1), SEQ ID NO: 5830 (700350748H1), SEQ ID NO: 6686 (700352236H1), SEQ ID NO: 4589 (700348678H1), SEQ ID NO: 5870 (700350819H1), SEQ ID NO: 5794 (700350692H1), SEQ ID NO: 4646 (700348782H1), SEQ ID NO: 4489 (700348513H1), SEQ ID NO: 4157 (700347830H1), SEQ ID NO: 5651 (700350478H1), SEQ ID NO: 5982 (700351019H1), SEQ ID NO: 4466 (700348472H1), SEQ ID NO: 4692 (700348872H1), SEQ ID NO: 6847 (700352506H1), SEQ ID NO: 4980 (700349375H1), SEQ ID NO: 4387 (700348343H1), SEQ ID NO: 4067 (700347631H1), SEQ ID NO: 5546 (700350324H1), SEQ ID NO: 3999 (700347509H1), SEQ ID NO: 4794 (700349046H1), SEQ ID NO: 4382 (700348333H1), SEQ ID NO: 5348 (700350008H1), SEQ ID NO: 4657 (700348806H1). These selected cdps represent unique, corn ear-specific polynucleotides which are used to produce a ear-specific profile of gene transcription, a transcript image.

The cdps are also used as a composition in methods to detect altered gene expression in inbred or hybrid plants. Such methods employ the cdps of the Sequence Listing, oligonucleotides, fragments, derivatives, or complementary sequences in hybridization technologies. The invention provides a method for detecting polynucleotides in a biological sample, the method comprising the steps of hybridizing a cdp to at least one of the nucleic acids in the biological sample, thereby forming a hybridization complex, and detecting the hybridization complex, wherein the presence of the complex correlates with the presence of the polynucleotide in the sample. An additional method provides for amplification of the nucleic acids of the biological sample prior to hybridization. The invention provides a method of screening a plurality of molecules for specific binding to a polynucleotide, the method comprising the steps of providing the plurality of molecules; combining the polynucleotide with each of the plurality of molecules for a time sufficient to allow binding under suitable conditions; and detecting binding of the polynucleotide to each of the plurality of molecules, thereby identifying the molecules which specifically bind the polynucleotide.

The invention further provides a method for recovering a regulatory element, the method comprising the steps of designing oligomers to at least one of the cdps, combining the oligomers with a DNA library under appropriate conditions to amplify the cdp, comparing the cdp with the amplified sequence to identify overlapping areas, identifying additional sequence beyond the overlapping areas, and repeating steps a) through d) until the regulatory element is recovered. The regulatory element is a ear-specific regulatory element which may be placed in an expression vector which is transformed into a corn plant. The regulatory element is of value in regulating the expression of introduced cdps.

The invention provides a purified corn ear-derived polynucleotide capable of expressing a corn ear-derived polypeptide. In one embodiment, the corn ear-derived polynucleotide is contained within an expression vector. In a second embodiment, the expression vector is contained within a host cell. The invention also provides a method for producing a corn ear-derived polypeptide, said method comprising the steps of culturing the host cells containing the ear-derived polynucleotide under conditions suitable for the expression of a corn ear-derived polypeptide, and recovering the corn ear-derived polypeptide from the cell culture.

The invention provides a purified corn ear-derived polypeptide (CDP) encoded by at least one of the cdps of the Sequence Listing. The invention also provides an anti-CDP antibody specific for a purified polypeptide encoded by the cdp. Such antibodies may be used for diagnostic purposes for the detection of CDPs in specific plant cells.

The invention further provides a method for identifying a test compound which specifically binds the CDP, the method comprising the steps of providing a test compound, combining the CDP with the test compound under suitable conditions for a time sufficient to allow binding, and detecting CDP binding to the test compound.

DESCRIPTION OF THE SEQUENCE LISTING AND TABLES

A portion of the disclosure of this patent document contains material which is subject to copyright protection. The copyright owner has no objection to the facsimile reproduction by anyone of the patent document or the patent disclosure, as it appears in the Patent and Trademark Office patent file or records, but otherwise reserves all copyright rights whatsoever.

The Sequence Listing is a compilation of nucleic acid sequences obtained by sequencing clone inserts or isolates of two corn ear cDNA libraries. Each sequence is identified by a sequence identification number (SEQ ID NO) and by an Incyte Clone number. TABLES 1 and 2 are compilations of Incyte Clones arranged as described below.

TABLE 1 lists homologous isolates from the two corn ear cDNA libraries prepared as described in the Examples. The first column contains Incyte Clone numbers. The Incyte Clone number provides a cross reference to the Sequence Listing. The second column contains a relevant GenBank identification number. The third and fourth columns represent product and log-likelihood scores (Karlin, S. and S. F. Altschul (1993) Proc. Nat. Acad. Sci. 90:5873–5877). The fifth column refers to the particular database and release of GenBank against which the Incyte Clone was searched and in which a related sequence was found. The sequences of this invention were compared to sequences in the GenBank plant, eukaryotic and protein databases, and most isolates list homology to sequences in those databases. The last column contains a description of the referenced GenBank sequence.

TABLE 2 is a compilation representing corn ear-specific gene activity as illustrated by sets of clustered or related sequences. Each cluster disclosed in the table contains unique or homologous sequences that are specific to the two corn ear cDNA libraries. The clones in a cluster may contain overlapping sequences or they may be related to or overlap a common reference sequence. Clusters are compiled by naming, matching, and counting all copies of the cdp. The minimum number of clones required to define a cluster is two; clusters containing two clones are found at the bottom of the table. Some clusters are characterized further by the homology of one or more sequences to a reference sequence which has a GenBank identifier (g) and description. Homologous sequences are more fully described in TABLE 1.

DETAILED DESCRIPTION OF THE INVENTION

Before the nucleic acid sequences and methods are presented, it is to be understood that this invention is not limited to the particular methodologies, protocols, cell lines, vectors, and reagents described. Although particular embodiments are described, methods and materials similar or equivalent to these embodiments may be used to practice the invention. The preferred methods, devices, and materials set forth are not intended to limit the scope of the invention which is limited only by the appended claims.

The singular forms "a", "an", and "the" include plural reference unless the context clearly dictates otherwise. All technical and scientific terms have the meanings commonly understood by one of ordinary skill in the art. All publications are incorporated by reference for the purpose of describing and disclosing the cell lines, vectors, and methodologies which are presented and which might be used in connection with the invention. Nothing in the specification is to be construed as an admission that the invention is not entitled to antedate such disclosure by virtue of prior invention.

Definitions

As used herein, the lower case "cdp" refers to a nucleic acid sequence, while the upper case "CDP" refers to an amino acid sequence. A "full-length" cdp refers to a nucleic acid sequence containing the entire coding region of a gene endogenously expressed in corn.

"Adjuvants" are materials such as Freund's, mineral gels (aluminum hydroxide), and surface active substances (lysolecithin, pluronic polyols, polyanions, peptides, oil emulsions, keyhole limpet hemocyanin (KLH; Sigma-Aldrich, St. Louis Mo.), and dinitrophenol) which may be administered to increase a host's immunological response.

"Allele" refers to an alternative form of a nucleic acid sequence. Alleles result from a "mutation", and any given genome may have none, one, or many allelic forms. Mutations which give rise to alleles are ascribed to deletions, additions or substitutions of nucleotides. Each of these types of changes may occur alone, or in combination with the others, one or more times in a given nucleic acid sequence. The present invention encompasses allelic cdps.

"Amino acid sequence" refers to an oligopeptide, a peptide, a polypeptide, or a protein of either natural or synthetic origin. The amino acid sequence is not limited to the complete, endogenous amino acid sequence and may be a portion, epitope, variant, or derivative of a protein expressed by a corn nucleic acid sequence.

"Amplification" refers to the production of additional copies of a sequence and is carried out using polymerase chain reaction (PCR) technologies well known in the art.

"Antisense" refers to nucleic acid sequences which are complementary to a specific DNA or RNA sequence. The antisense strand (negative or 3'-5') is that nucleic acid strand that is complementary to the sense strand (positive or 5'-3').

"Biologically active" refers to a peptide having a structural, regulatory biochemical, or immunological function of a naturally occurring peptide.

"Complementary" refers to the natural association of nucleic acid sequences by base-pairing (A-G-T pairs with its complement T-C-A).

"Complementary" between two single-stranded molecules may be partial or complete. The degree to which two sequences are complementary affects the efficiency of hybridization and amplification reactions.

"Derivative" refers to the chemical modification of a nucleic acid sequence by replacement of hydrogen by an alkyl, acyl, amino, or other group.

"Homology" refers to sequence similarity either between a reference nucleic acid sequence and at least a fragment of a cdp or between a reference amino acid sequence and a portion of a CDP.

"Hybridization" refers to the process by which a strand of nucleic acid joins with a complementary strand through base pairing.

"Immunogenic" defines the capability of a natural, recombinant or synthetic oligopeptide, or polypeptide, to induce antibody production in appropriate animals or cells.

"Labeling" refers to the covalent or noncovalent joining of a polynucleotide, polypeptide or antibody with a reporter molecule that provides for a detectable and often measurable signal.

"Linkers" are short stretches of nucleotide sequence which may be added onto a vector or a cdp to create restriction endonuclease sites for ease in cloning. "Polylinkers" are engineered to include multiple restriction enzyme sites and provide for the use of both those enzymes which leave 5' and 3' overhangs (such as BamHI, EcoRI, and HindIII) or which provide a blunt end (such as EcoRV, SnaBI, and StuI).

"Naturally occurring" refers to an endogenous polynucleotide or polypeptide that may be isolated from viruses or prokaryotic or eukaryotic cells.

"Nucleic acid sequence" refers to an oligomer, oligonucleotide, nucleotide or polynucleotide, and its fragments, and to DNA or RNA of genomic or synthetic origin which may be single- or double-stranded and represent the sense or complementary (antisense) strand.

"Oligomer" refers to a nucleic acid sequence of at least about 10 nucleotides and as many as about 60 nucleotides, preferably about 15 to 30 nucleotides, that may be used as a primer or amplimer in amplification technologies. Oligomers are usually chemically synthesized.

"Peptide nucleic acid" (PNA) refers to an oligomer of at least six nucleotides to which an amino acid residue, such as lysine, and an amino group have been added. PNAs, also designated antigene agents, stop transcript elongation by binding to their complementary strand of nucleic acid.

"Plant sample" refers to a cell, chromosomes isolated from a cell, genomic DNA, RNA, or cDNA in solution or bound to a substrate; an extract from plant cells, a cleared tissue, a blot or imprint from the cut edge of a plant part, or the like.

A "portion" of an CDP may be selected based upon retention of biological or immunological characteristics shared with naturally occurring polypeptides derived from corn ear. For example, an antigenic portion of a CDP may be used to induce antibody in an appropriate host.

"Post-translational modification" of a CDP may involve lipidation, glycosylation, phosphorylation, acetylation, racemization, proteolytic cleavage, and the like. These processes may occur synthetically or biochemically. Biochemical modifications will vary by cell type depending on the enzymatic milieu and the CDP.

"Probe" refers to cdps or fragments thereof, which are used to detect identical, allelic or related nucleic acid sequences. "Purified" refers to molecules, either polynucleotides or polypeptides that are isolated or separated from their natural environment and are at least 60% free, preferably 75% free, and most preferably 90% free from other compounds with which they are naturally associated.

"Regulatory element" refers to a nucleic acid sequence from nontranslated regions of a gene such as enhancers, promoters, introns, and 3' untranslated regions which interact with host proteins to carry out transcription or translation.

"Reporter" molecules are chemical or biochemical moieties used for labeling a nucleic acid, an amino acid, or an antibody. They include radionuclides; enzymes; fluorescent, chemiluminescent, or chromogenic agents; substrates; cofactors; inhibitors; magnetic particles; and the like.

"Substrate" refers to any suitable rigid or semi-rigid support including membranes, filters, chips, slides, wafers, fibers, magnetic or nonmagnetic beads, gels, capillaries or other tubing, plates, polymers, and microparticles. The substrate can have a variety of surface forms, such as wells, trenches, pins, channels and pores, to which the polynucleotides are bound.

"Transformation" refers to a process by which exogenous DNA enters and changes a recipient cell. It may occur under natural or artificial conditions using various methods well known in the art. Transformation may rely on any known method for the insertion of foreign nucleic acid sequences into a prokaryotic or eukaryotic host cell. The method is selected based on the host cell being transformed. Transformants include stably transformed cells in which the inserted DNA is capable of replication either as an autonomously replicating plasmid or as part of the host chromosome, as well as cells which transiently express the inserted DNA or RNA.

"Variant" refers to an amino acid sequence which differs from another sequence by at least one amino acid. The variant may have "conservative" changes (e.g. replacement of leucine with isoleucine), which does not affect structural or chemical properties; or more rarely, "nonconservative" changes (e.g. replacement of glycine with tryptophan), which may affect structural and/or chemical properties.

The Invention

In a particular embodiment, mRNA was isolated from corn ear and used to construct the SATMON022 and SATMON023 cDNA libraries. The invention relates to nucleic acid sequences comprising corn ear-derived polynucleotides (cdps) as presented in the Sequence Listing and to the use of these nucleic acid sequences. A "corn ear-derived polynucleotide" refers to a cdp which may be naturally occurring, recombinant, synthetic, or semi-synthetic. A subset of clustered ear-specific cdps is given in TABLE 2. The cdps may be used to identify, isolate, or extend identical or related corn ear nucleic acid sequences from DNA libraries for the purpose of producing an entire coding region or recovering a regulatory element. The cdps may also be used in nucleic acid hybridization or amplification technologies to follow expression of desirable traits through plant breeding programs. The present invention provides for expression vectors and host cells containing nucleic acid sequences that encode CDPs or portions thereof and regulatory elements obtained using methods described herein. The CDPs may possess biological or immunological activity, or both. The invention provides for the use of purified CDPs to induce antibodies for diagnostic use and to identify test compounds which specifically bind the CDP.

Specifically, the present invention relates to the following subset of unique and ear-specific cdps whose transcripts occurred more than once in the two corn ear cDNA libraries. They are SEQ ID NO: 3250 (700611189H1), SEQ ID NO: 3392 (700611501H1), SEQ ID NO: 2031 (700551933H1), SEQ ID NO: 1954 (700551804H1), SEQ ID NO: 2582 (700552928H1), SEQ ID NO: 2016 (700551910H1), SEQ ID NO: 2311 (700552464H1), SEQ ID NO: 2238 (700552317H1), SEQ ID NO: 2096 (700552062H1), SEQ ID NO: 2152 (700552161H1), SEQ ID NO: 636 (700549563H1), SEQ ID NO: 1359 (700550807H1), SEQ ID NO: 811 (700549876H1), SEQ ID NO: 1817 (700551570H1), SEQ ID NO: 2648 (700553058H1), SEQ ID NO: 1460 (700550984H1), SEQ ID NO: 2983 (700282115H1), SEQ ID NO: 2061 (700551985H1), SEQ ID NO: 3095 (700610867H1), SEQ ID NO: 100 (700548530H1), SEQ ID NO: 2 (700548303H1), SEQ ID NO: 3307 (700611293H1), SEQ ID NO: 2160 (700552173H1), SEQ ID NO: 2104 (700552073H1), SEQ ID NO: 2058 (700551981H1), SEQ ID NO: 2177 (700552202H1), SEQ ID NO: 1190 (700550523H1), SEQ ID NO: 2665 (700553084H1), SEQ ID NO: 2510 (700552784H1), SEQ ID NO: 1406 (700550886H1), SEQ ID NO: 1196 (700550530H1), SEQ ID NO: 1127 (700550431H1), SEQ ID NO: 271 (700548896H1), SEQ ID NO: 1126 (700550430H1), SEQ ID NO: 738 (700549740H1), SEQ ID NO: 548 (700549421H1), SEQ ID NO: 542 (700549412H1), SEQ ID NO: 547 (700549420H1), SEQ ID NO: 2114 (700552089H1), SEQ ID NO: 3321 (700611324H1), SEQ ID NO: 2416 (700552643H1), SEQ ID NO: 2430 (700552661H1), SEQ ID NO: 830 (700549908H1), SEQ ID NO: 2182 (700552213H1), SEQ ID NO: 1135 (700550444H1), SEQ ID NO: 1742 (700551432H1), SEQ ID NO: 1633 (700551252H1), SEQ ID NO: 880 (700549994H1), SEQ ID NO: 2234 (700552312H1), SEQ ID NO: 1608 (700551216H1), SEQ ID NO: 2985 (700282117H1), SEQ ID NO: 234 (700548810H1), SEQ ID NO: 1273 (700550651H1), SEQ ID NO: 349 (700549051H1), SEQ ID NO: 3553 (700611877H1), SEQ ID NO: 364 (700549083H1), SEQ ID NO: 2014 (700551904H1), SEQ ID NO: 2962 (700282075H1), SEQ ID NO: 2390 (700552590H1), SEQ ID NO: 1814 (700551565H1), SEQ ID NO: 2892 (700553450H1), SEQ ID NO: 959 (700550142H1), SEQ ID NO: 3069 (700610808H1), SEQ ID NO: 3543 (700611844H1), SEQ ID NO: 3414 (700611544H1), SEQ ID NO: 1097 (700550384H1), SEQ ID NO: 1197 (700550531H1), SEQ ID NO: 1230 (700550584H1), SEQ ID NO: 1648 (700551276H1), SEQ ID NO: 2077 (700552025H1), SEQ ID NO: 3637 (700612029H1), SEQ ID NO: 2429 (700552659H1), SEQ ID NO: 2308 (700552459H1), SEQ ID NO: 2402 (700552620H1), SEQ ID NO: 1278 (700550659H1), SEQ ID NO: 1279 (700550660H1), SEQ ID NO: 1083 (700550360H1), SEQ ID NO: 485 (700549323H1), SEQ ID NO: 645 (700549585H1), SEQ ID NO: 222 (700548774H1), SEQ ID NO: 344 (700549039H1), SEQ ID NO: 879 (700549992H1), SEQ ID NO: 697 (700549667H1), SEQ ID NO: 1257 (700550630H1), SEQ ID NO: 902 (700550036H1), SEQ ID NO: 956 (700550134H1), SEQ ID NO: 67 (700548448H1), SEQ ID NO: 32 (700548366H1), SEQ ID NO: 144 (700548623H1), SEQ ID NO: 1074 (700550338H1), SEQ ID NO: 1201 (700550538H1), SEQ ID NO: 339 (700549027H1), SEQ ID NO: 2115 (700552091H1), SEQ ID NO: 2171 (700552190H1), SEQ ID NO: 2172 (700552191H1), SEQ ID NO: 3108 (700610893H1), SEQ ID NO: 3160 (700610993H1), SEQ ID NO: 3207 (700611093H1), SEQ ID NO: 239 (700548820H1), SEQ ID NO: 2247 (700552332H1), SEQ ID NO: 279 (700548915H1), SEQ ID NO: 3806 (700612280H1), SEQ ID NO: 3732 (700612174H1), SEQ ID NO: 3814 (700612292H1), SEQ ID NO: 2158 (700552171H1), SEQ ID NO: 1184 (700550516H1), SEQ ID NO: 1870 (700551656H1), SEQ ID NO: 2324 (700552483H1), SEQ ID NO: 2375 (700552569H1), SEQ ID NO: 2454 (700552691H1), SEQ ID NO: 1621 (700551231H1), SEQ ID NO: 3735 (700612180H1), SEQ ID NO: 3566 (700611907H1), SEQ ID NO: 264 (700548874H1), SEQ ID NO: 1025 (700550257H1), SEQ ID NO: 535 (700549401H1), SEQ ID NO: 951 (700550126H1), SEQ ID NO: 354 (700549060H1), SEQ ID NO: 332 (700549012H1), SEQ ID NO: 936 (700550089H1), SEQ ID NO: 781 (700549822H1), SEQ ID NO: 1326 (700550749H1), SEQ ID NO: 3564 (700611904H1), SEQ ID NO: 3565 (700611905H1), SEQ ID NO: 1444 (700550962H1), SEQ ID NO: 1994 (700551863H1), SEQ ID NO: 3781 (700612249H1), SEQ ID NO: 2221 (700552281H1), SEQ ID NO: 3313 (700611306H1), SEQ ID NO: 3213 (700611106H1), SEQ ID NO: 3354 (700611405H1), SEQ ID NO: 213 (700548752H1), SEQ ID NO: 99 (700548523H1), SEQ ID NO: 359 (700549072H1), SEQ ID NO: 356 (700549067H1), SEQ ID NO: 992 (700550195H1), SEQ ID NO: 1228 (700550580H1), SEQ ID NO: 3333 (700611357H1), SEQ ID NO: 3381 (700611465H1), SEQ ID NO: 3699 (700612123H1), SEQ ID NO: 3634 (700612024H1), SEQ ID NO: 1432 (700550935H1), SEQ ID NO: 1327 (700550750H1), SEQ ID NO: 1256 (700550629H1), SEQ ID NO: 1068 (700550330H1), SEQ ID NO: 744 (700549752H1), SEQ ID NO: 892 (700550022H1), SEQ ID NO: 2697 (700553128H1), SEQ ID NO: 1708 (700551374H1), SEQ ID NO: 3347 (700611392H1), SEQ ID NO: 3560 (700611894H1), SEQ ID NO: 2036 (700551941H1), SEQ ID NO: 2028 (700551929H1), SEQ ID NO: 3703 (700612129H1), SEQ ID NO: 3767 (700612229H1), SEQ ID NO: 1008 (700550233H1), SEQ ID NO: 997 (700550214H1), SEQ ID NO: 472 (700549301H1), SEQ ID NO: 477 (700549309H1), SEQ ID NO: 2290 (700552436H1), SEQ ID NO: 2313 (700552468H1), SEQ ID NO: 3172 (700611010H1), SEQ ID NO: 2450 (700552686H1), SEQ ID NO: 524 (700549380H1), SEQ ID NO: 1417 (700550911H1), SEQ ID NO: 1383 (700550848H1), SEQ ID NO: 619 (700549540H1), SEQ ID NO: 1551 (700551129H1), SEQ ID NO: 1577 (700551161H1), SEQ ID NO: 250 (700548841H1), SEQ ID NO: 146 (700548625H1), SEQ ID NO: 1711 (700551380H1), SEQ ID NO: 1765 (700551476H1), SEQ ID NO: 1720 (700551391H1), SEQ ID NO: 905 (700550041H1), SEQ ID NO: 3391 (700611496H1), SEQ ID NO: 3349 (700611396H1), SEQ ID NO: 2126 (700552124H1), SEQ ID NO: 2030 (700551932H1), SEQ ID NO: 998 (700550215H1), SEQ ID NO: 1526 (700551091H1), SEQ ID NO: 1756 (700551460H1), SEQ ID NO: 474 (700549303H1), SEQ ID NO: 1177 (700550507H1), SEQ ID NO: 939 (700550093H1), SEQ ID NO: 2848 (700553376H1), SEQ ID NO: 1794 (700551534H1), SEQ ID NO: 2460 (700552701H1), SEQ ID NO: 2621 (700553001H1), SEQ ID NO: 216 (700548758H1), SEQ ID NO: 1213 (700550558H1), SEQ ID NO: 1733 (700551417H1), SEQ ID NO: 1669 (700551309H1), SEQ ID NO: 19 (700548332H1), SEQ ID NO: 614 (700549532H1), SEQ ID NO: 748 (700549762H1), SEQ ID NO: 2644 (700553051H1), SEQ ID NO: 2876 (700553418H1), SEQ ID NO: 3490 (700611717H1), SEQ ID NO: 106 (700548542H1), SEQ ID NO: 94 (700548510H1), SEQ ID NO: 2767 (700553233H1), SEQ ID NO: 1854 (700551635H1), SEQ ID NO: 2033 (700551937H1), SEQ ID NO: 2034 (700551938H1), SEQ ID NO: 1360 (700550808H1), SEQ ID NO: 3280 (700611242H1), SEQ ID NO: 629 (700549550H1), SEQ ID NO: 678 (700549642H1), SEQ ID NO: 491 (700549330H1), SEQ ID NO: 1620 (700551230H1), SEQ ID NO: 1456 (700550980H1), SEQ ID NO: 1524 (700551088H1), SEQ ID NO: 2631 (700553025H1), SEQ ID NO: 2639 (700553042H1), SEQ ID NO: 3546 (700611857H1), SEQ ID NO: 3510 (700611757H1), SEQ ID NO: 1301 (700550707H1), SEQ ID NO: 1063 (700550324H1), SEQ ID NO: 2255

(700552366H1), SEQ ID NO: 1738 (700551424H1), SEQ ID NO: 3419 (700611551H1), SEQ ID NO: 3468 (700611651H1), SEQ ID NO: 112 (700548554H1), SEQ ID NO: 162 (700548655H1), SEQ ID NO: 3756 (700612213H1), SEQ ID NO: 3692 (700612113H1), SEQ ID NO: 2049 (700551960H1), SEQ ID NO: 3522 (700611784H1), SEQ ID NO: 2181 (700552212H1), SEQ ID NO: 3378 (700611461H1), SEQ ID NO: 478 (700549312H1), SEQ ID NO: 845 (700549929H1), SEQ ID NO: 1416 (700550910H1), SEQ ID NO: 1362 (700550810H1), SEQ ID NO: 2769 (700553235H1), SEQ ID NO: 2323 (700552482H1), SEQ ID NO: 2677 (700553107H1), SEQ ID NO: 2867 (700553406H1), SEQ ID NO: 1612 (700551220H1), SEQ ID NO: 1459 (700550983H1), SEQ ID NO: 1622 (700551232H1), SEQ ID NO: 1613 (700551222H1), SEQ ID NO: 149 (700548632H1), SEQ ID NO: 314 (700548972H1), SEQ ID NO: 2129 (700552132H1), SEQ ID NO: 1863 (700551648H1), SEQ ID NO: 919 (700550063H1), SEQ ID NO: 924 (700550072H1), SEQ ID NO: 3218 (700611112H1), SEQ ID NO: 3262 (700611212H1), SEQ ID NO: 3424 (700611560H1), SEQ ID NO: 3548 (700611860H1), SEQ ID NO: 2052 (700551963H1), SEQ ID NO: 2223 (700552283H1), SEQ ID NO: 2184 (700552217H1)., SEQ ID NO: 3794 (700612265H1), SEQ ID NO: 1293 (700550690H1), SEQ ID NO: 1246 (700550611H1), SEQ ID NO: 1465 (700550992H1), SEQ ID NO: 479 (700549313H1), SEQ ID NO: 771 (700549807H1), SEQ ID NO: 46 (700548403H1), SEQ ID NO: 2682 (700553112H1), SEQ ID NO: 2678 (700553108H1), SEQ ID NO: 3222 (700611121H1), SEQ ID NO: 800 (700549855H1), SEQ ID NO: 1498 (700551048H1), SEQ ID NO: 1395 (700550868H1), SEQ ID NO: 922 (700550068H1), SEQ ID NO: 1003 (700550224H1), SEQ ID NO: 488 (700549327H1), SEQ ID NO: 754 (700549776H1), SEQ ID NO: 147 (700548630H1), SEQ ID NO: 167 (700548662H1), SEQ ID NO: 3529 (700611796H1), SEQ ID NO: 3507 (700611748H1), SEQ ID NO: 1250 (700550617H1), SEQ ID NO: 1255 (700550626H1), SEQ ID NO: 1052 (700550309H1), SEQ ID NO: 1053 (700550310H1), SEQ ID NO: 2884 (700553429H1), SEQ ID NO: 2679 (700553109H1), SEQ ID NO: 1487 (700551033H1), SEQ ID NO: 1482 (700551025H1), SEQ ID NO: 3759 (700612216H1), SEQ ID NO: 3655 (700612057H1), SEQ ID NO: 401 (700549145H1), SEQ ID NO: 2790 (700553265H1), SEQ ID NO: 3224 (700611125H1), SEQ ID NO: 3265 (700611217H1), SEQ ID NO: 1020 (700550247H1), SEQ ID NO: 41 (700548389H1), SEQ ID NO: 3045 (700610749H1), SEQ ID NO: 1934 (700551766H1), SEQ ID NO: 1627 (700551242H1), SEQ ID NO: 1398 (700550876H1), SEQ ID NO: 2203 (700552255H1), SEQ ID NO: 3786 (700612255H1), SEQ ID NO: 97 (700548517H1), SEQ ID NO: 253 (700548853H1), SEQ ID NO: 1687 (700551338H1), SEQ ID NO: 1704 (700551367H1), SEQ ID NO: 166 (700548661H1), SEQ ID NO: 946 (700550114H1), SEQ ID NO: 2791 (700553267H1), SEQ ID NO: 2870 (700553410H1), SEQ ID NO: 1652 (700551283H1), SEQ ID NO: 1632 (700551251H1), SEQ ID NO: 2704 (700553141H1), SEQ ID NO: 2920 (700553491H1), SEQ ID NO: 1939 (700551773H1), SEQ ID NO: 3516 (700611770H1), SEQ ID NO: 291 (700548928H1), SEQ ID NO: 1105 (700550393H1), SEQ ID NO: 923 (700550070H1), SEQ ID NO: 1470 (700551001H1), SEQ ID NO: 3235 (700611152H1), SEQ ID NO: 3373 (700611452H1), SEQ ID NO: 3788 (700612257H1), SEQ ID NO: 2204 (700552257H1), SEQ ID NO: 578 (700549468H1), SEQ ID NO: 3188 (700611049H1), SEQ ID NO: 79 (700548474H1), SEQ ID NO: 202 (700548728H1), SEQ ID NO: 1495 (700551045H1), SEQ ID NO: 1512 (700551065H1), SEQ ID NO: 652 (700549593H1), SEQ ID NO: 837 (700549919H1), SEQ ID NO: 930 (700550082H1), SEQ ID NO: 1291 (700550685H1), SEQ ID NO: 487 (700549326H1), SEQ ID NO: 1123 (700550425H1), SEQ ID NO: 133 (700548604H1), SEQ ID NO: 84 (700548484H1), SEQ ID NO: 2208 (700552264H1), SEQ ID NO: 2793 (700553271H1), SEQ ID NO: 580 (700549471H1), SEQ ID NO: 1662 (700551295H1), SEQ ID NO: 5 (700548309H1), SEQ ID NO: 681 (700549646H1), SEQ ID NO: 1499 (700551049H1), SEQ ID NO: 3004 (700282149H1), SEQ ID NO: 2742 (700553201H1), SEQ ID NO: 3316 (700611312H1), SEQ ID NO: 1646 (700551273H1), SEQ ID NO: 1707 (700551373H1), SEQ ID NO: 2146 (700552153H1), SEQ ID NO: 505 (700549350H1), SEQ ID NO: 1617 (700551227H1), SEQ ID NO: 819 (700549890H1), SEQ ID NO: 87 (700548490H1), SEQ ID NO: 1307 (700550714H1), SEQ ID NO: 1654 (700551286H1), SEQ ID NO: 49 (700548408H1), SEQ ID NO: 933 (700550086H1), SEQ ID NO: 943 (700550109H1), SEQ ID NO: 3602 (700611959H1), SEQ ID NO: 3591 (700611944H1), SEQ ID NO: 2220 (700552280H1), SEQ ID NO: 2673 (700553095H1), SEQ ID NO: 207 (700548736H1), SEQ ID NO: 1040 (700550285H1), SEQ ID NO: 2570 (700552903H1), SEQ ID NO: 2671 (700553092H1), SEQ ID NO: 588 (700549482H1), SEQ ID NO: 728 (700549718H1), SEQ ID NO: 2750 (700553211H1), SEQ ID NO: 3192 (700611057H1), SEQ ID NO: 198 (700548717H1), SEQ ID NO: 1988 (700551854H1), SEQ ID NO: 1503 (700551055H1), SEQ ID NO: 1619 (700551229H1), SEQ ID NO: 1815 (700551566H1), SEQ ID NO: 2226 (700552292H1), SEQ ID NO: 3245 (700611178H1), SEQ ID NO: 3340 (700611377H1), SEQ ID NO: 3772 (700612237H1), SEQ ID NO: 3792 (700612263H1), SEQ ID NO: 1082 (700550355H1), SEQ ID NO: 1099 (700550387H1), SEQ ID NO: 3577 (700611923H1), SEQ ID NO: 3694 (700612115H1), SEQ ID NO: 2249 (700552337H1), SEQ ID NO: 2337 (700552512H1), SEQ ID NO: 2622 (700553003H1), SEQ ID NO: 2564 (700552891H1), SEQ ID NO: 2755 (700553217H1), SEQ ID NO: 2875 (700553417H1), SEQ ID NO: 1401 (700550879H1), SEQ ID NO: 1523 (700551087H1), SEQ ID NO: 3087 (700610851H1), SEQ ID NO: 3193 (700611058H1), SEQ ID NO: 3286 (700611260H1), SEQ ID NO: 3270 (700611227H1), SEQ ID NO: 2143 (700552149H1), SEQ ID NO: 1972 (700551829H1), SEQ ID NO: 1694 (700551351H1), SEQ ID NO: 1751 (700551451H1), SEQ ID NO: 1104 (700550392H1), SEQ ID NO: 2426 (700552656H1), SEQ ID NO: 50 (700548409H1), SEQ ID NO: 76 (700548466H1), SEQ ID NO: 2353 (700552535H1), SEQ ID NO: 2251 (700552352H1), SEQ ID NO: 537 (700549403H1), SEQ ID NO: 293 (700548931H1), SEQ ID NO: 2585 (700552936H1), SEQ ID NO: 2583 (700552933H1), SEQ ID NO: 1656 (700551288H1), SEQ ID NO: 1428 (700550928H1), SEQ ID NO: 1544 (700551120H1), SEQ ID NO: 1540 (700551115H1), SEQ ID NO: 895 (700550027H1), SEQ ID NO: 888 (700550015H1), SEQ ID NO: 3106 (700610887H1), SEQ ID NO: 3094 (700610863H1), SEQ ID NO: 853 (700549944H1), SEQ ID NO: 844 (700549928H1), SEQ ID NO: 463 (700549278H1), SEQ ID NO: 121 (700548569H1), SEQ ID

NO: 3721 (700612158H1), SEQ ID NO: 3742 (700612193H1), SEQ ID NO: 1124 (700550426H1), SEQ ID NO: 1128 (700550433H1), SEQ ID NO: 436 (700549224H1), SEQ ID NO: 486 (700549324H1), SEQ ID NO: 1504 (700551056H1), SEQ ID NO: 1435 (700550941H1), SEQ ID NO: 2590 (700552944H1), SEQ ID NO: 2584 (700552935H1), SEQ ID NO: 598 (700549505H1), SEQ ID NO: 817 (700549885H1), SEQ ID NO: 1710 (700551376H1), SEQ ID NO: 189 (700548705H1), SEQ ID NO: 1696 (700551354H1), SEQ ID NO: 890 (700550018H1), SEQ ID NO: 1823 (700551582H1), SEQ ID NO: 2859 (700553390H1), SEQ ID NO: 2116 (700552093H1), SEQ ID NO: 2371 (700552565H1), SEQ ID NO- 1374 (700550830H1), SEQ ID NO: 606 (700549518H1), SEQ ID NO: 3110 (700610896H1), SEQ ID NO: 3162 (700610995H1), SEQ ID NO: 3294 (700611273H1), SEQ ID NO: 896 (700550028H1), SEQ ID NO: 2598 (700552959H1), SEQ ID NO: 6 (700548311H1), SEQ ID NO: 3648 (700612048H1), SEQ ID NO: 2089 (700552048H1), SEQ ID NO: 3610 (700611975H1), SEQ ID NO: 3601 (700611958H1), SEQ ID NO: 609 (700549523H1), SEQ ID NO: 2195 (700552240H1), SEQ ID NO: 363 (700549082H1), SEQ ID NO: 368 (700549092H1), SEQ ID NO: 177 (700548676H1), SEQ ID NO: 1289 (700550678H1), SEQ ID NO: 2124 (700552120H1), SEQ ID NO: 2123 (700552119H1), SEQ ID NO: 2592 (700552949H1), SEQ ID NO: 2595 (700552954H1), SEQ ID NO: 1438 (700550950H1), SEQ ID NO: 3166 (700611003H1), SEQ ID NO: 758 (700549782H1), SEQ ID NO: 764 (700549793H1), SEQ ID NO: 512 (700549363H1), SEQ ID NO: 638 (700549570H1), SEQ ID NO: 1312 (700550720H1), SEQ ID NO: 298 (700548940H1), SEQ ID NO: 862 (700549958H1), SEQ ID NO: 1485 (700551030H1), SEQ ID NO: 2032 (700551936H1), SEQ ID NO: 1831 (700551602H1), SEQ ID NO: 900 (700550034H1), SEQ ID NO: 2380 (700552574H1), SEQ ID NO: 3161 (700610994H1), SEQ ID NO: 3138 (700610946H1), SEQ ID NO: 1001 (700550222H1), SEQ ID NO: 2599 (700552960H1), SEQ ID NO: 3770 (700612232H1), SEQ ID NO: 1684 (700551335H1), SEQ ID NO: 2596 (700552955H1), SEQ ID NO: 2495 (700552757H1), SEQ ID NO: 612 (700549527H1), SEQ ID NO: 621 (700549542H1), SEQ ID NO: 1706 (700551371H1), SEQ ID NO: 1698 (700551356H1), SEQ ID NO: 759 (700549785H1), SEQ ID NO: 1424 (700550921H1), SEQ ID NO: 1010 (700550236H1), SEQ ID NO: 864 (700549961H1), SEQ ID NO: 1842 (700551614H1), SEQ ID NO: 1843 (700551615H1), SEQ ID NO: 3163 (700610996H1), SEQ ID NO: 3210 (700611096H1), SEQ ID NO: 372 (700549101H1), SEQ ID NO: 377 (700549107H1), SEQ ID NO: 1691 (700551344H1), SEQ ID NO: 319 (700548981H1), SEQ ID NO: 2816 (700553311H1), SEQ ID NO: 2836 (700553355H1), SEQ ID NO: 3605 (700611966H1), SEQ ID NO: 2053 (700551966H1), SEQ ID NO: 733 (700549726H1), SEQ ID NO: 1344 (700550773H1), SEQ ID NO: 705 (700549679H1), SEQ ID NO: 2715 (700553157H1), SEQ ID NO: 2497 (700552760H1), SEQ ID NO: 3097 (700610872H1), SEQ ID NO: 791 (700549838H1), SEQ ID NO: 554 (700549428H1), SEQ ID NO: 2619 (700552995H1), SEQ ID NO: 2618 (700552994H1), SEQ ID NO: 1762 (700551470H1), SEQ ID NO: 3337 (700611364H1), SEQ ID NO: 3283 (700611254H1), SEQ ID NO: 2943 (700282042H1), SEQ ID NO: 3199 (700611081H1), SEQ ID NO: 3472 (700611660H1), SEQ ID NO: 1845 (700551620H1), SEQ ID NO: 1964 (700551820H1), SEQ ID NO: 225 (700548780H1), SEQ ID NO: 28 (700548353H1), SEQ ID NO: 1147 (700550461H1), SEQ ID NO: 1012 (700550238H1), SEQ ID NO: 3640 (700612035H1), SEQ ID NO: 3777 (700612243H1), SEQ ID NO: 27 (700548352H1), SEQ ID NO: 48 (700548407H1), SEQ ID NO: 2500 (700552764H1), SEQ ID NO: 2653 (700553066H1), SEQ ID NO: 2627 (700553015H1), SEQ ID NO: 2630 (700553022H1), SEQ ID NO: 1397 (700550875H1), SEQ ID NO: 1952 (700551802H1), SEQ ID NO: 1777 (700551508H1), SEQ ID NO: 1955 (700551808H1), SEQ ID NO: 3757 (700612214H1), SEQ ID NO: 3029 (700282195H1), SEQ ID NO: 2084 (700552041H1), SEQ ID NO: 348 (700549049H1), SEQ ID NO: 1115 (700550416H1), SEQ ID NO: 1028 (700550260H1), SEQ ID NO: 2445 (700552678H1), SEQ ID NO: 2059 (700551982H1), SEQ ID NO: 392 (700549129H1), SEQ ID NO: 405 (700549161H1), SEQ ID NO: 2179 (700552210H1), SEQ ID NO: 2801 (700553281H1), SEQ ID NO: 558 (700549433H1), SEQ ID NO: 575 (700549465H1), SEQ ID NO: 1496 (700551046H1), SEQ ID NO: 1382 (700550846H1), SEQ ID NO: 3170 (700611007H1), SEQ ID NO: 2553 (700552869H1), SEQ ID NO: 3627 (700612015H1), SEQ ID NO: 3628 (700612017H1), SEQ ID NO: 955 (700550133H1), SEQ ID NO: 36 (700548376H1), SEQ ID NO: 399 (700549142H1), SEQ ID NO: 1046 (700550296H1), SEQ ID NO: 2455 (700552692H1), SEQ ID NO: 2440 (700552672H1), SEQ ID NO: 3616 (700611993H1), SEQ ID NO: 2064 (700551993H1), SEQ ID NO: 573 (700549463H1), SEQ ID NO: 1748 (700551447H1), SEQ ID NO: 514 (700549365H1), SEQ ID NO: 739 (700549742H1), SEQ ID NO: 2837 (700553358H1), SEQ ID NO: 7587 (700381977H1), SEQ ID NO: 5347 (700350007H1), SEQ ID NO: 5462 (700350186H1), SEQ ID NO: 6027 (700351106H1), SEQ ID NO: 5829 (700350746H1), SEQ ID NO: 5628 (700350442H1), SEQ ID NO: 5761 (700350638H1), SEQ ID NO: 6144 (700351311H1), SEQ ID NO: 4713 (700348913H1), SEQ ID NO: 6689 (700352239H1), SEQ ID NO: 5287 (700349905H1), SEQ ID NO: 6130 (700351281H1), SEQ ID NO: 7119 (700381151H1), SEQ ID NO: 4430 (700348418H1), SEQ ID NO: 7215 (700381331H1), SEQ ID NO: 4473 (700348481H1), SEQ ID NO: 7082 (700381096H1), SEQ ID NO: 5600 (700350402H1), SEQ ID NO: 5271 (700349875H1), SEQ ID NO: 6505 (700351918H1), SEQ ID NO: 6731 (700352307H1), SEQ ID NO: 4836 (700349114H1), SEQ ID NO: 4665 (700348817H1), SEQ ID NO: 7210 (700381325H1), SEQ ID NO: 5970 (700350990H1), SEQ ID NO: 4835 (700349113H1), SEQ ID NO: 5524 (700350292H1), SEQ ID NO: 5482 (700350231H1), SEQ ID NO: 4591 (700348683H1), SEQ ID NO: 5490 (700350244H1), SEQ ID NO: 5883 (700350843H1), SEQ ID NO: 4399 (700348360H1), SEQ ID NO: 5068 (700349538H1), SEQ ID NO: 4116 (700347737H1), SEQ ID NO: 5074 (700349547H1), SEQ ID NO: 4590 (700348682H1), SEQ ID NO: 6023 (700351094H1), SEQ ID NO: 7528 (700381886H1), SEQ ID NO: 7071 (700381079H1), SEQ ID NO: 6316 (700351590H1), SEQ ID NO: 6424 (700351780H1), SEQ ID NO: 5862 (700350801H1), SEQ ID NO: 6369 (700351676H1), SEQ ID NO: 5411 (700350101H1), SEQ ID NO: 6850 (700352516H1), SEQ ID NO: 6546 (700351988H1), SEQ ID NO: 7562 (700381943H1), SEQ ID NO: 6211 (700351417H1), SEQ ID NO: 6659 (700352179H1), SEQ ID NO: 6950 (700380888H1), SEQ

ID NO: 4047 (700347589H1), SEQ ID NO: 4934 (700349303H1), SEQ ID NO: 6137 (700351296H1), SEQ ID NO: 7372 (700381626H1), SEQ ID NO: 5192 (700349751H1), SEQ ID NO: 6089 (700351218H1), SEQ ID NO: 5515 (700350279H1), SEQ ID NO: 6795 (700352418H1), SEQ ID NO: 5638 (700350457H1), SEQ ID NO: 6192 (700351380H1), SEQ ID NO: 6199 (700351396H1), SEQ ID NO: 5773 (700350657H1), SEQ ID NO: 7141 (700381192H1), SEQ ID NO: 6748 (700352335H1), SEQ ID NO: 4070 (700347635H1), SEQ ID NO: 7447 (700381743H1), SEQ ID NO: 5802 (700350708H1), SEQ ID NO: 6509 (700351926H1), SEQ ID NO: 5131 (700349632H1), SEQ ID NO: 7116 (700381144H1), SEQ ID NO: 6820 (700352453H1), SEQ ID NO: 7515 (700381865H1), SEQ ID NO: 6911 (700380828H1), SEQ ID NO: 6718 (700352284H1), SEQ ID NO: 4557 (700348625H1), SEQ ID NO: 6862 (700352545H1), SEQ ID NO: 5856 (700350789H1), SEQ ID NO: 6982 (700380949H1), SEQ ID NO: 5556 (700350341H1), SEQ ID NO: 4905 (700349240H1), SEQ ID NO: 6124 (700351269H1), SEQ ID NO: 5816 (700350730H1), SEQ ID NO: 5823 (700350738H1), SEQ ID NO: 5680 (700350524H1), SEQ ID NO: 5388 (700350066H1), SEQ ID NO: 6669 (700352201H1), SEQ ID NO: 5703 (700350553H1), SEQ ID NO: 4103 (700347712H1), SEQ ID NO: 3943 (700347412H1), SEQ ID NO: 7252 (700381415H1), SEQ ID NO: 6019 (700351084H1), SEQ ID NO: 4690 (700348868H1), SEQ ID NO: 4718 (700348921H1), SEQ ID NO: 5320 (700349953H1), SEQ ID NO: 7105 (700381128H1), SEQ ID NO: 5742 (700350611H1), SEQ ID NO: 5923 (700350910H1), SEQ ID NO: 6004 (700351058H1), SEQ ID NO: 6574 (700352039H1), SEQ ID NO: 6600 (700352077H1), SEQ ID NO: 5167 (700349712H1), SEQ ID NO: 6356 (700351655H1), SEQ ID NO: 4672 (700348831H1), SEQ ID NO: 4394 (700348354H1), SEQ ID NO: 5660 (700350492H1), SEQ ID NO: 6163 (700351338H1), SEQ ID NO: 5534 (700350311H1), SEQ ID NO: 6738 (700352316H1), SEQ ID NO: 5725 (700350581H1), SEQ ID NO: 4760 (700348993H1), SEQ ID NO: 7480 (700381806H1), SEQ ID NO: 7288 (700381486H1), SEQ ID NO: 6516 (700351934H1), SEQ ID NO: 6512 (700351930H1), SEQ ID NO: 4136 (700347771H1), SEQ ID NO: 4115 (700347736H1), SEQ ID NO: 5477 (700350220H1), SEQ ID NO: 6522 (700351954H1), SEQ ID NO: 4158 (700347835H1), SEQ ID NO: 4619 (700348737H1), SEQ ID NO: 4676 (700348837H1), SEQ ID NO: 6420 (700351774H1), SEQ ID NO: 5181 (700349734H1), SEQ ID NO: 6403 (700351739H1), SEQ ID NO: 5549 (700350329H1), SEQ ID NO: 3834 (700282233H2), SEQ ID NO: 7132 (700381176H1), SEQ ID NO: 4420 (700348387H1), SEQ ID NO: 6343 (700351632H1), SEQ ID NO: 6105 (700351241H1), SEQ ID NO: 6064 (700351163H1), SEQ ID NO: 5396 (700350077H1), SEQ ID NO: 5006 (700349420H1), SEQ ID NO: 7488 (700381818H1), SEQ ID NO: 7416 (700381688H1), SEQ ID NO: 5031 (700349468H1), SEQ ID NO: 6746 (700352333H1), SEQ ID NO: 5616 (700350427H1), SEQ ID NO: 4484 (700348505H1), SEQ ID NO: 4890 (700349220H1), SEQ ID NO: 4892 (700349224H1), SEQ ID NO: 5550 (700350330H1), SEQ ID NO: 6404 (700351740H1), SEQ ID NO: 4764 (700349002H1), SEQ ID NO: 7266 (700381438H1), SEQ ID NO: 4003 (700347516H1), SEQ ID NO: 4097 (700347694H1), SEQ ID NO: 5176 (700349729H1), SEQ ID NO: 4630 (700348755H1), SEQ ID NO: 6652 (700352168H1), SEQ ID NO: 4321 (700348229H1), SEQ ID NO: 6113 (700351254H1), SEQ ID NO: 5064 (700349532H1), SEQ ID NO: 5415 (700350106H1), SEQ ID NO: 6304 (700351573H1), SEQ ID NO: 6577 (700352043H1), SEQ ID NO: 7582 (700381971H1), SEQ ID NO: 3853 (700282260H2), SEQ ID NO: 6876 (700352570H1), SEQ ID NO: 6796 (700352419H1), SEQ ID NO: 4709 (700348907H1), SEQ ID NO: 5528 (700350303H1), SEQ ID NO: 6833 (700352475H1), SEQ ID NO: 5653 (700350481H1), SEQ ID NO: 6910 (700380827H1), SEQ ID NO: 3944 (700347413H1), SEQ ID NO: 6696 (700352248H1), SEQ ID NO: 7122 (700381160H1), SEQ ID NO: 7274 (700381453H1), SEQ ID NO: 7087 (700381106H1), SEQ ID NO: 4858 (700349153H1), SEQ ID NO: 4335 (700348255H1), SEQ ID NO: 5372 (700350040H1), SEQ ID NO: 4500 (700348526H1), SEQ ID NO: 5133 (700349636H1), SEQ ID NO: 5003 (700349411H1), SEQ ID NO: 3938 (700282394H2), SEQ ID NO: 7330 (700381549H1), SEQ ID NO: 6639 (700352150H1), SEQ ID NO: 4170 (700347868H1), SEQ ID NO: 4351 (700348279H1), SEQ ID NO: 4907 (700349243H1), SEQ ID NO: 7145 (700381201H1), SEQ ID NO: 5659 (700350491H1), SEQ ID NO: 4535 (700348590H1), SEQ ID NO: 6198 (700351390H1), SEQ ID NO: 6191 (700351374H1), SEQ ID NO: 5156 (700349691H1), SEQ ID NO: 6481 (700351876H1), SEQ ID NO: 4199 (700347944H1), SEQ ID NO: 4569 (700348646H1), SEQ ID NO: 7165 (700381227H1), SEQ ID NO: 4945 (700349322H1), SEQ ID NO: 4555 (700348623H1), SEQ ID NO: 4937 (700349308H1), SEQ ID NO: 4944 (700349320H1), SEQ ID NO: 4885 (700349205H1), SEQ ID NO: 5244 (700349839H1), SEQ ID NO: 6164 (700351339H1), SEQ ID NO: 4649 (700348787H1), SEQ ID NO: 4546 (700348611H1), SEQ ID NO: 6288 (700351544H1), SEQ ID NO: 5445 (700350153H1), SEQ ID NO: 3839 (700282240H1), SEQ ID NO: 4543 (700348607H1), SEQ ID NO: 5378 (700350051H1), SEQ ID NO: 4652 (700348795H1), SEQ ID NO: 5896 (700350862H1), SEQ ID NO: 7106 (700381129H1), SEQ ID NO: 4742 (700348966H1), SEQ ID NO: 5817 (700350731H1), SEQ ID NO: 6260 (700351502H1), SEQ ID NO: 4648 (700348785H1), SEQ ID NO: 4211 (700347970H1), SEQ ID NO: 6930 (700380858H1), SEQ ID NO: 4560 (700348628H1), SEQ ID NO: 4565 (700348638H1), SEQ ID NO: 6687 (700352237H1), SEQ ID NO: 4949 (700349329H1), SEQ ID NO: 5577 (700350369H1), SEQ ID NO: 6140 (700351304H1), SEQ ID NO: 6359 (700351660H1), SEQ ID NO: 5259 (700349861H1), SEQ ID NO: 7118 (700381149H1), SEQ ID NO: 3957 (700347434H1), SEQ ID NO: 4758 (700348990H1), SEQ ID NO: 4001 (700347514H1), SEQ ID NO: 6704 (700352261H1), SEQ ID NO: 6892 (700380802H1), SEQ ID NO: 5232 (700349813H1), SEQ ID NO: 7337 (700381559H1), SEQ ID NO: 4121 (700347749H1), SEQ ID NO: 4331 (700348249H1), SEQ ID NO: 6350 (700351645H1), SEQ ID NO: 5235 (700349820H1), SEQ ID NO: 5609 (700350414H1), SEQ ID NO: 6720 (700352288H1), SEQ ID NO: 7406 (700381678H1), SEQ ID NO: 5504 (700350265H1), SEQ ID NO: 4383 (700348334H1), SEQ ID NO: 4131 (700347763H1), SEQ ID NO: 4423 (700348396H1), SEQ ID NO: 7329 (700381547H1), SEQ ID NO: 4093 (700347688H1), SEQ ID NO: 4310 (700348209H1), SEQ ID NO: 6681 (700352229H1), SEQ ID NO: 5263 (700349865H1), SEQ ID NO: 6254 (700351489H1), SEQ ID NO: 6442 (700351811H1), SEQ ID NO: 5226 (700349807H1), SEQ ID NO: 5308 (700349935H1), SEQ

ID NO: 6730 (700352306H1), SEQ ID NO: 7499 (700381835H1), SEQ ID NO: 5902 (700350873H1), SEQ ID NO: 7531 (700381889H1), SEQ ID NO: 4371 (700348314H1), SEQ ID NO: 7600 (700381994H1), SEQ ID NO: 6354 (700351650H1), SEQ ID NO: 4653 (700348801H1), SEQ ID NO: 3941 (700347405H1), SEQ ID NO: 4206 (700347960H1), SEQ ID NO: 6832 (700352474H1), SEQ ID NO: 4337 (700348259H1), SEQ ID NO: 4193 (700347929H1), SEQ ID NO: 6220 (700351433H1), SEQ ID NO: 5511 (700350274H1), SEQ ID NO: 6337 (700351625H1), SEQ ID NO: 6900 (700380811H1), SEQ ID NO: 7547 (700381923H1), SEQ ID NO: 5525 (700350293H1), SEQ ID NO: 4474 (700348485H1), SEQ ID NO: 6498 (700351910H1), SEQ ID NO: 4968 (700349359H1), SEQ ID NO: 6295 (700351554H1), SEQ ID NO: 7584 (700381973H1), SEQ ID NO: 4750 (700348978H1), SEQ ID NO: 5355 (700350018H1), SEQ ID NO: 4464 (700348467H1), SEQ ID NO: 6755 (700352345H1), SEQ ID NO: 4106 (700347718H1), SEQ ID NO: 4886 (700349211H1), SEQ ID NO: 5553 (700350334H1), SEQ ID NO: 4396 (700348356H1), SEQ ID NO: 5939 (700350936H1), SEQ ID NO: 6189 (700351371H1), SEQ ID NO: 5803 (700350709H1), SEQ ID NO: 4655 (700348803H1), SEQ ID NO: 6120 (700351265H1), SEQ ID NO: 4799 (700349054H1), SEQ ID NO: 5830 (700350748H1), SEQ ID NO: 6686 (700352236H1), SEQ ID NO: 4589 (700348678H1), SEQ ID NO: 5870 (700350819H1), SEQ ID NO: 5794 (700350692H1), SEQ ID NO: 4646 (700348782H1), SEQ ID NO: 4489 (700348513H1), SEQ ID NO: 4157 (700347830H1), SEQ ID NO: 5651 (700350478H1), SEQ ID NO: 5982 (700351019H1), SEQ ID NO: 4466 (700348472H1), SEQ ID NO: 4692 (700348872H1), SEQ ID NO: 6847 (700352506H1), SEQ ID NO: 4980 (700349375H1), SEQ ID NO: 4387 (700348343H1), SEQ ID NO: 4067 (700347631H1), SEQ ID NO: 5546 (700350324H1), SEQ ID NO: 3999 (700347509H1), SEQ ID NO: 4794 (700349046H1), SEQ ID NO: 4382 (700348333H1), SEQ ID NO: 5348 (700350008H1), SEQ ID NO: 4657 (700348806H1).

Analogous to the nucleic acid sequences, a CDP may have an amino acid sequence which is naturally occurring, synthetic, or variant. Guidance in determining which amino acid residues may be substituted, inserted, or deleted without abolishing biological or immunological activity may be found using computer programs such as LASERGENE Navigator (DNASTAR, Madison Wis.) which are well known in the art.

Derivation of Nucleic Acid Sequences

In the present embodiment, mRNA was isolated from corn ear and used to construct the SATMON022 and SATMON023 cDNA libraries. Random cDNA isolates were sequenced in part and analyzed using the homology programs described below. The sequences of the isolates are disclosed in the Sequence Listing. These cdps may contain either a partial or a full length open reading frame, or they may contain all or part of a regulatory element for a particular gene. This variation is attributed to the fact that many genes are several hundred, and sometimes several thousand, bases in length. With current technology, large genes cannot be cloned in their entirety because of vector limitations, incomplete reverse transcription of the first strand, or incomplete replication of the second strand. This is particularly common in libraries generated by random priming, since first strand synthesis may begin anywhere within the transcript. Contiguous, secondary clones containing additional nucleotide sequences may be obtained using a variety of methods known to those of skill in the art.

Sequencing of the cDNAs

Methods for DNA sequencing are well known in the art. Conventional enzymatic methods employ DNA polymerase, Klenow fragment, THERMO SEQUENASE DNA polymerase (Amersham Pharmacia Biotech, Piscataway N.J.), or Taq DNA polymerase (Amersham Pharmacia Biotech) to extend the nucleic acid sequence from an oligonucleotide primer annealed to the DNA template of interest. Methods have been developed for the use of both single-stranded and double-stranded templates. Chain termination reaction products may be electrophoresed on urea-polyacrylamide gels and detected either by autoradiography (for radionucleotide-labeled nucleotides) or by fluorescence (for fluorescent-labeled nucleotides). Recent improvements in mechanized reaction preparation, sequencing, and analysis using the fluorescent detection method have permitted expansion in the number of inserts that may be sequenced per day using machines such as the ABI 377 DNA Sequencer (Perkin Elmer, Norwalk Conn.).

Reading Frame Determinations

The reading frame of the nucleotide sequence may be ascertained by several types of analyses. First, reading frames contained within the coding sequence may be analyzed for the presence of start (ATG, GTG, etc.) and stop codons (TGA, TAA, TAG). Typically, one reading frame will continue throughout the major portion of a cDNA sequence while the other two reading frames tend to contain numerous stop codons. For more difficult cases, algorithms have been created to analyze the occurrence of individual nucleotide bases at each putative codon triplet (Fickett, J. W. (1982) Nucl. Acids Res. 10:5303–5318). Coding sequences for particular organisms (bacteria, plants, and animals) tend to contain certain triplet periodicities, such as a significant preference for pyrimidines in the third codon position. These preferences have been incorporated into widely available software which may be used to determine the coding potential and frame of a given stretch of DNA. Coding preferences and start/stop codon information may be used to determine proper frame with a high degree of certainty which, in turn, permits cloning of the sequence in the correct frame.

The nucleotide sequences of the Sequence Listing have been prepared by current, state-of-the-art, automated methods and, as such, may contain occasional sequencing errors and unidentified nucleotides. Such unidentified nucleotides are designated by an N. The infrequent sequencing errors or N's in the nucleotide sequences of the Sequence Listing do not present a problem to those skilled in the art who wish to practice the invention. Several methods employing standard recombinant techniques, described in Ausubel, F. M. et al. (1997; *Short Protocols in Molecular Biology*, John Wiley & Sons, New York N.Y.), Sambrook, J. et al. (1989; *Molecular Cloning, A Laboratory Manual*, Cold Spring Harbor Press, Plainview N.Y.), or periodic updates thereof, may be used to correct errors and complete the missing sequence information. The same techniques used for obtaining a full-length sequence may be used to obtain a complete and accurate nucleotide sequence.

Homology Searches

The nucleic acid sequences of the Sequence Listing were used as query sequences against GenBank, or other databases available to the public, to determine homology to known sequences. Illustrative of computer programs known to those of skill in the art for performing computer-assisted nucleic acid or amino acid homology searches is the program Basic Local Alignment Search Tool or BLAST (Altschul, S. F. (1993) J. Mol. Evol. 36:290–300; Altschul, et al. (1990) J. Mol. Biol. 215:403–410). BLAST produces alignments of both nucleotide and amino acid sequences to determine sequence similarity. BLAST is especially useful in determining exact matches or homology. GenBank databases may be searched for sequences containing regions of homology to a query cdp of the present invention. Other databases (such as SwissProt, BLOCKS, or Pima II) may be searched for regions of amino acid sequence homology corresponding to the deduced CDP.

As described in Karlin (supra), the fundamental unit of BLAST algorithm output is the High-scoring Segment Pair (HSP). An HSP consists of two sequence fragments of arbitrary, but equal lengths, whose alignment is locally maximal and for which the alignment score meets or exceeds a threshold or cutoff score set by the user. The parameter E establishes the statistically significant threshold for reporting database sequence matches. E is interpreted as the upper bound of the expected frequency of chance occurrence of an HSP (or set of HSPs) within the context of the entire database search. Any database sequence whose match satisfies E is reported in the BLAST program output.

BLAST may be used with any of the cdps of the present invention to search for HSPs between a query sequence and sequences in a reference nucleotide or protein database. The statistical significance of any matches is evaluated, and those matches that satisfy the user-selected threshold of significance are reported.

Homologous sequences, as determined by a BLAST search, may include prokaryotic (bacterial) or eukaryotic (animal, fungal, or plant) sequences. Where a cdp represents only part of a gene, the degree of homology is based only on the partial sequence disclosed in the Sequence Listing. When sequences have sufficiently long regions of agreement or sufficiently high overall agreement, the score of the cdp is considered to be a nearly exact match. Allelic sequences fit this category when they only differ by about three nucleotides per 100. Homologous matches between the cdps provided in the Sequence Listing and the GenBank databases are reported in TABLES 1 and 2.

Corn Ear-Derived Sequences

The cdps of the present invention may serve to identify, evaluate, alter, or follow the inheritance of desired characteristics associated with growth and development, disease resistance, environmental adaptability, quality, and yield of corn. In particular, cdps are useful as molecular markers for studying inheritance of multigene traits in a plant breeding program.

Hybridization and Genetic Analysis

The cdps, their oligonucleotides, fragments, or complementary sequences, may be used to identify the presence of and/or to determine the degree of similarity between two (or more) nucleic acid sequences. The cdps may be hybridized to naturally occurring or recombinant nucleic acid sequences under appropriately selected temperatures and salt concentrations. Hybridization with a probe based on the nucleic acid sequence of at least one of the cdps allows for the detection of nucleic acid sequences, including genomic sequences, which are identical or closely homologous to the cdps of the Sequence Listing. Probes may be selected from non-conserved or unique regions of the cdps of interest and pretested for their ability to identify or amplify the target nucleic acid sequence using standard protocols. Optimization of the protocol, e.g. increasing stringency to reduce the frequency of false positives or avoiding polyadenylated or other regions predicted to provide secondary structure to reduce false negatives, should provide the desired results. A labeled probe may be used to detect or quantify cDNAs, endogenous corn transcripts, or genes. As will be understood by those of skill in the art, hybridization conditions, probe length and labeling will vary depending upon the intended use. Hybridization conditions, based on the melting temperature (Tm) of the probe and on the salt concentrations under which hybridization and subsequent washes are carried out are well known in the art and are taught in Sambrook (supra) and Ausubel (supra).

A probe for use in Southern or northern hybridization may be a cdp sequence or its complement that is up to several hundred nucleotides long and either single-stranded or double-stranded. Such probes may be hybridized in solution to biological materials such as plasmids, bacterial or yeast artificial chromosomes, cleared plant tissues, etc. or to artificial substrates containing cdps. Microarrays are particularly suitable for identifying the presence and detecting the level of gene expression of multiple desired traits by examining gene expression of selected inbreds and is hybrids at various stages of development. An array analogous to a dot or slot blot may be used to arrange and link the cDNA fragments or oligonucleotides to the surface of a substrate using one or more of the following: mechanical (vacuum), chemical, thermal, or UV bonding procedures. Such an array may contain any number of cdps and may be produced by hand or by using available devices, materials, and machines.

Probes may be labeled by either PCR or enzymatic techniques using a variety of reporter molecules. Commercial kits are available for radioactive labeling and probe cleanup from Amersham Pharmacia Biotech, for alkaline phosphatase labeling from Life Technologies (Rockville Md.), for chemiluminescent labeling from Lumigen (Southfield Mich.), etc. Alternatively, cdps may be cloned into commercially available vectors for the production of RNA probes. Such probes may be transcribed in the presence of at least one labeled nucleotide (e.g. [$\alpha$-$^{32}$P] CTP, Amersham Pharmacia Biotech).

Genetic maps, based upon molecular markers (restriction fragment length polymorphisms, RFLPs) are being assembled for several grains including rice, corn, barley, and wheat. These maps have improved understanding and manipulation of both single and multigene traits. Even when the genes involved are unknown, the ability to show the presence of the associated marker and the desired characteristics in inbred or hybrid corn plants and to follow segregation in a breeding program make the marker valuable as a diagnostic. Moreover, continuous variation within a segregating family may often be resolved into a handful of major gene effects associated with molecular markers. As genetic maps merge with physical maps, it becomes possible to walk along the chromosome and clone virtually any gene. Hybridization and newer technologies such as random amplified polymorphic DNA (RAPD) analysis, microsatellites and amplified fragment length polymorphisms (AFLP) make it easier to isolate the actual genes which interact and are responsible for a desired trait.

Diagnostic Uses

Diagnostic assays known to those of skill in the art may be used to detect or confirm conditions or diseases associated with abnormal levels of cdp expression. Labeled probes developed from the nucleotide sequence encoding a cdp are added to a plant sample under amplifying or hybridizing conditions. The complex between the naturally occurring sequence and the labeled probe is quantified and compared with a standard for that cell or tissue. If cdp expression varies significantly from the standard, the assay indicates the presence of the condition or disease. Qualitative or quantitative diagnostic methods may include northern, dot blot, or other membrane or dip-stick based technologies or multiple-sample format technologies such as PCR, ELISA-like, pin, or chip-based assays. The determination of whether cdp expression in a sample varies significantly from a standard is determined by methods of statistical analyses well known to those of skill in the art.

Accordingly, the invention provides a method for assessing disease resistance or other conditions using a panel of probes. A candidate probe is identified from CDPs which are specific to corn tissue and have not been observed in GenBank or other Incyte-sequenced cDNA libraries. The usefulness of the probe may be tested by quantifying its hybridization across tissues which are normal versus diseased. Once an increase (or decrease) in expression level is related to a trait such as fungal resistance, the probe can be used to monitor ability of a particular inbred or hybrid corn line to withstand fungal infection.

Transcript Imaging

Another embodiment relates to development of diagnostic or treatment methods based on specific imaging of the cdps of the present invention. The profile of nucleic acid sequences which reflect gene transcription activity in a particular cell type, tissue, or plant at a particular time, is defined as a "transcript image". Such profiles are generated by naming, matching, and counting all copies of related clones and arranging them in order of abundance.

Clones may also be arranged in clusters in descending order of abundance. The minimum number of clones necessary to constitute a cluster, as illustrated at the bottom of TABLE 2, is two. All clones in TABLE 2 are ear specific although individual clusters may consist of either unique cdps or cdps that are homologous to known sequences. An alternative presentation of this data might involve a spreadsheet which contains cluster abundance data as well as some descriptive information for the homologous clones.

Subtractions, or subsetting, among transcript images may be used to discern various differences in gene expression and cellular activities. For example, subsetting may be used with the PHYTOSEQ database (Incyte Pharmaceuticals, Palo Alto Calif.) to show differences between: a) organs of two different developmental stages; b) two different organs, such as leaves and roots; c) organs from two different species; or d) normal and diseased or stressed plant tissues.

Large numbers of mRNA transcripts, as represented by their respective cDNA clones, may be compared using computational methods rather than analogous laboratory methods, such as northern blot analysis. For example, electronic subtraction between any two transcript images parallels hybrid subtraction between any two cDNA libraries (cf. Sambrook, supra). The information produced by the subtraction of transcript images between different libraries may be used to select single or multiple cdps which may be used to predict yield.

A cdp identified through transcript imaging, or other means, may also be used to clone regulatory elements for use in transformation vectors. Expression may be quantified using amplification or microarray technologies which are well known in the art.

Complementary Strand

The cdp, or any part thereof, may be used as a tool in technologies for altering gene expression. To inhibit in vivo or in vitro cdp transcription, a PNA (Nielsen, P. E. et al. (1993) Anticancer Drug Des. 8:53–63) or an oligonucleotide based on the sequence of a cdp is designed using OLIGO 4.06 software (National Biosciences, Plymouth MN) or LASERGENE Navigator (DNASTAR). Alternatively, a fragment of a cdp is cloned into an expression vector which is transformed into a host cell to express the complementary strand. An analogous molecule may be designed to inhibit promoter binding in the upstream nontranslated leader or at various sites along the 5' coding region of the cdp. Alternatively, complementary molecules may be designed to inhibit translation of an mRNA by preparing an oligomer or fragment which binds to the transcript preventing its association with the ribosomal machinery.

Complementary molecules may also be designed to disrupt genomic sequences (such as enhancers, introns) preventing the normal activity of these regulatory elements. Similarly, complementary strands may be used in a process known as "triple helix" base pairing to inhibit replication. These molecules compromise the ability of the double helix to open and bind to polymerases and transcription factors necessary for replication.

Stable transformation of appropriate dividing cells with an expression vector encoding the complement of a cdp may produce a transgenic cell line, tissue, or organism. Those cells which assimilate, replicate, and express the nucleic acid sequence in sufficient quantities may compromise or entirely eliminate the natural activity of the cdp. Frequently, the function of a cdp may be ascertained by observing lethality, loss of physiological activity, changes in morphology, etc. at the cellular, tissue, organ, or organismal level.

Expression

The cdps may be used in recombinant vectors to express a polypeptide. It may be advantageous to design nucleic acid sequences possessing the GC ratio of codons preferred by a particular prokaryotic or eukaryotic host (Murray, E. et al. (1989) Nuc. Acids Res. 17:477–508). In addition, 3' terminators, such as bacterial nopalene synthase or octapine synthase, may be modified, or substituted into vectors, to produce transcripts having more desirable properties, such as a longer half-life, than transcripts produced from the naturally occurring sequence (Sullivan, M. L. and Green, P. J. (1993) Plant Mol. Biol. 23:1091–1104; Silva, E. M. et al. (1987) J. Cell Biol. 105:245). The cdps may also be altered by site-directed mutagenesis to insert new restriction sites and to modify the peptide by glycosylation, phosphorylation, acetylation, etc.

The cdp may be ligated to a heterologous sequence to create a chimeric or fusion protein. For ease of purification, it may be useful to produce a fusion protein that is recognized by a commercially available antibody. In addition, the sequence may be engineered to introduce a cleavage site between the peptide of interest and the heterologous protein sequence, so that the peptide may be cleaved from the heterologous moiety and purified.

Alternately, the peptide may be synthesized, whole or in part, using chemical methods well known in the art. For example, peptides may be synthesized using various solid-phase techniques (Roberge, J. Y. et al. (1995) Science 269:202–204) or an Peptide Synthesizer Model 431A (Perkin Elmer) using instructions provided by the manufacturer. Once synthesized, the peptide may be purified by preparative high performance liquid chromatography, and composition confirmed by amino acid sequencing (Ausubel (supra) p. 10.82f).

Expression Systems

For protein expression, the nucleic acid sequence may be inserted into an expression vector which contains the necessary elements for appropriate transcription and translation. Methods which are well known to those skilled in the art may be used to construct such vectors. These methods include in vitro recombinant DNA techniques, synthetic techniques, in vivo recombination, or genetic recombination. Such techniques are described in Sambrook (supra) and Ausubel (supra). One of the advantages of producing the CDPs by recombinant DNA technology is the ability to obtain highly-enriched sources of the polypeptides that simplify purification procedures.

The cdps may be engineered into a variety of expression vectors and host cells. These include, but are not limited to, microorganisms such as bacteria transformed with recombinant bacteriophage, plasmid or cosmid DNA expression vectors; yeast transformed with yeast expression vectors; insect cell systems infected with virus expression vectors (e.g. baculovirus); plant cells transfected with expression vectors containing viral, bacterial, or eukaryotic elements (e.g. cauliflower mosaic virus, CaMV; Ti or pBR322 plasmids; and cell or ear-specific, constitutive or inducible, monocot or corn elements).

The regulatory elements of vectors- vary in their strength and specificities and are those nontranslated regions such as enhancers, promoters, introns, and 3' untranslated regions which interact with host proteins to carry out transcription and translation. Depending on the vector and host, any number of suitable transcription and translation elements may be used. For example, promoters or enhancers derived from the genomes of plant cells (e.g. heat shock, RUBISCO; and storage protein genes) or from plant viruses (e.g. viral promoters or leader sequences) may be cloned into the vector containing an appropriate selectable marker. In fact, the cdps of this invention may be used to clone upstream, tissue-specific or inducible regulatory elements for purposes of engineering and expressing heterologous genes in corn.

In a bacterial system, an expression vector may be selected to direct a high level expression of a fusion protein. Commercial vectors include, but are not limited to, the multifunctional *E. coli* cloning and expression vectors, PBLUESCRIPT (Stratagene, La Jolla Calif.) and PSPORT (Life Technologies). Using either of these vectors, the nucleic acid sequence may be ligated into the vector in-frame with sequences for the amino-terminal Met and the subsequent 7 residues of 3-galactosidase so that a chimeric protein is produced. PGEX vectors (Amersham Pharmacia Biotech) may also be used to express peptides by ligating the nucleic acid sequence to glutathione S-transferase (GST). In general, such fusion proteins are soluble and may easily be purified from lysed cells by adsorption to glutathione-agarose beads followed by elution in the presence of free glutathione. Proteins made in such systems are designed to include heparin, thrombin, or factor XA protease cleavage sites so that the peptide of interest may be released from the GST moiety at will.

In plants, the expression of nucleic acid sequences may be driven by any of a number of promoters. Viral promoters such as the 35S and 19S promoters of CaMV may be used alone or in combination with the omega leader sequence from TMV (Takamatsu, N. et al. (1987) EMBO J. 6:307–311). Alternatively, plant promoters such as the small subunit of RUBISCO (Coruzzi, G. et al. (1984) EMBO J. 3:1671–1680; Broglie, R. et al. (1984) Science 224:838–843); or heat shock promoters (Winter, J. and Sinibaldi, R. M. (1991) Results Probl. Cell Differ. 17:85–105) may be used. Preferably, the cdps of the invention may be used to identify clones containing full length genes by hybridization or to clone full length genes or regulatory elements for use in expression vectors by PCR.

X-Ray Crystallography

Expression of the recombinant CDP in sufficient amounts may make analytical studies such as X-ray crystallography possible. In the alternative, knowledge of the amino acid sequence deduced from the nucleic acid sequence may provide guidance to those employing computer modeling techniques in place of or in addition to X-ray crystallography.

Antibodies

Anti-CDP antibodies may be produced to use in assays of protein expression. Such antibodies include, but are not limited to, polyclonal, monoclonal, chimeric, single chain, Fab fragments and fragments produced by a Fab expression library. Neutralizing antibodies, i.e., those which inhibit dimer formation, are especially useful for diagnostics.

The amino acid sequence encoded by the cdps of the Sequence Listing may be analyzed by appropriate software (e.g. LASERGENE Navigator, DNASTAR) to determine regions of high immunogenicity. The optimal sequences for immunization are selected from the C-terminus, the N-terminus, and those intervening, hydrophilic regions of the peptide which are likely to be exposed to the external environment when the peptide is in its natural conformation. Analysis used to select appropriate epitopes is also described by Ausubel (supra, unit 11-7). Peptides used for antibody induction do not need to have biological activity; however, they must be antigenic. Peptides used to induce specific antibodies may have an amino acid sequence consisting of at least five amino acids, and preferably at least 10 amino acids. An oligopeptide should mimic an antigenic portion of the natural peptide and may be fused with another protein such as KLH (Sigma-Aldrich) for antibody production. An oligopeptide or peptide encompassing an antigenic region may be expressed from the nucleic acid sequence, synthesized, or purified from corn.

Procedures well known in the art may be used for the production of antibodies. Various hosts including mice, goats, and rabbits, may be immunized by injection with a peptide or oligopeptide. Depending on the host species, various adjuvants may be used to increase immunological response.

In one procedure, oligopeptides about 15 residues in length may be synthesized using a Peptide Synthesizer Model 431A (Perkin Elmer) using Fmoc-chemistry and coupled to KLH (Sigma-Aldrich) by reaction with M-maleimidobenzoyl-N-hydroxysuccinimide ester (Ausubel, supra). If necessary, a cysteine may be introduced at the N-terminus of the oligopeptide to permit coupling to KLH. Rabbits are immunized with the oligopeptide-KLH complex in complete Freund's adjuvant. The resulting antisera are tested for antipeptide activity by binding the peptide to plastic, blocking with 1% BSA, reacting with rabbit antisera, washing, and reacting with radioiodinated goat anti-rabbit IgG.

In another procedure, the peptide, in quantities up to 75 mg, may be used to immunize mice or rabbits. About 100 µg are used to immunize a mouse, while up to 1 mg is used to immunize a rabbit. Subsequently, the peptide is radioiodinated and used to screen the B-lymphocyte cells from the immunized animal for production of hybridomas using standard techniques. About 20 mg of protein are sufficient for labeling and screening several thousand clones.

Hybridomas may also be prepared and screened using standard techniques. Hybridomas of interest are detected by screening with radioiodinated peptide to identify those fusions producing peptide-specific monoclonal antibody. In a typical protocol, wells of microtiter plates are coated with affinity-purified, specific rabbit-anti-mouse (or suitable anti-species IgG) antibodies at 10 mg/ml. The coated wells are blocked with 1% BSA and washed and exposed to supernatants from hybridomas. After incubation, the wells are exposed to radiolabeled peptide at 1 mg/ml. Clones producing antibodies bind a quantity of labeled peptide that is detectable above background.

Such clones are expanded and subjected to 2 cycles of cloning at 1 cell/3 wells. Cloned hybridomas are injected into pristane-treated mice to produce ascites, and monoclonal antibody is purified from the ascitic fluid by affinity chromatography on Protein A (Amersham Pharmacia Biotech). Monoclonal antibodies with affinities of at least $10^8$ $M^{-1}$, preferably $10^9$ $M^{-1}$ to $10^{10}$ $M^{-1}$ or greater, are made by standard procedures as described in Harlow (1988; *Antibodies: A Laboratory Manual*, Cold Spring Harbor Laboratory, Cold Spring Harbor N.Y.) and Goding (1986; *Monoclonal Antibodies: Principles and Practice*, Academic Press, New York N.Y.).

Antibody fragments which contain specific binding sites for an epitope may also be generated. For example, such fragments include, but are not limited to, the F(ab')2 fragments which may be produced by pepsin digestion of the antibody molecule and the Fab fragments which may be generated by reducing the disulfide bridges of the F(ab')2 fragments. Alternatively, Fab expression libraries may be constructed to allow rapid and easy identification of monoclonal Fab fragments with the desired specificity (Huse, W. D. et al. (1989) Science 256:1275–1281).

Assays Using Antibodies

Anti-CDP antibodies may be used to determine the amount of CDP found in a particular cell of a corn inbred line or hybrid under various environmental or disease conditions. Assays for such peptides include methods utilizing the antibody and a label to detect expression in plant extracts, cells, or tissues. The peptides and antibodies of the invention may be used with or without modification. Frequently, the peptides and antibodies will be labeled by joining them, either covalently or noncovalently, with a reporter molecule.

Protocols for detecting and measuring protein expression using either polyclonal or monoclonal antibodies, are known in the art. Examples include enzyme-linked immunosorbent assay (ELISA), radioimmunoassay (RIA) and fluorescent activated cell sorting (FACS). A two-site, monoclonal-based immunoassay utilizing monoclonal antibodies reactive to two non-interfering epitopes on a peptide is preferred, but a competitive binding assay may be employed. Such immunoassays typically involve the formation of complexes between the CDP and its specific antibody and the measurement of such complexes. These and other assays are described, among other places, in Hampton, R. et al. (1990, *Serological Methods, a Laboratory Manual*, APS Press, St Paul Minn.) and Maddox, D. E. et al. (1983, J. Exp. Med. 158:1211–1226).

Screening for Useful Compounds

The cdps or CDPs are particularly useful for screening libraries of molecules or test compounds for identification of those molecules which bind specifically to them. For example, a cdp or fragment thereof may be combined with a plurality of natural, synthetic, or inorganic molecules to screen for molecules that bind to them and function as transcription factors, enhancers, or other cellular elements which contribute to gene expression. Similarly, a CDP or portion thereof may be combined with a plurality of molecules to screen for molecules which bind to them. Molecules identified by screening with cdps or CDPs preferably affect growth and development, disease resistance, environmental adaptability, quality, or yield.

Technologies with multiple-sample format, ELISA-like, capillary, or chip-based assays, are well known in the art and allow large-scale screening. These methods use complex formation, quantification, and comparison with a standard to detect molecules which specifically bind the cdps or CDPs. In the assay, the cdp or CDP may be free in solution, affixed to a substrate, borne on a cell surface, or located intracellularly. For example, prokaryotic host cells which are stably transformed with recombinant nucleic acids that express and position a CDP on the cell surface can be used to screen for molecules which specifically bind the CDP. Viable or fixed cells are screened against a plurality of test compounds and the specificity of binding or formation of complexes between an expressed CDP and the test compound is measured.

Transformation

Bacterial and plant transformation systems are well known in the art. Expression vectors may be introduced into suitable *E. coli* cells by electroporation, heat shock or other means as described in Ausubel (supra) for the purpose of expressing a plant protein. Expression vectors may also be introduced into plant cells by direct transfer of DNA or pathogen-mediated transfection. For reviews, see McGraw Hill *Yearbook of Science and Technology* (1992; McGraw Hill New York N.Y., pp 191–196); or Weissbach, A. and Weissbach, H. (1988; Methods Enzymol. 118:421–463). Direct transfer of DNA into plant protoplasts or cells is one approach for transforming plants genetically. DNA uptake by protoplasts may be promoted chemically with polyethylene glycol or electrically with a high-voltage pulse. Both of these methods depend upon a cell culture system to recover plants from a single transformed cell (Rhodes, C. A. et al. (1988) Biotechnology 6:56–60; Morocz, S. (1991) Theor. Appl. Genet. 80:721–726). Regeneration of transformed, fertile plants has been demonstrated in several cereals including rice (Zhang, H. M. (1988) Plant Cell Rep. 7:379–384).

Electroporation, lipofection, microinjection, particle bombardment, vacuum infiltration, and electrotransformation may be used to transform corn cells and embryos. Gordon-Kamm, W. J. et al. (1992; Plant Mol. Biol. 18:201–210) used particle bombardment to transform embryogenic, suspension culture cells; Murry, L. E. et al. (In: Bajaj, Y. P. S. (1994) *Biotechnology in Agriculture and Forestry* 25:252–261) used continuous, low voltage electric current to transform embryos; and Rhodes, C. A. et al. (1995; Methods Mol. Biol. 55:121–131) describe the electroporation of embryos. Stable transformation requires the use of an expression vector which contains an appropriate origin of replication and gene cassettes containing viral or plant expression elements, a selectable or visible marker, and a gene of interest. Following the introduction of the vector, cells may be allowed to grow for 1–2 days in an enriched media. If the vector contains a selectable marker, the cells are switched to selective media. The selectable marker confers resistance to selective agents and allows growth and recovery of those cells which successfully express the introduced sequences.

Any number of selection systems may be used to recover transformed cell lines. Antimetabolite, antibiotic or herbicide resistance may be used as the basis for selection using genes such as dhfr, which confers resistance to methotrexate (wigler, M. et al. (1980) Proc. Natl. Acad. Sci. 77:3567–3570); npt, which confers resistance to the aminoglycosides, neomycin and G-418 (Colbere-Garapin, F. et al. (1981) J. Mol. Biol. 150:1–14); and als or pat, which confer resistance to chlorsulfuron and phosphinotricin acetyltransferase, respectively (McGraw Hill *Yearbook of Science and Technology*, supra). Recently, the use of visible markers has gained. popularity with such markers as anthocyanins, β glucuronidase and its substrate, GUS, luciferase and its substrate, luciferin, and green fluorescent protein, GFP, being widely used not only to identify transformants, but also to quantify the amount of transient or stable protein expression attributable to a specific vector system (Rhodes (1995) supra; Haseloff, J. and Amos, B. (1995) Trends Genet. 11:328–329). Plant expression vectors contain 5' promoters, enhancers and 3' terminators that will function in the plant cell.

Identification of Transformants

Although the presence/absence of marker gene expression suggests that the gene of interest is also present, its expression should be confirmed. For example, if the sequence is inserted within a marker gene sequence, cells containing the recombinant sequence may be identified by the absence of marker gene function. Alternatively, a marker gene may be placed in tandem with the nucleic acid sequence under the control of a single promoter. Expression of the marker gene in response to induction or selection may indicate the presence and expression of the tandem sequence as well.

Alternatively, host cells which contain the introduced nucleic acid sequence may be identified by a variety of procedures known to those of skill in the art. These procedures include, but are not limited to, DNA-DNA or DNA-RNA hybridization and protein bioassay or immunoassay techniques which include membrane, solution, gel, or chip based technologies for the detection and/or quantification of the nucleic or amino acids and any of the molecules to which they bind.

The presence of the nucleic acid sequence may be detected by DNA-DNA or DNA-RNA hybridization or amplification using probes comprising all or a portion of a nucleic acid sequence. Nucleic acid amplification based assays involve the use of oligonucleotides or oligomers based on the nucleic acid sequence to detect transformants containing the introduced DNA.

A wide variety of labels and conjugation techniques are known by those skilled in the art and may be used in various nucleic acid and amino acid assays. Means for producing labeled hybridization or PCR probes for detecting related sequences include oligolabeling, nick translation, end-labeling, or PCR amplification and are well known in the art. Alternatively, the nucleic acid sequence may be cloned into a vector for the production of an mRNA probe. Such vectors are known in the art, are commercially available, and may be used to synthesize RNA probes in vitro by addition of an appropriate RNA polymerase such as T7, T3, or SP6 and labeled nucleotides. A number of companies (e.g., Amersham Pharmacia Biotech and Life Technologies) supply commercial kits, reporter molecules, and protocols for these procedures.

EXAMPLES

Isolation, Sequence Analysis and Use of Corn Sequences

I Growth Conditions

The corn cDNA libraries, SATMON022 and SATMON023, were constructed from corn ear grown as follows. Seeds were planted 3 cm deep in soil in 2"–3" peat pots containing Metro-Mix 200 growing medium (The Scotts Company, Marysville Ohio). After 2–3 weeks, the plants were transplanted into 10" pots. After transplant, PETERS 15-16-17 fertilizer (The Scotts Company) at a strength of 150 ppm nitrogen was applied ~3× per week. Iron (total ~900 mg) was added to each pot two to three times between transplanting and flowering of the plant. Corn plants were grown in a greenhouse in 27° C./21° C., 15 hr day/9 hr night cycles. Lighting was provided by 1000 W sodium vapor lamps. For SATMON022, when the corn plant was at about V8 and immature ear shoots were visible, an immature ear shoot 3–4 cm long was harvested, frozen in liquid nitrogen, and stored at −80° C. For SATMON023, when the corn plant was at V8, an ear 10–15 cm in length, with silks of about 2.5 cm in length, was harvested, frozen in liquid nitrogen, and stored at −80° C.

II CDNA Library Construction

The frozen tissue from SATMON022 and SATMON023 was homogenized, and total RNA was extracted with TRIZOL reagent (Life Technologies). Polyadenylated RNA was isolated from the total RNA using a magnetic Dynabeads mRNA purification kit (Dynal Inc, Lake Success N.Y.). The mRNA was handled according to the recommended protocols in the SuperScript Plasmid System for cDNA synthesis and plasmid cloning (Life Technologies). The cDNAs were fractionated on a SEPHAROSE CL-4B column (Amersham Pharmacia Biotech), and those cDNAs exceeding 400 bp were ligated into the NotI and EcoRI sites of the pINCY1 plasmid (Incyte Pharmaceuticals). The plasmid pINCY1 was subsequently transformed into DH10B competent cells (Life Technologies).

III Isolation and Sequencing of cDNA Clones

The plasmid DNA was released from the cells and purified using the R.E.A.L. Prep 96 plasmid kit (Qiagen, Valencia Calif.). This kit enabled the simultaneous purification of 96 samples in a 96-well block using multi-channel reagent dispensers. The recommended protocol was employed except for the following changes: 1) the bacteria were cultured in 1 ml of sterile Terrific Broth (Life Technologies) with carbenicillin at 25 mg/l and glycerol at 0.4%; 2) after inoculation, the cultures were incubated for 19 hours and at the end of incubation, the cells were lysed with 0.3 ml of lysis buffer; and 3) following isopropanol precipitation, the plasmid DNA pellet was resuspended in 0.1 ml of distilled water. After the last step in the protocol, samples were transferred to a 96-well block for storage at 4° C. is in the alternative, DNA was isolated using the following protocols.

Single bacterial colonies were transferred into individual wells of the 384-well plates (Genetix, Christchurch UK) using sterile toothpicks. The wells contained 1 ml of sterile Terrific Broth (Life Technologies) with 25 mg/l carbenicillin and 0.4% glycerol (v/v). The plates were covered and placed in a THERMODYNE incubator (Thermodyne Corp, Newtown Square Pa.) at 37° C. for 8–10 hours prior to use. Plasmid DNA was released from the cells and amplified using direct link PCR (Rao, V. B. (1994) Anal. Biochem. 216:1–14) as follows. The direct link PCR solution included 30 ml of NUCLEIX PLUS PCR nucleotide mix (Amersham Pharmacia Biotech) and 300 $\mu$l of Taq DNA polymerase (Amersham Pharmacia Biotech) with or without 12 $\mu$l Pfu DNA polymerase (Stratagene). Five microliters of the PCR solution were added to each of the 384 wells using the Hydra-96 microdispenser (Hamilton, Reno NV); plates were centrifuged at 1000 rpm for 20 seconds and refrigerated until use. A 384 pin tool (V&P Scientific, San Diego Calif.) was used to transfer bacterial cells from the incubation plate into the plate containing the PCR solution where the component 0.1% Tween 20 (polyoxyethylene(20)sorbitan monolaurate) caused the cells to undergo lysis and release the plasmid DNA. After lysis, the plates were centrifuged up to 500 rpm, covered with a cycle sealer, and cycled using a 384-well Peltier Thermal Cycler (PCT-200; MJ Research, Watertown Mass.) using the program dPCR30 with the following parameters: Step 1) 95° C., 1 minute; Step 2) 94° C., 30 seconds; Step 3) 55° C., 30 seconds; Step 4) 72° C., 2 minutes; Step 5) steps 2, 3, and 4 repeated 29 times; Step 6) 72° C., 10 minutes; and Step 7) storage at 4° C.

The concentration of DNA in each well was determined by dispensing 100 μl PICOGREEN quantitation reagent (Molecular Probes, Eugene Oreg.) (0.25% reagent dissolved in 10 mM TrisHCl, pH 7.5, 1 mM ethylenediamine tetraacetic acid (EDTA) (1×TE, v/v), and 0.5 μl of undiluted PCR product into each well of an opaque fluorimeter plate (Corning Costar, Acton Mass.) and allowing the DNA to bind to the reagent. The plate was scanned in a Fluoroskan II (Labsystems Oy, Helsinki, Finland) to measure the fluorescence of the sample and to quantify the concentration of DNA.

The cDNAs were prepared and sequenced by the method of Sanger, F. and A. R. Coulson (1975; J. Mol. Biol. 94:441–448), using either a MICROLAB 2200 system (Hamilton) or a HYDRA microdispenser (Robbins Scientific, Sunnyvale Calif.) in combination with PTC-200 cyclers (MJ Research) and ABI PRISM 377 DNA sequencing systems (Perkin Elmer). Most of the isolates were sequenced according to standard PE protocols and kits (Cat. #79345, 79339, 79340, 79357, 79355). The solution volumes were used at 0.25×–10×concentrations. In the alternative, cDNAs may have been sequenced using solutions and dyes from Amersham Pharmacia Biotech.

IV Homology Searching of cDNA Clones and their Deduced Proteins

After the reading frame was determined, the nucleotide sequences of the Sequence Listing or their deduced amino acid sequences were queried against databases such as GenBank, SwissProt, BLOCKS, and Pima II. These databases which contain annotated sequences were searched for regions of homology (similarity) using BLAST (Altschul (1993) supra; Altschul (1990) supra).

BLAST produced alignments of both nucleic and amino acid sequences to determine sequence similarity. Because of the local nature of the alignments, BLAST was especially useful in determining exact matches or in identifying homologs of viral, prokaryotic, or eukaryotic origin. Other algorithms such as the one described in Smith, T. F. (1992; Protein Engineering 5:35–51) could have been used to deal with primary sequence patterns and secondary structure gap penalties. The sequences disclosed in this application have lengths of at least 49 nucleotides, and no more than 12% uncalled bases (where N is recorded rather than A, C, G, or T).

SATMON022 and SATMON023 nucleotide sequences were searched, as described in Karlin (supra), against the GenBank plant (pin) and eukaryote (eukp) databases, and deduced amino acid sequences from the same clones were then searched against GenBank functional protein databases (allp). The relevant database for a particular match was reported in column 5 of TABLE 1. In TABLE 1 column 3, the product score is calculated as follows: the % nucleotide or amino acid identity [between the query and reference sequences] in BLAST is multiplied by the % maximum possible BLAST score [based on the lengths of query and reference sequences] and then divided by 100. In an analogy to the hybridization procedures used in the laboratory, the electronic stringency for an exact match was set at 70, and the conservative lower limit for an exact match was set at approximately 40 (with 1–2% error due to uncalled bases). Column 4 provides log-likelihood where the value=log (probability÷threshold) and the threshold for exact matches was set at $10^{-25}$ for nucleotides and $10^{-14}$ for peptides. Column 6 contains a GenBank description of the protein; some of the GenBank descriptions were standardized with respect to abbreviations and spelling.

V Gene Transcript Analysis

The abundance sort program of the invention described in U.S. Pat. No. 5,840,484 entitled "Comparative Gene Transcript Analysis", incorporated herein by reference, tabulates and sorts by frequency the mRNA transcripts corresponding to each gene identified in a database. The process for obtaining this data set, the profile of corn ear gene activity or transcript image, is referred to as "gene transcript analysis".

A transcript analysis summarizes the presence and abundance of exact, unique, and homologous transcripts which are ear specific. A transcript image may be assembled using TABLE 1, TABLE 2, and the Sequence Listing. Such a collection of sequences is used to characterize minimally active, active, or highly active cdps. Comparisons among normal, diseased, or immature ear are used to identify those sequences of particular use in predicting yield or in recovering regulatory elements to be used in vectors for genetic engineering. The entire set, or a selected subset, of ear-specific, unique, or homologous cDNAs may be useful in membrane-based or PCR-based diagnostic technologies.

VI Library Comparisons, Subsetting

LIFESEQ database (Incyte Pharmaceuticals) software is used to compare sets of transcript images for PHYTOSEQ database (Incyte Pharmaceuticals) cDNA libraries. The cdps are filtered by selecting desired values for relative abundance, stringency, and/or product score (described infra). For any particular library, only the subset of cdps that meet the selected values is included in the comparison. Additional filters, such as those to exclude common genes, such as ribosomal proteins, elongation factor, etc. may be used in the search operation. The subsetting of thousands of corn sequences from the transcript images of callus, ear, embryo, endosperm, leaf, meristem, root, seed, seedling, stem, and tassel libraries is used to identify cdps which are of interest.

VII Extension of CDNA Sequences

The nucleic acid sequence was extended using an Incyte cDNA clone and oligonucleotide primers. One primer was synthesized to initiate 5' extension of the known fragment, and the other, to initiate 3' extension of the known fragment. The initial primers were designed using OLIGO 4.06 software (National Biosciences), or another appropriate program, to be about 22 to 30 nucleotides in length, to have a GC content of about 50% or more, and to anneal to the target sequence at temperatures of about 68° C. to about 72° C. Any stretch of nucleotides which would result in hairpin structures and primer-primer dimerizations was avoided.

Selected plant cDNA libraries were used to extend the sequence. If more than one extension was necessary or desired, additional or nested sets of primers were designed. Preferred libraries are ones that have been size-selected to include larger cDNAs. Also, random primed libraries are preferred because they will contain more sequences with the 5' and upstream regions of genes. A randomly primed library may be particularly useful if an oligo d(T) library does not yield a full-length cDNA. Genomic libraries are useful for extension 5' of the promoter binding region in obtaining regulatory elements.

High fidelity amplification was obtained by PCR using methods well known in the art. PCR was performed in 96-well plates using the PTC-200 cycler (MJ Research). The reaction mix contained DNA template, 200 nmol of each primer, reaction buffer containing $Mg^{2-}$, $(NH_4)_2SO_4$, and β-mercaptoethanol, Taq DNA polymerase (Amersham Pharmacia Biotech), ELONGASE enzyme (Life Technologies), and Pfu DNA polymerase (Stratagene), with the following parameters for primer pair PCI A and PCI B: Step 1: 94° C., 3 min; Step 2: 94° C., 15 sec; Step 3: 60° C., 1 min; Step 4: 68° C., 2 min; Step 5: Steps 2, 3, and 4 repeated 20 times; Step 6: 68° C., 5 min; Step 7: storage at 4° C. In the alternative, the parameters for primer pair T7 and SK+ were as follows: Step 1: 94° C., 3 min; Step 2: 94° C., 15 sec; Step 3: 57° C., 1 min; Step 4: 68° C., 2 min; Step 5: Steps 2, 3, and 4 repeated 20 times; Step 6: 68° C., 5 min; Step 7: storage at 4° C.

The concentration of DNA in each well was determined by dispensing 100 μl PICOGREEN quantitation reagent (0.25% v/v; Molecular Probes) dissolved in 1×TE and 0.5 μl of undiluted PCR product into each well of an opaque fluorimeter plate (Corning Costar, Acton Mass.) and allowing the DNA to bind to the reagent. The plate was scanned in a Fluoroskan II (Labsystems Oy) to measure the fluorescence of the sample and to quantify the concentration of DNA. A 5 μl to 10 μl aliquot of the reaction mixture was analyzed by electrophoresis on a 1% agarose mini-gel to determine which reactions were successful in extending the sequence.

The extended nucleotides were desalted and concentrated, transferred to 384-well plates, digested with CviJI cholera virus endonuclease (Molecular Biology Research, Madison Wis.), and sonicated or sheared prior to religation into pUC18 vector (Amersham Pharmacia Biotech). For shotgun sequencing, the digested nucleotides were separated on low concentration (0.6 to 0.8%) agarose gels, fragments were excised, and agar digested with AGARACE enzyme (Promega, Madison Wiss.). Extended clones were religated using T4 DNA ligase (New England Biolabs, Beverly Mass.) into pUC18 vector (Amersham Pharmacia Biotech), treated with Pfu DNA polymerase (Stratagene) to fill-in restriction site overhangs, and transfected into competent *E. coli* cells. Transformed cells were selected on antibiotic-containing media, and individual colonies were picked and cultured overnight at 37° C. in 384-well plates in LB/2× carbenicillin liquid media.

The cells were lysed, and DNA was amplified by PCR using Taq DNA polymerase (Amersham Pharmacia Biotech) and Pfu DNA polymerase (Stratagene) with the following parameters: Step 1: 94° C., 3 min; Step 2: 94° C., 15 sec; Step 3: 60° C., 1 min; Step 4: 72° C., 2 min; Step 5: steps 2, 3, and 4 repeated 29 times; Step 6: 72° C., 5 min; Step 7: storage at 4° C. DNA was quantified using PICOGREEN reagent (Molecular Probes) as described above. Samples with low DNA recoveries were reamplified using the same conditions described above.

Samples were diluted with 20% dimethylsulfoxide (DMSO) (1:2, v/v), and sequenced using DYENAMIC energy transfer sequencing primers and the DYENAMIC DIRECT cycle sequencing kit (Amersham Pharmacia Biotech) or the ABI PRISM BIGDYE Terminator cycle sequencing kit (Perkin-Elmer).

VIII Labeling of Probes and Hybridization Analyses

Target nucleic acids are isolated from a biological source and applied to a substrate suitable for standard nucleic acid hybridization protocols by one of the following methods. A mixture of target nucleic acids, a restriction digest of genomic DNA, is fractionated by electrophoresis through an 0.7% agarose gel in 1×TAE (40 mM Tris acetate, ~pH 8.5, 2 mM EDTA) running buffer and transferred to a nylon membrane by capillary transfer using 20×saline sodium citrate (SSC). Alternatively, the target nucleic acids are individually ligated to a vector and inserted into bacterial host cells to form a library. Target nucleic acids are then arranged on a substrate by one of the following methods. In the first method, bacterial cells containing individual clones are robotically picked and arranged on a nylon membrane. The membrane is placed on bacterial growth medium, LB agar containing carbenicillin, and incubated at 37° C. for 16 hours. Bacterial colonies are denatured, neutralized, and digested with proteinase K. Nylon membranes are exposed to UV irradiation in a STRATALINKER UV-crosslinker (Stratagene) to cross-link DNA to the membrane.

In the second method, target nucleic acids are amplified from bacterial cells by thirty cycles of PCR using primers complementary to vector sequences flanking the insert. Amplified target nucleic acids are purified using SEPHACRYL-400 (Amersham Pharmacia Biotech). Purified target nucleic acids are robotically arrayed onto a glass microscope slide (Corning Science Products, Corning N.Y.). The slide was previously coated with 0.05% aminopropyl silane (Sigma-Aldrich, St. Louis Mo.) and cured at 110° C. The arrayed glass slide (microarray) is exposed to UV irradiation in a STRATALINKER UV-crosslinker (Stratagene).

Probe Preparation cDNA probes are made from mRNA templates. Five micrograms of mRNA is mixed with 1 μg random primer (Life Technologies), incubated at 70° C. for 10 minutes, and lyophilized. The lyophilized sample is resuspended in 50 μl of 1×first strand buffer (cDNA synthesis system; Life Technologies) containing a dNTP mix, [α-$^{32}$P]dCTP, dithiothreitol, and MMLV reverse transcriptase (Stratagene), and incubated at 42° C. for 1–2 hours. After incubation, the probe is diluted with 42 μl dH$_2$O, heated to 95° C. for 3 minutes, and cooled on ice. mRNA in the probe is removed by alkaline degradation. The probe is neutralized, and degraded mRNA and unincorporated nucleotides are removed using a PROBEQUANT G-50 Micro Column (Amersham Pharmacia Biotech). Probes can be labeled with fluorescent markers, Cy3-dCTP or Cy5-dCTP (Amersham Pharmacia Biotech), in place of the radionuclide [$^{32}$P]dCTP.

Hybridization

Hybridization is carried out at 65° C. in a hybridization buffer containing 0.5 M sodium phosphate (pH 7.2), 7% SDS, and 1 mM EDTA. After the blot is incubated in hybridization buffer at 65° C. for at least 2 hours, the buffer is replaced with 10 ml of fresh buffer containing the probe. After incubation at 65° C. for 18 hours, the hybridization buffer is removed, and the blot is washed sequentially under increasingly stringent conditions, up to 40 mM sodium phosphate, 1% SDS, 1 mM EDTA at 65° C. To detect signal produced by a radiolabeled probe hybridized on a membrane, the blot is exposed to a PHOSPHORIMAGER cassette (Molecular Dynamics, Sunnyvale Calif.), and the image is analyzed using IMAGEQUANT data analysis software (Molecular Dynamics). To is detect signals produced by a fluorescent probe hybridized on a microarray, the blot is examined by confocal laser microscopy, and images are collected and analyzed using GEMTOOLS gene expression analysis software (Incyte Pharmaceuticals).

X Restriction Fragment Length Polymorphisms

Restriction fragment length polymorphisms (RFLPs) are created by using one or more restriction enzymes to cut DNA into fragments at specific recognition sites. The fragments and molecular size standards are separated using gel electrophoresis. Ethidium bromide staining is used to reveal the fragments under UV (260 nm) illumination. Fragment size differences between samples result from mutations or sequence rearrangements within restriction enzyme recognition sites. RFLP markers are selected by examining these differences (Paterson, A. H. et al. (1988) Nature 335:721–726). Alternative DNA fragments include RAPDs (Welsh, J. and McClelland, M. (1990) Nucleic Acids Res. 18:7213–7218), microsatellites (also called simple sequence repeats; Akkaya, M. S. et al. (1992) Genetics 132:1131–1139) or amplified fragment length polymorphisms (AFLPS; Nandi, S. et al. (1997); Mol. Gen. Genet. 255:1–8). Any of these DNA fragments may be mapped onto a chromosomal map, and all are chosen and used to study multigene traits or quantitative trait loci (QTL) at the intraspecific level or among closely related taxa.

XI Peptide Expression

Expression of a corn peptide is accomplished by transforming the multifunctional vector, PSPORT (Life Technologies) or PINCY (Incyte Pharmaceuticals), containing the sequence encoding the peptide into E. coli. A transfected colony is cultured and induced with isopropyl beta-D-thiogalactopyranoside (IPTG) using standard methods. The signal sequence resident in the vector directs the secretion of the peptide into the bacterial growth media. Purification of the peptide using polyacrylamide gel electrophoresis will provide peptide for antibody induction or for use in various assays.

XII Production of Antibodies

The amino acid sequence encoded by a cdp is analyzed using LASERGENE Navigator (DNASTAR) to determine regions of high immunogenicity. An oligopeptide of about 15 residues is synthesized using a Peptide Synthesizer Model 431A (Perkin Elmer) using Fmoc-chemistry and coupled to KLH (Sigma-Aldrich) by reaction with M-maleimidobenzoyl-N-hydroxysuccinimide ester (Ausubel, supra). If necessary, a cysteine may be introduced at the N-terminus of the oligopeptide to permit coupling to KLH. Rabbits are immunized with the oligopeptide-KLH complex in complete Freund's adjuvant. The resulting antisera are tested for antipeptide activity, for example, by binding the peptide to plastic, blocking with 1% BSA, reacting with rabbit antisera, washing, and reacting with radioiodinated goat anti-rabbit IgG.

XIII Two-Hybrid Screen

A yeast two-hybrid system such as MATCHMAKER LexA Two-Hybrid system (Clontech Laboratories, Palo Alto Calif.) is used to screen for peptides which bind CDPs. A nucleotide encoding a CDP is inserted into the multiple cloning site of a pLexA vector, ligated, and transformed into E. coli. cDNA, prepared from mRNA, is directionally inserted into the multiple cloning site of a pB42AD vector, ligated, and transformed into E. coli to construct a cDNA library. The pLexA plasmid and pB42AD-cDNA library constructs are isolated from E. coli and used in a 2:1 ratio to co-transform competent yeast EGY48[p8op-lacZ] using a polyethylene glycol/lithium acetate protocol. The transformed yeast cells are plated on synthetic dropout (SD) media lacking histidine (-His), tryptophan (-Trp), and uracil (-Ura), and incubated at 30° C. until colonies may be easily counted. The colonies are pooled in a minimal volume of 1×TE (pH 7.5), replated on SD/-His/-Leu/-Trp/-Ura media supplemented with 2% galactose (Gal), 1% raffinose (Raf), and 80 mg/ml X-Gal (X-Gal), and subsequently examined for growth of blue colonies. Interaction between expressed CDP and cDNA fusion proteins activates expression of a LEU2 reporter gene in EGY48 and produces colony growth on media lacking leucine (-Leu). Interaction also activates expression of β-galactosidase from the p8ops-lacZ reporter construct which produces blue color in colonies grown on X-Gal.

Positive interactions between expressed CDP and cDNA fusion proteins can be verified by isolating individual positive colonies and growing them in SD/-Trp/-Ura liquid medium for 1–2 days at 30° C. A sample of the culture is plated on SD/-Trp/-Ura media and incubated at 30° C. until colonies appear. A sample of 20–30 colonies is identically arranged on SD/-Trp/-Ura and SD/-His/-Trp/-Ura plates. Colonies that grow on SD containing histidine but not on media lacking histidine have lost the pLexA plasmid. The histidine-requiring colonies are grown on SD/Gal/Raf/X-Gal/-Trp/-Ura, and white colonies are isolated and propagated. The pB42AD-cDNA plasmid, which contains a polynucleotide encoding a protein which physically interacts with a CDP, can be isolated from the yeast cells and characterized.

XIV Significant Sequences and their Uses

The biological activity of polypeptides encoded by the cdps is based in part on a comparison between nucleic acid sequences in the Sequence Listing and reference or homologous sequences from GenBank which encode polypeptides of known function or activity. The biological properties and potential uses of polypeptides encoded by the cdps are based in part upon the biological properties of their known homologs.

Incyte Clone No. 700350393H1 is a nonexact homolog of GenBank GI No. 829147, which encodes a maize gene for cyclophilin (Marivet, J., et al. (1995) Mol Gen Genet 247:222–228).

Cyclophilins are ubiquitous proteins, expressed at a basal level in all plant tissues, that are believed to play a role in protein folding (Marivet, J. et al. (1994) Plant Mol. Biol. 26:1181–1189). In maize, amounts of cyclophilin (Cpy) mRNA above the basic level are observed in germinating seedlings, meristematic tissues of young plants, embryonic female inflorescences, and nodes, and internodes of adult plants. Salicylic acid (SA) enhances the transcription of maize Cyp genes which are known to be induced by heat shock, and salt, cold, and abiotic stress. Marivet et al. isolated a maize Cyp genomic clone using a maize Cyp cDNA probe. This Cyp clone, containing 737 bp of the 5' upstream and the entire coding region, was not interrupted by intervening sequences. In the 5' upstream region, the authors identified characteristic transcription signals as well as putative regulatory sequences. Two TATA boxes were found at positions −56 bp and −66 bp with respect to the transcription start site. Two putative heat shock elements were identified in the promoter region. A metal regulatory element and a third heat shock element were localized in the 5' untranslated leader. Several putative polyadenylation signals and (G)T-rich sequence motifs were identified in the 3' untranslated region.

Incyte Clone No. 700350393H1 is defined as a nonexact but functionally related homolog based on a product score of 22 and a log-likelihood value of −13 as shown in TABLE 1. Incyte Clone No. 700350393H1 can be used as a marker to follow inheritance in a corn breeding program or as an element in an array to monitor the effects of the application of agrichemicals.

All publications and patents mentioned in the above specification are herein incorporated by reference. Various modifications and variations of the described method and system of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the above-described modes for carrying out the invention which are obvious to those skilled in the field of molecular biology or related fields are intended to be within the scope of the following claims.

TABLE 1

LIST OF INCYTE CLONES DERIVED FROM SATMON022023
COPYRIGHT 1998 INCYTE PHARMACEUTICALS, INC.

| | | | | | |
|---|---|---|---|---|---|
| 700265096H1 | g2245126 | 8 | 16 | gb105pln | *Arabidopsis thaliana* DNA chromosome 4, ESSA I contig fragment No. 9. |
| 700262546H1 | g899607 | 74 | −60 | gb105pln | *Zea mays* polyubiquitin (MubC5) mRNA, complete cds. |
| 700260331H2 | g2149640 | 14 | 2 | gb105eukp | AGO1; leaf development; Argonaute protein |
| 700266987H1 | g2645165 | 58 | 1 | gb105pln | *Oryza sativa* mRNA, similar to ribosomal protein 41. |
| 700256853H1 | g1171351 | 24 | −4 | gb105pln | *Oryza sativa* 16 kDa oleosin (ole16) mRNA, complete cds. |
| 700264432H1 | g2688824 | 21 | 5 | gb105eukp | putative auxin-repressed protein |
| 700257081H1 | g433040 | 39 | −2 | gb105pln | *Zea mays* W-22 clone PREM-1A retroelement PREM-1, partial sequence. |
| 700262671H1 | g21492 | 20 | −3 | gb105pln | *S. tuberosum* mRNA for mitochondrial processing peptidase. |
| 700258849H1 | g2661421 | 30 | −26 | gb105pln | *Arabidopsis thaliana* mRNA for S-phase-specific ribosomal protein. |
| 700266522H1 | g2414402 | 25 | −8 | gb105eukp | Y57G11C.15 |
| 700265085H1 | g498913 | 26 | −26 | gb105pln | *Arabidopsis thaliana* Columbia glutamate-1-semialdehyde aminotransferase (gsa2) gene, complete cds. |
| 700267081H1 | g22312 | 65 | −32 | gb105pln | Maize ABA-inducible gene for glycine-rich protein (ABA = abscisic acid). |
| 700259547H1 | g7353 | 43 | 4 | gb105eukp | rp1024 protein |
| 700267427H1 | g541683 | 32 | −22 | gb105pln | *L. esculentum* (Ailsa Craig) mRNA for nucleoside diphosphate kinase. |
| 700264250H1 | g514945 | 50 | −61 | gb105pln | *Zea mays* sucrose synthase (Sus1) mRNA, complete cds. |
| 700263649H1 | g1498052 | 56 | 3 | gb105pln | *Zea mays* ribosomal protein S8 mRNA, complete cds. |
| 700263279H1 | g2218135 | 27 | −0 | gb105eukp | UDPGDH; UDP-glucose dehydrogenase |
| 700263168H1 | g162697 | 25 | −5 | gb105allp | argininosuccinate synthetase |
| 700262478H1 | g469069 | 5 | 7 | gb105allp | NMDA receptor subunit NR2D |
| 700267734H1 | g1301963 | 13 | 6 | gb105allp | ORF YNL075w |
| 700262520H1 | g1907367 | 18 | 10 | gb105pln | Taiwania cryptomerioides 28S ribosomal RNA gene, partial sequence. |
| 700264746H1 | g641971 | 11 | 6 | gb105allp | succinyl-CoA synthetase alpha chain |
| 700264369H1 | g400481 | 13 | 10 | gb105pln | *P. nudum* gene for phytochrome. |
| 700262056H1 | g22516 | 50 | −65 | gb105pln | Maize Zc2 gene for zein Zc2 (28 kD glutelin-2). |
| 700260476H1 | g1574937 | 21 | −52 | gb105pln | *Zea mays* superoxide dismutase 4 (sod4) gene, partial cds. |
| 700262348H1 | g603601 | 12 | −3 | gb105eukp | NTF2; Ntf2p: Nuclear Transport Factor 2 |
| 700263788H1 | g396209 | 44 | −45 | gb105pln | *S. polyrrhiza* mRNA for D-myo-inositol-3-phosphate synthase. |
| 700263545H1 | g22237 | 61 | 2 | gb105pln | Maize mRNA for cytosolic GAPDH (GapC) glyceraldehyde-3-phosphate dehydrogenase. |
| 700267323H1 | g722271 | 17 | 12 | gb105pln | *Brassica napus* chitinase class IV (LSC222) mRNA, partial cds. |
| 700262466H1 | g469067 | 4 | 6 | gb105allp | NMDA receptor subunit NR2D |
| 700262413H1 | g471320 | 37 | −38 | gb105pln | *H. vulgare* (cv. Bomi) B15C mRNA. |
| 700260386H2 | g728592 | 32 | 6 | gb105allp | aldose reductase |
| 700257965H1 | g556685 | 17 | 6 | gb105pln | *Z. mays* mRNA for ADP-ribosylation factor. |
| 700267358H1 | g2827142 | 27 | −29 | gb105pln | *Arabidopsis thaliana* cellulose synthase catalytic subunit (Ath-B) mRNA, complete cds. |
| 700261121H1 | g396209 | 22 | −0 | gb105pln | *S. polyrrhiza* mRNA for D-myo-inositol-3-phosphate synthase. |
| 700258174H1 | g2370511 | 14 | −2 | gb105eukp | SPAC2C6.14c; putative 40s ribosomal protein |
| 700259210H1 | g463856 | 15 | −4 | gb105pln | *Chlamydomonas reinhardtii* 21gr ribosomal protein S14 (CRY1) gene, complete cds. |
| 700258178H1 | g886470 | 58 | −51 | gb105pln | *C. roseus* MetE mRNA for methionine synthase. |
| 700257310H1 | g473602 | 63 | −47 | gb105pln | *Zea mays* W-22 histone H2A mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700267804H1 | g644491 | 83 | −82 | gb105pln | Corn mRNA for elongation factor 1A. |
| 700258418H1 | g998429 | 94 | −78 | gb105pln | GRF1 = general regulatory factor [Zea mays, XL80, Genomic, 5348 nt]. |
| 700257502H1 | g596079 | 56 | −27 | gb105pln | Zea mays thiamine biosynthetic enzyme (thil-2) mRNA, complete cds. |
| 700261382H1 | g2440204 | 7 | 6 | gb105eukp | SPAC7D4.10; hypothetical protein |
| 700258773H1 | g218178 | 35 | −39 | gb105pln | Rice OSA1 gene for H+-ATPase, complete cds. |
| 700265488H1 | g1212995 | 61 | −52 | gb105pln | H. vulgare mRNA for UDP-glucose pyrophosphorylase. |
| 700260329H1 | g2990 | 9 | 14 | gb105pln | Neurospora crassa crp-1 gene for ribosomal protein homologous to Yeast cyH2 gene encoding L29. |
| 700266106H1 | g19012 | 18 | −12 | gb105pln | H. vulgare mRNA for LEA B19.1 protein. |
| 700263169H1 | g168442 | 61 | −29 | gb105pln | Zea mays chitinase B (seed chitinase) gene, 3'end. |
| 700264429H1 | g1519252 | 21 | −30 | gb105pln | Oryza sativa GF14-d protein mRNA, complete cds. |
| 700264419H1 | g2345153 | 47 | −61 | gb105pln | Zea mays ribsomal protein S4 (rps4) mRNA, complete cds. |
| 700257443H2 | g940017 | 46 | −24 | gb105pln | Oryza sativa histone H3 gene, complete cds. |
| 700265824H1 | g2760173 | 25 | 16 | gb105pln | Arabidopsis thaliana genomic DNA, chromosome 5, P1 clone: MYH19, complete sequence. |
| 700264501H1 | g22155 | 31 | −31 | gb105pln | Z. mays mRNA for alpha-tubulin 5. |
| 700257104H1 | g1200160 | 26 | −9 | gb105pln | T. gesneriana mRNA for tonoplast intrinsic protein. |
| 700264221H1 | g459267 | 35 | −17 | gb105pln | Z. mays gene for HMG protein. |
| 700259420H1 | g458929 | 15 | −1 | gb105eukp | SUN1; Sunlp: Proteasome subunit |
| 700262740H1 | g1200282 | 8 | 4 | gb105eukp | F48F7.1 |
| 700259143H2 | g1262145 | 14 | −6 | gb105pln | S. oleracea mRNA for proteasome 37 kD subunit. |
| 700258359H1 | g471320 | 47 | −50 | gb105pln | H. vulgare (cv. Bomi) B15C mRNA. |
| 700262211H1 | g1171428 | 14 | −0 | gb105pln | Arabidopsis thaliana transcription factor CKC mRNA, complete cds. |
| 700266286H1 | g2465923 | 9 | 5 | gb105eukp | RKF1; receptor-like serine/threonine kinase |
| 700264438H1 | g248336 | 64 | −51 | gb105pln | polyubiquitin [maize, Genomic, 3841 nt]. |
| 700266447H1 | g22302 | 39 | −79 | gb105pln | Maize Gpcl gene for glyceraldehyde-3-phosphate dehydrogenase (GADPH) subunit C. |
| 700263282H1 | g22302 | 51 | −82 | gb105pln | Maize Gpcl gene for glyceraldehyde-3-phosphate dehydrogenase (GADPH) subunit C. |
| 700266886H1 | g20250 | 57 | −26 | gb105pln | Oryza sativa H3 histone gene H3R-11. |
| 700261384H1 | g1658312 | 18 | 8 | gb105pln | O. sativa osr40g2 gene. |
| 700265926H1 | g2809480 | 64 | −66 | gb105pln | Oryza sativa calmodulin (CaM2) mPNA, complete cds. |
| 700259530H1 | g1183936 | 19 | 14 | gb105pln | P. sativum 5S rRNA gene. |
| 700259477H1 | g687244 | 96 | −20 | gb105pln | Zea mays oil body protein 16 kDa oleosin (ole16) gene, complete cds. |
| 700263354H1 | g303834 | 32 | −39 | gb105pln | Rice mRNA for 21kd polypeptide, complete cds. |
| 700260708H1 | g22287 | 8 | 8 | gb105allp | vicilin-like embryo storage protein |
| 700266345H1 | g304109 | 32 | 2 | gb105eukp | PAB2; poly(A)-binding protein |
| 700264538H1 | g433706 | 97 | −90 | gb105pln | Z. mays PRP gene. |
| 700266775H1 | g1790876 | 11 | 8 | gb105allp | DNA gyrase subunit A |
| 700258885H1 | g168442 | 57 | −26 | gb105pln | Zea mays chitinase B (seed chitinase) gene, 3'end. |
| 700266485H1 | g396209 | 21 | −0 | gb105pln | S. polyrrhiza mRNA for D-myo-inositol-3-phosphate synthase. |
| 700262063H1 | g2664214 | 6 | 5 | gb105eukp | G2484-1; unknown |
| 700256791H1 | g2160155 | 18 | 6 | gb105pln | Sequence of BAC F21M12 from Arabidopsis thaliana chromosome 1, complete sequence. |
| 700257239H1 | g2583106 | 46 | −1 | gb105pln | Arabidopsis thaliana chromosome II BAC F4L23 genomic sequence, |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | complete sequence. |
| 700267437H1 | g1263160 | 10 | −2 | gb105eukp | lrk2; leucine-rich repeat/receptor protein kinase |
| 700260125H1 | g22283 | 43 | −70 | gb105pln | *Zea mays* Glb1-L gene for vicilin-like embryo storage protein. |
| 700256924H1 | g168481 | 7 | 8 | gb105allp | globulin precursor |
| 700266572H1 | g168512 | 45 | −35 | gb105pln | Maize major protein (L3) mRNA from the surface of lipid bodies, 3' end. |
| 700261613H1 | g20255 | 77 | −73 | gb105pln | *O. sativa* gene for heat shock protein 82 HSP82. |
| 700264514H1 | g927238 | 52 | −69 | gb105pln | *Zea mays* globulin1 (Glb1) gene, allele Glb1-Hb, complete cds. |
| 700262981H1 | g22272 | 77 | −57 | gb105pln | Maize mRNA for enolase (2-phospho-D-glycerate hydrolase). |
| 700258559H1 | g1938575 | 16 | 8 | gb105eukp | B0025.3 |
| 700267652H1 | g1321660 | 21 | 7 | gb105pln | Rice mRNA for ascorbate peroxidase, complete cds. |
| 700267424H1 | g1171351 | 13 | 10 | gb105pln | *Oryza sativa* 16 kDa oleosin (ole16) mRNA, complete cds. |
| 700267210H1 | g2330761 | 6 | 6 | gb105eukp | SPAC20G4.05c; hypothetical protein |
| 700258641H1 | g473976 | 50 | −36 | gb105pln | Rice mRNA, partial homologous to elongation factor 1-alpha gene. |
| 700257364H1 | g2267592 | 41 | −23 | gb105pln | *Oryza sativa* glycine-rich RNA-binding protein mRNA, complete cds. |
| 700267426H1 | g21832 | 41 | −29 | gb105pln | Wheat mRNA for chloroplast phosphoglycerate kinase (EC 2.7.2.3). |
| 700259382H1 | g687244 | 39 | −67 | gb105pln | *Zea mays* oil body protein 16 kDa oleosin (ole16) gene, complete cds. |
| 700266364H1 | g596079 | 64 | −56 | gb105pln | *Zea mays* thiamine biosynthetic enzyme (thil-2) mRNA, complete cds. |
| 700266638H1 | g683503 | 49 | −42 | gb105pln | *A. thaliana* mRNA for 65 kDa regulatory subunit of protein phosphatase 2A. |
| 700262516H1 | g468040 | 42 | −16 | gb105eukp | Smc2p |
| 700258440H1 | g1575127 | 78 | −2 | gb105pln | *Zea mays* lumenal binding protein cBiPe2 mRNA, complete cds. |
| 700266507H1 | g325 | 13 | 3 | gb105allp | initiation factor 2 alpha |
| 700264542H1 | g2739376 | 40 | 6 | gb105eukp | T9J22.18; putative permease |
| 700261132H1 | g687244 | 39 | −67 | gb105pln | *Zea mays* oil body protein 16 kDa oleosin (ole16) gene, complete cds. |
| 700259694H1 | g2341060 | 36 | −24 | gb105pln | *Zea mays* translational initiation factor eIF-4A (tif-4A3) mRNA, complete cds. |
| 700265936H1 | g886737 | 40 | −33 | gb105pln | *Z. mays* histone H3 gene. |
| 700261217H1 | g2588887 | 13 | −4 | gb105pln | *Citrus unshiu* mRNA for sucrose-phosphate synthase, complete cds. |
| 700258504H1 | g1754994 | 66 | −58 | gb105pln | *Triticum aestivum* calmodulin TaCaM1-3 mRNA, complete cds. |
| 700258054H1 | g2570342 | 24 | −8 | gb105eukp | Glx2-2; glyoxalase II cytoplasmic isozyme; EC 3.1.2.6 |
| 700262010H1 | g168460 | 76 | −68 | gb105pln | *Zea mays* cyclophilin (CyP) mRNA, complete cds. |
| 700258684H1 | g2464935 | 10 | −1 | gb105eukp | serine C-palmitoyltransferase homolog |
| 700256812H1 | g1296954 | 30 | −15 | gb105pln | *O. sativa* mRNA for novel protein, osr40cl. |
| 700263361H1 | g1532047 | 16 | 15 | gb105pln | *O. sativa* mRNA for S-adenosylmethionine decarboxylase. |
| 700268095H1 | g927238 | 58 | −21 | gb105pln | *Zea mays* globulin1 (Glb1) gene, allele Glb1-Hb, complete cds. |
| 700258296H1 | g168512 | 16 | −17 | gb105pln | Maize major protein (L3) mRNA from the surface of lipid bodies, 3' end. |
| 700257936H1 | g927238 | 35 | −47 | gb105pln | *Zea mays* globulin1 (Blb1) gene, allele Glb1-Hb, complete cds. |
| 700258610H1 | g297798 | 28 | −21 | gb105eukp | mitochondrial formate dehydrogenase precursor; EC 1.2.1.2 |
| 700265395H1 | g287398 | 18 | 4 | gb105pln | Rice mRNA for a protein related to chilling tolerance. |
| 700260585H2 | g1403024 | 19 | −3 | gb105eukp | hnRNP protein |
| 700267784H1 | g596079 | 53 | −43 | gb105pln | *Zea mays* thiamine biosynthetic enzyme (thil-2) mRNA, complete cds. |
| 700263829H1 | g1321660 | 73 | −24 | gb105pln | Rice mRNA for ascorbate peroxidase, complete cds. |
| 700258640H1 | g550543 | 41 | −31 | gb105pln | *A. thaliana* mRNA for ribosomal protein L16. |
| 700257578H1 | g1431138 | 26 | 5 | gb105eukp | ORF YDL100c |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700266350H1 | g1293783 | 61 | −61 | gb105pln | *Oryza sativa* QM gene, complete cds. |
| 700259493H1 | g17931 | 63 | −5 | gb105pln | *B. secalinas* embryo-specific mRNA. |
| 700258893H1 | g20598 | 54 | −48 | gb105pln | *P. miliaceum* mRNA for aspartate aminotransferase (pcAAT2) |
| 700258167H1 | g2760173 | 36 | −21 | gb105pln | *Arabidopsis thaliana* genomic DNA, chromosome 5, Pl clone: MYH19, complete sequence. |
| 700268190H1 | g21834 | 61 | −58 | gb105pln | Wheat mRNA for cytosolic phosphoglycerate kinase (EC 2.7.2.3). |
| 700267115H1 | g2330786 | 26 | 4 | gb105eukp | SPAC24C9.03; diphosphomevalonate decarboxylase |
| 700262491H1 | g471320 | 37 | −17 | gb105pln | *H. vulgare* (cv. Bomi) B15C mRNA. |
| 700257089H1 | g22270 | 79 | −65 | gb105pln | Maize mRNA from an embryogenic abscisic acid-inducible gene. |
| 700263857H1 | g416144 | 42 | −19 | gb105pln | *Zea mays* beta-4 tubulin (tub4) mRNA, complete cds. |
| 700259354H1 | g1403043 | 64 | −59 | gb105pln | *H. chilense* × *T. turgidum* conv. durum (Tritordeum) mRNA for S-adenosylmethionine decarboxylase. |
| 700207155H1 | g2505870 | 57 | −6 | gb105eukp | hypothetical protein |
| 700265131H1 | g1149570 | 45 | −36 | gb105pln | *A. thaliana* mRNA for mitochondrial elongation factor Tu. |
| 700264429H1 | g1519248 | 12 | −1 | gb105pln | *Oryza sativa* GF14-b protein mRNA, complete cds. |
| 700266354H1 | g790640 | 16 | 6 | gb105pln | *Hordeum vulgare* gamma-thionin (HTH3) mRNA, complete cds. |
| 700257089H1 | g19016 | 25 | −4 | gb105pln | *H. vulgare* mRNA for LEA B19.4 protein. |
| 700266252H1 | g1575129 | 71 | −87 | gb105pln | *Zea mays* lumenal binding protein cBiPe3 mRNA, complete cds. |
| 700260555H2 | g2459410 | 16 | −0 | gb105eukp | F4P9.4; putative thioredoxin |
| 700266350H1 | g468055 | 78 | −74 | gb105pln | *Zea mays* B73 QM protein mRNA, complete cds. |
| 700268042H1 | g2213600 | 12 | 3 | gb105eukp | T7N9.20 |
| 700257261H1 | g687244 | 46 | −14 | gb105pln | *Zea mays* oilbody protein 16 kDa oleosin (ole16) gene, complete cds. |
| 700258053H1 | g644492 | 70 | −55 | gb105pln | Corn elongation factor 1alpha gene, complete cds. |
| 700256838H1 | g1531764 | 12 | 13 | gb105pln | *D. stramonium* mRNA for S-adenosylmethionine decarboxylase. |
| 700258445H1 | g22144 | 72 | −70 | gb105pln | Maize anaerobically regulated gene for fructose bisphosphate aldolase (EC 4.1.2.13). |
| 700267570H1 | g22287 | 7 | 8 | gb105allp | vicilin-like embryo storage protein |
| 700263464H1 | g1839582 | 39 | 16 | gb105pln | polyubiquitin homolog {clone CHEM 6} [*Zea mays* = maize, cv. INRA 258, mercuric chloride-treated, leaves, mRNA Partial, 199 nt, segment 1 of 2]. |
| 700266496H1 | g687244 | 75 | −8 | gb105pln | *Zea mays* oil body protein 16 kDa oleosin (ole16) gene, complete cds. |
| 700263918H1 | g2244827 | 24 | −8 | gb105eukp | hypothetical protein |
| 700265839H1 | g1675393 | 16 | −27 | gb105pln | *Oryza sativa* class III ADH enzyme (AdhIII) gene, complete cds. |
| 700262336H1 | g887594 | 57 | −33 | gb105eukp | unknown |
| 700265096H1 | g2245131 | 21 | −11 | gb105eukp | hypothetical protein |
| 700263845H1 | g1421750 | 24 | −0 | gb105pln | *Pisum sativum* S-adenosylmethionine decarboxylase mRNA, complete cds. |
| 700261150H1 | g1694832 | 26 | −41 | gb105pln | *H. vulgare* Per1 gene. |
| 700265232H1 | g551287 | 93 | −40 | gb105pln | *Z. mays* (W22) phosphoglycerate mutase gene (exon 1) |
| 700259020H1 | g1354469 | 27 | −0 | gb105eukp | U1 snRNP 70K protein |
| 700267453H1 | g217366 | 9 | 8 | gb105eukp | Hgv2; Hgv2 |
| 700263536H1 | g22324 | 72 | −42 | gb105pln | *Z. mays* mRNA for H2B histone (clone cH2B221) |
| 700263233H1 | g687244 | 81 | −26 | gb105pln | *Zea mays* oil body protein 16 kDa oleosin (ole16) gene, complete cds. |
| 700263107H1 | g22292 | 82 | −16 | gb105pln | *Z. mays* mRNA for glycine-rich protein. |
| 700263613H1 | g2282583 | 49 | −54 | gb105pln | *Zea mays* elongation factor 1-alpha (EF1-A) mRNA, complete cds. |
| 700263712H1 | g1403043 | 15 | 12 | gb105pln | *H. chilense* × *T. turgidum* conv. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | durum (Tritordeum) mRNA for S-adenosylmethionine decarboxylase. |
| 700266830H1 | g168512 | 25 | −13 | gb105pln | Maize major protein (L3) mRNA from the surface of lipid bodies, 3' end. |
| 700265524H1 | g2462931 | 23 | 8 | gb105allp | UDP-glucose:sterol glucosyltransferase |
| 700258669H1 | g1770020 | 58 | −46 | gb105pln | *Oryza sativa* S-adenosyl-L-methionine synthetase (pOS-SAMS2) mRNA, complete cds. |
| 700264702H1 | g393400 | 73 | −69 | gb105pln | *Z. mays* mRNA for alpha-tubulin. |
| 700260128H1 | g22281 | 34 | −65 | gb105pln | *Zea mays* Glb1-0 gene for vicilin-like storage protein (truncated). |
| 700258962H1 | g2414402 | 27 | −14 | gb105eukp | Y57G11C.15 |
| 700257445H2 | g1050798 | 9 | 4 | gb105eukp | YCK2 |
| 700262413H1 | g971279 | 36 | −36 | gb105pln | Rice mRNA for RAB24 protein, complete cds. |
| 700256711H1 | g2245126 | 12 | 6 | gb105pln | *Arabidopsis thaliana* DNA chromosome 4, ESSA I contig fragment No. 9. |
| 700265615H1 | g415316 | 26 | −33 | gb105pln | Rice mRNA for acidic ribosomal protein P0, complete cds. |
| 700264065H1 | g1532047 | 37 | −9 | gb105pln | *O. sativa* mRNA for S-adenosylmethionine decarboxylase. |
| 700262329H1 | g1667593 | 41 | −46 | gb105pln | *Oryza sativa* transmembrane protein mRNA, complete cds. |
| 700264586H1 | g2832611 | 24 | −5 | gb105pln | *Arabidopsis thaliana* DNA chromosome 4, BAC clone F13C5 (ESSAII project). |
| 700258664H1 | g21953 | 15 | −2 | gb105eukp | Li; beta-glucosidase; EC 3.2.1.21; linamarase |
| 700266053H1 | g162469 | 3 | 7 | gb105eukp | VSG; variant surface glycoprotein |
| 700260676H1 | g436032 | 20 | 5 | gb105eukp | 60S ribosomal protein L34 |
| 700258006H1 | g2754859 | 38 | −42 | gb105pln | *Fragaria x ananassa* cytosolic ascorbate peroxidase (ApxSC) mRNA, complete cds. |
| 700257583H1 | g1419369 | 55 | −50 | gb105pln | *Z. mays* ZmABP3 mRNA for actin depolymerizing factor. |
| 700262326H1 | g2465430 | 20 | −3 | gb105eukp | JRG1.3; 32 kDa protein |
| 700260671H1 | g2662340 | 70 | −64 | gb105pln | *Oryza sativa* mRNA for EF-1 alpha, complete cds. |
| 700267741H1 | g1616658 | 23 | −11 | gb105pln | *Triticum aestivum* adenylosuccinate synthetase mRNA, partial cds. |
| 700268029H1 | g398921 | 24 | −20 | gb105pln | *B. napus* cold induced protein (BnC24B) |
| 700256875H1 | g47977 | 8 | 6 | gb105allp | ketoacyl reductase (AA 1-289) |
| 700258361H1 | g18501 | 14 | 8 | gb105eukp | D-34 Lea protein |
| 700266293H1 | g22287 | 7 | 8 | gb105allp | vicilin-like embryo storage protein |
| 700258606H1 | g217973 | 22 | −46 | gb105pln | *Zea mays* gene for triosephosphate isomerase, complete cds. |
| 700266435H1 | g474007 | 38 | −24 | gb105pln | Rice mRNA, partial homologous to ribosomal protein S12 gene. |
| 700257310H1 | g1322276 | 27 | −2 | gb105pln | *Triticum aestivum* histone H2A gene, complete cds. |
| 700258495H1 | g2511530 | 39 | −36 | gb105pln | *Eleusine indica* alpha tubulin 1 (TUA1) mRNA, complete cds. |
| 700263643H1 | g1262453 | 27 | −12 | gb105eukp | TpCCTeta; CCTeta |
| 700258052H1 | g1370438 | 7 | 6 | gb105eukp | ORF YPL211w |
| 700265735H1 | g1694832 | 33 | −48 | gb105pln | *H. vulgare* Perl gene. |
| 700264057H1 | g22283 | 61 | −79 | gb105pln | *Zea mays* Glb1-L gene for vicilin-like embryo storage protein. |
| 700261609H1 | g1531764 | 11 | 13 | gb105pln | *D. stramonium* mRNA for S-adenosylmethionine decarboxylase. |
| 700263744H1 | g22285 | 38 | −48 | gb105pln | *Zea mays* Glb1-S gene for vicilin-like embryo storage protein. |
| 700258176H1 | g644491 | 98 | −86 | gb105pln | Corn mRNA for elongation factor 1A. |
| 700257840H1 | g556685 | 45 | −12 | gb105pln | *Z. mays* mRNA for ADP-ribosylation factor. |
| 700263633H1 | g1498628 | 34 | −0 | gb105pln | *Arabidopsis thaliana* p40 protein homolog mRNA, complete cds. |
| 700262853H1 | g1841869 | 23 | 7 | gb105pln | *Pimpinella brachycarpa* elongation factor 1-beta (EF-1-beta) mRNA, complete cds. |
| 700266424H1 | g1212995 | 28 | −12 | gb105pln | *H. vulgare* mRNA for UDP-glucose pyrophosphorylase. |
| 700258046H1 | g168480 | 66 | −54 | gb105pln | Maize embryo globulin S allele |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | (7S-like) mRNA, complete cds. |
| 700258359H1 | g971279 | 44 | −46 | gb105pln | Rice mRNA for RAB24 protein, complete cds. |
| 700259444H1 | g416148 | 47 | −55 | gb105pln | *Zea mays* beta-7 tubulin (tub7) mRNA, complete cds. |
| 700258372H1 | g396209 | 19 | 9 | gb105pln | *S. polyrrhiza* mRNA for D-myo-inositol-3-phosphate synthase. |
| 700258294H1 | g927239 | 7 | 6 | gb105allp | globulin1 |
| 700257986H1 | g2662346 | 61 | −52 | gb105pln | *Oryza sativa* mRNA for EF-1 alpha, complete cds. |
| 700257080H1 | g295925 | 29 | 2 | gb105allp | ribosomal protein |
| 700264659H1 | g303852 | 25 | −37 | gb105pln | Rice mRNA for ribosomal protein L3, complete cds. |
| 700266772H1 | g2708531 | 24 | −10 | gb105pln | *Nicotiana tabacum* putative RNA binding protein (QRRBP-1) mRNA, partial cds. |
| 700264682H1 | g596077 | 23 | −27 | gb105pln | *Zea mays* thiamine biosynthetic enzyme (thil-1) mRNA, complete cds. |
| 700258143H1 | g395156 | 21 | −3 | gb105pln | Yeast (*Saccharomyces cerevisiae*) PRP8 gene, complete CDS. |
| 700257211H1 | g544506 | 18 | −4 | gb105eukp | SIK1; Sik1p |
| 700260523H2 | g416460 | 6 | 0 | gb105allp | unidentified protein |
| 700267657H1 | g393706 | 18 | −4 | gb105pln | *C. sativus* mRNA for 3-ketoacyl-CoA thiolase. |
| 700261173H1 | g509548 | 8 | 15 | gb105pln | Sorghum bicolor dehydrin (DHN1) mRNA, complete cds. |
| 700265470H1 | g170901 | 16 | −2 | gb105eukp | peroxisomal membrane protein (PMP20B) |
| 700261491H1 | g1513227 | 46 | −7 | gb105pln | *Brassica napus* myo-inositol 1-phosphate synthase mRNA, complete cds. |
| 700258610H1 | g1420835 | 12 | 1 | gb105eukp | ORF YOR388c |
| 700260421H1 | g687244 | 42 | −35 | gb105pln | *Zea mays* oil body protein 16 kDa oleosin (ole16) gene, complete cds. |
| 700264691H1 | g1865731 | 5 | 7 | gb105eukp | C25A1.9 |
| 700264619H1 | g2736285 | 46 | −32 | gb105pln | *Camptotheca acuminata* isopentenyl diphosphate isomerase I (IPI1) mRNA, complete cds. |
| 700262566H1 | g18140 | 12 | 11 | gb105pln | *C. rubrum* mRNA for light-induced 34 kD protein. |
| 700262137H1 | g168512 | 49 | −45 | gb105pln | Maize major protein (L3) mRNA from the surface of lipid bodies, 3' end. |
| 700260572H2 | g293886 | 37 | −32 | gb105pln | *Zea mays* glyceraldehyde-3-phosphate dehydrogenase mRNA, 3' end, (clone GAPC3). |
| 700258663H1 | g1171351 | 29 | −18 | gb105pln | *Oryza sativa* 16 kDa oleosin (ole16) mRNA, complete cds. |
| 700266441H1 | g633890 | 21 | 4 | gb105allp | glucose and ribitol dehydrogenase homolog [barley, *Hordeum vulgare*, Peptide, 293 aa] |
| 700267918H1 | g2529431 | 26 | 3 | gb105eukp | rpb10; RNA polymerases I-III common subunit Rpb10; EC 2.7.7.6 |
| 700264257H1 | g170772 | 56 | −22 | gb105pln | *Triticum aestivum* S-adenosyl-L-homocysteine hydrolase (SH6.2) mRNA, complete cds. |
| 700265542H1 | g22235 | 70 | −61 | gb105pln | Maize cat-3 mRNA for catalase-3 isoenzyme (EC 1.11.1.6). |
| 700264005H1 | g166866 | 37 | −2 | gb105pln | *A. thaliana* ribosomal protein S11 mRNA, 3' end. |
| 700260946H1 | g168679 | 61 | −79 | gb105pln | Maize 19 kDa zein mRNA, clone cZ19C2, complete cds. |
| 700264041H1 | g2244950 | 10 | 9 | gb105pln | *Arabidopsis thaliana* DNA chromosome 4, ESSA I contig fragment No. 5. |
| 700263710H1 | g2465430 | 18 | −4 | gb105eukp | JRG1.3; 32 kDa protein |
| 700258343H1 | g495021 | 13 | 1 | gb105eukp | DebB; membrane-associated protein |
| 700256801H1 | g587499 | 63 | −58 | gb105pln | *O. sativa* mRNA for calcium dependent protein kinase 11. |
| 700266239H1 | g2623620 | 59 | −33 | gb105eukp | PRP1; putative RNA helicase PRP1 |
| 700259472H1 | g2245113 | 11 | 3 | gb105eukp | glycerol-3-phosphate permease homolog |
| 700258538H1 | g2076715 | 13 | −1 | gb105eukp | SEC61; ER translocation; SEC61 protein |
| 700257653H1 | g602605 | 29 | −58 | gb105pln | *Zea mays* tandem genes for alpha1-tubulin and alpha2-tubulin. |
| 700266266H1 | g388052 | 92 | −88 | gb105pln | *Zea mays* alcohol dehydrogenase (Adh1-S) mRNA, complete cds. |
| 700262541H1 | g1848282 | 57 | −39 | gb105pln | Sorghum bicolor aldehyde |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | dehydrogenase (Dha1) mRNA, partial cds. |
| 700207116H1 | g398257 | 9 | 0 | gb105allp | Ribosomal protein L2 |
| 700262341H1 | g2827496 | 14 | 3 | gb105eukp | EG:30B8.1 |
| 700256926H1 | g22281 | 78 | −45 | gb105pln | *Zea mays* Glb1-0 gene for vicilin-like storage protein (truncated) |
| 700265559H1 | g2267005 | 49 | −32 | gb105pln | *Oryza sativa* endosperm lumenal binding protein (BiP) mRNA, complete cds. |
| 700265018H1 | g2351061 | 16 | −3 | gb105pln | *Arabidopsis thaliana* genomic DNA, chromosome 5, P1 clone: MAF19. |
| 700267343H1 | g1622938 | 37 | −18 | gb105pln | *Bromus secalinus* oleosin (ole16) mRNA, complete cds. |
| 700260591H2 | g12544 | 20 | 7 | gb105allp | chaperonin 60 |
| 700264559H1 | g1658314 | 34 | −8 | gb105pln | *O. sativa* osr40g3 gene. |
| 700258244H1 | g22468 | 97 | −58 | gb105pln | *Z. mays* mRNA for root-origin phosphoenolpyruvate carboxylase (PEPC) |
| 700266337H1 | g625147 | 96 | −85 | gb105pln | *Zea mays* protein disulfide isomerase (pdi) mRNA, complete cds. |
| 700266622H1 | g2677829 | 56 | −40 | gb105pln | *Prunus armeniaca* ribosomal protein L12 mRNA, complete cds. |
| 700262316H1 | g1289203 | 16 | 10 | gb105pln | *A. glutinosa* mRNA for thiazole biosynthetic enzyme. |
| 700261483H1 | g1546918 | 62 | −14 | gb105pln | *Z. mays* mRNA for translation initiation factor 5A. |
| 700263279H1 | g1518540 | 33 | −4 | gb105eukp | provides UDP-glucuronic acid for hemicellulose precursors; UDP-glucose dehydrogenase; EC 1.1.1.22 |
| 700263152H1 | g2992 | 25 | −10 | gb105pln | *Neurospora crassa* crp-1 mRNA for ribosomal protein homologous to Yeast cyH2 gene encoding L29. |
| 700256867H1 | g170775 | 58 | −52 | gb105pln | Wheat translation elongation factor 1 alpha-subunit (TEF1) mRNA, complete cds. |
| 700266447H1 | g1184771 | 86 | −81 | gb105pln | *Zea mays* glyceraldehyde-3-phosphate dehydrogenase GAPC2 (gpc2) mRNA, complete cds. |
| 700268140H1 | g1813335 | 17 | −2 | gb105eukp | pmm1; phosphomannomutase |
| 700263018H1 | g36053 | 13 | 5 | gb105allp | precursor |
| 700267579H1 | g459894 | 81 | −85 | gb105pln | *Zea mays* sus1 gene, complete cds. |
| 700264595H1 | g1902902 | 61 | −49 | gb105pln | *Oryza sativa* DNA for phospholipase D, complete cds. |
| 700261188H1 | g22149 | 70 | −78 | gb105pln | *Z. mays* mRNA for alpha-tubulin 3. |
| 700266685H1 | g2244950 | 24 | −39 | gb105pln | *Arabidopsis thaliana* DNA chromosome 4, ESSA I contig fragment No. 5. |
| 700265996H1 | g450548 | 70 | −67 | gb105pln | *O. sativa (pRSAM-1) gene* for S-adenosyl methionine synthetase. |
| 700262160H1 | g1486425 | 14 | 7 | gb105allp | BioA homologue |
| 700267856H1 | g1799937 | 16 | 1 | gb105allp | NIFU PROTEIN. |
| 700264548H1 | g1888357 | 25 | −14 | gb105eukp | orf16; alpha-mannosidase |
| 700262725H1 | g2266661 | 36 | −19 | gb105pln | *Hordeum vulgare* mRNA for 14-3-3 protein (Hv1433c) |
| 700259091H1 | g2182028 | 24 | −39 | gb105pln | *Oryza sp.* mRNA for shaggy-like kinase etha. |
| 700263725H1 | g21598 | 16 | 7 | gb105pln | *S. tuberosum* mRNA for UDP-glucose pyrophosphorylase. |
| 700267874H1 | g457708 | 20 | 1 | gb105pln | *S. oleracea* mRNA for protein kinase. |
| 700259357H1 | g548322 | 20 | −2 | gb105pln | *Stylosanthes humilis* cinnamyl alcohol dehydrogenase (CAD3) mRNA, complete cds. |
| 700260255H1 | g2342717 | 35 | −4 | gb105pln | *Arabidopsis thaliana* chromosome II BAC T14G11 genomic sequence, complete sequence. |
| 700263856H1 | g1136119 | 38 | −38 | gb105pln | *O. sativa* mRNA for alpha-tubulin (clone OSTA-111) |
| 700263208H1 | g2345153 | 80 | −41 | gb105pln | *Zea mays* ribsomal protein S4 (rps4) mRNA, complete cds. |
| 700262831H1 | g2642323 | 33 | −46 | gb105pln | *Zea mays* profilin (PRO4) mRNA, complete cds. |
| 700262326H1 | g2465426 | 20 | −3 | gb105eukp | JRG1.1; 32 kDa protein |
| 700266602H1 | g488614 | 25 | −3 | gb105pln | *A. thaliana* Chloroplast gsh1 mRNA for glutamate-cysteine ligase. |
| 700256863H1 | g1230697 | 17 | −20 | gb105eukp | YPR094W; Ypr094wp |
| 700267368H1 | g18591 | 38 | −8 | gb105eukp | GH3; auxin-responsive GH3 product |
| 700264780H1 | g1289203 | 28 | −9 | gb105pln | *A. glutinosa* mRNA for thiazole biosynthetic enzyme. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700265940H1 | g1067096 | 11 | 6 | gb105eukp | ZK637.14 |
| 700264850H1 | g777757 | 57 | −59 | gb105pln | Saccharum hybrid (clone SCUBI561) polyubiquitin mRNA, complete cds. |
| 700262161H1 | g1171351 | 15 | 13 | gb105pln | Oryza sativa 16 kDa oleosin (ole16) mRNA, complete cds. |
| 700262102H1 | g2204224 | 46 | 4 | gb105eukp | cleave terminal galactose residue; alpha-galactosidase; EC 3.2.1.22 |
| 700266666H1 | g798817 | 25 | −5 | gb105pln | A. thaliana mRNA for ribosomal protein L2. |
| 700259134H1 | g1890574 | 29 | 12 | gb105pln | H. vulgare mRNA for xyloglucan endotransglycosylase-like protein (XEA). |
| 700262491H1 | g971279 | 37 | −18 | gb105pln | Rice mRNA for RAB24 protein, complete cds. |
| 700207167H1 | g642243 | 23 | 12 | gb105pln | H. vulgare cdr29 gene. |
| 700262902H1 | g1561577 | 34 | −6 | gb105eukp | spermine synthase 1; EC 2.5.1.22 |
| 700261285H1 | g687244 | 31 | −77 | gb105pln | Zea mays oil body protein 16 kDa oleosin (ole16) gene, complete cds. |
| 700265748H1 | g2213606 | 12 | 16 | gb105pln | Genomic sequence for Arabidopsis thaliana BAC F21J9, complete sequence. |
| 700265495H1 | g22283 | 87 | −59 | gb105pln | Zea mays Gibi-L gene for vicilin-like embryo storage protein. |
| 700264502H1 | g527618 | 26 | −24 | gb105pln | Glycine max 3-methylcrotonyl-CoA carboxylase mRNA, biotin-carrier domain, partial cds. |
| 700266150H1 | g587562 | 22 | −9 | gb105eukp | MPP; mitochondrial processing peptidase |
| 700263075H1 | g1742968 | 35 | −10 | gb105pln | A. thaliana mRNA for SNF1-related ser/thr protein kinase (1869 bp). |
| 700257134H1 | g168508 | 30 | −19 | gb105pln | Maize oleosin KD18 (KD18; L2) gene, complete cds. |
| 700263652H1 | g22283 | 69 | −47 | gb105pln | Zea mays Gibi-L gene for vicilin-like embryo storage protein. |
| 700267176H1 | g168480 | 50 | −40 | gb105pln | Maize embryo globulin S allele (7S-like) mRNA, complete cds. |
| 700258418H1 | g168602 | 38 | −46 | gb105pln | Zea mays regulatory protein GF14-12 mRNA, complete cds. |
| 700266324H1 | g596079 | 89 | −81 | gb105pln | Zea mays thiamine biosynthetic enzyme (thil-2) mRNA, complete cds. |
| 700264748H1 | g2641637 | 21 | 2 | gb105pln | Arabidopsis thaliana DnaJ homolog AtJ3 (ATJ3) gene, complete cds. |
| 700263991H1 | g1016086 | 12 | 7 | gb105eukp | groES-A; molecular chaperone; chaperonin; heat-shock protein; protein folding; GroES |
| 700263282H1 | g1184771 | 90 | −83 | gb105pln | Zea mays glyceraldehyde-3-phosphate dehydrogenase GAPC2 (gpc2) mRNA, complete cds. |
| 700268029H1 | g398917 | 26 | −23 | gb105pln | B. napus cold induced protein (BnC24A) mRNA. |
| 700260151H1 | g561663 | 53 | −21 | gb105pln | Rice mRNA, partial homologous to ribosomal protein coding sequence. |
| 700258750H1 | g168442 | 47 | −45 | gb105pln | Zea mays chitinase B (seed chitinase) gene, 3'end. |
| 700258378H1 | g498772 | 83 | −67 | gb105pln | Z. mays (cv DH5xDH7) hsp70-4 mRNA for heat shock protein 70. |
| 700263258H1 | g485376 | 51 | −86 | gb105pln | Zea mays alpha-3-tubulin gene, complete cds. |
| 700265066H1 | g1345548 | 5 | 6 | gb105allp | polygalacturonase |
| 700263975H1 | g21802 | 22 | −24 | gb105pln | T. aestivum mRNA for high mobility group protein (HMGW). |
| 700261421H1 | g22281 | 39 | −3 | gb105pln | Zea mays Glb1-0 gene for vicilin-like storage protein (truncated). |
| 700267486H1 | g1906825 | 59 | −18 | gb105pln | A. thaliana hsp81.2 gene. |
| 700267453H1 | g64762 | 6 | 7 | gb105allp | N1/N2 (AA 1-590) |
| 700263748H1 | g1171347 | 36 | −18 | gb105pln | Triticum aestivum pMA1951 mRNA, partial cds. |
| 700267037H1 | g2529657 | 20 | 12 | gb105pln | Arabidopsis thaliana chromosome II BAC T30B22 genomic sequence, complete sequence. |
| 700261488H1 | g2266661 | 34 | 7 | gb105pln | Hordeum vulgare mRNA for 14-3-3 protein (Hv1433c). |
| 700266524H1 | g435648 | 24 | −32 | gb105pln | Rice mRNA for gamma-Tip, complete cds. |
| 700267804H1 | g644492 | 64 | −79 | gb105pln | Corn elongation factor 1alpha gene, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700260946H1 | g22528 | 66 | −82 | gb105pln | *Zea mays* mRNA encoding a zein (clone A20). |
| 700267476H1 | g22281 | 31 | −42 | gb105pln | *Zea mays* Glb1-0 gene for vicilin-like storage protein (truncated). |
| 700267328H1 | g506860 | 19 | −6 | gb105eukp | HRSec61 |
| 700265775H1 | g687244 | 42 | −79 | gb105pln | *Zea mays* oil body protein 16 kDa oleosin (ole16) gene, complete cds. |
| 700263710H1 | g2465426 | 18 | −4 | gb105eukp | JRG1.1; 32 kDa protein |
| 700258110H1 | g22314 | 65 | −77 | gb105pln | Maize mRNA for GSH gluthathione S-transferase I (GST;EC 2.5.1.18). |
| 700257255H1 | g471320 | 38 | 4 | gb105pln | *H. vulgare (cv. Bomi)* B15C mRNA. |
| 700267727H1 | g471320 | 37 | −1 | gb105pln | *H. vulgare (cv. Bomi)* B15C mRNA. |
| 700266085H1 | g2345153 | 84 | −66 | gb105pln | *Zea mays* ribsomal protein S4 (rps4) mRNA, complete cds. |
| 700265227H1 | g21800 | 21 | −26 | gb105pln | *T. aestivum* L mRNA for histone H2B. |
| 700259216H1 | g4392 | 13 | 2 | gb105eukp | RPL37A; ribosomal protein L37a |
| 700261862H1 | g22281 | 88 | 2 | gb105pln | *Zea mays* Glb1-0 gene for vicilin-like storage protein (truncated). |
| 700267652H1 | g1321661 | 21 | 7 | gb105eukp | ascorbate peroxidase; EC 1.11.1.11 |
| 700267232H1 | g1015849 | 19 | −12 | gb105eukp | RPS5 |
| 700266781H1 | g633889 | 17 | 8 | gb105pln | glucose and ribitol dehydrogenase homolog [*Hordeum vulgare* = barley, Aura, embryo, mRNA, 1170 nt]. |
| 700261986H1 | g1325967 | 28 | 5 | gb105pln | *T. aestivum* histone H2A gene (clone TH274). |
| 700266018H1 | g1632767 | 40 | −6 | gb105pln | Maize mRNA for calcium dependent protein kinase, complete cds. |
| 700264746H1 | g1122286 | 10 | 6 | gb105allp | succinyl coenzyme A synthetase |
| 700262548H1 | g1532072 | 18 | −3 | gb105pln | *Z. mays* mRNA for S-adenosylmethionine decarboxylase. |
| 700256789H1 | g1296954 | 73 | −72 | gb105pln | *O. sativa* mRNA for novel protein, osr40cl. |
| 700265048H1 | g1171351 | 30 | −17 | gb105pln | *Oryza sativa* 16 kDa oleosin (ole16) mRNA, complete cds. |
| 700261339H1 | g396209 | 43 | −19 | gb105pln | *S. polyrrhiza* mRNA for D-myo-inositol-3-phosphate synthase. |
| 700266762H1 | g1791307 | 5 | 1 | gb105eukp | AtPER-X; permease homolog |
| 700257547H1 | g22285 | 96 | −36 | gb105pln | *Zea mays* Glb1-S gene for vicilin-like embryo storage protein. |
| 700264685H1 | g1707642 | 25 | −11 | gb105eukp | TMK |
| 700258479H1 | g968901 | 68 | −65 | gb105pln | Rice mRNA for ribosomal protein S8, complete cds. |
| 700265516H1 | g532571 | 41 | −16 | gb105pln | Barley lipoxygenase 1 (LoxA) gene, complete cds. |
| 700262370H1 | g168673 | 92 | −81 | gb105pln | Maize 19 kDa zein mRNA, clone cZ19B1, complete cds. |
| 700264502H1 | g497180 | 28 | −27 | gb105pln | *Lycopersicon esculentum* biotin-containing subunit of methylcrotonyl-CoA carboxylase mRNA, partial cds. |
| 700257303H1 | g960356 | 40 | −8 | gb105pln | Barley mRNA for S-adenosylmethionine synthetase, complete cds. |
| 700258701H1 | g22275 | 67 | −44 | gb105pln | Maize mRNA for ferritin (clone FM1). |
| 700207258H1 | g886470 | 43 | −11 | gb105pln | *C. roseus* MetE mRNA for methionine synthase. |
| 700267396H1 | g168512 | 29 | −1 | gb105pln | Maize major protein (L3) mRNA from the surface of lipid bodies, 3' end. |
| 700267020H1 | g2739376 | 23 | −4 | gb105eukp | T9J22.18; putative permease |
| 700258441H1 | g532227 | 87 | −55 | gb105pln | *Ribes aureum* Pursh. 18S ribosomal RNA (18S rRNA) gene. |
| 700262190H1 | g1575129 | 85 | −72 | gb105pln | *Zea mays* lumenal binding protein cBiPe3 mRNA, complete cds. |
| 700257161H1 | g1345504 | 11 | 5 | gb105eukp | ATAF2 |
| 700256927H1 | g927238 | 34 | −20 | gb105pln | *Zea mays* globulin1 (Glb1) gene, allele Glb1-Hb, complete cds. |
| 700258925H1 | g22149 | 70 | −73 | gb105pln | *Z. mays* mRNA for alpha-tubulin 3. |
| 700263773H1 | g2992 | 27 | −11 | gb105pln | *Neurospora crassa* crp-1 mRNA for ribosomal protein homologous to Yeast cyH2 gene encoding L29. |
| 700258174H1 | g902622 | 19 | −3 | gb105eukp | 40S ribosomal protein S12 |
| 700258408H1 | g2662342 | 70 | −61 | gb105pln | *Oryza sativa* mRNA for EF-1 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700267885H1 | g1786456 | 23 | 6 | gb105allp | alpha, complete cds. o310; 100 pct identicai to GB: EDU70214_103 Accession U70214; 27 pct identical (34 gaps) to 306 residues from 5-methlytetrahydrofolate:homocysteine methyltransferase METH_SALTY SW: P37586 (370 aa) |
| 700258141H1 | g22118 | 50 | −71 | gb105pln | Z. mays DNA for Adh1-Cm allele. |
| 700264467H1 | g1945276 | 30 | −20 | gb105pln | L. esculentum mRNA for branched chain alpha-keto acid dehydrogenase E1-alpha subunit. |
| 700263767H1 | g456671 | 14 | 17 | gb105pln | T. aestivum VDAC 1 mRNA. |
| 700260583H1 | g1171347 | 32 | −14 | gb105pln | Triticum aestivum pMA1951 mRNA, partial cds. |
| 700258962H1 | g495263 | 24 | −14 | gb105eukp | sec61; sec61 protein |
| 700268173H1 | g1651457 | 30 | −10 | gb105allp | Aminopeptidase N |
| 700266553H1 | g2160438 | 4 | 6 | gb105allp | glutamate receptor channel subunit epsilon 4 |
| 700262846H1 | g168512 | 31 | −5 | gb105pln | Maize major protein (L3) mRNA from the surface of lipid bodies, 3' end. |
| 700261125H1 | g1200160 | 29 | −4 | gb105pln | T. gesneriana mRNA for tonoplast intrinsic protein. |
| 700262708H1 | g22283 | 43 | 5 | gb105pln | Zea mays Glb1-L gene for vicilin-like embryo storage protein. |
| 700258246H1 | g168512 | 48 | −42 | gb105pln | Maize major protein (L3) mRNA from the surface of lipid bodies, 3' end. |
| 700258185H1 | g438279 | 27 | −17 | gb105allp | Ribosomal protein L7 |
| 700267970H1 | g22149 | 53 | −45 | gb105pln | Z. mays mRNA for alpha-tubulin 3. |
| 700263756H1 | g167112 | 42 | −32 | gb105pln | Bromus inermis aldose reductase-related protein, complete cds. |
| 700262958H1 | g2331301 | 28 | 5 | gb105eukp | rps4; ribosomal protein S4 type I |
| 700262702H1 | g2266661 | 55 | −16 | gb105pln | Hordeum vulgare mRNA for 14-3-3 protein (Hv1433c). |
| 700259467H1 | g506534 | 50 | 0 | gb105eukp | PKTL7; protein kinase |
| 700266350H1 | g575354 | 62 | −66 | gb105pln | O. sativa SC34 mRNA for tumor suppressor. |
| 700257411H2 | g1749509 | 25 | −17 | gb105pln | Fission Yeast mRNA, partial cds. |
| 700267664H1 | g2842482 | 9 | 6 | gb105eukp | F21O9.80; protein phosphatase 2C-like protein |
| 700261125H1 | g520935 | 45 | −19 | gb105pln | H. vulgare mRNA for gamma-TIP-like protein. |
| 700265829H1 | g396209 | 40 | −40 | gb105pln | S. polyrrhiza mRNA for D-myo-inositol-3-phosphate synthase. |
| 700266137H1 | g2342676 | 17 | −3 | gb105eukp | F7G19.3 |
| 700266264H1 | g168508 | 79 | −87 | gb105pln | Maize oleosin KD18 (KD18; L2) gene, complete cds. |
| 700262282H1 | g168500 | 72 | −58 | gb105pln | Maize (Zea mays) histone H4 gene (H4C14), complete cds. |
| 700259329H1 | g1777706 | 51 | −40 | gb105pln | Zea mays 18S ribosomal RNA gene, partial sequence. |
| 700264370H1 | g2827650 | 9 | 7 | gb105eukp | F18F4.60; potassium transporter-like protein |
| 700267108H1 | g169834 | 51 | −18 | gb105pln | Rye 26S rRNA 3' end and 18S rRNA, 5' end. |
| 700260852H1 | g687244 | 44 | 0 | gb105pln | Zea mays oil body protein 16 kDa oleosin (ole16) gene, complete cds. |
| 700268004H1 | g2688829 | 49 | −44 | gb105pln | Prunus armeniaca putative sugar transporter mRNA, complete cds. |
| 700258110H1 | g168490 | 69 | −48 | gb105pln | Maize glutathione S-transferase (GST-I) mRNA, complete cds. |
| 700262836H1 | g21800 | 21 | −38 | gb105pln | T. aestivum L mRNA for histone H2B. |
| 700259530H1 | g20163 | 37 | −4 | gb105pln | O. sativa Rr15 mRNA for 5S ribosomal RNA. |
| 700267547H1 | g2331300 | 32 | −37 | gb105pln | Zea mays ribosomal protein S4 type I (rps4) mRNA, complete cds. |
| 700256796H1 | g1532047 | 61 | −54 | gb105pln | O. sativa mRNA for S-adenosylmethionine decarboxylase. |
| 700265650H1 | g595681 | 31 | −1 | gb105eukp | SODiT1; transports dicarboxylates across chloroplast envelope; 2-oxoglutarate/malate translocator |
| 700262010H1 | g829147 | 76 | −75 | gb105pln | Z. mays gene for cyclophilin. |
| 700258533H1 | g987122 | 74 | −62 | gb105pln | Z. mays mRNA for class II metallothionein. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700257932H1 | g2529663 | 58 | −6 | gb105eukp | T30B22.6; putative lysophospholipase |
| 700267781H1 | g18260 | 15 | 2 | gb105eukp | cs DnaJ-1 |
| 700267548H1 | g2341060 | 63 | −71 | gb105pln | *Zea mays* translational initiation factor eIF-4A (tif-4A3) mRNA, complete cds. |
| 700266380H1 | g168480 | 9 | 15 | gb105pln | Maize embryo globulin S allele (7S-like) mRNA, complete cds. |
| 700258055H1 | g1132482 | 17 | 14 | gb105pln | Rice mRNA for ADP-ribosylation factor, complete cds. |
| 700264915H1 | g471320 | 62 | −56 | gb105pln | *H. vulgare* (cv. Bomi) B15C mRNA. |
| 700258605H1 | g899607 | 83 | −84 | gb105pln | *Zea mays* polyubiquitin (MubC5) mRNA, complete cds. |
| 700258280H1 | g467974 | 24 | −3 | gb105pln | *Arabidopsis thaliana* casein kinase II beta subunit CKB2 mRNA, complete cds. |
| 700262088H1 | g479146 | 14 | 3 | gb105eukp | putative ATP synthase subunit |
| 700256925H1 | g2343181 | 23 | −12 | gb105eukp | MDL3; catalyzes dissociation of (R)-mandelonitrile to hydrogen cyanide and benzaldehyde; (R)-(+)-mandelonitrile lyase isoform MDL3 precursor; EC 4.1.2.10 |
| 700263137H1 | g168543 | 72 | −11 | gb105pln | *Zea mays* putative ribosomal protein S8 mRNA, partial cds. |
| 700264874H1 | g21732 | 25 | −28 | gb105pln | Wheat mRNA for Em protein. |
| 700262894H1 | g780371 | 24 | 13 | gb105pln | *Oryza sativa* enolase mRNA, complete cds. |
| 700259608H1 | g18890 | 43 | −33 | gb105pln | *H. vulgare* gene for aldose reductase-related protein. |
| 700262176H1 | g2353172 | 23 | 1 | gb105pln | *Arabidopsis thaliana* sigma factor 2 (SIG2) mRNA, nuclear gene encoding chloroplast protein, complete cds. |
| 700262863H1 | g1220177 | 20 | 5 | gb105pln | *T. ledebourii* mRNA for pG31-like dormancy related protein. |
| 700261293H1 | g1181672 | 83 | −81 | gb105pln | Sorghum bicolor heat shock protein 70 cognate (hsc70) mRNA, partial cds. |
| 700266354H1 | g790641 | 11 | −5 | gb105eukp | HTH3; gamma-thionin |
| 700262413H1 | g1694832 | 24 | −36 | gb105pln | *H. vulgare* Perl gene. |
| 700268142H1 | g786326 | 6 | −1 | gb105eukp | SEC23; Sec23p: cytoplasmic GTPase-activating protein |
| 700264504H1 | g927239 | 7 | 6 | gb105allp | globulin1 |
| 700266152H1 | g2245014 | 29 | −22 | gb105eukp | glucosyltransferase homolog |
| 700261055H1 | g169818 | 47 | 2 | gb105pln | Rice 25S ribosomal RNA gene. |
| 700266011H1 | g2244759 | 27 | −29 | gb105eukp | selenium-binding protein |
| 700264266H1 | g2760167 | 27 | −35 | gb105pln | *Arabidopsis thaliana* genomic DNA, chromosome 5, P1 clone: MCO15, complete sequence. |
| 700267190H1 | g633890 | 23 | 5 | gb105eukp | glucose and ribitol dehydrogenase homolog |
| 700265375H1 | g602252 | 30 | −16 | gb105pln | *Zea mays* enolase (eno2) mRNA, complete cds. |
| 700263872H1 | g1171351 | 28 | −15 | gb105pln | *Oryza sativa* 16 kDa oleosin (ole16) mRNA, complete cds. |
| 700257751H1 | g2398831 | 8 | 7 | gb105eukp | 4-coumarate:CoA ligase; 4-coumarate:CoA ligase |
| 700260908H1 | g2298899 | 20 | 4 | gb105allp | unnamed protein product |
| 700256857H1 | g2632253 | 23 | −12 | gb105pln | *S. bicolor* mRNA for putative protein serine/threonine kinase, clone cSNFL2. |
| 700258982H1 | g402551 | 22 | −41 | gb105pln | *A. thaliana* gene for acetohydroxy acid isomeroreductase. |
| 700256908H1 | g520581 | 17 | 15 | gb105pln | Barley gene for Ids3, complete cds. |
| 700265180H1 | g168512 | 28 | −47 | gb105pln | Maize major protein (L3) mRNA from the surface of lipid bodies, 3' end. |
| 700260585H2 | g1044856 | 16 | −3 | gb105eukp | W02B12.3 |
| 700266483H1 | g2511530 | 55 | −46 | gb105pln | *Eleusine indica* alpha tubulin 1 (TUA1) mRNA, complete cds. |
| 700265261H1 | g527618 | 30 | −19 | gb105pln | *Glycine max* 3-methylcrotonyl-CoA carboxylase mRNA, biotin-carrier domain, partial cds. |
| 700264511H1 | g22287 | 8 | 7 | gb105allp | vicilin-like embryo storage protein |
| 700264506H1 | g168508 | 68 | −35 | gb105pln | Maize oleosin KD18 (KD18; L2) gene, complete cds. |
| 700263220H1 | g468055 | 80 | −13 | gb105pln | *Zea mays* B73 QM protein mRNA, complete cds. |
| 700268188H1 | g1531764 | 11 | 12 | gb105pln | *D. stramonium* mRNA for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700267183H1 | g2341041 | 14 | 6 | gb105eukp | S-adenosylmethionine decarboxylase. F19P19.25 |
| 700266742H1 | g1050430 | 20 | 6 | gb105eukp | snRNP protein; U1snRNP-specific protein; U1A |
| 700264851H1 | g2154716 | 22 | −6 | gb105pln | *A. thaliana* mRNA for Kap alpha protein. |
| 700258532H1 | g167100 | 5 | 7 | gb105eukp | Sip1; seed imbibition protein |
| 700265207H1 | g1419389 | 33 | −34 | gb105pln | *A. thaliana* mRNA for thylakoid-bound ascorbate peroxidase. |
| 700259656H1 | g669002 | 35 | −30 | gb105pln | Glycine max calnexin mRNA, complete cds. |
| 700264618H1 | g562074 | 17 | −3 | gb105allp | ribosomal protein L35 |
| 700258890H1 | g22285 | 44 | −73 | gb105pln | *Zea mays* Glb1-S gene for vicilin-like embryo storage protein. |
| 700262962H1 | g1171351 | 19 | 3 | gb105pln | *Oryza sativa* 16 kDa oleosin (ole16) mRNA, complete cds. |
| 700257155H1 | g2464884 | 21 | 3 | gb105eukp | RNA-binding protein homolog |
| 700257051H1 | g22302 | 37 | −77 | gb105pln | Maize Gpc1 gene for glyceraldehyde-3-phosphate dehydrogenase (GADPH) subunit C. |
| 700265106H1 | g1184775 | 40 | −29 | gb105pln | *Zea mays* glyceraldehyde-3-phosphate dehydrogenase GAPC4 (gpc4) mRNA, complete cds. |
| 700263207H1 | g471320 | 62 | −29 | gb105pln | *H. vulgare* (cv. Bomi) B15C mRNA. |
| 700257181H1 | g506470 | 16 | 6 | gb105pln | *N. tabacum* mRNA pNLA-35. |
| 700257372H1 | g1184771 | 71 | −56 | gb105pln | *Zea mays* glyceraldehyde-3-phosphate dehydrogenase GAPC2 (gpc2) mRNA, complete cds. |
| 700266535H1 | g1209315 | 24 | −3 | gb105pln | *Hevea brasiliensis* ethylene-inducible protein processed pseudogene mRNA, 3' end. |
| 700263441H1 | g21834 | 75 | −23 | gb105pln | Wheat mRNA for cytosolic phosphoglycerate kinase (EC 2.7.2.3) |
| 700261637H1 | g168480 | 88 | −80 | gb105pln | Maize embryo globulin S allele (7S-like) mRNA, complete cds. |
| 700258512H1 | g1181672 | 42 | −28 | gb105pln | Sorghum bicolor heat shock protein 70 cognate (hsc70) mRNA, partial cds. |
| 700264742H1 | g914916 | 30 | −32 | gb105pln | *Brassica napus* ribosomal protein RL10 mRNA, partial cds. |
| 700263113H1 | g19012 | 36 | 8 | gb105pln | *H. vulgare* mRNA for LEA B19.1 protein. |
| 700259002H1 | g809513 | 13 | 16 | gb105pln | Rice mRNA for ferredoxin-nitrite reductase, complete cds. |
| 700257385H1 | g2738247 | 37 | −12 | gb105pln | *Arabidopsis thaliana* cobalamin-independent methionine synthase (ATCIMS) mRNA, complete cds. |
| 700266262H1 | g1845196 | 80 | −38 | gb105pln | *Z. mays* mRNA for HMGc2 protein. |
| 700259337H1 | g2345153 | 36 | −65 | gb105pln | *Zea mays* ribsomal protein S4 (rps4) mRNA, complete cds. |
| 700259208H1 | g2398680 | 32 | −36 | gb105pln | *Morinda citrifolia* mRNA for 3-deoxy-D-arabino-heptulosonate 7-phosphate synthase, DS2. |
| 700261627H1 | g1171351 | 46 | −36 | gb105pln | *Oryza sativa* 16 kDa oleosin (ole16) mRNA, complete cds. |
| 700259189H1 | g168502 | 39 | −11 | gb105pln | Maize (*Zea mays*) histone H4 gene (H4C7), complete cds. |
| 700266513H1 | g469067 | 4 | 7 | gb105allp | NMDA receptor subunit NR2D |
| 700266522H1 | g506860 | 26 | −8 | gb105eukp | HRSec61 |
| 700263345H1 | g2511745 | 14 | 1 | gb105eukp | dre4; probable transcriptional regulator dre4 |
| 700265465H1 | g303942 | 28 | −18 | gb105pln | Yeast ppe1+ gene for protein phosphatase, complete cds. |
| 700265465H1 | g1143510 | 48 | −40 | gb105pln | *M. domestica* Borkh mRNA for serine/threonine protein phosphatase (PPX). |
| 700256710H1 | g1777706 | 71 | −79 | gb105pln | *Zea mays* 18S ribosomal RNA gene, partial sequence. |
| 700265484H1 | g167112 | 37 | −22 | gb105pln | *Bromus inermis* aldose reductase-related protein, complete cds. |
| 700260534H2 | g293888 | 30 | −36 | gb105pln | *Zea mays*, glyceraldehyde-3-phosphate dehydrogenase mRNA, 3' end (clone GAPC2). |
| 700261764H1 | g2270994 | 29 | −14 | gb105eukp | GmPM13; Ca+2-binding EF hand protein |
| 700207144H1 | g2813982 | 17 | 6 | gb105eukp | F49E2.1 |
| 700260779H1 | g22270 | 71 | −63 | gb105pln | Maize mRNA from an embryogenic |

TABLE 1-continued

LIST OF INCYTE CLONES DERIVED FROM SATMON022023
COPYRIGHT 1998 INCYTE PHARMACEUTICALS, INC.

| Clone | GenBank | | | Library | Description |
|---|---|---|---|---|---|
| 700266342H1 | g166797 | 19 | −3 | gb105eukp | abscisic acid-inducible gene. phosphoprotein phosphatase-type 1; EC 3.1.3.16 |
| 700265528H1 | g963061 | 14 | 8 | gb105pln | *H. vulgare* Ole-1 mRNA for oleosin. |
| 700259154H2 | g2351375 | 21 | 5 | gb105pln | *Arabidopsis thaliana* translation initiation factor eIF3 p47 subunit homolog mRNA, complete cds. |
| 700264914H1 | g520935 | 63 | −57 | gb105pln | *H. vulgare* mRNA for gamma-TIP-like protein. |
| 700257232H1 | g609381 | 5 | 7 | gb105eukp | YLR350W; Ylr350wp |
| 700257541H1 | g397400 | 32 | 7 | gb105pln | *B. rapa* mRNA for S phase specific gene. |
| 700267334H1 | g471320 | 48 | −46 | gb105pln | *H. vulgare* (cv. Bomi) B15C mRNA. |
| 700262487H1 | g1213536 | 59 | −6 | gb105eukp | eft-1; the above GenBank entry begins at aa 120 |
| 700260779H1 | g19016 | 21 | 4 | gb105pln | *H. vulgare* mRNA for LEA B19.4 protein. |
| 700264261H1 | g1620896 | 19 | 7 | gb105eukp | protein involved in sexual development |
| 700262865H1 | g1129083 | 22 | 4 | gb105pln | Wheat mRNA for protein H2A, complete cds, clone wcH2A-2. |
| 700257255H1 | g971279 | 37 | −5 | gb105pln | Rice mRNA for RAB24 protein, complete cds. |
| 700267727H1 | g971279 | 36 | 0 | gb105pln | Rice mRNA for RAB24 protein, complete cds. |
| 700262480H1 | g1658312 | 16 | 7 | gb105pln | *O. sativa* osr40g2 gene. |
| 700258176H1 | g644492 | 98 | −86 | gb105pln | Corn elongation factor 1alpha gene, complete cds. |
| 700257376H1 | g2624211 | 24 | −25 | gb105pln | *M. acuminata* mRNA; clone pBAN UU131. |
| 700257190H1 | g927239 | 6 | 7 | gb105allp | globulin1 |
| 700262628H1 | g1825645 | 31 | −7 | gb105eukp | F46F11.4 |
| 700266962H1 | g1142698 | 10 | −4 | gb105eukp | NADPH-dependent aldehyde reductase; EC 1.1.1.2 |
| 700262869H1 | g347063 | 41 | −11 | gb105pln | *Brassica rapa* ubiquitin/ribosomal protein mRNA, complete cds. |
| 700258419H1 | g2288968 | 21 | −3 | gb105pln | *Zea mays* mRNA for glutathione transferase. |
| 700257225H1 | g927238 | 52 | −71 | gb105pln | *Zea mays* globulin1 (Glb1) gene, allele Glb1-Hb, complete cds. |
| 700265261H1 | g497180 | 26 | −14 | gb105pln | *Lycopersicon esculentum* biotin-containing subunit of methylcrotonyl-CoA carboxylase mRNA, partial cds. |
| 700259646H1 | g168512 | 56 | −57 | gb105pln | Maize major protein (L3) mRNA from the surface of lipid bodies, 3′ end. |
| 700265502H1 | g17789 | 18 | 7 | gb105eukp | Bp10 |
| 700265006H1 | g687244 | 56 | −47 | gb105pln | *Zea mays* oil body protein 16 kDa oleosin (ole16) gene, complete cds. |
| 700261827H1 | g18047 | 28 | −5 | gb105pln | *C. latifolia* mRNA CUR09 for curculin. |
| 700266131H1 | g2300247 | 21 | −1 | gb105allp | unnamed protein product |
| 700263677H1 | g452559 | 58 | −27 | gb105pln | *Zea mays* group 3 Lea protein MGL3 mRNA, complete cds. |
| 700266075H1 | g687246 | 8 | 2 | gb105pln | *Zea mays* oil body protein 17 kDa oleosin (ole17) gene, complete cds. |
| 700263380H1 | g22283 | 86 | −22 | gb105pln | *Zea mays* Glb1-L gene for vicilin-like embryo storage protein. |
| 700266510H1 | g1667262 | 57 | −11 | gb105eukp | B0035.1 |
| 700257292H1 | g1694832 | 47 | 14 | gb105pln | *H. vulgare* Per1 gene. |
| 700266953H1 | g669002 | 35 | −10 | gb105pln | Glycine max calnexin mRNA, complete cds. |
| 700265966H1 | g2351061 | 24 | 14 | gb105pln | *Arabidopsis thaliana* genomic DNA, chromosome 5, P1 clone: MAF19. |
| 700263940H1 | g973313 | 15 | 6 | gb105eukp | myo-inositol 1-phosphate synthase isozyme-2 |
| 700260149H1 | g1839188 | 16 | 3 | gb105eukp | RHD3; putative GTP-binding protein; root hair defective 3 |
| 700265968H1 | g1556439 | 13 | 0 | gb105allp | yta7 |
| 700263067H1 | g1519250 | 62 | −36 | gb105pln | *Oryza sativa* GF14-c protein mRNA, complete cds. |
| 700260871H1 | g21062 | 9 | 5 | gb105eukp | pectinesterase; EC 3.1.1.11 |
| 700267170H1 | g479089 | 49 | −41 | gb105pln | *S. tuberosum* met3-2 mRNA for ATP-sulfate adenylyltransferase. |
| 700263902H1 | g687244 | 39 | −18 | gb105pln | *Zea mays* oil body protein 16 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | kDa oleosin (ole16) gene, complete cds. |
| 700262913H1 | g2274776 | 11 | −3 | gb105eukp | GSL2; glucan synthase |
| 700259516H1 | g1658312 | 53 | −35 | gb105pln | *O. sativa* osr40g2 gene. |
| 700258490H1 | g166548 | 41 | −24 | gb105pln | *Avena sativa* vacuolar H+-ATPase 16 kDa proteolipid subunit (vatp-P1) mRNA, complete cds. |
| 700266689H1 | g1945611 | 16 | −2 | gb105allp | 26S proteasome subunit p55 |
| 700266475H1 | g168423 | 100 | −49 | gb105pln | *Zea mays* polypeptide chain-binding protein mRNA, 3' end. |
| 700267350H1 | g21233 | 40 | −25 | gb105pln | *S. oleracea* AHRI mRNA for acetohydroxy acid reductoisomerase. |
| 700266222H1 | g2654867 | 35 | −39 | gb105pln | *Arabidopsis thaliana* RbohAp108 mRNA, complete cds. |
| 700261522H1 | g2302292 | 14 | 6 | gb105allp | unnamed protein product |
| 700256712H1 | g2624199 | 26 | −9 | gb105pln | *M. acuminata* mRNA; clone pBAN UU93. |
| 700265454H1 | g458938 | 24 | −11 | gb105eukp | YHR186c; Yhr186cp |
| 700264621H1 | g1575127 | 54 | −72 | gb105pln | *Zea mays* lumenal binding protein cBiPe2 mRNA, complete cds. |
| 700259321H1 | g168480 | 52 | −73 | gb105pln | Maize embryo globulin S allele (7S-like) mRNA, complete cds. |
| 700263382H1 | g168702 | 59 | −68 | gb105pln | Corn 22 kDa zein protein gene, complete cds. |
| 700257272H1 | g22292 | 69 | −15 | gb105pln | *Z. mays* mRNA for glycine-rich protein. |
| 700262551H1 | g1389566 | 16 | −1 | gb105eukp | ER; receptor protein kinase |
| 700264286H1 | g972332 | 21 | 7 | gb105allp | splicing factor U2AF 35 kd subunit |
| 700262656H1 | g168579 | 57 | −24 | gb105pln | Maize pyruvate, orthophosphate dikinase mRNA, complete cds. |
| 700262453H1 | g168512 | 25 | 16 | gb105pln | Maize major protein (L3) mRNA from the surface of lipid bodies, 3' end. |
| 700257186H1 | g1532047 | 14 | 15 | gb105pln | *O. sativa* mRNA for S-adenosylmethionine decarboxylase. |
| 700257338H1 | g516838 | 70 | −31 | gb105pln | Rice mRNA for catalase, complete cds. |
| 700264564H1 | g168512 | 33 | −30 | gb105pln | Maize major protein (L3) mRNA from the surface of lipid bodies, 3' end. |
| 700262095H1 | g2345153 | 79 | −53 | gb105pln | *Zea mays* ribosomal protein S4 (rps4) mRNA, complete cds. |
| 700261513H1 | g687244 | 61 | −33 | gb105pln | *Zea mays* oil body protein 16 kDa oleosin (ole16) gene, complete cds. |
| 700258367H1 | g471320 | 47 | −46 | gb105pln | *H. vulgare* (cv. Bomi) B15C mRNA. |
| 700268091H1 | g687246 | 48 | −56 | gb105pln | *Zea mays* oil body protein 17 kDa oleosin (ole17) gene, complete cds. |
| 700267430H1 | g2464923 | 19 | −7 | gb105eukp | 26S proteosome regulatory subunit 8 homolog |
| 700265988H1 | g2194119 | 5 | 5 | gb105eukp | F20P5.5 |
| 700264707H1 | g2213425 | 37 | −7 | gb105eukp | unknown; hypothetical protein |
| 700261304H1 | g436782 | 49 | −30 | gb105pln | Rice mRNA for cyc07, complete cds. |
| 700266543H1 | g2353183 | 27 | −5 | gb105eukp | ctrA; CtrA |
| 700256836H1 | g435648 | 51 | −36 | gb105pln | Rice mRNA for gamma-Tip, complete cds. |
| 700266743H1 | g602605 | 64 | −89 | gb105pln | *Zea mays* tandem genes for alpha1-tubulin and alpha2-tubulin. |
| 700267108H1 | g2687430 | 42 | −12 | gb105pln | *Acorus gramineus* large subunit 26S ribosomal RNA gene, partial sequence. |
| 700262176H1 | g1314677 | 24 | 2 | gb105eukp | emo-1; Sec61p gamma homolog |
| 700259738H1 | g1632821 | 40 | 4 | gb105pln | *O. sativa* mRNA for transmembrane protein. |
| 700267925H1 | g22283 | 56 | −69 | gb105pln | *Zea mays* Glb1-L gene for vicilin-like embryo storage protein. |
| 700263349H1 | g575407 | 19 | 8 | gb105allp | phytoene desaturase |
| 700263109H1 | g2765316 | 23 | −13 | gb105eukp | AS1; asparagine synthetase 1 |
| 700267874H1 | g457709 | 32 | −15 | gb105eukp | protein kinase |
| 700264915H1 | g971279 | 58 | −51 | gb105pln | Rice mRNA for RAB24 protein, complete cds. |
| 700264090H1 | g469147 | 38 | −29 | gb105pln | *H. vulgare* mRNA for alanine aminotransferase. |
| 700263596H1 | g2431766 | 66 | −3 | gb105pln | *Zea mays* acidic ribosomal protein P3a (rpp3a) mRNA, complete cds. |
| 700258185H1 | g2275264 | 7 | 3 | gb105allp | 60S ribosomal protein L7B |
| 700265066H1 | g1345549 | 5 | 6 | gb105eukp | NPG; polygalacturonase; EC 3.2.1.15 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700261384H1 | g1658314 | 13 | 15 | gb105pln | *O. sativa* osr40g3 gene. |
| 700262215H1 | g2253411 | 9 | 7 | gb105allp | PP2A inhibitor |
| 700259345H1 | g2244950 | 19 | 2 | gb105pln | *Arabidopsis thaliana* DNA chromosome 4, ESSA I contig fragment No. 5. |
| 700262692H1 | g1200160 | 28 | 5 | gb105pln | *T. gesneriana* mRNA for tonoplast intrinsic protein. |
| 700264519H1 | g868002 | 38 | −47 | gb105pln | Pumpkin mRNA for aconitase, complete cds. |
| 700262912H1 | g2827141 | 33 | −6 | gb105eukp | Ath-A; cellulose synthase catalytic subunit |
| 700262142H1 | g511937 | 39 | −29 | gb105pln | Soybean mRNA for cysteine proteinase, complete cds. |
| 700265594H1 | g2760165 | 15 | 7 | gb105pln | *Arabidopsis thaliana* genomic DNA, chromosome 5, P1 clone: MAC9, complete sequence. |
| 700262976H1 | g1272684 | 98 | −71 | gb105pln | *Z. mays* mRNA for acetyl CoA carboxylase (partial) |
| 700261941H1 | g1694832 | 28 | −41 | gb105pln | *H. vulgare* Per1 gene. |
| 700264184H1 | g22283 | 64 | −23 | gb105pln | *Zea mays* Glb1-L gene for vicilin-like embryo storage protein. |
| 700262436H1 | g22283 | 65 | −69 | gb105pln | *Zea mays* Glb1-L gene for vicilin-like embryo storage protein. |
| 700267317H1 | g536027 | 27 | −10 | gb105eukp | SNP3 |
| 700265067H1 | g1431870 | 7 | 7 | gb105eukp | ent-kaurene synthase B in gibberellin biosynthesis; ent-kaurene synthase B |
| 700260547H2 | g1724111 | 18 | 7 | gb105pln | *Triticum aestivum* ABA induced plasma membrane protein PM-19 (WTABAPM) mRNA, complete cds. |
| 700256833H1 | g17931 | 29 | −30 | gb105pln | *B. secalinas* embryo-specific mRNA. |
| 700262466H1 | g469069 | 4 | 6 | gb105allp | NMDA receptor subunit NR2D |
| 700261063H1 | g474001 | 37 | −26 | gb105pln | Rice mRNA, partial homologous to ribosomal protein L38 gene. |
| 700257492H1 | g1711035 | 33 | −18 | gb105pln | *Pisum sativum* hydroxyproline rich glycoprotein PsHRGP1 mRNA, partial cds. |
| 700261128H1 | g1620753 | 17 | 3 | gb105eukp | RPI; proteinase inhibitor |
| 700261376H1 | g2586083 | 14 | −5 | gb105eukp | receptor kinase-like protein |
| 700258359H1 | g1694832 | 31 | −48 | gb105pln | *H. vulgare* Per1 gene. |
| 700260266H1 | g687244 | 72 | −36 | gb105pln | *Zea mays* oil body protein 16 kDa oleosin (ole16) gene, complete cds. |
| 700258234H1 | g22144 | 96 | −83 | gb105pln | Maize anaerobically regulated gene for fructose bisphosphate aldolase (EC 4.1.2.13) |
| 700261356H1 | g1838984 | 18 | 6 | gb105allp | serine C-palmitoyltransferase |
| 700262360H1 | g2218151 | 18 | −4 | gb105pln | *Vigna unguiculata* type IIIa membrane protein cp-wap13 mRNA, complete cds. |
| 700267979H1 | g248338 | 66 | −55 | gb105pln | polyubiquitin [maize, Genomic, 3439 nt]. |
| 700266424H1 | g218000 | 21 | 3 | gb105pln | Potato mRNA for UDP-glucose pyrophosphorylase (EC 2.7.7.9). |
| 700266395H1 | g1217605 | 4 | 7 | gb105eukp | prp1+; pre-mRNA splicing factor; fission yeast pre-mRNA processing gene prp1+ |
| 700265493H1 | g475552 | 5 | 7 | gb105allp | N-methyl-D-aspartate receptor NMDAR2D subunit |
| 700262608H1 | g438450 | 30 | −19 | gb105pln | *Arabidopsis thaliana* delta-12 desaturase (Fad2) mRNA, complete cds. |
| 700260121H1 | g473976 | 44 | −30 | gb105pln | Rice mRNA, partial homologous to elongation factor 1-alpha gene. |
| 700263484H1 | g469147 | 65 | −60 | gb105pln | *H. vulgare* mRNA for alanine aminotransferase. |
| 700258375H1 | g1171351 | 17 | −7 | gb105pln | *Oryza sativa* 16 kDa oleosin (ole16) mRNA, complete cds. |
| 700264753H1 | g960356 | 50 | −39 | gb105pln | Barley mRNA for S-adenosylmethionine synthetase, complete cds. |
| 700266166H1 | g22138 | 63 | −1 | gb105pln | *Z. mays* gene for acetohydroxyacid synthase (AHAS108) |
| 700265123H1 | g168494 | 39 | −12 | gb105pln | Maize (*Zea mays*) histone H3 gene (H3C2), complete cds. |
| 700258045H1 | g902583 | 84 | −67 | gb105pln | *Zea mays* clone MubG1 ubiquitin gene, complete cds. |
| 700263677H1 | g444044 | 58 | −27 | gb105pln | *Z. mays* mRNA for group 3 Lea protein MGL3. |
| 700263207H1 | g971279 | 63 | −30 | gb105pln | Rice mRNA for RAB24 protein, complete cds. |
| 700262348H1 | g347715 | 14 | −3 | gb105eukp | shows 46% identity to human |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | placental protein 15 (PP15) |
| 700260671H1 | g170775 | 70 | −65 | gb105pln | Wheat translation elongation factor 1 alpha-subunit (TEF1) mRNA, complete cds. |
| 700261079H1 | g1597722 | 49 | −30 | gb105pln | Zea mays CRINKLY4 precursor (cr4) mRNA, complete cds. |
| 700258262H1 | g288063 | 23 | 6 | gb105allp | ketol-acid reductoisomerase |
| 700258141H1 | g168406 | 50 | −71 | gb105pln | Z. mays alcohol dehydrogenase (ADH-1 C-m allele) gene, complete cds. |
| 700265557H1 | g2828188 | 32 | −31 | gb105pln | Arabidopsis thaliana genomic DNA, chromosome 5, TAC clone: K3I3, complete sequence. |
| 700264622H1 | g2829921 | 20 | 4 | gb105eukp | F22K20.18 |
| 700264112H1 | g533251 | 62 | −8 | gb105pln | Zea mays (clone pSM8) sucrose synthase 2 (Sus1) gene, complete cds. |
| 700258459H1 | g20163 | 28 | 16 | gb105pln | O. sativa Rr15 mRNA for 5S ribosomal RNA. |
| 700267325H1 | g17931 | 34 | −5 | gb105pln | B. secalinas embryo-specific mRNA. |
| 700266465H1 | g22287 | 8 | 7 | gb105allp | vicilin-like embryo storage protein |
| 700207194H1 | g459267 | 35 | −17 | gb105pln | Z. mays gene for HMG protein. |
| 700261474H1 | g168512 | 42 | −27 | gb105pln | Maize major protein (L3) mRNA from the surface of lipid bodies, 3' end. |
| 700263666H1 | g22322 | 55 | −9 | gb105pln | Z. mays mRNA for H2B histone (clone cH2B214). |
| 700267036H1 | g927238 | 54 | −38 | gb105pln | Zea mays globulin1 (Glb1) gene, allele Glb1-Hb, complete cds. |
| 700260676H1 | g498908 | 20 | 5 | gb105eukp | RPL34; ribosomal protein L34 homolog |
| 700264788H1 | g2341023 | 34 | −20 | gb105pln | Sequence of BAC F19P19 from Arabidopsis thaliana chromosome 1, complete sequence. |
| 700263593H1 | g2286152 | 61 | −59 | gb105pln | Zea mays cytoplasmic malate dehydrogenase mRNA, complete cds. |
| 700264438H1 | g248338 | 72 | −57 | gb105pln | polyubiquitin [maize, Genomic, 3439 nt]. |
| 700260157H1 | g927239 | 6 | 6 | gb105allp | globulin1 |
| 700265473H1 | g886470 | 38 | −38 | gb105pln | C. roseus MetE mRNA for methionine synthase. |
| 700261329H1 | g17616 | 23 | 1 | gb105allp | 40S RIBOSOMAL PROTEIN S5 |
| 700260122H1 | g22287 | 7 | 8 | gb105eukp | Glb1-S; vicilin-like embryo storage protein |
| 700266474H1 | g1706955 | 45 | −19 | gb105pln | Gossypium hirsutum cellulose synthase (celA1) mRNA, complete cds. |
| 700263008H1 | g2505870 | 43 | −15 | gb105eukp | hypothetical protein |
| 700261138H1 | g437900 | 32 | −1 | gb105pln | P. sativum mRNA For phosphoprotein phosphatase 2A 65 kDa regulatory subunit. |
| 700265576H1 | g166603 | 32 | −22 | gb105pln | Arabidopsis thaliana anthranilate synthase alpha subunit gene, complete cds. |
| 700263272H1 | g1895083 | 92 | −82 | gb105pln | Zea mays golgi associated protein se-wap41 mRNA, complete cds. |
| 700264907H1 | g168512 | 41 | −38 | gb105pln | Maize major protein (L3) mRNA from the surface of lipid bodies, 3' end. |
| 700262112H1 | g1694832 | 19 | −38 | gb105pln | H. vulgare Per1 gene. |
| 700262757H1 | g311238 | 53 | −29 | gb105pln | Z. mays cat1gene for catalase 1. |
| 700261483H1 | g2668737 | 86 | −31 | gb105pln | Zea mays translation initiation factor 5A (TIF5A) mRNA, complete cds. |
| 700258410H1 | g2494121 | 23 | −5 | gb105eukp | T1G11.19 |
| 700267334H1 | g971279 | 46 | −39 | gb105pln | Rice mRNA for RAB24 protein, complete cds. |
| 700260667H1 | g22746 | 16 | −11 | gb105eukp | actin depolymerization; actin depolymerizing factor |
| 700264840H1 | g21732 | 26 | −17 | gb105pln | Wheat mRNA for Em protein. |
| 700267482H1 | g168480 | 41 | −7 | gb105pln | Maize embryo globulin S allele (7S-like) mRNA, complete cds. |
| 700266055H1 | g473877 | 50 | −47 | gb105pln | Arabidopsis thaliana Columbia calnexin homolog gene, complete cds. |
| 700265542H1 | g168434 | 70 | −60 | gb105pln | Z. mays catalase isozyme 3 (CAT-3) mRNA, complete cds. |
| 700259088H1 | g927239 | 8 | 5 | gb105allp | globulin1 |
| 700264183H1 | g169818 | 81 | −31 | gb105pln | Rice 25S ribosomal RNA gene. |
| 700263457H1 | g1208478 | 10 | −1 | gb105allp | ABC1-like |
| 700259631H1 | g602252 | 16 | −5 | gb105pln | Zea mays enolase (eno2) mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700258025H1 | g747979 | 32 | −20 | gb105pln | *Nicotiana tabacum* UMP synthase (pyr5-6) mRNA, partial cds. |
| 700262964H1 | g1532047 | 13 | 16 | gb105pln | *O. sativa* mRNA for S-adenosylmethionine decarboxylase. |
| 700262277H1 | g1877396 | 50 | −43 | gb105pln | *R. communis* mRNA for shaggy-like kinase, partial. |
| 700265838H1 | g606774 | 32 | 2 | gb105eukp | ZC506.3 |
| 700256738H1 | g1488311 | 17 | −1 | gb105pln | Sorghum bicolor dehydrin (DHN2) mRNA, partial cds. |
| 700262992H1 | g1888458 | 11 | 14 | gb105pln | *S. tuberosum* mRNA for 14-3-3 protein, isolate 16R. |
| 700260318H2 | g169818 | 46 | −37 | gb105pln | Rice 25S ribosomal RNA gene. |
| 700267081H1 | g21624 | 33 | −5 | gb105pln | *S. vulgare* mRNA for glycine-rich RNA-binding protein (clone S2) |
| 700259590H1 | g1743007 | 15 | −0 | gb105eukp | ribosomal protein L13a |
| 700262373H1 | g166866 | 48 | −28 | gb105pln | *A. thaliana* ribosomal protein S11 mRNA, 3' end. |
| 700265574H1 | g2264309 | 19 | −17 | gb105pln | *Arabidopsis thaliana* genomic DNA, chromosome 5, P1 clone: MJJ3, complete sequence. |
| 700267434H1 | g168481 | 7 | 8 | gb105allp | globulin precursor |
| 700266987H1 | g2739216 | 23 | 5 | gb105pln | *Hordeum vulgare* L41 ribosomal protein. |
| 700265838H1 | g2811228 | 34 | 2 | gb105allp | phosphatidylserine synthase-1 |
| 700258256H1 | g1658312 | 18 | −35 | gb105pln | *O. sativa* osr40g2 gene. |
| 700257135H1 | g1694832 | 32 | −48 | gb105pln | *H. vulgare* Per1 gene. |
| 700264860H1 | g1209099 | 15 | −3 | gb105eukp | AINTEGUMENTA; AINTEGUMENTA |
| 700264594H1 | g450548 | 72 | −30 | gb105pln | *O. sativa* (pRSAM-1) gene for S-adenosyl methionine synthetase. |
| 700265003H1 | g2462742 | 20 | 6 | gb105eukp | F8A5.25 |
| 700264759H1 | g1082146 | 13 | −2 | gb105eukp | T18D3.3 |
| 700261744H1 | g169818 | 28 | −60 | gb105pln | Rice 25S ribosomal RNA gene. |
| 700263337H1 | g2191181 | 13 | 17 | gb105pln | *Arabidopsis thaliana* BAC TM021B04. |
| 700264366H1 | g454913 | 21 | −1 | gb105pln | *A. porrum* LDJ2 mRNA. |
| 700264844H1 | g2668741 | 22 | 7 | gb105pln | *Zea mays* glycine-rich RNA binding protein (GRP) mRNA, complete cds. |
| 700263220H1 | g575354 | 74 | −11 | gb105pln | *O. sativa* SC34 mRNA for tumor suppressor. |
| 700262312H1 | g21271 | 58 | −55 | gb105pln | *S. oleracea* mRNA for phosphoglycerate kinase (chloroplast isoenzyme). |
| 700261788H1 | g403218 | 34 | −2 | gb105allp | Transplantation Antigene |
| 700259158H2 | g22281 | 41 | −60 | gb105pln | *Zea mays* Glb1-0 gene for vicilin-like storage protein (truncated) |
| 700258727H1 | g1532047 | 14 | 1 | gb105pln | *O. sativa* mRNA for S-adenosylmethionine decarboxylase. |
| 700266228H1 | g1196896 | 56 | −51 | gb105pln | *Glycine max* acidic ribosomal protein P0 mRNA, complete cds. |
| 700258141H1 | g22119 | 96 | −77 | gb105pln | Maize Adh1-F mRNA for alcohol dehydrogenase. |
| 700262834H1 | g1870198 | 54 | −39 | gb105pln | *Z. mays* mRNA for acyl carrier protein. |
| 700258151H1 | g303854 | 48 | −58 | gb105pln | Rice mRNA for ribosomal protein L7A, complete cds. |
| 700268119H1 | g2078349 | 43 | −38 | gb105pln | *Solanum tuberosum* transaldolase (PotTal1) mRNA, complete cds. |
| 700266171H1 | g1458098 | 16 | −5 | gb105eukp | Gea8; globulin-like protein |
| 700265904H1 | g2814711 | 15 | 5 | gb105eukp | T12D8.8 |
| 700262632H1 | g2464926 | 34 | −3 | gb105eukp | hypothetical protein |
| 700257989H1 | g2293565 | 30 | −11 | gb105pln | *Oryza sativa* ADP-ribosylation factor 1 (Os-ARF1) mRNA, complete cds. |
| 700266460H1 | g963061 | 29 | −12 | gb105pln | *H. vulgare* Ole-1 mRNA for oleosin. |
| 700262656H1 | g168584 | 34 | −22 | gb105pln | Corn pyruvate, orthophosphate dikinase gene, exons 2–19. |
| 700260518H2 | g687244 | 37 | −70 | gb105pln | *Zea mays* oil body protein 16 kDa oleosin (ole16) gene, complete cds. |
| 700264534H1 | g168512 | 36 | −43 | gb105pln | Maize major protein (L3) mRNA from the surface of lipid bodies, 3' end. |
| 700256940H1 | g1325967 | 27 | 5 | gb105pln | *T. aestivum* histone H2A gene (clone TH274). |
| 700257476H2 | g500677 | 9 | 5 | gb105eukp | YHR122w; Yhr122wp |
| 700264459H1 | g397524 | 7 | 6 | gb105allp | polypyrimidine tract binding protein |
| 700258488H1 | g313266 | 34 | −6 | gb105pln | *T. aestivum* gene for phosphoglycerate kinase. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700258367H1 | g971279 | 44 | −42 | gb105pln | Rice mRNA for RAB24 protein, complete cds. |
| 700259353H1 | g995838 | 26 | −10 | gb105pln | *Arabidopsis thaliana* protein phosphatase homolog (PPH1) mRNA, partial cds. |
| 700266050H1 | g2267005 | 44 | −39 | gb105pln | *Oryza sativa* endosperm lumenal binding protein (BiP) mRNA, complete cds. |
| 700263141H1 | g1022971 | 29 | 6 | gb105allp | weak similarity to *M. musculus* ubiquitin carboxyl-terminal hydrolase (SP:UBP MOUSE, P35123); similar to *S. pombe* double-strand-break repair protein, RAD21 (SP:RA21_SCHPO,P30776) |
| 700256931H1 | g687244 | 76 | 2 | gb105pln | *Zea mays* oil body protein 16 kDa oleosin (ole16) gene, complete cds. |
| 700260329H1 | g2992 | 9 | 8 | gb105pln | *Neurospora crassa* crp-1 mRNA for ribosomal protein homologous to Yeast cyH2 gene encoding L29. |
| 700260035H1 | g1296954 | 46 | −3 | gb105pln | *O. sativa* mRNA for novel protein, osr40c1. |
| 700261453H1 | g2345153 | 36 | −40 | gb105pln | *Zea mays* ribsomal protein S4 (rps4) mRNA, complete cds. |
| 700260263H1 | g170133 | 25 | −3 | gb105eukp | ribosomal protein L13 |
| 700257726H1 | g555941 | 33 | 7 | gb105allp | ribosomal protein S3 |
| 700265217H1 | g435648 | 40 | −0 | gb105pln | Rice mRNA for gamma-Tip, complete cds. |
| 700262781H1 | g1185553 | 33 | −70 | gb105pln | *Zea mays* glyceraldehyde-3-phosphate dehydrogenase (gpc2) gene, complete cds. |
| 700260015H1 | g1136741 | 11 | 8 | gb105allp | predicted protein of 548 amino acids |
| 700257824H1 | g561911 | 49 | −35 | gb105pln | *Triticum aestivum* L. (clone 3LC2) heat shock protein (hsp16.9-3LC2) mRNA, complete cds. |
| 700265625H1 | g1724101 | 48 | −44 | gb105pln | *Mesembryanthemum crystallinum* S-adenosyl-L-homocystein hydrolase mRNA, complete cds. |
| 700266465H1 | g168481 | 8 | 7 | gb105eukp | globulin precursor |
| 700259671H1 | g1486286 | 20 | −21 | gb105pln | *C. sativus* mRNA for T-complex polypeptide 1. |
| 700262261H1 | g1054795 | 61 | −65 | gb105pln | *H. vulgare* mRNA for transmembrane protein. |
| 700264256H1 | g168512 | 35 | −66 | gb105pln | Maize major protein (L3) mRNA from the surface of lipid bodies, 3' end. |
| 700266535H1 | g1209316 | 28 | −29 | gb105pln | *Hevea brasiliensis* ethylene-inducible protein (ER1) mRNA, complete cds. |
| 700207122H1 | g22281 | 49 | −17 | gb105pln | *Zea mays* Glb1-0 gene for vicilin-like storage protein (truncated). |
| 700261174H1 | g1184771 | 44 | −75 | gb105pln | *Zea mays* glyceraldehyde-3-phosphate dehydrogenase GAPC2 (gpc2) mRNA, complete cds. |
| 700258284H1 | g1870151 | 18 | 1 | gb105pln | Yeast (*Saccharomyces pombe*) mRNA for SEC61 protein. |
| 700266165H1 | g416149 | 11 | 3 | gb105eukp | tub7; beta-7 tubulin |
| 700265210H1 | g1938424 | 6 | 5 | gb105eukp | K09H11.1 |
| 700258610H1 | g1370568 | 11 | 1 | gb105eukp | ORF YPL275w |
| 700267475H1 | g1788173 | 10 | 5 | gb105allp | aspartyl-tRNA synthetase |
| 700262311H1 | g393400 | 27 | −70 | gb105pln | *Z. mays* mRNA for alpha-tubulin. |
| 700256908H1 | g520582 | 20 | 0 | gb105eukp | Ids3 |
| 700264802H1 | g168512 | 30 | −16 | gb105pln | Maize major protein (L3) mRNA from the surface of lipid bodies, 3' end. |
| 700262116H1 | g258166 | 57 | −56 | gb105pln | Wx (wx-Stoner) = waxy gene {long terminal repeat} [maize, Genomic Mutant, 559 nt]. |
| 700258923H1 | g168608 | 74 | −54 | gb105pln | Maize 17S ribosomal RNA gene and flanks. |
| 700266069H1 | g168405 | 68 | −83 | gb105pln | maize alcohol dehydrogenase (adh1) mrna 3' end and flank. |
| 700264232H1 | g2341023 | 42 | −30 | gb105pln | Sequence of BAC F19P19 from *Arabidopsis thaliana* chromosome 1, complete sequence. |
| 700257726H1 | g32532 | 33 | 7 | gb105allp | ribosomal protein s3 |
| 700265610H1 | g687244 | 66 | −10 | gb105pln | *Zea mays* oil body protein 16 kDa oleosin (ole16) gene, complete cds. |
| 700264759H1 | g2815100 | 11 | −1 | gb105eukp | Y39E4A.2b |
| 700262355H1 | g296204 | 23 | −10 | gb105eukp | PAlaAT-2; alanine aminotransferase; EC 2.6.1.2 |
| 700262072H1 | g1724111 | 15 | 14 | gb105pln | *Triticum aestivum* ABA induced |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | plasma membrane protein PM-19 (WTABAPM) mRNA, complete cds. |
| 700267426H1 | g21834 | 62 | −56 | gb105pln | Wheat mRNA for cytosolic phosphoglycerate kinase (EC 2.7.2.3). |
| 700263133H1 | g22614 | 66 | −13 | gb105pln | *S. vulgare* pepC gene for PEP carboxylase. |
| 700265374H1 | g487286 | 39 | 4 | gb105pln | Rice mRNA EN053, partial sequence. |
| 700257674H1 | g22285 | 56 | −29 | gb105pln | *Zea mays* Glb1-S gene for vicilin-like embryo storage protein. |
| 700267315H1 | g1519250 | 49 | −42 | gb105pln | *Oryza sativa* GF14-c protein mRNA, complete cds. |
| 700265232H1 | g168587 | 84 | −34 | gb105pln | *Zea mays* cofactor-independent phosphoglycerate mutase mRNA, complete cds. |
| 700261209H1 | g168460 | 46 | −49 | gb105pln | *Zea mays* cyclophilin (CyP) mRNA, complete cds. |
| 700266892H1 | g1550813 | 96 | −54 | gb105pln | *Z. mays* mRNA for acidic ribosomal protein P0. |
| 700258224H1 | g172423 | 24 | −8 | gb105pln | Yeast (*Saccharomyces cerevisiae*) ribosomal protein L1 gene, complete cds. |
| 700264619H1 | g2736287 | 43 | −29 | gb105pln | *Camptotheca acuminata* isopentenyl diphosphate isomerase II (IPI2) mRNA, complete cds. |
| 700257875H1 | g429019 | 23 | −7 | gb105pln | Rice mRNA for MAP kinase (gene name SS516), partial cds. |
| 700261005H1 | g854669 | 10 | 5 | gb105eukp | PRP18 |
| 700258143H1 | g551319 | 21 | −3 | gb105pln | Yeast (*Saccharomyces cerevisiae*) chromosome VIII cosmid 9986. |
| 700258901H1 | g22285 | 39 | −69 | gb105pln | *Zea mays* Glb1-S gene for vicilin-like embryo storage protein. |
| 700261293H1 | g736271 | 45 | −62 | gb105pln | *O. sativa* hsp70 gene for heat shock protein 70. |
| 700259154H2 | g2351376 | 27 | −6 | gb105eukp | eIF3-p47 homolog; homolog of human translation initiation factor eIF3 p47 subunit |
| 700258605H1 | g777757 | 71 | −85 | gb105pln | *Saccharum* hybrid (clone SCUBI561) polyubiquitin mRNA, complete cds. |
| 700266145H1 | g1370187 | 28 | −24 | gb105pln | *L. japonicus* mRNA for small GTP-binding protein, RAB7D. |
| 700265206H1 | g2443890 | 14 | −11 | gb105eukp | F11P17.16 |
| 700258783H1 | g1707371 | 35 | −20 | gb105pln | *A. thaliana* mRNA for SMT3 protein. |
| 700258475H1 | g1658312 | 66 | 1 | gb105pln | *O. sativa* osr40g2 gene. |
| 700257181H1 | g506471 | 24 | −0 | gb105eukp | unnamed protein product |
| 700262865H1 | g1129084 | 21 | 5 | gb105pln | Wheat mRNA for protein H2A, complete cds, clone wcH2A-3. |
| 700256939H1 | g2462744 | 13 | 5 | gb105eukp | F8A5.28 |
| 700266122H1 | g1622938 | 21 | −3 | gb105pln | *Bromus secalinus* oleosin (ole16) mRNA, complete cds. |
| 700267071H1 | g1854445 | 21 | 5 | gb105eukp | CPRD14 protein |
| 700260373H2 | g170767 | 47 | −43 | gb105pln | Wheat Nor-D3 locus ribosomal RNA gene. |
| 700265375H1 | g22272 | 82 | −79 | gb105pln | Maize mRNA for enolase (2-phospho-D-glycerate hydrolase). |
| 700264377H1 | g168460 | 77 | −70 | gb105pln | *Zea mays* cyclophilin (CyP) mRNA, complete cds. |
| 700262306H1 | g22287 | 7 | 7 | gb105eukp | Glb1-S; vicilin-like embryo storage protein |
| 700256972H1 | g1808578 | 43 | 1 | gb105allp | proteasome subunit p112 |
| 700264752H1 | g603415 | 25 | −8 | gb105eukp | YER174C; Yer174cp |
| 700263690H1 | g685198 | 8 | 4 | gb105allp | copper amine oxidase |
| 700259380H1 | g2264316 | 13 | 4 | gb105pln | *Arabidopsis thaliana* genomic DNA, chromosome 5, P1 clone: MRO11, complete sequence. |
| 700268189H1 | g606810 | 66 | −56 | gb105pln | *Zea mays* carbonic anhydrase mRNA, complete cds. |
| 700257148H1 | g2213606 | 13 | 15 | gb105pln | Genomic sequence for *Arabidopsis thaliana* BAC F21J9, complete sequence. |
| 700266292H1 | g168508 | 55 | −49 | gb105pln | Maize oleosin KD18 (KD18; L2) gene, complete cds. |
| 700259245H1 | g2351061 | 14 | −4 | gb105pln | *Arabidopsis thaliana* genomic DNA, chromosome 5, P1 clone: MAF19. |
| 700267972H1 | g169818 | 49 | −64 | gb105pln | Rice 25S ribosomal RNA gene. |
| 700259384H1 | g471320 | 22 | −34 | gb105pln | *H. vulgare* (cv. Bomi) B15C mRNA. |
| 700257833H1 | g1814400 | 25 | −12 | gb105pln | *Mesembryanthemum crystallinum* |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | phosphoglucomutase (PGM) mRNA, complete cds. |
| 700259302H1 | g22118 | 37 | −77 | gb105pln | Z. mays DNA for Adh1-Cm allele. |
| 700258814H1 | g671655 | 18 | −6 | gb105pln | S. vulgare gene for gamma-kafirin. |
| 700268025H1 | g927239 | 9 | 3 | gb105allp | globulin1 |
| 700261575H1 | g168460 | 64 | −21 | gb105pln | Zea mays cyclophilin (CyP) mRNA, complete cds. |
| 700265486H1 | g169834 | 43 | −52 | gb105pln | Rye 26S rRNA 3' end and 18S rRNA, 5' end. |
| 700265364H1 | g18890 | 51 | −49 | gb105pln | H. vulgare gene for aldose reductase-related protein. |
| 700266380H1 | g1458097 | 11 | 13 | gb105pln | Daucus carot globulin-like protein (Gea8) gene, complete cds. |
| 700263968H1 | g22270 | 24 | −23 | gb105pln | Maize mRNA from an embryogenic abscisic acid-inducible gene. |
| 700262478H1 | g475552 | 5 | 7 | gb105allp | N-methyl-D-aspartate receptor NMDAR2D subunit |
| 700256707H1 | g396209 | 36 | −25 | gb105pln | S. polyrrhiza mRNA for D-myo-inositol-3-phosphate synthase. |
| 700267687H1 | g22483 | 76 | −67 | gb105pln | Z. mays RNA for superoxide dismutase Sod4. |
| 700258520H1 | g168665 | 74 | −64 | gb105pln | Maize 16- kDa zein-2 mRNA, complete cds. |
| 700263439H1 | g2243115 | 24 | −18 | gb105pln | A. thaliana mRNA for aspartate kinase. |
| 700266617H1 | g1143387 | 25 | 13 | gb105pln | A. thaliana mRNA for Class III ADH. |
| 700258048H1 | g1495768 | 30 | 1 | gb105allp | chloroplast inner envelope protein, 110 kD (IEP110) |
| 700264308H1 | g1694832 | 23 | −19 | gb105pln | H. vulgare Per1 gene. |
| 700258495H1 | g22151 | 60 | −30 | gb105pln | Z. mays (A188) mRNA for alpha-tubulin 4. |
| 700207120H1 | g2668745 | 51 | −71 | gb105pln | Zea mays inorganic pyrophosphatase (IPP) mRNA, complete cds. |
| 700264944H1 | g1658312 | 28 | −27 | gb105pln | O. sativa osr40g2 gene. |
| 700264426H1 | g2586077 | 13 | 13 | gb105pln | Sorghum bicolor repeat region pSau3A9. |
| 700265662H1 | g1136574 | 31 | −46 | gb105pln | Sorghum bicolor heat shock protein 70 (hsp70) pseudogene. |
| 700263049H1 | g2668747 | 68 | −48 | gb105pln | Zea mays ribosomal protein L17 (rp117) mRNA, complete cds. |
| 700260160H1 | g168480 | 66 | −66 | gb105pln | Maize embryo globulin S allele (7S-like) mRNA, complete cds. |
| 700258773H1 | g633109 | 26 | −28 | gb105pln | Rice mRNA for plasma membrane H+-ATPase, complete cds. |
| 700259363H1 | g22272 | 98 | −90 | gb105pln | Maize mRNA for enolase (2-phospho-D-glycerate hydrolase) |
| 700264682H1 | g596079 | 67 | −56 | gb105pln | Zea mays thiamine biosynthetic enzyme (thi1-2) mRNA, complete cds. |
| 700259693H1 | g294667 | 28 | −19 | gb105pln | Castor bean chloroplast beta-ketoacyl-ACP synthase (50 kDa synthase) mRNA, complete cds. |
| 700262102H1 | g2204226 | 48 | 6 | gb105eukp | cleave terminal galactose residue; alpha-galactosidase; EC 3.2.1.22 |
| 700262554H1 | g471320 | 46 | −51 | gb105pln | H. vulgare (cv. Bomi) B15C mRNA. |
| 700261858H1 | g18748 | 10 | 6 | gb105eukp | a protein similar to potato tuber protein p322 homolgous to Bowman-Birk Proteinase Inhibitor |
| 700265193H1 | g168545 | 69 | −28 | gb105pln | Zea mays putative ribosomal protein L19 homolog mRNA, partial cds. |
| 700257233H1 | g406663 | 19 | −2 | gb105allp | GTP-binding protein |
| 700262822H1 | g2246378 | 16 | −6 | gb105eukp | plastid development; plastid protein |
| 700259743H1 | g286011 | 28 | 5 | gb105allp | KIAA0002 |
| 700258419H1 | g287398 | 35 | −19 | gb105pln | Rice mRNA for a protein related to chilling tolerance. |
| 700266662H1 | g1480017 | 26 | −16 | gb105pln | Brassica rapa mRNA for ribosomal protein, complete cds. |
| 700264745H1 | g168480 | 82 | 5 | gb105pln | Maize embryo globulin S allele (7S-like) mRNA, complete cds. |
| 700258278H1 | g22281 | 37 | −53 | gb105pln | Zea mays Glb1-0 gene for vicilin-like storage protein (truncated). |
| 700259620H1 | g20187 | 41 | −51 | gb105pln | O. sativa gene encoding calmodulin. |
| 700267070H1 | g687244 | 51 | −83 | gb105pln | Zea mays oil body protein 16 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | kDa oleosin (ole16) gene, complete cds. |
| 700261258H1 | g2463334 | 20 | −21 | gb105pln | *Oryza sativa* mRNA for ribosomal protein S4. |
| 700258110H1 | g168487 | 96 | −81 | gb105pln | Maize glutathione S-transferase gene (GST-I), exons 2 and 3. |
| 700267065H1 | g732576 | 28 | 6 | gb105allp | SAM-synthetase |
| 700260128H1 | g22283 | 32 | −63 | gb105pln | *Zea mays* Glb1-L gene for vicilin-like embryo storage protein. |
| 700263263H1 | g2190991 | 21 | −4 | gb105pln | *Aegilops squarrosa* glutathione S-transferase TSI-1 mRNA, complete cds. |
| 700265544H1 | g19275 | 6 | 6 | gb105eukp | protein of unknown function |
| 700261829H1 | g2114208 | 89 | −84 | gb105pln | Wheat DNA for 18S rRNA and telomere repeat sequence. |
| 700261217H1 | g2754745 | 10 | 8 | gb105pln | *Actinidia deliciosa* sucrose-phosphate synthase (KSPS-1) mRNA, partial cds. |
| 700265783H1 | g687244 | 49 | −84 | gb105pln | *Zea mays* oil body protein 16 kDa oleosin (ole16) gene, complete cds. |
| 700264702H1 | g2511530 | 60 | −52 | gb105pln | *Eleusine indica* alpha tubulin 1 (TUA1) mRNA, complete cds. |
| 700265121H1 | g2827524 | 18 | 7 | gb105eukp | F8F16.110; predicted protein |
| 700266432H1 | g2291232 | 36 | −22 | gb105eukp | F32D1.1 |
| 700264448H1 | g687244 | 49 | −81 | gb105pln | *Zea mays* oil body protein 16 kDa oleosin (ole16) gene, complete cds. |
| 700263823H1 | g168512 | 26 | −5 | gb105pln | Maize major protein (L3) mRNA from the surface of lipid bodies, 3' end. |
| 700258619H1 | g556559 | 45 | −39 | gb105pln | Rice mRNA for homologue of Tat binding protein, complete cds. |
| 700264627H1 | g599722 | 54 | −45 | gb105pln | *C. melo* mRNA for aconitase (UNI-ZAPxR). |
| 700267225H1 | g2062022 | 6 | 8 | gb105allp | putative progesterone binding protein |
| 700262594H1 | g1184771 | 54 | −56 | gb105pln | *Zea mays* glyceraldehyde-3-phosphate dehydrogenase GAPC2 (gpc2) mRNA, complete cds. |
| 700267876H1 | g2398680 | 28 | −28 | gb105pln | *Morinda citrifolia* mRNA for 3-deoxy-D-arabino-heptulosonate 7-phosphate synthase, DS2. |
| 700264961H1 | g2656029 | 17 | −6 | gb105pln | *Arabidopsis thaliana* genomic DNA, chromosome 5, P1 clone: MQB2. |
| 700262621H1 | g793901 | 36 | 2 | gb105pln | *Z. mays* mRNA for ZEMa protein (ZEM1 gene). |
| 700267670H1 | g1335965 | 88 | −81 | gb105pln | *Zea mays* acetyl CoA carboxylase mRNA, partial cds. |
| 700266834H1 | g1136123 | 23 | 8 | gb105pln | *O. sativa* mRNA for alpha-tubulin (clone OSTA-274) |
| 700264247H1 | g1173555 | 32 | −26 | gb105eukp | gaiE; catabolism of galactose to glucose in Leloir pathway, and in galactose synthesis from glucose.; UDP-galactose-4-epimerase; EC 5.1.3.2 |
| 700262642H1 | g1542940 | 18 | 4 | gb105pln | *R. sativus* L. (Saxa knacker) AACT mRNA. |
| 700266735H1 | g1276946 | 34 | 0 | gb105eukp | globulin-like protein |
| 700257055H1 | g5272 | 25 | −11 | gb105eukp | DBP2; p68 protein |
| 700265157H1 | g218262 | 25 | −7 | gb105eukp | early nodulin |
| 700258053H1 | g473976 | 51 | −38 | gb105pln | Rice mRNA, partial homologous to elongation factor 1-alpha gene. |
| 700267983H1 | g20501 | 13 | 1 | gb105eukp | vicilin-like storage protein |
| 700262270H1 | g514945 | 39 | −31 | gb105pln | *Zea mays* sucrose synthase (Sus1) mRNA, complete cds. |
| 700207228H1 | g2344885 | 14 | −12 | gb105pln | *Arabidopsis thaliana* chromosome II BAC T13E15 genomic sequence, complete sequence. |
| 700266256H1 | g1743006 | 21 | −8 | gb105pln | *C. paradoxa* mRNA for ribosomal protein L13a. |
| 700265471H1 | g963061 | 12 | 10 | gb105pln | *H. vulgar* Ole-1 mRNA for oleosin. |
| 700260962H1 | g1216228 | 23 | −6 | gb105eukp | orf:PZC399 |
| 700257104H1 | g435648 | 46 | −32 | gb105pln | Rice mRNA for gamma-Tip, complete cds. |
| 700260547H2 | g1724112 | 23 | 3 | gb105eukp | WTABAPM; ABA induced plasma membrane protein PM 19 |
| 700259329H1 | g20359 | 78 | −32 | gb105pln | Rice gene for 17S ribosomal RNA. |
| 700265378H1 | g2641943 | 24 | −10 | gb105pln | Yeast (*Schizosaccharomyces pombe*) DNA for elongation factor 2, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264064H1 | g20237 | 30 | −27 | gb105pln | *O. sativa* (rice) constitutive GOS2 gene. |
| 700262670H1 | g623590 | 26 | 3 | gb105eukp | Nt-rab7b |
| 700258781H1 | g506138 | 64 | −48 | gb105pln | *Zea mays* Ec metallothionein class II protein mRNA, complete cds. |
| 700264654H1 | g166955 | 39 | −31 | gb105pln | *Beta vulgaris* (sugarbeet) cytosolic fructose-1,6-bisphosphatase mRNA, complete cds. |
| 700258414H1 | g1143444 | 26 | −11 | gb105pln | *E. gunnii* mRNA for cinnamyl alcohol dehydrogenase. |
| 700258267H1 | g454303 | 30 | −3 | gb105eukp | LDJ2 |
| 700265453H1 | g1403043 | 14 | 4 | gb105pln | *H. chilense* × *T. turgidum* conv. durum (Tritordeum) mRNA for S-adenosyl-methionine decarboxylase. |
| 700264372H1 | g168480 | 53 | −86 | gb105pln | Maize embryo globulin S allele (7S-like) mRNA, complete cds. |
| 700261674H1 | g20255 | 13 | −11 | gb105pln | *O. sativa* gene for heat shock protein 82 HSP82. |
| 700267308H1 | g2331300 | 48 | −82 | gb105pln | *Zea mays* ribosomal protein S4 type I (rps4) mRNA, complete cds. |
| 700261004H1 | g1049090 | 9 | 5 | gb105allp | SRp40-2 |
| 700266963H1 | g886739 | 61 | −50 | gb105pln | *Z. mays* histone H4 gene. |
| 700261313H1 | g22281 | 61 | −50 | gb105pln | *Zea mays* Glb1-0 gene for vicilin-like storage protein (truncated) |
| 700260589H2 | g1575127 | 75 | 3 | gb105pln | *Zea mays* lumenal binding protein cBiPe2 mRNA, complete cds. |
| 700258789H1 | g409580 | 15 | 6 | gb105allp | serine carboxypeptidase I |
| 700266206H1 | g180004S | 11 | 7 | gb105allp | SUCCINATE-SEMIALDEHYDE DEHYDROGENASE (NADP+) (EC 1.2.1.16) (SSDH) |
| 700260947H1 | g762784 | 10 | 15 | gb105pln | *Brassica campestris* (clone BCPI-1) cysteine proteinase inhibitor mRNA, complete cds. |
| 700262559H1 | g1532162 | 14 | 9 | gb105pln | *Arabidopsis thaliana* AT.I.24-1, AT.I.24-2, AT.I.24-3, AT.I.24-4, AT.I.24-5, AT.I.24-6, AT.I.24-9 and AT.I.24-14 genes, partial cds, AT.I.24-7, ascorbate peroxidase (ATHAPX1), EF-1alpha-A1, -A2 and -A3 (EF-1alpha) and AT.I.24-13 genes, complete cds. |
| 700260813H1 | g2266661 | 50 | −31 | gb105pln | *Hordeum vulgare* mRNA for 14-3-3 protein (Hv1433c) |
| 700259714H1 | g455496 | 67 | −17 | gb105pln | Rice mRNA for pyrophosphate-fructose 6-phosphate 1-phosphotransferase, partial sequence. |
| 700266865H1 | g2257597 | 49 | −24 | gb105pln | *Robinia pseudoacacia* mRNA for phosphoglycerate kinase, partial cds. |
| 700261105H1 | g294666 | 16 | 0 | gb105eukp | beta-ketoacyl-ACP synthase; 46 kDa synthase |
| 700263928H1 | g168508 | 70 | 2 | gb105pln | Maize oleosin KD18 (KD18; L2) gene, complete cds. |
| 709262936H1 | g508974 | 30 | −33 | gb105pln | *Triticum aestivum* Chinese spring protein disulfide isomerase (PDI) mRNA, complete cds. |
| 700262429H1 | g167112 | 38 | −23 | gb105pln | *Bromus inermis* aldose reductase-related protein, complete cds. |
| 700261319H1 | g459894 | 86 | −32 | gb105pln | *Zea mays* sus1 gene, complete cds. |
| 700258238H1 | g469147 | 51 | −54 | gb105pln | *H. vulgare* mRNA for alanine aminotransferase. |
| 700266186H1 | g687244 | 48 | −67 | gb105pln | *Zea mays* oil body protein 16 kDa oleosin (ole16) gene, complete cds. |
| 700259024H1 | g763204 | 14 | −9 | gb105eukp | TCPibeta; Tcpibetap |
| 700264846H1 | g1532047 | 11 | 16 | gb105pln | *O. sativa* mRNA for S-adenosylmethionine decarboxylase. |
| 700257161H1 | g1345506 | 8 | −2 | gb105eukp | ATAF1 |
| 700259218H1 | g1561576 | 37 | −21 | gb105pln | *D. stramonium* mRNA for spermidine synthase 1. |
| 700267289H1 | g1724111 | 16 | 13 | gb105pln | *Triticum aestivum* ABA induced plasma membrane protein PM-19 (WTABAPM) mRNA, complete cds. |
| 700265502H1 | g17795 | 18 | 7 | gb105eukp | Bplo |
| 700260563H2 | g167107 | 39 | −38 | gb105pln | *Hordeum vulgare* vacuolar ATPase B subunit isoform mRNA, complete cds. |
| 700265012H1 | g2352923 | 19 | 7 | gb105allp | cytosolic glucose-6-phosphate dehydrogenase 2 |
| 700261885H1 | g2662342 | 55 | −68 | gb105pln | *Oryza sativa* mRNA for EF-1 |

TABLE 1-continued

LIST OF INCYTE CLONES DERIVED FROM SATMON022023
COPYRIGHT 1998 INCYTE PHARMACEUTICALS, INC.

| | | | | |
|---|---|---|---|---|
| 700256701H1 | g2282583 | 68 | −77 | gb105pln | alpha, complete cds. Zea mays elongation factor 1-alpha (EF1-A) mRNA, complete cds. |
| 700268142H1 | g4443 | 6 | −1 | gb105eukp | SEC23 gene product (AA 1–768) |
| 700260124H1 | g924952 | 33 | −22 | gb105pln | Triticum aestivum beta 1,3-glucanase (Glc1) mRNA, complete cds. |
| 700267685H1 | g393707 | 10 | 6 | gb105allp | acetyl-CoA acyltransferase |
| 700260255H1 | g2246624 | 33 | −2 | gb105pln | Oryza sativa protein kinase mRNA, complete cds. |
| 700258378H1 | g498774 | 98 | −80 | gb105pln | Z. mays (cv DH5xDH7) hsp70-5 mRNA for heat shock protein 70. |
| 700267786H1 | g533251 | 76 | −37 | gb105pln | Zea mays (clone pSM8) sucrose synthase 2 (Sus1) gene, complete cds. |
| 700266728H1 | g2262111 | 34 | −4 | gb105eukp | T19F06.14; ribitol dehydrogenase isolog |
| 700260591H2 | g12546 | 20 | 7 | gb105eukp | pMCPN60-2; chaperonin 60 |
| 700267651H1 | g2217970 | 12 | 1 | gb105allp | p40 |
| 700267164H1 | g168480 | 58 | −60 | gb105pln | Maize embryo globulin S allele (7S-like) mRNA, complete cds. |
| 700260310H2 | g687246 | 38 | 2 | gb105pln | Zea mays oil body protein 17 kDa oleosin (ole17) gene, complete cds. |
| 700264618H1 | g206730 | 17 | −3 | gb105allp | ribosomal protein L35 |
| 700263620H1 | g904154 | 17 | −1 | gb105eukp | microsomal omega-6 desaturase |
| 700257111H1 | g466441 | 17 | 7 | gb105allp | Ser/Thr protein phosphatase |
| 700258632H1 | g1155212 | 42 | −35 | gb105pln | Avena fatua aldose reductase-related protein mRNA, complete cds. |
| 700258287H1 | g20412 | 29 | −9 | gb105pln | P. amygdalus mRNA for alpha-tubulin. |
| 700256706H1 | g170784 | 36 | −14 | gb105pln | Wheat ubiquitin carrier protein (UBC1) mRNA, complete cds. |
| 700265871H1 | g22281 | 52 | −49 | gb105pln | Zea mays Glb1-0 gene for vicilin-like storage protein (truncated) |
| 700264692H1 | g19348 | 21 | −6 | gb105pln | L. esculentum mRNA for shikimate kinase precursor. |
| 700264369H1 | g1800218 | 66 | −59 | gb105pln | Sorghum bicolor phytochrome C (PHYC) mRNA, complete cds. |
| 700256911H1 | g170107 | 11 | 7 | gb105eukp | CPN10; chaperonin 10 |
| 700257054H1 | g2225877 | 36 | 2 | gb105allp | TIP49 |
| 700263358H1 | g288062 | 32 | −22 | gb105pln | A. thaliana mRNA for ketol-acid reductoisomerase subunit. |
| 700262020H1 | g168512 | 42 | −36 | gb105pln | Maize major protein (L3) mRNA from the surface of lipid bodies, 3′ end. |
| 700266631H1 | g710307 | 53 | −45 | gb105pln | Avena sativa victorin binding protein mRNA, complete cds. |
| 700262959H1 | g168508 | 75 | −55 | gb105pln | Maize oleosin KD18 (KD18; L2) gene, complete cds. |
| 700262933H1 | g2463334 | 39 | −54 | gb105pln | Oryza sativa mRNA for ribosomal protein S4. |
| 700262781H1 | g312178 | 33 | −66 | gb105pln | Z. mays GapC2 gene. |
| 700267715H1 | g2654209 | 50 | −48 | gb105pln | Spinacia oleracea heat shock 70 protein (HSC70-10) mRNA, nuclear gene encoding mitochondrial protein, complete cds. |
| 700263973H1 | g520935 | 31 | −3 | gb105pln | H. vulgare mRNA for gamma-TIP-like protein. |
| 700260105H1 | g2218151 | 20 | −39 | gb105pln | Vigna unguiculata type IIIa membrane protein cp-wap13 mRNA, complete cds. |
| 700257645H1 | g1256944 | 18 | 8 | gb105eukp | sui2; translation initiation factor 2 alpha subunit |
| 700264413H1 | g1946997 | 18 | −10 | gb105eukp | C32E10.8 |
| 700267212H1 | g2443401 | 51 | −43 | gb105pln | Oryza sativa mRNA for orthophosphate dikinase, complete cds. |
| 700267193H1 | g1015650 | 14 | −9 | gb105eukp | ILV3 |
| 700264914H1 | g1200160 | 27 | −17 | gb105pln | T. gesneriana mRNA for tonoplast intrinsic protein. |
| 700264749H1 | g520935 | 51 | −43 | gb105pln | H. vulgare mRNA for gamma-TIP-like protein. |
| 700260988H1 | g520935 | 28 | 7 | gb105pln | H. vulgare mRNA for gamma-TIP-like protein. |
| 700257828H1 | g2244760 | 21 | 7 | gb105eukp | selenium-binding protein |
| 700264084H1 | g1160445 | 6 | 3 | gb105allp | ribosomal protein S7 |
| 700266232H1 | g1066474 | 16 | −3 | gb105eukp | YPR118W; Ypr118wp |
| 700266444H1 | g1575127 | 68 | −82 | gb105pln | Zea mays lumenal binding protein cBiPe2 mRNA, complete cds. |
| 700264768H1 | g311330 | 20 | −1 | gb105pln | S. vulgare ltp1 gene. |
| 700260189H1 | g169818 | 60 | −30 | gb105pln | Rice 25S ribosomal RNA gene. |
| 700261546H1 | g533707 | 26 | 3 | gb105allp | 3-methylcrotonyl-CoA |

TABLE 1-continued

LIST OF INCYTE CLONES DERIVED FROM SATMON022023
COPYRIGHT 1998 INCYTE PHARMACEUTICALS, INC.

| Clone ID | g-number | | | Code | Description |
|---|---|---|---|---|---|
| | | | | | carboxylase precursor |
| 700266543H1 | g2394432 | 14 | 5 | gb105eukp | F23F1.6 |
| 700266425H1 | g168481 | 7 | 8 | gb105allp | globulin precursor |
| 700260920H1 | g1498385 | 55 | −68 | gb105pln | *Zea mays* actin (Maz87) gene, partial cds. |
| 700265564H1 | g1216231 | 19 | −2 | gb105eukp | SES1; seryl-tRNA synthetase |
| 700263633H1 | g493056 | 15 | 17 | gb105pln | *Pneumocystis carinii* extracellular matrix receptor protein mRNA, complete cds. |
| 700262778H1 | g687244 | 41 | −20 | gb105pln | *Zea mays* oil body protein 16 kDa oleosin (ole16) gene, complete cds. |
| 700264121H1 | g999395 | 51 | −40 | gb105pln | HSP81-3 = heat-shock Protein [*Arabidopsis thaliana* = thale-cress, Genomic, 3094 nt]. |
| 700267155H1 | g2274990 | 60 | −51 | gb105pln | *Hordeum vulgare* mRNA for expressed sequence tag. |
| 700267526H1 | g514945 | 72 | 15 | gb105pln | *Zea mays* sucrose synthase (Sus1) mRNA, complete cds. |
| 700258868H1 | g508295 | 15 | −5 | gb105pln | *Coffes arabica* Guatemalan metallothionein I (CAMETAL1) mRNA, complete cds. |
| 700267314H1 | g22270 | 67 | −73 | gb105pln | Maize mRNA from an embryogenic abscisic acid-inducible gene. |
| 700261362H1 | g2688828 | 10 | 3 | gb105eukp | ethylene-forming-enzyme-like dioxygenase |
| 700258594H1 | g2213425 | 19 | 6 | gb105eukp | unknown; hypothetical protein |
| 700262958H1 | g2345153 | 28 | 4 | gb105pln | *Zea mays* ribsomal protein S4 (rps4) mRNA, complete cds. |
| 700258343H1 | g2281081 | 22 | 5 | gb105pln | *Arabidopsis thaliana* chromosome II BAC F18O19 genomic sequence, complete sequence. |
| 700266622H1 | g2264318 | 43 | −27 | gb105pln | *Arabidopsis thaliana* genomic DNA, chromosome 5, P1 clone: MUP24, complete sequence. |
| 700263425H1 | g644491 | 37 | −21 | gb105pln | Corn mRNA for elongation factor 1A. |
| 700265272H1 | g1498052 | 77 | −85 | gb105pln | *Zea mays* ribosomal protein S8 mRNA, complete cds. |
| 700265972H1 | g2832633 | 14 | −7 | gb105eukp | F13C5.220; putative protein |
| 700259675H1 | g1015849 | 9 | −0 | gb105eukp | RPS5 |
| 700258329H1 | g168512 | 43 | −39 | gb105pln | Maize major protein (L3) mRNA from the surface of lipid bodies, 3' end. |
| 700266139H1 | g1296954 | 47 | −19 | gb105pln | *O. sativa* mRNA for novel protein, osr40c1. |
| 700264909H1 | g1502354 | 22 | −4 | gb105pln | Yeast (*Saccharomyces cerevisiae*) genomic sequence from chromosome VII. |
| 700261385H1 | g2351097 | 7 | 3 | gb105eukp | ATMRK1 |
| 700267003H1 | g170657 | 37 | −24 | gb105pln | *V. carteri* histone H2A-IV and H2B-IV genes, complete cds. |
| 700264183H1 | g169819 | 81 | −31 | gb105pln | Rice gene encoding three ribosomal RNA's: the 17S, 3' end; 5.8S, complete; 25S, 5' end. |
| 700260175H1 | g913941 | 27 | 0 | gb105eukp | btg-26 |
| 700262814H1 | g168405 | 95 | −52 | gb105pln | maize alcohol dehydrogenase (adh1) mrna 3' end and flank. |
| 700261685H1 | g1054845 | 32 | −14 | gb105eukp | END13 |
| 700265083H1 | g2618731 | 34 | −15 | gb105eukp | IAA21; IAA21 |
| 700263437H1 | g1045304 | 100 | −40 | gb105pln | *Zea mays* acetyl-coenzyme A carboxylase mRNA, complete cds. |
| 700260489H1 | g22287 | 8 | 7 | gb105eukp | Glb1-S; vicilin-like embryo storage protein |
| 700258495H1 | g602605 | 44 | −48 | gb105pln | *Zea mays* tandem genes for alpha1-tubulin and alpha2-tubulin. |
| 700264406H1 | g973312 | 15 | 7 | gb105pln | *Arabidopsis thaliana* myo-inositol 1-phosphate synthase isozyme-2 mRNA, complete cds. |
| 700264762H1 | g1171351 | 31 | −24 | gb105pln | *Oryza sativa* 16 kDa oleosin (ole16) mRNA, complete cds. |
| 700267559H1 | g509548 | 11 | 2 | gb105pln | Sorghum bicolor dehydrin (DHN1) mRNA, complete cds. |
| 700259842H1 | g2414402 | 29 | −12 | gb105eukp | Y57G11C.15 |
| 700266172H1 | g1209317 | 27 | −31 | gb105eukp | ER1; ethylene-inducible protein |
| 700262554H1 | g971279 | 43 | −46 | gb105pln | Rice mRNA for RAB24 protein, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700262288H1 | g168512 | 25 | −9 | gb105pln | Maize major protein (L3) mRNA from the surface of lipid bodies, 3' end. |
| 700266182H1 | g1236950 | 27 | −22 | gb105pln | Glycine max nucleoside diphosphate kinase mRNA, complete cds. |
| 700263701H1 | g16210 | 30 | −27 | gb105pln | *Arabidopsis thaliana* calnexin homolog. |
| 700258527H1 | g1561576 | 48 | −40 | gb105pln | *D. stramonium* mRNA for spermidine synthase 1. |
| 700258373H1 | g2464894 | 17 | −14 | gb105pln | *Arabidopsis thaliana* DNA chromosome 4, ESSA I AP2 contig fragment No. 2. |
| 700257833H1 | g1881692 | 50 | −41 | gb105pln | *Zea mays* phosphoglucomutase mRNA, partial cds. |
| 700264460H1 | g1532047 | 16 | 13 | gb105pln | *O. sativa* mRNA for S-adenosylmethionine decarboxylase. |
| 700265355H1 | g2815519 | 23 | −6 | gb105pln | *Arabidopsis thaliana* BAC T5J8 from chromosome IV, top arm, complete sequence. |
| 700261232H1 | g396209 | 20 | 0 | gb105pln | *S. polyrrhiza* mRNA for D-myo-inositol-3-phosphate synthase. |
| 700256867H1 | g396133 | 59 | −51 | gb105pln | *H. vulgare* BLT63 mRNA, complete CDS. |
| 700267261H1 | g1289203 | 38 | −37 | gb105pln | *A. glutinosa* mRNA for thiazole biosynthetic enzyme. |
| 700266649H1 | g20420 | 3 | 7 | gb105eukp | extensin |
| 700263177H1 | g2656024 | 23 | 5 | gb105pln | *Arabidopsis thaliana* genomic DNA, chromosome 5, TAC clone: K15E6. |
| 700267458H1 | g2351579 | 23 | 1 | gb105pln | *Prunus armeniaca* thymidine diphospho-glucose 4-6-dehydratase homolog mRNA, partial cds. |
| 700260010H1 | g1519252 | 34 | −5 | gb105pln | *Oryza sativa* GE14-d protein mRNA, complete cds. |
| 700264654H1 | g895908 | 42 | −35 | gb105pln | S. hybrid mRNA for cytosolic fructose-1,6-bisphosphatase. |
| 700260594H2 | g1147585 | 44 | −27 | gb105eukp | LysRS; ATP+L-LYSYNE + tRNA(LYS) = AMP + PYROPHOSPHATE +L-LYSYL −tRNA(LYS); Lysyl-tRNA synthetase; EC 6.1.1.6 |
| 700260528H2 | g536512 | 13 | 2 | gb105eukp | SSE2 |
| 700262491H1 | g1694832 | 26 | −5 | gb105pln | *H. vulgare* Per1 gene. |
| 700266104H1 | g20255 | 67 | −40 | gb105pln | *O. sativa* gene for heat shock protein 82 HSP82. |
| 700261546H1 | g550452 | 23 | 2 | gb105allp | 3-methylcrotonyl-CoA carboxylase, biotin-carrier domain |
| 700264855H1 | g22332 | 47 | 1 | gb105pln | *Z. mays* HRGP gene. |
| 700261862H1 | g22283 | 88 | 2 | gb105pln | *Zea mays* Glb1-L gene for vicilin-like embryo storage protein. |
| 700265514H1 | g170775 | 63 | −54 | gb105pln | Wheat translation elongation factor 1 alpha-subunit (TEF1) mRNA, complete cds. |
| 700262768H1 | g687244 | 29 | −79 | gb105pln | *Zea mays* oil body protein 16 kDa oleosin (ole16) gene, complete cds. |
| 700258168H1 | g687244 | 47 | −83 | gb105pln | *Zea mays* oil body protein 16 kDa oleosin (ole16) gene, complete cds. |
| 700259570H1 | g2828011 | 72 | −79 | gb105pln | *Zea mays* starch synthase I precursor (Ss1) mRNA, nuclear gene encoding plastid protein, complete cds. |
| 700259822H1 | g19701 | 24 | −26 | gb105pln | *N. plumbaginifolia* mRNA NeIF-5A2 for initiation factor 5A(2) |
| 700257617H1 | g7353 | 25 | 7 | gb105eukp | rp1024 protein |
| 700265550H1 | g18748 | 13 | 5 | gb105eukp | a protein similar to potato tuber protein p322 homolgous to Bowman-Birk Proteinase Inhibitor |
| 700263345H1 | g2511747 | 14 | 1 | gb105allp | probable transcriptional regulator dre4 |
| 700259474H1 | g22514 | 63 | −15 | gb105pln | Maize Zc1 gene for Zein Zc1 (14 kD zein-2) |
| 700258392H1 | g438241 | 17 | −13 | gb105eukp | CYP77A2 |
| 700267989H1 | g21732 | 25 | −2 | gb105pln | Wheat mRNA for Em protein. |
| 700266004H1 | g1254996 | 47 | 2 | gb105eukp | serine/threonine protein phosphatase type 2A regulatory subunit A |
| 700258619H1 | g732814 | 25 | −6 | gb105pln | *L. esculentum* LeMA-1 mRNA for putatve Mg-dependent ATPase 1. |
| 700268106H1 | g21863 | 63 | −62 | gb105pln | Wheat mRNA for Rubisco subunit binding-protein alpha subunit. |
| 700266165H1 | g166640 | 11 | 3 | gb105eukp | beta-tubulin |
| 700264357H1 | g927238 | 41 | −26 | gb105pln | *Zea mays* globulin1 (Glb1) gene, allele Glb1-Hb, complete cds. |
| 700266778H1 | g168512 | 35 | 14 | gb105pln | Maize major protein (L3) mRNA |

TABLE 1-continued

LIST OF INCYTE CLONES DERIVED FROM SATMON022023
COPYRIGHT 1998 INCYTE PHARMACEUTICALS, INC.

| Clone | GI | | | Library | Description |
|---|---|---|---|---|---|
| | | | | | from the surface of lipid bodies, 3' end. |
| 700267273H1 | g633890 | 20 | 4 | gb105allp | glucose and ribitol dehydrogenase homolog [barley, *Hordeum vulgare*, Peptide, 293 aa]. |
| 700262935H1 | g21245 | 53 | 1 | gb105eukp | Scytfbpy; fructose-bisphosphatase; EC 3.1.3.11 |
| 700266483H1 | g602605 | 39 | -51 | gb105pln | *Zea mays* tandem genes for alpha1-tubulin and alpha2-tubulin. |
| 700261671H1 | g2431766 | 69 | -53 | gb105pln | *Zea mays* acidic ribosomal protein P3a (rpp3a) mRNA, complete cds. |
| 700260959H1 | g927238 | 96 | -69 | gb105pln | *Zea mays* globulin1 (Glb1) gene, allele Glb1-Hb, complete cds. |
| 700261995H1 | g166386 | 39 | 0 | gb105eukp | isocitrate dehydrogenase |
| 700258701H1 | g22277 | 62 | -35 | gb105pln | Maize mRNA for ferritin (clone FM2). |
| 700258475H1 | g1658313 | 70 | 2 | gb105allp | osr40g2 |
| 700268142H1 | g2244772 | 31 | -21 | gb105eukp | transport protein |
| 700266251H1 | g533251 | 38 | -91 | gb105pln | *Zea mays* (clone pSM8) sucrose synthase 2 (Sus1) gene, complete cds. |
| 700264261H1 | g1620898 | 19 | 6 | gb105allp | protein involved in sexual development |
| 700262955H1 | g168460 | 87 | -65 | gb105pln | *Zea mays* cyclophilin (CyP) mRNA, complete cds. |
| 700262480H1 | g1658314 | 12 | 14 | gb105pln | *O. sativa* osr40g3 gene. |
| 700259743H1 | g1591659 | 22 | 8 | gb105allp | thermosome (ths) |
| 700267053H1 | g2827698 | 43 | -42 | gb105pln | *Arabidopsis thaliana* DNA chromosome 4, BAC clone F6H11 (ESSAII project) |
| 700267631H1 | g22237 | 98 | -90 | gb105pln | Maize mRNA for cytosolic GAPDH (GapC) glyceraldehyde-3-phosphate dehydrogenase. |
| 700264268H1 | g1136574 | 49 | -46 | gb105pln | Sorghum bicolor heat shock protein 70 (hsp70) pseudogene. |
| 700267054H1 | g1125690 | 32 | -16 | gb105pln | *S. tuberosum* mRNA for DnaJ protein. |
| 700262508H1 | g22281 | 41 | -68 | gb105pln | *Zea mays* Glb1-0 gene for vicilin-like storage protein (truncated) |
| 700264262H1 | g471320 | 67 | -56 | gb105pln | *H. vulgare* (cv. Bomi) B15C mRNA. |
| 700262277H1 | g2182028 | 52 | -45 | gb105pln | Oryza sp. mRNA for shaggy-like kinase etha. |
| 700267513H1 | g624938 | 28 | 8 | gb105allp | ribosomal protein L16 |
| 700262176H1 | g459748 | 26 | 1 | gb105allp | Sec61-complex gamma-subunit |
| 700262985H1 | g289212 | 29 | -30 | gb105pln | *Atriplex nummularia* homologous sequence (ANJ1) mRNA. |
| 700257017H1 | g2586333 | 16 | 2 | gb105allp | importin alpha |
| 700267990H1 | g1532072 | 29 | 3 | gb105pln | *Z. mays* mRNA for S-adenosylmethionine decarboxylase. |
| 700263283H1 | g1049067 | 50 | -43 | gb105pln | *Lycopersicon esculentum* RNA polymerase II subunit 2 (rpb2) mRNA, complete cds. |
| 700260246H1 | g1694832 | 21 | -26 | gb105pln | *H. vulgare* Per1 gene. |
| 700262975H1 | g471320 | 64 | -44 | gb105pln | *H. vulgare* (cv. Bomi) B15C mRNA. |
| 700264562H1 | g533280 | 25 | -1 | gb105eukp | ATMPK1 |
| 700267451H1 | g1296954 | 34 | -18 | gb105pln | *O. sativa* mRNA for novel protein, osr40c1. |
| 700263111H1 | g1532073 | 50 | 1 | gb105allp | S-adenosylmethionine decarboxylase |
| 700260344H2 | g168512 | 45 | -47 | gb105pln | Maize major protein (L3) mRNA from the surface of lipid bodies, 3' end. |
| 700264341H1 | g2749918 | 24 | 1 | gb105pln | *Arabidopsis thaliana* chromosome I BAC F3I6 genomic sequence, complete sequence. |
| 700263067H1 | g1519252 | 53 | -28 | gb105pln | *Oryza sativa* GF14-d protein mRNA, complete cds. |
| 700261209H1 | g829147 | 47 | -52 | gb105pln | *Z. mays* gene for cyclophilin. |
| 700259516H1 | g1658314 | 53 | -35 | gb105pln | *O. sativa* osr40g3 gene. |
| 700258512H1 | g2624199 | 40 | -26 | gb105pln | *M. acuminata* mRNA; clone pBAN UU93. |
| 700257382H1 | g687244 | 43 | -71 | gb105pln | *Zea mays* oil body protein 16 kDa oleosin (ole16) gene, complete cds. |
| 700266187H1 | g2351068 | 13 | 10 | gb105pln | *Arabidopsis thaliana* genomic DNA, chromosome 5, Pi clone: MRH10. |
| 700258633H1 | g1171351 | 64 | -66 | gb105pln | *Oryza sativa* 16 koa oleosin (ole16) mRNA, complete cds. |
| 700263739H1 | g2570009 | 6 | 7 | gb105allp | CLIC2 |
| 700263918H1 | g2244788 | 13 | 12 | gb105pln | *Arabidopsis thaliana* DNA |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | chromosome 4, ESSA I contig fragment No. 1. |
| 700266222H1 | g2654869 | 56 | −68 | gb105pln | *Oryza sativa* RbohAOsp mRNA, partial cds. |
| 700261522H1 | g2302294 | 14 | 6 | gb105allp | unnamed protein product |
| 700257979H1 | g1622938 | 23 | 1 | gb105pln | *Bromus secalinus* oleosin (ole16) mRNA, complete cds. |
| 700264621H1 | g1575129 | 55 | −75 | gb105pln | *Zea mays* lumenal binding protein cBiPe3 mRNA, complete cds. |
| 700263983H1 | g1019690 | 26 | −12 | gb105eukp | CDC8 |
| 700259607H1 | g1420650 | 18 | −8 | gb105eukp | ORF YOR293w |
| 700262540H1 | g2160190 | 32 | −6 | gb105eukp | F21M12.37 |
| 700266730H1 | g22285 | 50 | −75 | gb105pln | *Zea mays* Glb1-S gene for vicilin-like embryo storage protein. |
| 700260125H1 | g927230 | 40 | −63 | gb105pln | *Zea mays* globulin1 (Glb1) gene, allele Glb1-Hb, complete cds. |
| 700256964H1 | g1370185 | 39 | 1 | gb105pln | *L. japonicus* mRNA for small GTP-binding protein, RAB7C. |
| 700266593H1 | g1513227 | 42 | −7 | gb105pln | *Brassica napus* myo-inositol 1-phosphate synthase mRNA, complete cds. |
| 700265004H1 | g687244 | 89 | −28 | gb105pln | *Zea mays* oil body protein 16 kDa oleosin (ole16) gene, complete cds. |
| 700256707H1 | g1066282 | 30 | −19 | gb105pln | *Phaseolus vulgaris* 1L-myo-inositol 1-phosphate synthase mRNA, complete cds. |
| 700266963H1 | g170746 | 60 | −50 | gb105pln | Wheat histone H4 TH091 gene, complete cds. |
| 700262909H1 | g168512 | 27 | −14 | gb105pln | Maize major protein (L3) mRNA from the surface of lipid bodies, 3' end. |
| 700262329H1 | g1632821 | 41 | −46 | gb105pln | *O. sativa* mRNA for transmembrane protein. |
| 700264640H1 | g2282583 | 30 | −11 | gb105pln | *Zea mays* elongation factor 1-alpha (EF1-A) mRNA, complete cds. |
| 700264377H1 | g829147 | 85 | −78 | gb105pln | *Z. mays* gene for cyclophilin. |
| 700267269H1 | g21598 | 32 | −20 | gb105pln | *S. tuberosum* mRNA for UDP-glucose pyrophosphorylase. |
| 700257689H1 | g2791948 | 25 | 8 | gb105allp | ribosomal protein L13a |
| 700258723H1 | g22272 | 78 | −88 | gb105pln | Maize mRNA for enolase (2-phospho-D-glycerate hydrolase) |
| 700262660H1 | g450353 | 21 | −7 | gb105pln | *H. vulgare* (cv Bomi) gB19.1b gene. |
| 700266513H1 | g469069 | 4 | 7 | gb105allp | NMDA receptor subunit NR2D |
| 700261061H1 | g168406 | 23 | 12 | gb105pln | *Z. mays* alcohol dehydrogenase (ADH-1 C-m allele) gene, complete cds. |
| 700266111H1 | g167371 | 8 | 2 | gb105eukp | vicilin precursor |
| 700264538H1 | g1657850 | 24 | −14 | gb105pln | *Triticum aestivum* cold acclimation protein WCORS18 (Wcor518) mRNA, parial cds. |
| 700207249H1 | g1185553 | 36 | −20 | gb105pln | *Zea mays* glyceraldehyde-3-phosphate dehydrogenase (gpc2) gene, complete cds. |
| 700257168H1 | g396209 | 20 | −0 | gb105pln | *S. polyrrhiza* mRNA for D-myo-inositol-3-phosphate synthase. |
| 700263732H1 | g20598 | 31 | −22 | gb105pln | *P. miliaceum* mRNA for aspartate aminotransferase (pcAAT2) |
| 700265691H1 | g556685 | 36 | 5 | gb105pln | *Z. mays* mRNA for ADP-ribosylation factor. |
| 700263877H1 | g168575 | 20 | −26 | gb105pln | Maize phospholipid transfer protein mRNA, complete cds. of clone 9C2. |
| 700265625H1 | g170772 | 75 | −73 | gb105pln | *Triticum aestivum* S-adenosyl-L-homocysteine hydrolase (SH6.2) mRNA, complete cds. |
| 700261175H1 | g20501 | 6 | 8 | gb105eukp | vicilin-like storage protein |
| 700258544H1 | g2130521 | 25 | −9 | gb105eukp | RGP1; reversibly glycosylatable polypeptide |
| 700261575H1 | g829147 | 64 | −21 | gb105pln | *Z. mays* gene for cyclophilin. |
| 700260010H1 | g1519248 | 20 | 10 | gb105pln | *Oryza sativa* GF14-b protein mRNA, complete cds. |
| 700262745H1 | g960356 | 52 | −38 | gb105pln | Barley mRNA for S-adenosylmethionine synthetase, complete cds. |
| 700263109H1 | g2765318 | 23 | −14 | gb105eukp | AS2; asparagine synthetase 2 |
| 700264413H1 | g469148 | 31 | −18 | gb105eukp | alanine aminotransferase |
| 700263631H1 | g17931 | 16 | −3 | gb105pln | *B. secalinas* embryo-specific mRNA. |
| 700262751H1 | g1658312 | 12 | 16 | gb105pln | *O. sativa* osr40g2 gene. |
| 700256805H1 | g463251 | 32 | −21 | gb105pln | *M. sativa* (Nagyszenasi) mRNA for ribosomal protein RLS. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 7002S8601H1 | g313266 | 31 | −11 | gb105pln | *T. aestivum* gene for phosphoglycerate kinase. |
| 700263725H1 | g218000 | 17 | 5 | gb105pln | Potato mRNA for UDP-glucose pyrophosphorylase (EC 2.7.7.9) |
| 700259180H2 | g168512 | 26 | −40 | gb105pln | Maize major protein (L3) mRNA from the surface of lipid bodies, 3' end. |
| 700258973H1 | g168508 | 51 | −28 | gb105pln | Maize oleosin KD18 (KD18; L2) gene, complete cds. |
| 700261558H1 | g483489 | 30 | 17 | gb105pln | *Z. mays* IBP1 mRNA for initiator-binding protein. |
| 700259606H1 | g2842474 | 16 | 14 | gb105pln | *Arabidopsis thaliana* DNA chromosome 4, BAC clone F2IO9 (ESSAII project). |
| 700267809H1 | g496310 | 16 | −14 | gb105pln | Yeast (*Schizosaccharomyces pombe*) supressor protein, complete cds. |
| 700258244H1 | g21629 | 30 | −11 | gb105pln | *Sorghum vulgare* mRNA for phosphoenolpyruvate carboxylase (PEPC). |
| 700262422H1 | g258166 | 58 | −75 | gb105pln | Wx (wx-Stoner) = waxy gene {long terminal repeat} (maize, Genomic Mutant, 559 nt]. |
| 700259607H1 | g887611 | 18 | −8 | gb105eukp | unknown |
| 700266969H1 | g22272 | 34 | −10 | gb105pln | Maize mRNA for enolase (2-phospho-D-glycerate hydrolase) |
| 700261867H1 | g804656 | 40 | −11 | gb105eukp | BGQ60; beta-glucosidase |
| 700257087H1 | g162866 | 38 | 6 | gb105allp | casein kinase I-alpha |
| 700263851H1 | g871505 | 11 | 15 | gb105pln | *P. sativum* mRNA for small GTP-binding protein (clone pGTP11). |
| 700267566H1 | g1196896 | 12 | −1 | gb105pln | Glycine max acidic ribosomal protein PO mRNA, complete cds. |
| 700262642H1 | g1542941 | 32 | −7 | gb105eukp | AACT; Acetoacetyl-coenzyme A thiolase; EC 2.3.1.9 |
| 700266491H1 | g600768 | 57 | −48 | gb105pln | *Oryza sativa* cyclophilin 2 (Cyp2) mRNA, complete cds. |
| 700261348H1 | g434327 | 57 | −19 | gb105pln | *Z. mays* mRNA gs1-3 for glutamine synthetase. |
| 700258601H1 | g21832 | 31 | −12 | gb105pln | Wheat mRNA for chloroplast phosphoglycerate kinase (EC 2.7.2.3) |
| 700265539H1 | g22272 | 82 | −71 | gb105pln | Maize mRNA for enolase (2-phospho-D-glycerate hydrolase) |
| 700265538H1 | g1171347 | 14 | 11 | gb105pln | *Triticum aestivum* pMA1951 mRNA, partial cds. |
| 700265207H1 | g1321626 | 35 | −38 | gb105pln | *Cucurbita* sp. mRNA for thylakoid-bound ascorbate peroxidase, complete cds. |
| 700259738H1 | g575730 | 54 | −0 | gb105pln | *Z. mays* mRNA for transmembrane protein. |
| 700259302H1 | g22119 | 55 | −86 | gb105pln | Maize Adh1-F mRNA for alcohol dehydrogenase. |
| 700264909H1 | g1323459 | 22 | −4 | gb105pln | Yeast (*Saccharomyces cerevisiae*) chromosome VII reading frame ORF YGR2S3c. |
| 700262912H1 | g2827143 | 46 | −12 | gb105eukp | Ath-B; cellulose synthase catalytic subunit |
| 700266415H1 | g695789 | 11 | 6 | gb105eukp | GST27; glutathione transferase; EC 2.5.1.18 |
| 700261336H1 | g218000 | 16 | −20 | gb105pln | Potato mRNA for UDP-glucose pyrophosphorylase (EC 2.7.7.9) |
| 700261304H1 | g387908 | 39 | −20 | gb105pln | *Brassica rapa* S-phase-specific (BIS289) mRNA, complete cds. |
| 700259324H1 | g927238 | 42 | 3 | gb105pln | *Zea mays* globulin1 (Glb1) gene, allele Glb1-Hb, complete cds. |
| 700264647H1 | g168512 | 36 | −33 | gb105pln | Maize major protein (L3) mRNA from the surface of lipid bodies, 3' end. |
| 700264329H1 | g893433 | 31 | −14 | gb105eukp | unknown |
| 700265602H1 | g527680 | 44 | −1 | gb105eukp | ribosomal protein S3 |
| 700262654H1 | g435456 | 28 | −54 | gb105pln | Proso millet gene for aspartate aminotransferase, complete cds. |
| 700267687H1 | g22484 | 73 | −62 | gb105pln | *Z. mays* RNA for superoxide dismutase Sod4A. |
| 700264847H1 | g2668741 | 52 | −34 | gb105pln | *Zea mays* glycine-rich RNA binding protein (GRP) mRNA, complete cds. |
| 700261376H1 | g2586085 | 26 | −7 | gb105eukp | Xa21; receptor kinase-like protein |
| 700258024H1 | g169834 | 44 | −37 | gb105pln | Rye 26S rRNA 3' end and 18S rRNA, 5' end. |
| 700265391H1 | g1172158 | 39 | −30 | gb105pln | *Ipomoea batatas* starch synthase (SPSS67) mRNA, complete cds. |
| 700257868H1 | g21732 | 32 | −1 | gb105pln | Wheat mRNA for Em protein. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700258326H1 | g453562 | 59 | −51 | gb105pln | *Lycopersicon esculentum* Ran protein/TC4 protein (RAN2A) mRNA, complete cds. |
| 700266330H1 | g2462762 | 36 | −3 | gb105eukp | F8A5.21 |
| 700264073H1 | g5012 | 21 | −9 | gb105pln | Yeast (*Saccharomyces pombe*) polA gene for DNA polymerase Alpha. |
| 700257245H1 | g168512 | 41 | −37 | gb105pln | Maize major protein (L3) mRNA from the surface of lipid bodies, 3' end. |
| 700263279H1 | g1518539 | 22 | 1 | gb105pln | Glycine max UDP-glucose dehydrogenase mRNA, complete cds. |
| 700257319H1 | g453563 | 25 | −0 | gb105eukp | Ran protein/TC4 protein |
| 700265213H1 | g1532047 | 26 | −36 | gb105pln | *O. sativa* mRNA for S-adenosylmethionine decarboxylase. |
| 700262219H1 | g1665777 | 12 | 8 | gb105allp | Similar to *S. cerevisiae* EMP70 protein precursor (S25110) |
| 700263067H1 | g1519248 | 57 | −32 | gb105pln | *Oryza sativa* GF14-b protein mRNA, complete cds. |
| 700265567H1 | g311238 | 35 | −72 | gb105pln | *Z. mays* cat1 gene for catalase 1. |
| 700259015H1 | g1707012 | 11 | 1 | gb105eukp | T01B08.14; tyrosyl-tRNA synthetase isolog |
| 700264217H1 | g530207 | 30 | −4 | gb105eukp | SB100; heat shock protein |
| 700262316H1 | g596077 | 21 | −25 | gb105pln | *Zea mays* thiamine biosynthetic enzyme (thi1-1) mRNA, complete cds. |
| 700259666H1 | g2252629 | 19 | 5 | gb105eukp | T19D16.23 |
| 700263962H1 | g18891 | 27 | −8 | gb105eukp | aldose reductase-related protein |
| 700261662H1 | g18890 | 37 | −21 | gb105pln | *H. vulgare* gene for aldose reductase-related protein. |
| 700258072H1 | g168480 | 21 | 9 | gb105pln | Maize embryo globulin S allele (7S-like) mRNA, complete cds. |
| 700267966H1 | g506138 | 40 | 6 | gb105pln | *Zea mays* Ec metallothionein class II protein mRNA, complete cds. |
| 700266788H1 | g1161601 | 48 | −42 | gb105pln | *N. tabacum* mRNA for phosphoglycerate kinase (cytosolic isoenzyme) |
| 700258629H1 | g2645198 | 13 | 10 | gb105pln | *Arabidopsis thaliana* chromosome I BAC T26J12 genomic sequence, complete sequence. |
| 700259237H1 | g1335965 | 87 | −86 | gb105pln | *Zea mays* acetyl CoA carboxylase mRNA, partial cds. |
| 700265680H1 | g432445 | 10 | 0 | gb105pln | *Arabidopsis thaliana* (FUS6) gene, complete cds. |
| 700263427H1 | g1353352 | 37 | −20 | gb105eukp | catalyzes the transfer of —NH2 from ala to 2-oxoglutarate; alanine aminotransferase; EC 2.6.1.2 |
| 700260510H2 | g2257755 | 32 | −82 | gb105pln | *Zea mays* nucleolar histone deacetylase HD2-p39 mRNA, complete cds. |
| 700266364H1 | g1289203 | 15 | 10 | gb105pln | *A. glutinosa* mRNA for thiazole biosynthetic enzyme. |
| 700262090H1 | g804656 | 10 | 7 | gb105allp | beta-glucosidase |
| 700262865H1 | g473602 | 34 | −16 | gb105pln | *Zea mays* W-22 histone H2A mRNA, complete cds. |
| 700267696H1 | g1335965 | 89 | −79 | gb105pln | *Zea mays* acetyl CoA carboxylase mRNA, partial cds. |
| 700261175H1 | g22284 | 8 | 7 | gb105allp | vicilin-like embryo storage protein |
| 700265994H1 | g968995 | 47 | −9 | gb105pln | *Oryza sativa* clone glyceraldehyde-3-phosphate dehydrogenase (Gpc) mRNA, complete cds. |
| 700256933H1 | g1009709 | 23 | −18 | gb105pln | *Oryza sativa* pyruvate decarboxylase 2 (Pdc2) mRNA, complete cds. |
| 700263427H1 | g296204 | 20 | −9 | gb105eukp | pAlaAT-2; alanine aminotransferase; EC 2.6.1.2 |
| 700260371H2 | g1421729 | 85 | −65 | gb105pln | *Zea mays* T cytoplasm male sterility restorer factor 2 (rf2) mRNA, complete cds. |
| 700256929H1 | g2245020 | 6 | 3 | gb105eukp | growth regulator homolog |
| 700258194H1 | g2828266 | 18 | −11 | gb105pln | *Arabidopsis thaliana* mRNA for geranylgeranyl reductase. |
| 700266786H1 | g577123 | 14 | 1 | gb105allp | YI9910.05c, unknown orf, len: 721, CAI: 0.17 |
| 700257243H1 | g1652282 | 27 | 5 | gb105allp | cell division protein FtsH |
| 700257087H1 | g881619 | 42 | 5 | gb105allp | casein kinase I delta |
| 700266832H1 | g1212995 | 23 | −9 | gb105pln | *H. vulgare* mRNA for UDP-glucose pyrophosphorylase. |
| 700262048H1 | g168423 | 92 | −22 | gb105pln | *Zea mays* polypeptide chain-binding protein mRNA, 3' end. |
| 700258888H1 | g1171351 | 30 | −6 | gb105pln | *Oryza sativa* 16 kDa oleosin |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700265159H1 | g2673920 | 17 | 8 | gb105eukp | (ole16) mRNA, complete cds. T24P15.15; similar to Drosophila couch potato protein |
| 700265520H1 | g1107486 | 39 | −16 | gb105pln | *A. thaliana* mRNA for 60S ribosomal protein L27a. |
| 700263273H1 | g471320 | 48 | −52 | gb105pln | *H. vulgare* (cv. Bomi) B15C mRNA. |
| 700260671H1 | g949877 | 70 | −65 | gb105pln | *H. vulgare* mRNA for elongation factor 1-alpha. |
| 700264424H1 | g1421750 | 14 | −5 | gb105pln | *Pisum sativum* S-adenosylmethionine decarboxylase mRNA, complete cds. |
| 700262750H1 | g1129083 | 25 | −24 | gb105pln | Wheat mRNA for protein H2A, complete cds, clone wcH2A-2. |
| 700258510H1 | g1531764 | 11 | 12 | gb105pln | *D. stramonium* mRNA for S-adenosylmethionine decarboxylase. |
| 700266119H1 | g218135 | 30 | −52 | gb105pln | Rice mRNA for heat shock protein 90KD (AK108 gene), partial sequence. |
| 700265136H1 | g474167 | 43 | −31 | gb105pln | *N. tabacum* mRNA for phosphoglyceromutase. |
| 700258763H1 | g395071 | 39 | −13 | gb105pln | *V. faba* guanine nucleotide regulatory protein mRNA, complete CDS. |
| 700265974H1 | g2408084 | 32 | −21 | gb105pln | Yeast (*Saccharomyces pombe*) chromosome I cosmid c8C9. |
| 700261630H1 | g1173622 | 50 | −9 | gb105eukp | homeobox protein |
| 700256838H1 | g1532047 | 17 | 15 | gb105pln | *O. sativa* mRNA for S-adenosylmethionine decarboxylase. |
| 700257536H1 | g309862 | 24 | −5 | gb105allp | dehydroquinate synthase |
| 700258277H1 | g168545 | 63 | −24 | gb105pln | *Zea mays* putative ribosomal protein L19 homolog mRNA, partial cds. |
| 700264262H1 | g971279 | 62 | −51 | gb105pln | Rice mRNA for RAB24 protein, complete cds. |
| 700262086H1 | g2662346 | 61 | −49 | gb105pln | *Oryza sativa* mRNA for EF-1 alpha, complete cds. |
| 700259823H1 | g960356 | 28 | −6 | gb105pln | Barley mRNA for S-adenosylmethionine synthetase, cplete cds. |
| 700258406H1 | g687244 | 49 | −78 | gb105pln | *Zea mays* oil body protein 16 kDa oleosin (ole16) gene, complete cds. |
| 700267350H1 | g288062 | 41 | −26 | gb105pln | *A. thaliana* mRNA for ketol-acid reductoisomerase subunit. |
| 700257885H1 | g1930069 | 54 | −17 | gb105pln | *Oryza sativa* proteasome alpha subunit mRNA, complete cds. |
| 700258380H1 | g1272634 | 35 | −9 | gb105eukp | K07C5.4 |
| 700266936H1 | g5022 | 40 | −11 | gb105eukp | rad15 |
| 700264121H1 | g1906825 | 51 | −41 | gb105pln | *A. thaliana* hsp81.2 gene. |
| 700260288H1 | g927238 | 26 | −10 | gb105pln | *Zea mays* globulin1 (Glb1) gene, allele Glb1-Hb, complete cds. |
| 700267137H1 | g1200160 | 54 | 0 | gb105pln | *T. gesneriana* mRNA for tonoplast intrinsic protein. |
| 700265032H1 | g248338 | 69 | −57 | gb105pln | polyubiquitin [maize, Genomic, 3439 nt]. |
| 700262975H1 | g971279 | 62 | −41 | gb105pln | Rice mRNA for RAB24 protein, complete cds. |
| 700261858H1 | g509769 | 9 | 5 | gb105allp | seed-specific low molecular weight sulfur-rich protein |
| 700265918H1 | g2832620 | 7 | 4 | gb105eukp | F13C5.90; hypotheticalprotein |
| 700256992H1 | g290057 | 35 | −0 | gb105eukp | TBP10; HIV1 TAT-binding protein |
| 700258867H1 | g687244 | 38 | −71 | gb105pln | *Zea mays* oil body protein 16 kDa oleosin (ole16) gene, complete cds. |
| 700258784H1 | g22270 | 70 | −73 | gb105pln | Maize mRNA from an embryogenic abscisic acid-inducible gene. |
| 700258652H1 | g496723 | 15 | 0 | gb105allp | N2038 gene product |
| 700267874H1 | g506534 | 19 | −6 | gb105eukp | PKTL7; protein kinase |
| 700267332H1 | g2102690 | 12 | 11 | gb105pln | *Lycopersicon esculentum* fructokinase (Frk1) mRNA, complete cds. |
| 700264569H1 | g1403043 | 25 | −7 | gb105pln | *H. chilense* × *T. turgidum* conv. durum (Tritordeum) mRNA for S-adenosylmethionine decarboxylase. |
| 700256835H1 | g2760836 | 12 | 3 | gb105eukp | F18A8.7; putative Ser/Thr protein kinase |
| 700258256H1 | g1658314 | 24 | −16 | gb105pln | *O. sativa* osr40g3 gene. |
| 700265022H1 | g473976 | 61 | −53 | gb105pln | Rice mRNA, partial homologous to elongation factor 1-alpha gene. |
| 700258784H1 | g19016 | 22 | −11 | gb105pln | *H. vulgare* mRNA for LEA B19.4 protein. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700257053H1 | g396209 | 50 | −4 | gb105pln | *S. polyrrhiza* mRNA for D-myo-inositol-3-phosphate synthase. |
| 700262520H1 | g1907376 | 17 | 11 | gb105pln | *Ephedra nebrodensis* 28S ribosomal RNA gene, partial sequence. |
| 700261160H1 | g312691 | 24 | −16 | gb105pln | *H. vulgare* prx6 gene, complete CDS. |
| 700266572H1 | g11713Si | 26 | −8 | gb105pln | *Oryza sativa* 16 kDa oleosin (ole16) mRNA, complete cds. |
| 700264870H1 | g450548 | 55 | −66 | gb105pln | *O. sativa* (pRSAM-1) gene for S-adenosyl methionine synthetase. |
| 700258682H1 | g1800227 | 11 | 7 | gb105eukp | Bowman-Birk proteinase inhibitor |
| 700261534H1 | g602564 | 49 | −44 | gb105pln | *C. paradisi* (Macf) INO1 gene. |
| 700259606H1 | g21404 | 15 | 16 | gb105pln | *S. tuberosum* PANT1 mRNA for adenine nucleotide translocator (also called ADP/ATP translocase). |
| 700260160H1 | g22283 | 61 | −66 | gb105pln | *Zea mays* Glb1-L gene for vicilin-like embryo storage protein. |
| 700258014H1 | g168481 | 13 | 3 | gb105eukp | globulin precursor |
| 700258464H1 | g577734 | 40 | −18 | gb105pln | *A. thaliana* PRL1 mRNA. |
| 700262107H1 | g18904 | 16 | 3 | gb105allp | aspartic proteinase |
| 700264268H1 | g22340 | 87 | −76 | gb105pln | Maize gene for heat shock protein 70 exon 1 (hsp70; clone pMON 9502) |
| 700265760H1 | g550543 | 30 | −13 | gb105pln | *A. thaliana* mRNA for ribosomal protein L16. |
| 700258735H1 | g20448 | 17 | 7 | gb105allp | H2A histone protein (AA 1–149) |
| 700256718H1 | g169295 | 17 | −6 | gb105pln | Pharbitis nil heat shock protein 83 (Hsp83) gene, complete cds. |
| 700258067H1 | g471320 | 48 | −51 | gb105pln | *H. vulgare* (cv. Bomi) B15C mRNA. |
| 700266375H1 | g168512 | 43 | −31 | gb105pln | Maize major protein (L3) mRNA from the surface of lipid bodies, 3' end. |
| 700261392H1 | g2570223 | 29 | −5 | gb105pln | Sequence of BAC F20D22 from *Arabidopsis thaliana* chromosome 1, complete sequence. |
| 700258479H1 | g2274990 | 70 | −69 | gb105pln | *Hordeum vulgare* mRNA for expressed sequence tag. |
| 700263677H1 | g454872 | 58 | −27 | gb105pln | Maize mRNA for group 3 Lea protein MGL3, complete cds. |
| 700207258H1 | g2738247 | 44 | −10 | gb105pln | *Arabidopsis thaliana* cobalamin-independent methionine synthase (ATCIMS) mRNA, complete cds. |
| 700258789H1 | g1731987 | 21 | 1 | gb105pln | *H. vulgare* mRNA for serine carboxypeptidase I, CP-MI. |
| 700257813H1 | g1066282 | 38 | −12 | gb105pln | *Phaseoius vulgaris* 1L-myo-inositol 1-phosphate synthase mRNA, complete cds |
| 700258717H1 | g2149640 | 29 | −5 | gb105eukp | AGO1; leaf development; Argonaute protein |
| 700266228H1 | g1550813 | 98 | −93 | gb105pln | *Z. mays* mRNA for acidic ribosomal protein PO. |
| 700267547H1 | g2345153 | 37 | −53 | gb105pln | *Zea mays* ribosomal protein S4 (rps4) mRNA, complete cds. |
| 700263785H1 | g687244 | 39 | −71 | gb105pln | *Zea mays* oil body protein 16 kDa oleosin (ole16) gene, complete cds. |
| 700265260H1 | g1706958 | 50 | −11 | gb105eukp | celA2; cellulose synthase |
| 700257051H1 | g1184771 | 70 | −58 | gb105pln | *Zea mays* glyceraldehyde-3-phosphate dehydrogenase GAPC2 (gpc2) mRNA, complete cds. |
| 700266847H1 | g1694832 | 44 | −28 | gb105pln | *H. vulgare* Per1 gene. |
| 700261965H1 | g1293846 | 19 | 1 | gb105allp | coded for by *C. elegans* cDNA yk30b3.5; coded for by *C. elegans* cDNA yk30b3.3 |
| 700266441H1 | g633889 | 17 | 9 | gb105pln | glucose and ribitol dehydrogenase homolog [*Hordeum vulgare* = barley, Aura, embryo, mRNA, 1170 nt]. |
| 700268110H1 | g1518539 | 28 | −11 | gb105pln | Glycine max UDP-glucose dehydrogenase mRNA, complete cds. |
| 700261609H1 | g1532047 | 16 | 15 | gb105pln | *O. sativa* mRNA for S-adenosylmethionine decarboxylase. |
| 700263425H1 | g644492 | 37 | −21 | gb105pln | Corn elongation factor 1alpha gene, complete cds. |
| 700257437H2 | g22469 | 57 | −24 | gb105pln | Maize mRNA for cytoplasmic ribosomal protein S11. |
| 700266239H1 | g532106 | 49 | −29 | gb105eukp | F56D2.6 |
| 700264818H1 | g218340 | 36 | −9 | gb105pln | *Triticum aestivum* mRNA for elongation factor 1 beta'. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700265722H1 | g2760536 | 22 | −3 | gb105pln | *Lupinus luteus* mRNA for cyclophilin. |
| 700265684H1 | g1617036 | 25 | −8 | gb105eukp | Ted2 |
| 700262233H1 | g509548 | 11 | 15 | gb105pln | *Sorghum bicolor* dehydrin (DHN1) mRNA, complete cds. |
| 700260973H1 | g1296954 | 41 | −16 | gb105pln | *O. sativa* mRNA for novel protein, osr40c1. |
| 700258291H1 | g22284 | 16 | −6 | gb105eukp | Glb1-L; vicilin-like embryo storage protein |
| 700256920H1 | g22635 | 42 | −34 | gb105pln | *P. vulgaris* mRNA for 70 kD heat shock protein. |
| 700259555H1 | g2239150 | 14 | 1 | gb105pln | *N. tabacum* mRNA for CHLD magnesium chelatase subunit. |
| 700258438H1 | g2330650 | 27 | −8 | gb105pln | *Pisum sativum* mRNA for topoisomerase II. |
| 700265542H1 | g168436 | 66 | −61 | gb105pln | *Zea mays* catalase (Cat3) gene, complete cds. |
| 700264994H1 | g1749488 | 24 | −10 | gb105eukp | similar to *Saccharomyces cerevisiae* nuclear transport protein NIP 1, SWISS-PROT Accession Number P32497 |
| 700262455H1 | g557817 | 12 | −1 | gb105eukp | orf, len: 145, CAI: 0.33, similar to B44514 B44514 HYPOTHETICAL PROTEIN 1 (VNFA 5' REGION) |
| 700267318H1 | g633890 | 22 | 2 | gb105allp | glucose and ribitol dehydrogenase homolog [barley, *Hordeum vulgare*, Peptide, 293 aa]. |
| 700267354H1 | g168508 | 40 | −4 | gb105pln | Maize oleosin KD18 (KD18; L2) gene, complete cds. |
| 700268160H1 | g397395 | 51 | −31 | gb105pln | *Z. mays* MNB1b mRNA for DNA-binding protein. |
| 700257522H1 | g533251 | 85 | −29 | gb105pln | *Zea mays* (clone pSM8) sucrose synthase 2 (Sus1) gene, complete cds. |
| 700258614H1 | g147142 | 37 | −23 | gb105allp | peptidase N |
| 700257287H1 | g1814402 | 29 | −13 | gb105pln | *Mesembryanthemum crystallinum* methionine synthase (MetE) mRNA, complete cds. |
| 700265568H1 | g168553 | 72 | −36 | gb105pln | *Zea mays* putative cytoplasmic malate dehydrogenase homolog mRNA, partial cds. |
| 700257437H2 | g166866 | 35 | −7 | gb105pln | *A. thaliana* ribosomal protein S11 mRNA, 3' end. |
| 700262284H1 | g1183936 | 14 | 5 | gb105pln | *P. sativum* 5S rRNA gene. |
| 700263870H1 | g21233 | 28 | −4 | gb105pln | *S. oleracea* AHRI mRNA for acetohydroxy acid reductoisomerase. |
| 700265295H1 | g171798 | 31 | −16 | gb105pln | Yeast (*Saccharomyces cerevisiae*) lysyl-tRNA synthetase (KRS1) alpha-2 subunit gene, complete cds. |
| 700267811H1 | g2815099 | 13 | −4 | gb105eukp | Y39E4A.2a |
| 700264254H1 | g168512 | 49 | −49 | gb105pln | Maize major protein (L3) mRNA from the surface of lipid bodies, 3' end. |
| 700258290H1 | g450292 | 62 | −66 | gb105pln | *Zea mays* alpha-tubulin mRNA, complete cds. |
| 700267466H1 | g1173622 | 12 | 2 | gb105eukp | homeobox protein |
| 700267210H1 | g1787999 | 8 | 7 | gb105allp | f478; This 478 aa ORF is 39 pct identical (17 gaps) to 456 residues of an approx. 496 aa protein YPLC_CLOPE SW: Q06373 |
| 700266438H1 | g1167953 | 9 | −3 | gb105eukp | putative 32.6 kDa jasmonate-induced protein |
| 700267629H1 | g296204 | 18 | −2 | gb105eukp | pA1aAT-2; alanine aminotransferase; EC 2.6.1.2 |
| 700267378H1 | g168472 | 63 | −12 | gb105pln | Maize ferredoxin III (Fd) isoprotein mRNA, pFD3. |
| 700265029H1 | g1513227 | 22 | −4 | gb105pln | *Brassica napus* myo-inositol 1-phosphate synthase mRNA, complete cds. |
| 700258072H1 | g22283 | 21 | 9 | gb105pln | *Zea mays* Glb1-L gene for vicilin-like embryo storage protein. |
| 700261173H1 | g18963 | 47 | −64 | gb105pln | *Z. mays* mRNA for dehydrin (dhn3). |
| 700257080H1 | g2408019 | 27 | 3 | gb105allp | 40s ribosomal protein |
| 700264342H1 | g169834 | 52 | −56 | gb105pln | Rye 26S rRNA 3' end and 18S rRNA, 5' end. |
| 700261194H1 | g496857 | 9 | −2 | gb105eukp | CIF1 |
| 700257792H1 | g2244788 | 22 | 4 | gb105pln | *Arabidopsis thaliana* DNA chromosome 4, ESSA I contig fragment No. 1. |
| 700266843H1 | g998429 | 42 | −29 | gb105pln | GRF1 = general regulatory factor [*Zea mays*, XL80, Genomic, 5348 nt]. |
| 700258363H1 | g2262135 | 16 | −15 | gb105pln | *Arabidopsis thaliana* BAC T10P11, complete sequence. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700256860H1 | g396254 | 20 | −17 | gb105eukp | 40S ribosomal protein S5 |
| 700261972H1 | g22270 | 69 | −85 | gb105pln | Maize mRNA from an embryogenic abscisic acid-inducible gene. |
| 700258617H1 | g22151 | 64 | −34 | gb105pln | Z. mays (A188) mRNA for alpha-tubulin 4. |
| 700262750H1 | g473602 | 31 | −32 | gb105pln | Zea mays W-22 histone H2A mRNA, complete cds. |
| 700261995H1 | g1750380 | 38 | 1 | gb105eukp | EgICDH; NADP-isocitrate dehydrogenase |
| 700261855H1 | g2274990 | 46 | −63 | gb105pln | Hordeum vulgare mRNA for expressed sequence tag. |
| 700265455H1 | g22270 | 38 | −69 | gb105pln | Maize mRNA from an embryogenic abscisic acid-inducible gene. |
| 700257726H1 | g555943 | 33 | 7 | gb105allp | ribosomal protein 53 |
| 700265169H1 | g2737890 | 19 | 2 | gb105allp | nucleolar protein CaCbf5p |
| 700265727H1 | g927238 | 41 | 6 | gb105pln | Zea mays globulin1 (Glb1) gene, allele Glb1-Hb, complete cds. |
| 700260571H2 | g559973 | 11 | 7 | gb105allp | aldose reductase |
| 700265904H1 | g2827538 | 15 | 9 | gb105pln | Arabidopsis thaliana DNA chromosome 4, BAC clone T12H17 (ESSAII project) |
| 700263354H1 | g1419684 | 38 | −26 | gb105pln | M. sativa mRNA for TCTP-like protein. |
| 700257518H1 | g22606 | 46 | −7 | gb105pln | H. vulgare mRNA for 14-3-3 protein homologue (14-3-3a). |
| 700258066H1 | g520935 | 45 | −35 | gb105pln | H. vulgare mRNA for gamma-TIP-like protein. |
| 700264623H1 | g2104225 | 16 | −22 | gb105pln | B. campestris napin gene, promoter. |
| 700267378H1 | g1864000 | 64 | −28 | gb105pln | Maize DNA for Fd III, complete cds. |
| 700264855H1 | g22091 | 40 | 4 | gb105pln | Z. diploperennis gene for hydroxyproline-rich glycoprotein. |
| 700266317H1 | g170696 | 15 | 8 | gb105allp | storage protein |
| 700262955H1 | g829147 | 92 | −69 | gb105pln | Z. mays gene for cyclophilin. |
| 700260667H1 | g22748 | 18 | −12 | gb105eukp | actin depolymerization; actin depolymerizing factor |
| 700259547H1 | g2760173 | 46 | 4 | gb105pln | Arabidopsis thaliana genomic DNA, chromosome 5, P1 clone: MYH19, complete sequence. |
| 700266595H1 | g514945 | 100 | −59 | gb105pln | Zea mays sucrose synthase (Sus1) mRNA, complete cds. |
| 700262345H1 | g687244 | 40 | −73 | gb105pln | Zea mays oil body protein 16 kDa oleosin (ole16) gene, complete cds. |
| 700262650H1 | g1575127 | 51 | −14 | gb105pln | Zea mays lumenal binding protein cBiPe2 mRNA, complete cds. |
| 700262277H1 | g1161509 | 49 | −42 | gb105pln | A. thaliana mRNA for shaggy-like kinase dzeta. |
| 700259343H1 | g1842188 | 7 | 8 | gb105eukp | mitochondrial phosphate translocator |
| 700257793H1 | g687244 | 49 | −45 | gb105pln | Zea mays oil body protein 16 kDa oleosin (ole16) gene, complete cds. |
| 700264944H1 | g1658314 | 31 | 1 | gb105pln | O. sativa osr40g3 gene. |
| 700259391H1 | g168484 | 58 | 11 | gb105pln | Maize endosperm glutelin-2 gene, complete cds. |
| 700263783H1 | g2300247 | 8 | 8 | gb105allp | unnamed protein product |
| 700262685H1 | g1915959 | 22 | −3 | gb105pln | T. aestivum mRNA for peptidylprolyl isomerase. |
| 700264244H1 | g168512 | 48 | −29 | gb105pln | Maize major protein (L3) mRNA from the surface of lipid bodies, 3' end. |
| 700207129H1 | g975887 | 37 | −39 | gb105pln | Mesembryanthemum crystallinum myo-inositol-1-phosphate synthase mRNA, complete cds. |
| 700261086H1 | g798890 | 35 | 1 | gb105eukp | unknown |
| 700267230H1 | g2833627 | 24 | −12 | gb105pln | Arabidopsis thaliana chromosome 1 BAC F17O7 complete sequence. |
| 700259216H1 | g1244773 | 13 | 2 | gb105eukp | RPL37A; Rpl37ap: 60S ribosomal protein L37a |
| 700266744H1 | g22281 | 71 | −70 | gb105pln | Zea mays Glb1-0 gene for vicilin-like storage protein (truncated) |
| 700258781H1 | g21725 | 17 | −13 | gb105pln | T. aestivum (cDNA III) mRNA for EC protein. |
| 700267685H1 | g1694621 | 10 | 6 | gb105allp | 3-ketoacyl-CoA thiolase |
| 700265456H1 | g2668741 | 52 | −51 | gb105pln | Zea mays glycine-rich RNA binding protein (GRP) mRNA, complete cds. |
| 700262957H1 | g168512 | 31 | −4 | gb105pln | Maize major protein (L3) mRNA |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | from the surface of lipid bodies, 3' end. |
| 700266949H1 | g168480 | 73 | −40 | gb105pln | Maize embryo globulin S allele (7S-like) mRNA, complete cds. |
| 700266106H1 | g22270 | 63 | −83 | gb105pln | Maize mRNA from an embryogenic abscisic acid-inducible gene. |
| 700263273H1 | g971279 | 46 | −47 | gb105pln | Rice mRNA for RAB24 protein, complete cds. |
| 700261525H1 | g971279 | 20 | 17 | gb105pln | Rice mRNA for RAB24 protein, complete cds. |
| 700263853H1 | g312178 | 38 | −50 | gb105pln | Z. mays GapC2 gene. |
| 700261201H1 | g2529670 | 18 | −5 | gb105eukp | T30B22.13; ribosomal protein L18-like |
| 700259692H1 | g1196896 | 20 | −1 | gb105pln | Glycine max acidic ribosomal protein P0 mRNA, complete cds. |
| 700257747H1 | g1513227 | 40 | −3 | gb105pln | Brassica napus myo-inositol 1-phosphate synthase mRNA, complete cds. |
| 700258284H1 | g1870149 | 18 | 1 | gb105pln | Yeast (Saccharomyces pombe) SEC61 gene. |
| 700259158H2 | g22283 | 42 | −70 | gb105pln | Zea mays Glb1-L gene for vicilin-like embryo storage protein. |
| 700265110H1 | g388052 | 93 | −79 | gb105pln | Zea mays alcohol dehydrogenase (Adh1-S) mRNA, complete cds. |
| 700265633H1 | g147142 | 26 | −15 | gb105allp | peptidase N |
| 700257883H1 | g2668741 | 32 | −13 | gb105pln | Zea mays glycine-rich RNA binding protein (GRP) mRNA, complete cds. |
| 700267577H1 | g2341031 | 18 | −1 | gb105eukp | F19P19.10; F19P19.10 |
| 700263716H1 | g459894 | 52 | −52 | gb105pln | Zea mays sus1 gene, complete cds. |
| 700263291H1 | g22281 | 72 | −71 | gb105pln | Zea mays Glb1-0 gene for vicilin-like storage protein (truncated) |
| 700261992H1 | g170685 | 59 | 6 | gb105pln | Wheat ubiquitin activating enzyme (E1) mRNA, complete cds. |
| 700258296H1 | g1171351 | 9 | 11 | gb105pln | Oryza sativa 16 kDa oleosin (ole16) mRNA, complete cds. |
| 700264860H1 | g1244708 | 15 | −3 | gb105eukp | AINTEGUMENTA; ANT |
| 700264086H1 | g1129083 | 33 | 6 | gb105pln | Wheat mRNA for protein H2A, complete cds, clone wcH2A-2. |
| 700268108H1 | g927239 | 7 | 6 | gb105allp | globulin1 |
| 700263141H1 | g173446 | 28 | 8 | gb105eukp | rad21 |
| 700262488H1 | g488738 | 43 | −4 | gb105pln | G. hirsutum (DPL 62) mRNA for ribosomal protein small subunit 4e. |
| 700268141H1 | g168480 | 53 | −62 | gb105pln | Maize embryo globulin S allele (7S-like) mRNA, complete cds. |
| 700266580H1 | g21834 | 30 | −18 | gb105pln | Wheat mRNA for cytosolic phosphoglycerate kinase (EC 2.7.2.3). |
| 700265567H1 | g22231 | 77 | −74 | gb105pln | Maize cat-1 mRNA for catalase-1 isoenzyme (EC 1.11.1.6). |
| 700267315H1 | g1519248 | 41 | −29 | gb105pln | Oryza sativa GF14-b protein mRNA, complete cds. |
| 700257044H1 | g736271 | 53 | −26 | gb105pln | O. sativa hsp70 gene for heat shock protein 70. |
| 700258126H1 | g1171351 | 26 | −11 | gb105pln | Oryza sativa 16 kDa oleosin (ole16) mRNA, complete cds. |
| 700207147H1 | g790977 | 23 | −15 | gb105pln | B. juncea msams mRNA. |
| 700266206H1 | g147901 | 11 | 4 | gb105allp | succinic semialdehyde dehydrogenase |
| 700264248H1 | g2829870 | 31 | −19 | gb105eukp | F3I6.12 |
| 700268121H1 | g2641945 | 28 | −18 | gb105pln | Yeast (Schizosaccharomyces pombe) DNA for elongation factor 2, complete cds. |
| 700258445H1 | g168419 | 89 | −71 | gb105pln | Maize (Z. mays) aldolase mRNA, complete cds. |
| 700265859H1 | g432367 | 27 | −27 | gb105pln | Rice mRNA for elongation factor 1 beta, complete cds. |
| 700262082H1 | g2827513 | 14 | 14 | gb105pln | Arabidopsis thaliana DNA chromosome 4, BAC clone F8F16 (ESSAII project). |
| 700266819H1 | g21723 | 26 | 9 | gb105pln | T. aestivum (cDNA II) mRNA for EC protein. |
| 700268047H1 | g902597 | 37 | −1 | gb105allp | MIF homologue |
| 700267627H1 | g2570120 | 27 | −13 | gb105pln | S. latifolia mRNA, clone CCLS 29. |
| 700257308H1 | g927239 | 7 | 6 | gb105allp | globulin1 |
| 700264603H1 | g397400 | 51 | −44 | gb105pln | B. rapa mRNA for S phase specific gene. |
| 700263406H1 | g927571 | 53 | 4 | gb105pln | Z. mays mRNA for calreticulin precursor. |
| 700263059H1 | g1184771 | 79 | −71 | gb105pln | Zea mays glyceraldehyde-3-phosphate dehydrogenase GAPC2 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | (gpc2) mRNA, complete cds. |
| 700265413H1 | g1932925 | 22 | 5 | gb105eukp | putative pectin methylesterase |
| 700267223H1 | g21891 | 56 | −5 | gb105pln | *T. aestivum* (clone pTAU1.4) U1 snRNA. |
| 700207122H1 | g22283 | 49 | −17 | gb105pln | *Zea mays* Glb1-L gene for vicilin-like embryo storage protein. |
| 700257310H1 | g1325967 | 27 | −2 | gb105pln | *T. aestivum* histone H2A gene (clone TH274). |
| 700258067H1 | g971279 | 46 | −46 | gb105pln | Rice mRNA for RAB24 protein, complete cds. |
| 700258233H1 | g20255 | 33 | 9 | gb105pln | *O. sativa* gene for heat shock protein 82 HSP82. |
| 700268108H1 | g22287 | 8 | 7 | gb105allp | vicilin-like embryo storage protein |
| 700256711H1 | g2245135 | 28 | −18 | gb105eukp | hypothetical protein |
| 700259456H1 | g2266661 | 40 | −43 | gb105pln | *Hordeum vulgare* mRNA for 14-3-3 protein (Hv1433c). |
| 700266069H1 | g388052 | 65 | −80 | gb105pln | *Zea mays* alcohol dehydrogenase (Adh1-S) mRNA, complete cds. |
| 700265703H1 | g902526 | 64 | −30 | gb105pln | *Zea mays* clone MubG7 ubiquitin fusion protein gene, complete cds. |
| 700257103H1 | g168650 | 86 | −85 | gb105pln | *Zea mays* ubiquitin fusion protein (UBF9) gene, complete cds. |
| 700258347H1 | g168512 | 30 | −15 | gb105pln | Maize major protein (L3) mRNA from the surface of lipid bodies, 3' end. |
| 700262817H1 | g2393722 | 11 | 7 | gb105allp | glutathione-S-transferase homolog |
| 700262147H1 | g2511540 | 58 | −44 | gb105pln | *Oryza sativa* DNA-binding protein GBP16 (Rgbp16) mRNA, complete cds. |
| 700262879H1 | g998429 | 96 | −45 | gb105pln | GRF1 = general regulatory factor [*Zea mays*, XL80, Genomic, 5348 nt]. |
| 700266088H1 | g1403043 | 50 | −45 | gb105pln | *H. chilense* × *T. turgidum* conv. durum (Tritordeum) mRNA for S-adenosylmethionine decarboxylase. |
| 700264594H1 | g2305013 | 59 | −22 | gb105pln | *Musa acuminata* S-adenosyl-L-methionine synthetase homolog mRNA, complete cds. |
| 700262372H1 | g166692 | 7 | 4 | gb105eukp | Ark1; receptor kinase |
| 700266581H1 | g1679853 | 11 | 4 | gb105eukp | CCoAOMT-5; methylation of caffeoyl-CoA in lignin biosynthesis; caffeoyl-CoA O-methyltransferase 5; EC 2.1.1.104; S-adenosyl-L-methionine:caffeoyl-CoA O-methyltransferase |
| 700257754H1 | g168481 | 12 | 4 | gb105eukp | globulin precursor |
| 700264328H1 | g1532072 | 29 | 8 | gb105pln | *Z. mays* mRNA for S-adenosylmethionine decarboxylase. |
| 700267165H1 | g1694832 | 33 | −46 | gb105pln | *H. vulgare* Per1 gene. |
| 700266567H1 | g1304213 | 51 | −43 | gb105pln | Rice mRNA for cytosolic glutathione reductase, complete cds. |
| 700264768H1 | g168563 | 36 | −32 | gb105pln | *Zea mays* putative phospholipid transfer protein homolog mRNA, partial cds. |
| 700262147H1 | g1657616 | 27 | −6 | gb105pln | *Arabidopsis thaliana* putative nuclear DNA-binding protein G2p (AtG2) mRNA, complete cds. |
| 700265750H1 | g691752 | 9 | 8 | gb105eukp | preproMP27–MP32 |
| 700263706H1 | g172286 | 11 | −1 | gb105eukp | PRT1 |
| 700266303H1 | g471320 | 26 | −10 | gb105pln | *H. vulgare* (cv. Bomi) B15C mRNA. |
| 700263520H1 | g2117296 | 12 | 14 | gb105pln | Yeast (*Saccharomyces pombe*) chromosome II cosmid c3D5. |
| 700262123H1 | g2642159 | 48 | −16 | gb105eukp | T5I7.7; putative mannose-1-phosphate guanyltransferase |
| 700264350H1 | g530353 | 13 | 1 | gb105eukp | LBC1; serine palmitoyltransferase |
| 700260945H1 | g2315983 | 6 | 3 | gb105eukp | TrCPK1; calmodulin-like domain protein kinase |
| 700266780H1 | g1155212 | 43 | −11 | gb105pln | *Avena fatua* aldose reductase-related protein mRNA, complete cds. |
| 700261885H1 | g2662344 | 55 | −67 | gb105pln | *Oryza sativa* mRNA for EF-1 alpha, complete cds. |
| 700257513H1 | g429016 | 53 | −14 | gb105pln | Rice mRNA for Wilm's tumor suppressor (gene name SS501), partial cds. |
| 700268079H1 | g168677 | 92 | −91 | gb105pln | Maize 19 kDa zein mRNA, clone cZ19C1, complete cds. |
| 700265588H1 | g687244 | 48 | −64 | gb105pln | *Zea mays* oil body protein 16 kDa oleosin (ole16) gene, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700257492H1 | g1928865 | 32 | −11 | gb105pln | *Triticum aestivum* root abundant protein mRNA, complete cds. |
| 700263968H1 | g168466 | 29 | −58 | gb105pln | Corn late embryogenesis-abundant protein (EMB5) mRNA, complete cds. |
| 700259572H1 | g644491 | 83 | −78 | gb105pln | Corn mRNA for elongation factor 1A. |
| 700266248H1 | g396209 | 54 | −49 | gb105pln | *S. polyrrhiza* mRNA for D-myo-inositol-3-phosphate synthase. |
| 700257764H1 | g168579 | 74 | −47 | gb105pln | Maize pyruvate, orthophosphate dikinase mRNA, complete cds. |
| 700264073H1 | g2414643 | 21 | −9 | gb105pln | Yeast (*Saccharomyces pombe*) chromosome I cosmid c3H5. |
| 700257166H1 | g468055 | 65 | −67 | gb105pln | *Zea mays* B73 QM protein mRNA, complete cds. |
| 700267966H1 | g506139 | 35 | 7 | gb105eukp | Ec metallothionein class II protein |
| 700265952H1 | g168406 | 59 | −29 | gb105pln | *Z. mays* alcohol dehydrogenase (ADH-1 C-m allele) gene, complete cds. |
| 700264280H1 | g416499 | 6 | 7 | gb105allp | globulin |
| 700258635H1 | g168508 | 80 | −13 | gb105pln | Maize oleosin KD18 (KD18; L2) gene, complete cds. |
| 700263612H1 | g473978 | 34 | 1 | gb105pln | Rice mRNA, partial homologous to GAmRNA (cloneF). |
| 700257578H1 | g1199549 | 26 | 5 | gb105eukp | ORF 2371 |
| 700267470H1 | g20359 | 49 | −82 | gb105pln | Rice gene for 17S ribosomal RNA. |
| 700267458H1 | g2529657 | 22 | −17 | gb105pln | *Arabidopsis thaliana* chromosome II BAC T30B22 genomic sequence, complete sequence. |
| 700267401H1 | g1276929 | 31 | −26 | gb105pln | *Zea dipioperennis* Doebley M001 ITS1, 5.8S ribosomal RNA, ITS2. |
| 700267190H1 | g633889 | 23 | 4 | gb105pln | glucose and ribitol dehydrogenase homolog [*Hordeum vulgare* = barley, Aura, embryo, mRNA, 1170 nt]. |
| 700266345H1 | g1737492 | 29 | 3 | gb105eukp | wheatpab; poly(A)-binding protein |
| 700265680H1 | g432446 | 24 | −18 | gb105eukp | FUS6 |
| 700263090H1 | g11812S3 | 19 | 6 | gb105eukp | P1060 |
| 700261920H1 | g218000 | 12 | 16 | gb105pln | Potato mRNA for UDP-glucose pyrophosphorylase (EC 2.7.7.9). |
| 700267280H1 | g940288 | 15 | −2 | gb105eukp | protein localized in the nucleoli of pea nuclei; ORF; putative |
| 700264343H1 | g2104525 | 27 | −13 | gb105eukp | TiOM13.2; T10M13.2 |
| 700261164H1 | g2384757 | 60 | −30 | gb105pln | *Oryza sativa* GDP dissociation inhibitor protein OsGDI1) (OsGDI1) mRNA, complete cds. |
| 700266444H1 | g1575129 | 57 | −53 | gb105pln | *Zea mays* lumenal binding protein cBiPe3 mRNA, complete cds. |
| 700260380H2 | g1173905 | 5 | 7 | gb105allp | spliceosome associated protein |
| 700259306H1 | g2661840 | 26 | −5 | gb105eukp | adk; adenosine kinase; EC 2.7.1.20 |
| 700264664H1 | g2062153 | 12 | 4 | gb105pln | *Arabidopsis thaliana* chromosome III BAC T02O04 genomic sequence, complete sequence. |
| 700266630H1 | g31106 | 17 | 8 | gb105allp | elongation factor 2 |
| 700260920H1 | g1498387 | 38 | −45 | gb105pln | *Zea mays* actin (Maz83) gene, partial cds. |
| 700257765H1 | g22281 | 59 | −53 | gb105pln | *Zea mays* Glb1-0 gene for vicilin-like storage protein (truncated). |
| 700258441H1 | g1777706 | 51 | −57 | gb105pln | *Zea mays* 18S ribosomal RNA gene, partial sequence. |
| 700262265H1 | g147142 | 9 | 6 | gb105allp | peptidase N |
| 700267617H1 | g21832 | 23 | 14 | gb105pln | Wheat mRNA for chloroplast phosphoglycerate kinase (EC 2.7.2.3). |
| 700265518H1 | g973313 | 13 | 4 | gb105eukp | myo-inositol 1-phosphate synthase isozyme-2 |
| 700261861H1 | g710308 | 31 | 6 | gb105allp | victorin binding protein |
| 700258278H1 | g22283 | 37 | −53 | gb105pln | *Zea mays* Glb1-L gene for vicilin-like embryo storage protein. |
| 700266087H1 | g168406 | 50 | −82 | gb105pln | *Z. mays* alcohol dehydrogenase (ADH-1 C-m allele) gene, complete cds. |
| 700263337H1 | g2191184 | 14 | −7 | gb105eukp | A_TM021B04.4 |
| 700259158H2 | g168480 | 39 | −58 | gb105pln | Maize embryo globulin S allele (7S-like) mRNA, complete cds |
| 700265403H1 | g218000 | 32 | −14 | gb105pln | Potato mRNA for UDP-glucose |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | pyrophosphorylase (EC 2.7.7.9). |
| 700258817H1 | g687244 | 44 | −83 | gb105pln | Zea mays oil body protein 16 kDa oleosin (ole16) gene, complete cds. |
| 700264590H1 | g168512 | 38 | −34 | gb105pln | Maize major protein (L3) mRNA from the surface of lipid bodies, 3' end. |
| 700266265H1 | g1899059 | 98 | −94 | gb105pln | Zea mays endosperm C-24 sterol methyltransferase (ESMT1) mRNA, complete cds. |
| 700266161H1 | g433608 | 44 | −39 | gb105pln | R. communis mRNA for enolase. |
| 700263670H1 | g2266661 | 38 | −20 | gb105pln | Hordeum vulgare mRNA for 14-3-3 protein (Hv1433c). |
| 700263075H1 | g1935915 | 39 | −9 | gb105pln | Solanum tuberosum StubSNF1 protein (StubSNF1cDNA) mRNA, complete cds. |
| 700266286H1 | g2224911 | 23 | −13 | gb105eukp | somatic embryogenesis receptor-like kinase |
| 700264344H1 | g2244806 | 27 | −2 | gb105eukp | hypothetical protein |
| 700261378H1 | g2789660 | 13 | 6 | gb105eukp | p105 |
| 700260563H2 | g167109 | 30 | −23 | gb105pln | Hordeum vulgare vacuolar ATPase B subunit mRNA, complete cds. |
| 700263405H1 | g432488 | 36 | −8 | gb105pln | Wheat initiation factor 1A (eIF-1A) mRNA. |
| 700265530H1 | g2130942 | 12 | 1 | gb105allp | DEAD box protein 1 |
| 700258423H1 | g218082 | 33 | −36 | gb105pln | Rice mRNA for initiation factor eIF-4D (225 gene), partial sequence. |
| 700258081H1 | g736271 | 37 | −23 | gb105pln | O. sativa hsp70 gene for heat shock protein 70. |
| 700258789H1 | g1731988 | 16 | 7 | gb105eukp | Cxp;1; serine carboxypeptidase I, CP-MI |
| 700268188H1 | g1532047 | 17 | 15 | gb105pln | O. sativa mRNA for S-adenosylmethionine decarboxylase. |
| 700261163H1 | g984964 | 5 | 7 | gb105eukp | SIK1; suppressor of toxicity of GAL4-IKB; Sik1p |
| 700260683H1 | g2388968 | 9 | −5 | gb105eukp | SPAC31G5.17c; 40s ribosomal protein |
| 700263268H1 | g1296954 | 47 | −49 | gb105pln | O. sativa mRNA for novel protein, osr40c1. |
| 700258018H1 | g2651296 | 23 | −3 | gb105eukp | T2P4.3; b-zip DNA-binding protein |
| 700258640H1 | g2570506 | 52 | −43 | gb105pln | Oryza sativa ribosomal protein mRNA, complete cds. |
| 700262631H1 | g1171351 | 32 | −23 | gb105pln | Oryza sativa 16 kDa oleosin (ole16) mRNA, complete cds. |
| 700262107H1 | g1711289 | 17 | 2 | gb105eukp | aspartic protease |
| 700261794H1 | g606952 | 9 | 6 | gb105eukp | knotted-like homeobox protein |
| 700258544H1 | g2218150 | 26 | −9 | gb105eukp | type IIIa membrane protein cp-wap11 |
| 700261113H1 | g2708744 | 20 | −8 | gb105eukp | T13L16.8; putative Bop-like zinc-finger protein |
| 700258720H1 | g1145627 | 11 | 7 | gb105eukp | lipase |
| 700257833H1 | g1881694 | 53 | −45 | gb105pln | Zea mays phosphoglucomutase mRNA, partial cds. |
| 700263818H1 | g2529657 | 21 | 15 | gb105pln | Arabidopsis thaliana chromosome II BAC T30B22 genomic sequence, complete sequence. |
| 700257781H1 | g531481 | 12 | 11 | gb105pln | P. ciliare (Higgins) apospory associated mRNA, 1398 bp. |
| 700262250H1 | g872079 | 31 | −14 | gb105eukp | M28.5 |
| 700266265H1 | g1706964 | 29 | −11 | gb105pln | Triticum aestivum delta-24-sterol methyltransferase (TA-MT) mRNA, complete cds. |
| 700264530H1 | g17862 | 46 | −37 | gb105pln | B. napus mRNA for ribosomal protein S15a (pPCB8). |
| 700257892H1 | g1480105 | 10 | 8 | gb105allp | formamidase |
| 700258037H1 | g22292 | 57 | −68 | gb105pln | Z. mays mRNA for glycine-rich protein. |
| 700267496H1 | g1532072 | 52 | −14 | gb105pln | Z. mays mRNA for S-adenosylmethionine decarboxylase. |
| 700267360H1 | g2252847 | 53 | −16 | gb105eukp | A_IG005I10.nn |
| 700259555H1 | g2239151 | 28 | −11 | gb105eukp | chlD, CHLD magnesium chelatase subunit |
| 700257644H1 | g1546918 | 49 | −11 | gb105pln | Z. mays mRNA for translation initiation factor 5A. |
| 700265242H1 | g1658312 | 42 | −29 | gb105pln | O. sativa osr40g2 gene. |
| 700265519H1 | g602605 | 36 | −59 | gb105pln | Zea mays tandem genes for alpha1-tubulin and alpha2-tubulin. |
| 700258314H1 | g1408470 | 16 | 9 | gb105pln | Arabidopsis thaliana actin depolymerizing factor 1 (AtADF1) mRNA, |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | complete cds. |
| 700267763H1 | g927239 | 6 | 7 | gb105eukp | Glb1; globulin1 |
| 700261864H1 | g2462749 | 33 | −4 | gb105eukp | F8A5.31; Putative Serine/Threonine protein kinase |
| 700258332H1 | g1125690 | 21 | 2 | gb105pln | *S. tuberosum* mRNA for DnaJ protein. |
| 700264352H1 | g2347188 | 21 | 4 | gb105allp | laccase isolog |
| 700261313H1 | g22283 | 61 | −50 | gb105pln | *Zea mays* Glb1-L gene for vicilin-like embryo storage protein. |
| 700260952H1 | g168480 | 74 | −37 | gb105pln | Maize embryo globulin S allele (7S-like) mRNA, complete cds. |
| 700266137H1 | g1235569 | 16 | −2 | gb105eukp | rbohA; NAD(P)H oxidase |
| 700264580H1 | g168512 | 30 | −37 | gb105pln | Maize major protein (L3) mRNA from the surface of lipid bodies, 3' end. |
| 700266257H1 | g1185553 | 37 | −89 | gb105pln | *Zea mays* glyceraldehyde-3-phosphate dehydrogenase (gpc2) gene, complete cds. |
| 700263238H1 | g2804611 | 36 | −8 | gb105pln | *Podospora anserina* suppressor of vegetative incompatibility MOD-E (mod-E) gene, complete cds. |
| 700263259H1 | g1322599 | 16 | 1 | gb105allp | ORF YGL080w |
| 700262263H1 | g495263 | 25 | −8 | gb105eukp | sec61; sec61 protein |
| 700267159H1 | g168671 | 86 | −88 | gb105pln | Maize 19 kd zein protein, mRNA (incomplete). |
| 700258740H1 | g22087 | 12 | 10 | gb105pln | *H. vulgare* CHS gene for chalcone synthase. |
| 700265357H1 | g1143863 | 21 | −14 | gb105pln | *Oryza sativa* beta-glucosidase mRNA, nuclear gene encoding chloroplast protein, complete cds. |
| 700259044H1 | g881964 | 8 | 6 | gb105allp | aldose reductase |
| 700262496H1 | g1185553 | 31 | −14 | gb105pln | *Zea mays* glyceraldehyde-3-phosphate dehydrogenase (gpc2) gene, complete cds. |
| 700266617H1 | g1841501 | 76 | −31 | gb105pln | *Z. mays* mRNA for glutathione-dependent formaldehyde dehydrogenase. |
| 700259239H1 | g168480 | 61 | −66 | gb105pln | Maize embryo globulin S allele (7S-like) mRNA, complete cds. |
| 700262802H1 | g829255 | 9 | 4 | gb105allp | protein phosphatase type 1 |
| 700265485H1 | g687246 | 24 | −8 | gb105pln | *Zea mays* oil body protein 17 kDa oleosin (ole17) gene, complete cds. |
| 700265502H1 | g17797 | 18 | 7 | gb105allp | Bplo gene product |
| 700262573H1 | g1622938 | 23 | −2 | gb105pln | *Bromus secalinus* oleosin (ole16) mRNA, complete cds. |
| 700268029H1 | g404165 | 26 | −20 | gb105pln | *A. thaliana* gene for BBC1 protein. |
| 700262642H1 | g1749576 | 21 | −1 | gb105eukp | similar to *Saccharomyces cerevisiae* acetyl-CoA acetyltransferase, SWISS-PROT Accession Number P41338 |
| 700258045H1 | g899607 | 74 | −60 | gb105pln | *Zea mays* polyubiquitin (MubC5) mRNA, complete cds. |
| 700262487H1 | g1164977 | 16 | 5 | gb105eukp | YOR3317w |
| 700263267H1 | g312178 | 35 | −79 | gb105pln | *Z. mays* GapC2 gene. |
| 700261586H1 | g16431 | 25 | 2 | gb105eukp | PP1-At; cellular regulation; protein phosphatase-1 |
| 700256937H1 | g2662342 | 64 | −60 | gb105pln | *Oryza sativa* mRNA for EF-1 alpha, complete cds. |
| 700267250H1 | g473602 | 28 | −26 | gb105pln | *Zea mays* W-22 histone H2A mRNA, complete cds. |
| 700266658H1 | g22270 | 74 | −90 | gb105pln | Maize mRNA from an embryogenic abscisic acid-inducible gene. |
| 700259725H1 | g540534 | 59 | −10 | gb105pln | Rice mRNA for q group of receptor for activated C-kinase, complete cds. |
| 700256926H1 | g22285 | 76 | −44 | gb105pln | *Zea mays* Glb1-S gene for vicilin-like embryo storage protein. |
| 700268139H1 | g1498052 | 89 | −78 | gb105pln | *Zea mays* ribosomal protein S8 mRNA, complete cds. |
| 700267643H1 | g453669 | 64 | −71 | gb105pln | Maize heat shock protein 26 (HSP26) mRNA, complete cds. |
| 700266658H1 | g19016 | 24 | −20 | gb105pln | *H. vulgare* mRNA for LEA B19.4 protein. |
| 700263001H1 | g469148 | 31 | −8 | gb105eukp | alanine aminotransferase |
| 700266054H1 | g170455 | 53 | −54 | gb105pln | Tomato heat shock cognate protein 80 gene, 3' end. |
| 700268057H1 | g2443328 | 21 | 13 | gb105pln | *Arabidopsis thaliana* mRNA for mei2-like protein, complete cds. |
| 700266843H1 | g168602 | 50 | −18 | gb105pln | *Zea mays* regulatory protein |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | GF14-12 mRNA, complete cds. |
| 700265871H1 | g22283 | 52 | −49 | gb105pln | *Zea mays* Glb1-L gene for vicilin-like embryo storage protein. |
| 700258014H1 | g22284 | 12 | 4 | gb105allp | vicilin-like embryo storage protein |
| 700263854H1 | g2318131 | 13 | 7 | gb105allp | histone deacetylase |
| 700263744H1 | g168480 | 38 | −48 | gb105pln | Maize embryo globulin S allele (7S-like) mRNA, complete cds. |
| 700257647H1 | g984704 | 23 | −3 | gb105eukp | SPAC24H6.07; unknown |
| 700265509H1 | g602605 | 35 | −61 | gb105pln | *Zea mays* tandem genes for alpha1-tubulin and alpha2-tubulin. |
| 700259616H1 | g168466 | 41 | −10 | gb105pln | Corn late embryogenesis-abundant protein (EMB5) mRNA, complete cds. |
| 700258621H1 | g22292 | 42 | −70 | gb105pln | *Z. mays* mRNA for glycine-rich protein. |
| 700264740H1 | g349212 | 38 | −24 | gb105pln | *Arabidopsis thaliana* ubiquitin conjugating enzyme mRNA, complete cds. |
| 700257264H1 | g22144 | 50 | −81 | gb105pln | Maize anaerobically regulated gene for fructose bisphosphate aldolase (EC 4.1.2.13). |
| 700263643H1 | g1008297 | 25 | −7 | gb105eukp | CCT7 |
| 700261144H1 | g1100216 | 30 | −10 | gb105pln | *Zea mays* sucrose synthase (SUS1) gene, exons 1–2. |
| 700265627H1 | g2633671 | 8 | 8 | gb105allp | similar to hypothetical proteins |
| 700258678H1 | g963061 | 48 | −37 | gb105pln | *H. vulgare* Ole-1 mRNA for oleosin. |
| 700261674H1 | g169295 | 14 | −5 | gb105pln | Pharbitis nil heat shock protein 83 (Hsp83) gene, complete cds. |
| 700263630H1 | g687244 | 44 | −80 | gb105pln | *Zea mays* oil body protein 16 kDa oleosin (ole16) gene, complete cds. |
| 700258816H1 | g168480 | 68 | −59 | gb105pln | Maize embryo globulin S allele (7S-like) mRNA, complete cds. |
| 700267427H1 | g303848 | 61 | −55 | gb105pln | Rice mRNA for nucleoside diphosphate kinase, complete cds. |
| 700266054H1 | g20255 | 51 | −52 | gb105pln | *O. sativa* gene for heat shock protein 82 HSP82. |
| 700257815H1 | g2358139 | 22 | 0 | gb105pln | *Arabidopsis thaliana* chromosome 1 YAC yUP8H12 complete sequence. |
| 700262075H1 | g248338 | 51 | −28 | gb105pln | polyubiquitin [maize, Genomic, 3439 nt]. |
| 700263661H1 | g18963 | 60 | −43 | gb105pln | *Z. mays* mRNA for dehydrin (dhn3) |
| 700258392H1 | g438243 | 16 | −11 | gb105eukp | P450 hydroxylase |
| 700258487H1 | g2266661 | 27 | 16 | gb105pln | *Hordeum vulgare* mRNA for 14-3-3 protein (Hv1433c). |
| 700263893H1 | g2331300 | 79 | −61 | gb105pln | *Zea mays* ribosomal protein S4 type I (rps4) mRNA, complete cds. |
| 700207212H1 | g1184771 | 42 | −80 | gb105pln | *Zea mays* glyceraldehyde-3-phosphate dehydrogenase GAPC2 (gpc2) mRNA, complete cds. |
| 700258579H1 | g2431770 | 22 | 12 | gb105pln | *Zea mays* acidic ribosomal protein P2b (rpp2b) mRNA, complete cds. |
| 700264721H1 | g166692 | 7 | 7 | gb105allp | receptor kinase |
| 700257764H1 | g168584 | 52 | −45 | gb105pln | Corn pyruvate, orthophosphate dikinase gene, exons 2–19. |
| 700257754H1 | g22284 | 12 | 5 | gb105allp | vicilin-like embryo storage protein |
| 700262544H1 | g168512 | 31 | −32 | gb105pln | Maize major protein (L3) mRNA from the surface of lipid bodies, 3' end. |
| 700266773H1 | g1737491 | 34 | −27 | gb105pln | *Triticum aestivum* poly(A)-binding protein (wheatpab) mRNA, complete cds. |
| 700256875H1 | g47991 | 8 | 6 | gb105allp | ORF 6 (AA 1–249) |
| 700267032H1 | g1200160 | 29 | −1 | gb105pln | *T. gesneriana* mRNA for tonoplast intrinsic protein. |
| 700267108H1 | g18057 | 37 | −11 | gb105pln | *Citrus limon* 26S ribosomal RNA gene 3' region. |
| 700267590H1 | g644492 | 66 | −48 | gb105pln | Corn elongation factor 1alpha gene, complete cds. |
| 700261955H1 | g22149 | 77 | −48 | gb105pln | *Z. mays* mRNA for alpha-tubulin 3. |
| 700259676H1 | g1770020 | 50 | −39 | gb105pln | *Oryza sativa* S-adenosyl-L-methionine synthetase (pOS-SAMS2) mRNA, complete cds. |
| 700261351H1 | g21725 | 18 | −15 | gb105pln | *T. aestivum* (cDNA III) mRNA for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | EC protein. |
| 700262814H1 | g388052 | 93 | −51 | gb105pln | *Zea mays* alcohol dehydrogenase (Adh1-S) mRNA, complete cds. |
| 700266327H1 | g1777413 | 19 | −17 | gb105pln | *Aspergillus niger* 26S proteasome subunit (tbpA) gene, complete cds. |
| 700262567H1 | g509769 | 12 | 7 | gb105eukp | seed-specific low molecular weight sulfur-rich protein |
| 700268164H1 | g167822 | 9 | 6 | gb105eukp | low abundance class protein M4 |
| 700267829H1 | g2108344 | 29 | −14 | gb105pln | *Brassica campestris* small GTP-binding protein Bsarla (bsarla) mRNA, complete cds. |
| 700263291H1 | g927238 | 64 | −63 | gb105pln | *Zea mays* globulin1 (Glb1) gene, allele Glb1-Hb, complete cds. |
| 700261421H1 | g22285 | 38 | −2 | gb105pln | *Zea mays* Glb1-S gene for vicilin-like embryo storage protein. |
| 700268163H1 | g2275194 | 44 | −20 | gb105pln | *Arabidopsis thaliana* chromosome II BAC T08113 genomic sequence, complete sequence. |
| 700259032H1 | g687246 | 53 | −31 | gb105pln | *Zea mays* oil body protein 17 kDa oleosin (ole17) gene, complete cds. |
| 700266486H1 | g913941 | 9 | 4 | gb105eukp | btg-26 |
| 700264284H1 | g563926 | 13 | 15 | gb105pln | *Zea mays* xyloglucan endo-transglycosylase homolog mRNA, complete cds. |
| 700258441H1 | g20359 | 51 | −57 | gb105pln | Rice gene for 17S ribosomal RNA. |
| 700263457H1 | g1652753 | 21 | 1 | gb105allp | ABC1-like |
| 700263173H1 | g1296954 | 45 | −4 | gb105pln | *O. sativa* mRNA for novel protein, osr40c1. |
| 700262958H1 | g473295 | 35 | 4 | gb105allp | 40S ribosomal protein S4 |
| 700266748H1 | g433706 | 69 | −13 | gb105pln | *Z. mays* PRP gene. |
| 700258520H1 | g22514 | 74 | −62 | gb105pln | Maize Zc1 gene for Zein Zc1 (14 kD zein-2). |
| 700267829H1 | g1549221 | 27 | −9 | gb105pln | Tobacco mRNA for NtSar1 protein, complete cds. |
| 700261414H1 | g312178 | 21 | −55 | gb105pln | *Z. mays* GapC2 gene. |
| 700267566H1 | g1550813 | 50 | −87 | gb105pln | *Z. mays* mRNA for acidic ribosomal protein P0. |
| 700267281H1 | g22283 | 32 | −57 | gb105pln | *Zea mays* Glb1-L gene for vicilin-like embryo storage protein. |
| 700267627H1 | g2570121 | 27 | −13 | gb105pln | *S. latifolia* mRNA, clone CCLS 30.1 rev. |
| 700266830H1 | g1171351 | 12 | 16 | gb105pln | *Oryza sativa* 16 kDa oleosin (ole16) mRNA, complete cds. |
| 700266724H1 | g471320 | 47 | −3 | gb105pln | *H. vulgare* (cv. Bomi) B15C mRNA. |
| 700260528H2 | g1495251 | 22 | −4 | gb105eukp | heat-shock protein |
| 700263586H1 | g644491 | 85 | −40 | gb105pln | Corn mRNA for elongation factor 1A. |
| 700257340H1 | g22281 | 62 | −61 | gb105pln | *Zea mays* Glb1-0 gene for vicilin-like storage protein (truncated) |
| 700267660H1 | g22514 | 18 | −5 | gb105pln | Maize Zc1 gene for Zein Zc1 (14 kD zein-2). |
| 700266553H1 | g475552 | 4 | 6 | gb105allp | N-methyl-D-aspartate receptor NMDAR2D subunit |
| 700263643H1 | g2104461 | 37 | −13 | gb105eukp | cct7; Cct7p |
| 700263675H1 | g2440204 | 6 | 6 | gb105allp | hypothetical protein |
| 700256829H1 | g22281 | 37 | −59 | gb105pln | *Zea mays* Glb1-0 gene for vicilin-like storage protein (truncated) |
| 700207122H1 | g168480 | 45 | −9 | gb105pln | Maize embryo globulin S allele (7S-like) mRNA, complete cds. |
| 700264827H1 | g1171351 | 16 | −3 | gb105pln | *Oryza sativa* 16 kDa oleosin (ole16) mRNA, complete cds. |
| 700265216H1 | g1155212 | 33 | 3 | gb105pln | *Avena fatua* aldose reductase-related protein mRNA, complete cds. |
| 700263942H1 | g1498052 | 71 | −80 | gb105pln | *Zea mays* ribosomal protein S8 mRNA, complete cds. |
| 700257028H1 | g471320 | 36 | −18 | gb105pln | *H. vulgare* (cv. Bomi) B15C mRNA. |
| 700267770H1 | g2623310 | 20 | −3 | gb105eukp | T20B5.16 |
| 700259567H1 | g1200160 | 23 | −6 | gb105pln | *T. gesneriana* mRNA for tonoplast intrinsic protein. |
| 700258507H1 | g998429 | 9 | 13 | gb105pln | GRF1 = general regulatory factor [Zea mays], XL80, Genomic, 5348 nt]. |
| 700267685H1 | g1066163 | 14 | 7 | gb105eukp | beta oxidation; glyoxysomal beta-ketoacyl-thiolase; EC 2.3.1.16 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700258192H1 | g248336 | 65 | −49 | gb105pln | polyubiquitin [maize, Genomic, 3841 nt]. |
| 700262461H1 | g757522 | 27 | 1 | gb105eukp | ag12; subtilisin-like protease |
| 700259740H1 | g2804277 | 39 | 2 | gb105pln | *Panax ginseng* mRNA for squalene epoxidase, complete cds. |
| 700261862H1 | g22285 | 79 | 5 | gb105pln | *Zea mays* Glb1-S gene for vicilin-like embryo storage protein. |
| 700257221H1 | g2459421 | 22 | 7 | gb105eukp | F4P9.15; similar to calcium-binding EF-hand protein |
| 700260869H1 | g1321660 | 39 | −21 | gb105pln | Rice mRNA for ascorbate peroxidase, complete cds. |
| 700265369H1 | g1305548 | 19 | −5 | gb105pln | *Glycine max* asparagine synthetase mRNA, complete cds. |
| 700264343H1 | g2505874 | 30 | −14 | gb105eukp | putative kinase |
| 700263877H1 | g168577 | 39 | −46 | gb105pln | Maize phospholipid transfer protein mRNA, 3′ end. |
| 700267054H1 | g1872162 | 26 | −6 | gb105pln | *Arabidopsis thaliana* DnaJ homolog (atj) mRNA, complete cds. |
| 700264727H1 | g1531764 | 11 | 13 | gb105pln | *D. stramonium* mRNA for S-adenosylmethionine decarboxylase. |
| 700261686H1 | g790977 | 52 | −35 | gb105pln | *B. juncea* msams mRNA. |
| 700266446H1 | g927238 | 50 | −53 | gb105pln | *Zea mays* globulin1 (Glb1) gene, allele Glb1-Hb, complete cds. |
| 700266588H1 | g1370470 | 10 | 4 | gb105allp | ORF YPL227c |
| 700263281H1 | g471320 | 63 | −56 | gb105pln | *H. vulgare* (cv. Bomi) B15C mRNA. |
| 700262879H1 | g168602 | 81 | −36 | gb105pln | *Zea mays* regulatory protein GF14-12 mRNA, complete cds. |
| 700263845H1 | g1403043 | 45 | −9 | gb105pln | *H. chilense* × *T. turgidum* conv. durum (Tritordeum) mRNA for S-adenosylmethionine decarboxylase. |
| 700263076H1 | g687246 | 19 | 7 | gb105pln | *Zea mays* oil body protein 17 kDa oleosin (ole17) gene, complete cds. |
| 700257062H1 | g20681 | 10 | 7 | gb105allp | 508 aa peptide |
| 700267040H1 | g22292 | 89 | −51 | gb105pln | *Z. mays* mRNA for glycine-rich protein. |
| 700263152H1 | g1865791 | 20 | −2 | gb105pln | *E. graminis* f. sp. *hordei* mRNA for 60S ribosomal protein L29. |
| 700261186H1 | g22283 | 47 | −57 | gb105pln | *Zea mays* Glb1-L gene for vicilin-like embryo storage protein. |
| 700267583H1 | g168480 | 42 | −34 | gb105pln | Maize embryo globulin S allele (7S-like) mRNA, complete cds. |
| 700257788H1 | g22285 | 59 | −55 | gb105pln | *Zea mays* Glb1-S gene for vicilin-like embryo storage protein. |
| 700258414H1 | g1854444 | 25 | −9 | gb105pln | *Vigna unguiculata* mRNA for CPRD14 protein, complete cds. |
| 700265801H1 | g2656025 | 22 | 14 | gb105pln | *Arabidopsis thaliana* genomic DNA, chromosome 5, P1 clone: MCD7. |
| 700262508H1 | g22283 | 41 | −60 | gb105pln | *Zea mays* Glb1-L gene for vicilin-like embryo storage protein. |
| 700263767H1 | g558651 | 13 | 17 | gb105pln | *T. aestivum* VDAC3 mRNA for voltage dependent anion channel. |
| 700266981H1 | g2288887 | 36 | −0 | gb105eukp | MVD1; mevalonate diphosphate decarboxylase; EC 4.1.1.33 |
| 700262331H1 | g466350 | 6 | 3 | gb105allp | pyruvate kinase |
| 700257011H1 | g2182266 | 42 | −13 | gb105pln | *Hordeum vulgare* lipoxygenase (LoxB) mRNA, complete cds. |
| 700264762H1 | g687244 | 50 | −94 | gb105pln | *Zea mays* oil body protein 16 kDa oleosin (ole16) gene, complete cds. |
| 700257168H1 | g1513227 | 15 | 6 | gb105pln | *Brassica napus* myo-inositol 1-phosphate synthase mRNA, complete cds. |
| 700261963H1 | g415316 | 30 | 10 | gb105pln | Rice mRNA for acidic ribosomal protein P0, complete cds. |
| 700264057H1 | g927238 | 54 | −69 | gb105pln | *Zea mays* globulin1 (Glb1) gene, allele Glb1-Hb, complete cds. |
| 700263851H1 | g871507 | 12 | 14 | gb105pln | *P. sativum* mRNA for small GTP-binding protein (clone pGTP13) |
| 700258849H1 | g397400 | 31 | −21 | gb105pln | *B. rapa* mRNA for S phase specific gene. |
| 700267375H1 | g1888357 | 16 | −2 | gb105eukp | orf16; alpha-mannosidase |
| 700262559H1 | g2564050 | 16 | 9 | gb105pln | *Arabidopsis thaliana* genomic DNA, chromosome 5, P1 clone: MUA22, complete sequence. |
| 700264345H1 | g1463121 | 41 | −13 | gb105eukp | RPS3; ribosomal protein S3 |
| 700262654H1 | g287297 | 61 | −56 | gb105pln | *Oryza sativa* mRNA for aspartate aminotransferase, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700258011H1 | g22140 | 65 | −73 | gb105pln | Z. mays gene for acetohydroxyacid synthase (AHAS109) |
| 700267813H1 | g21233 | 40 | −35 | gb105pln | S. oleracea AHRI mRNA for acetohydroxy acid reductoisomerase. |
| 700263622H1 | g1322621 | 39 | −23 | gb105eukp | NBP35 |
| 700262567H1 | g16427 | 13 | 8 | gb105allp | protease inhibitor II |
| 700265369H1 | g1778371 | 21 | −8 | gb105pln | Glycine max asparagine synthetase 1 (AS1) mRNA, complete cds. |
| 700267308H1 | g2345153 | 41 | −65 | gb105pln | Zea mays ribsomal protein S4 (rps4) mRNA, complete cds. |
| 700258663H1 | g168512 | 46 | −46 | gb105pln | Maize major protein (L3) mRNA from the surface of lipid bodies, 3' end. |
| 700268150H1 | g736271 | 72 | −26 | gb105pln | O. sativa hsp70 gene for heat shock protein 70. |
| 700266611H1 | g1488296 | 37 | −18 | gb105pln | Oryza sativa osRAD23 mRNA, complete cds. |
| 700265365H1 | g166754 | 21 | −11 | gb105eukp | HAT5; homeobox protein |
| 700262750H1 | g1129085 | 24 | −23 | gb105pln | Wheat mRNA for protein H2A, complete cds, clone wcH2A-9. |
| 700263649H1 | g168543 | 57 | −2 | gb105pln | Zea mays putative ribosomal protein S8 mRNA, partial cds. |
| 700259471H1 | g687244 | 96 | −19 | gb105pln | Zea mays oil body protein 16 kDa oleosin (ole16) gene, complete cds. |
| 700259391H1 | g168694 | 58 | 11 | gb105pln | Maize gamma zein mRNA, partial cds. |
| 700267667H1 | g347844 | 68 | −55 | gb105pln | Zea mays globulin-1 gene, terminator region. |
| 700267223H1 | g21892 | 52 | −15 | gb105pln | T. aestivum (clone pTAU1.3) U1 snRNA. |
| 700265288H1 | g514945 | 94 | −83 | gb105pln | Zea mays sucrose synthase (Sus1) mRNA, complete cds. |
| 700264747H1 | g2160318 | 37 | −24 | gb105pln | Rice mRNA for ribosomal protein L9, partial sequence. |
| 700259420H1 | g1041041 | 15 | −1 | gb105eukp | SUN1; proteasome subunit |
| 700257538H1 | g1177337 | 59 | −8 | gb105eukp | SPAC1D4.04; unknown |
| 700266276H1 | g20501 | 9 | 5 | gb105eukp | vicilin-like storage protein |
| 700262161H1 | g168512 | 33 | −17 | gb105pln | Maize major protein (L3) mRNA from the surface of lipid bodies, 3' end. |
| 700263479H1 | g2760165 | 22 | −3 | gb105pln | Arabidopsis thaliana genomic DNA, chromosome 5, P1 clone: MAC9, complete sequence. |
| 700257131H1 | g393400 | 98 | −94 | gb105pln | Z. mays mRNA for alpha-tubulin. |
| 700263072H1 | g22281 | 77 | −46 | gb105pln | Zea mays Glb1-0 gene for vicilin-like storage protein (truncated) |
| 700262455H1 | g603293 | 15 | −4 | gb105eukp | YER057C; Yer057cp |
| 700265413H1 | g490042 | 24 | 6 | gb105allp | pectin esterase |
| 700264524H1 | g2276194 | 12 | −1 | gb105eukp | T04A11.4 |
| 700258326H1 | g453564 | 60 | −51 | gb105pln | Lycopersicon esculentum Ran protein/TC4 protein (RAN2B) mRNA, complete cds. |
| 700257089H1 | g21732 | 26 | −5 | gb105pln | Wheat mRNA for Em protein. |
| 700267739H1 | g2331300 | 79 | −72 | gb105pln | Zea mays ribosomal protein S4 type I (rps4) mRNA, complete cds. |
| 700265048H1 | g168512 | 49 | −46 | gb105pln | Maize major protein (L3) mRNA from the surface of lipid bodies, 3' end. |
| 700262831H1 | g1229168 | 22 | −16 | gb105pln | Hordeum vulgare profilin (Hvpro1) mRNA, complete cds. |
| 700259572H1 | g644492 | 83 | −78 | gb105pln | Corn elongation factor 1alpha gene, complete cds. |
| 700259466H1 | g2661840 | 35 | 5 | gb105allp | adenosine kinase |
| 700262316H1 | g596079 | 41 | −74 | gb105pln | Zea mays thiamine biosynthetic enzyme (thi1-2) mRNA, complete cds. |
| 700258850H1 | g599625 | 32 | −5 | gb105eukp | Aco; aconitase; EC 4.2.1.3 |
| 700263251H1 | g1289203 | 24 | −6 | gb105pln | A. glutinosa mRNA for thiazole biosynthetic enzyme. |
| 700262995H1 | g2464904 | 11 | −1 | gb105eukp | X-Pro aminopeptidase homolog |
| 700259137H2 | g217940 | 32 | 5 | gb105eukp | beta-amylase |
| 700267031H1 | g22118 | 49 | −51 | gb105pln | Z. mays DNA for Adh1-Cm allele. |
| 700258263H1 | g1171351 | 19 | 1 | gb105pln | Oryza sativa 16 kDa oleosin (ole16) mRNA, complete cds. |
| 700265904H1 | g2827544 | 27 | −12 | gb105eukp | T12H17.60; HSP associated protein like |
| 700260649H1 | g471320 | 30 | −45 | gb105pln | H. vulgare (cv. Bomi) B15C mRNA. |
| 700261886H1 | g1212995 | 34 | 10 | gb105pln | H. vulgare mRNA for UDP-glucose pyrophosphorylase. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700267049H1 | g172457 | 18 | 6 | gb105pln | Yeast (*Saccharomyces cerevisiae*) ribosomal protein 51A gene (RP51A) |
| 700261385H1 | g2781357 | 14 | −2 | gb105eukp | F24O1.13 |
| 700266288H1 | g2589161 | 57 | −54 | gb105pln | *Zea mays* mRNA for aldehyde oxidase, complete cds. |
| 700261613H1 | g1906825 | 65 | −61 | gb105pln | *A. thaliana* hsp81.2 gene. |
| 700262062H1 | g1042260 | 17 | 4 | gb105pln | {Mu1 element insertion site, clone 10} [maize, Transposon, 285 nt]. |
| 700264353H1 | g1694832 | 31 | −52 | gb105pln | *H. vulgare* Per1 gene. |
| 700262589H1 | g248336 | 63 | −73 | gb105pln | polyubiquitin [maize, Genomic, 3841 nt]. |
| 700263386H1 | g1143387 | 18 | 10 | gb105pln | *A. thaliana* mRNA for Class III ADH. |
| 700260744H1 | g2827530 | 28 | −12 | gb105eukp | F8F16.170; predicted protein |
| 700267978H1 | g20255 | 65 | −59 | gb105pln | *O. sativa* gene for heat shock protein 82 HSP82. |
| 700261253H1 | g895891 | 13 | −6 | gb105eukp | RPS5, ribosamal protein S5 |
| 700266324H1 | g2582664 | 31 | −20 | gb105pln | *C. sinensis* thi mRNA. |
| 700260490H1 | g485376 | 35 | −59 | gb105pln | *Zea mays* alpha-3-tubulin gene, complete cds. |
| 700266087H1 | g22121 | 50 | −81 | gb105pln | Maize alcohol dehydrogenase 1 gene (Adh1-1F). |
| 700265994H1 | g22237 | 74 | −28 | gb105pln | Maize mRNA for cytosolic GAPDH (GapC) glyceraldehyde-3-phosphate dehydrogenase. |
| 700260547H2 | g310570 | 15 | 8 | gb105eukp | GmPM3; dessication protectant; seed maturation protein; pGmPM3 |
| 700207167H1 | g2245030 | 25 | 5 | gb105allp | apetaia2 domain TINY homolog |
| 700258601H1 | g21834 | 51 | −37 | gb105pln | Wheat mRNA for cytosolic phosphoglycerate kinase (EC 2.7.2.3). |
| 700258061H1 | g984050 | 7 | 8 | gb105eukp | LEA protein Le25 homolog |
| 700267979H1 | g899607 | 67 | −63 | gb105pln | *Zea mays* polyubiquitin (MubC5) mRNA, complete cds. |
| 700265689H1 | g22281 | 52 | 0 | gb105pln | *Zea mays* Glb1-0 gene for vicilin-like storage protein (truncated). |
| 700258126H1 | g687244 | 52 | −74 | gb105pln | *Zea mays* oil body protein 16 kDa oleosin (ole16) gene, complete cds. |
| 700262142H1 | g2414680 | 37 | −27 | gb105pln | *Vicia narbonensis* mRNA for cysteine proteinase precursor. |
| 700265391H1 | g437041 | 35 | −25 | gb105pln | *M. esculenta* mRNA for granule-bound starch synthase. |
| 700267157H1 | g1854385 | 21 | 2 | gb105pln | *Vitis vinifera* mRNA for soluble NSF attachment protein homolog, complete cds. |
| 700264280H1 | g927239 | 7 | 6 | gb105allp | globulin1 |
| 700259714H1 | g483535 | 25 | −1 | gb105pln | *R. communis* gene for pyrophosphate-dependent phosphofructokinase beta subunit. |
| 700266645H1 | g166791 | 25 | 7 | gb105pln | *Arabidopsis thaliana* phosphoribosylanthranilate transferase (PAT1) gene, complete cds. |
| 700259334H1 | g2252864 | 8 | 2 | gb105eukp | A_TM018A10.19 |
| 700258023H1 | g1945611 | 12 | 8 | gb105allp | 26S proteasome subunit p55 |
| 700262892H1 | g169818 | 49 | 7 | gb105pln | Rice 25S ribosomal RNA gene. |
| 700258587H1 | g687244 | 52 | 0 | gb105pln | *Zea mays* oil body protein 16 kDa oleosin (ole16) gene, complete cds. |
| 700264837H1 | g1871196 | 20 | −20 | gb105eukp | T06D20.22 |
| 700258368H1 | g398326 | 27 | −12 | gb105pln | *A. phyllitidis* PABP mRNA for poly(A)-binding protein. |
| 700207266H1 | g687244 | 90 | −18 | gb105pln | *Zea mays* oil body protein 16 kDa oleosin (ole16) gene, complete cds. |
| 700258669H1 | g960356 | 49 | −37 | gb105pln | Barley mRNA for S-adenosylmethionine synthetase, complete cds. |
| 700257122H1 | g992633 | 20 | −6 | gb105eukp | cyclosporin A binding protein; cyclophilin B |
| 700261150H1 | g471320 | 40 | −44 | gb105pln | *H. vulgare* (cv. Bomi) B15C mRNA. |
| 700263796H1 | g169792 | 66 | −57 | gb105pln | Rice histone 3 gene, complete cds. |
| 700258375H1 | g168512 | 38 | −31 | gb105pln | Maize major protein (L3) mRNA from the surface of lipid bodies, 3' end. |
| 700263113H1 | g22270 | 96 | −27 | gb105pln | Maize mRNA from an embryogenic abscisic acid-inducible gene. |
| 700265948H1 | g2654121 | 16 | 12 | gb105pln | *Arabidopsis thaliana* ribosomal protein L23a (AtrpL23a) mRNA, complete cds. |
| 700263911H1 | g556685 | 38 | −39 | gb105pln | *Z. mays* mRNA for ADP-ribosylation factor. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700257406H2 | g19280 | 45 | −45 | gb105pln | *L. esculentum* mRNA for enolase. |
| 700267708H1 | g747916 | 71 | −68 | gb105pln | *Z. mays* CaM2 mRNA for calmodulin. |
| 700264388H1 | g2656028 | 10 | 13 | gb105pln | *Arabidopsis thaliana* genomic DNA, chromosome 5, P1 clone: MNF13. |
| 700265735H1 | g471320 | 50 | −51 | gb105pln | *H. vulgare* (cv. Bomi) B15C mRNA. |
| 700263168H1 | g28872 | 25 | −5 | gb105allp | argininosuccinate synthetase (aa 1–412) |
| 700263155H1 | g603415 | 11 | 4 | gb105eukp | YER174C; Yer174cp |
| 700267432H1 | g483431 | 14 | 3 | gb105eukp | T151; cyc07 |
| 700264634H1 | g2191135 | 34 | −4 | gb105eukp | A__IG002N01.14 |
| 700266358H1 | g1532047 | 17 | 11 | gb105pln | *O. sativa* mRNA for S-adenosylmethionine decarboxylase. |
| 700267380H1 | g2168136 | 23 | −8 | gb105pln | *F. sylvatica* mRNA for PKF1 protein |
| 700262631H1 | g687244 | 52 | −85 | gb105pln | *Zea mays* oil body protein 16 kDa oleosin (ole16) gene, complete cds. |
| 700264438H1 | g899607 | 73 | −63 | gb105pln | *Zea mays* polyubiquitin (MubC5) mRNA, complete cds. |
| 700261694H1 | g609402 | 6 | 6 | gb105allp | Tal1p: Transaldolase |
| 700259374H1 | g22614 | 86 | −76 | gb105pln | *S. vulgare* pepC gene for PEP carboxylase. |
| 700266617H1 | g1675393 | 16 | 5 | gb105pln | *Oryza sativa* class III ADH enzyme (AdhIII) gene, complete cds. |
| 700261357H1 | g1220285 | 15 | −4 | gb105eukp | SPAC22E12.10c; unknown |
| 700262845H1 | g868002 | 50 | −38 | gb105pln | Pumpkin mRNA for aconitase, complete cds. |
| 700256847H1 | g218000 | 24 | 12 | gb105pln | Potato mRNA for UDP-glucose pyrophosphorylase (EC 2.7.7.9) |
| 700266724H1 | g971279 | 46 | −1 | gb105pln | Rice mRNA for RAB24 protein, complete cds. |
| 700264052H1 | g602605 | 98 | −63 | gb105pln | *Zea mays* tandem genes for alpha1-tubulin and alpha2-tubulin. |
| 700263868H1 | g790969 | 36 | −41 | gb105pln | Rice mRNA for aldolase C-1, complete cds. |
| 700266645H1 | g2827662 | 39 | −3 | gb105eukp | F18F4.180; Phosphoribosylanthranilate transferase |
| 700256920H1 | g300263 | 42 | −36 | gb105pln | HSP68 = 68 kda heat-stress DnaK homolog [*Solanum tuberosum* = potatoes, mRNA, 2418 nt]. |
| 700266327H1 | g1155333 | 32 | −22 | gb105pln | *Solanum tuberosum* POTATP1 mRNA, complete cds. |
| 700266342H1 | g1929408 | 18 | −4 | gb105eukp | npp3; protein phosphatase type 1 |
| 700257303H1 | g2305013 | 33 | −2 | gb105pln | *Musa acuminata* S-adenosyl-L-methionine synthetase homolog mRNA, complete cds. |
| 700258464H1 | g577736 | 34 | −11 | gb105pln | *A. thaliana* PRL2 mRNA. |
| 700265550H1 | g16427 | 17 | 4 | gb105allp | protease inhibitor II |
| 700257028H1 | g971279 | 36 | −19 | gb105pln | Rice mRNA for RAB24 protein, complete cds. |
| 700257828H1 | g2244759 | 21 | 6 | gb105eukp | selenium-binding protein |
| 700261874H1 | g1009720 | 13 | 1 | gb105eukp | ENOD8; nodulin |
| 700261339H1 | g602564 | 38 | −14 | gb105pln | *C. paradisi* (Macf) INO1 gene. |
| 700268122H1 | g2582643 | 24 | −1 | gb105eukp | RSZp21; RSZp21 protein |
| 700266058H1 | g463251 | 24 | −11 | gb105pln | *M. sativa* (Nagyszenasi) mRNA for ribosomal protein RL5. |
| 700261235H1 | g927238 | 59 | −55 | gb105pln | *Zea mays* globulin1 (Glb1) gene, allele Glb1-Hb, complete cds. |
| 700266762H1 | g2190545 | 6 | 1 | gb105allp | Similar to *Zea mays* permease 1 (gb|U43034). |
| 700265675H1 | g22490 | 8 | −3 | gb105eukp | ORF1 |
| 700265639H1 | g22281 | 47 | −82 | gb105pln | *Zea mays* Glb1-G gene for vicilin-like storage protein (truncated). |
| 700264847H1 | g22292 | 80 | −49 | gb105pln | *Z. mays* mRNA for glycine-rich protein. |
| 700264827H1 | g687244 | 52 | −74 | gb105pln | *Zea mays* oil body protein 16 kDa oleosin (ole16) gene, complete cds. |
| 700267912H1 | g469148 | 16 | −2 | gb105eukp | alanine aminotransferase |
| 700263129H1 | g687244 | 98 | −25 | gb105pln | *Zea mays* oil body protein 16 kDa oleosin (ole16) gene, complete cds. |
| 700268057H1 | g2443329 | 27 | 3 | gb105allp | Mei2-like protein |
| 700264056H1 | g18890 | 32 | −36 | gb105pln | *H. vulgare* gene for aldose reductase-related protein. |
| 700258651H1 | g450292 | 74 | −70 | gb105pln | *Zea mays* alpha-tubulin mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700262872H1 | g17391 | 11 | 6 | gb105allp | GLYCINE-RICH RNA-BINDING PROTEIN |
| 700265172H1 | g473999 | 18 | 8 | gb105pln | Rice mRNA, partial homologous to ribosomal protein L31 gene. |
| 700263281H1 | g971279 | 58 | −51 | gb105pln | Rice mRNA for RAB24 protein, complete cds. |
| 700260134H1 | g1906825 | 42 | −50 | gb105pln | *A. thaliana* hsp81.2 gene. |
| 700265205H1 | g603957 | 14 | 4 | gb105allp | KIAA0099 is related to *D. melanogaster* pumilio gene. |
| 700262943H1 | g168665 | 47 | −59 | gb105pln | Maize 16- kDa zein-2 mRNA, complete cds. |
| 700264625H1 | g398921 | 38 | −23 | gb105pln | *B. napus* cold induced protein (BnC24B) |
| 700258909H1 | g167064 | 52 | −24 | gb105pln | *Hordeum vulgare* beta-ketoacyl-ACP synthase I (Kas12) mRNA, complete cds. |
| 700264395H1 | g18501 | 17 | 2 | gb105eukp | D-34 Lea protein |
| 700257818H1 | g21734 | 20 | −3 | gb105pln | *T. aestivum* (cDNA I) mRNA for EC protein. |
| 700264147H1 | g1694832 | 64 | 0 | gb105pln | *H. vulgare* Per1 gene. |
| 700266877H1 | g927238 | 72 | −41 | gb105pln | *Zea mays* globulin1 (Glb1) gene, allele Glb1-Hb, complete cds. |
| 700262049H1 | g1136119 | 37 | −48 | gb105pln | *O. sativa* mRNA for alpha-tubulin (clone OSTA-111). |
| 700265291H1 | g2829893 | 27 | −7 | gb105eukp | T26J12.5; phosphoglucomutase |
| 700267553H1 | g168480 | 71 | −67 | gb105pln | Maize embryo globulin S allele (7S-like) mRNA, complete cds. |
| 700261332H1 | g248336 | 36 | 16 | gb105pln | polyubiquitin [maize, Genomic, 3841 nt]. |
| 700266315H1 | g303854 | 65 | −20 | gb105pln | Rice mRNA for ribosomal protein L7A, complete cds. |
| 700265443H1 | g1628443 | 21 | 1 | gb105eukp | ORF |
| 700262650H1 | g1575129 | 76 | −30 | gb105pln | *Zea mays* lumenal binding protein cBiPe3 mRNA, complete cds. |
| 700262387H1 | g1924920 | 29 | −17 | gb105pln | *A. thaliana* mRNA for glyoxalase II. |
| 700264392H1 | g416265 | 27 | 4 | gb105pln | Rice mRNA for ribosomal protein A2, partial sequence. |
| 700256835H1 | g2708737 | 8 | 6 | gb105allp | putative nuclear protein |
| 700267487H1 | g1532047 | 40 | −35 | gb105pln | *O. sativa* mRNA for S-adenosylmethionine decarboxylase. |
| 700257414H1 | g1644339 | 11 | 5 | gb105allp | glucosyl transferase |
| 700266587H1 | g166410 | 18 | −2 | gb105eukp | nucleic acid binding protein; Alfin-1 |
| 700260112H1 | g22312 | 38 | −50 | gb105pln | Maize ABA-inducible gene for glycine-rich protein (ABA = abscisic acid). |
| 700266217H1 | g397395 | 62 | −45 | gb105pln | *Z. mays* MNB1b mRNA for DNA-binding protein. |
| 700262160H1 | g2182652 | 14 | 7 | gb105allp | Y4uB |
| 700266834H1 | g22149 | 62 | −36 | gb105pln | *Z. mays* mRNA for alpha-tubulin 3. |
| 700266659H1 | g2765667 | 13 | −5 | gb105eukp | SAL2; 3'(2'),5'-bisphosphate nucleotidase; EC 3.1.3.7 |
| 700264515H1 | g2827001 | 63 | −63 | gb105pln | *Triticum aestivum* 70 kDa heat shock protein (TaHSP70d) mRNA, complete cds. |
| 700259137H2 | g217936 | 32 | 5 | gb105allp | beta-amylase |
| 700258633H1 | g168512 | 83 | −86 | gb105pln | Maize major protein (L3) mRNA from the surface of lipid bodies, 3' end. |
| 700265593H1 | g1302535 | 6 | −1 | gb105eukp | ORF YNR035c |
| 700260446H1 | g1167857 | 33 | −40 | gb105pln | *S. cereale* cv. Petkus 'Halo' encoding cpn60. |
| 700262979H1 | g482937 | 42 | −25 | gb105pln | *N. tabacum* mRNA for pyruvate kinase (plastid isozyme). |
| 700256867H1 | g473976 | 57 | −52 | gb105pln | Rice mRNA, partial homologous to elongation factor 1-alpha gene. |
| 700263311H1 | g2388574 | 11 | −0 | gb105eukp | YUP8H12.16 |
| 700268055H1 | g902597 | 37 | −2 | gb105allp | MIF homologue |
| 700266078H1 | g1042260 | 17 | 9 | gb105pln | {Mu1 element insertion site, clone 10} [maize, Transposon, 285 nt]. |
| 700260160H1 | g22285 | 66 | −66 | gb105pln | *Zea mays* Glb1-S gene for vicilin-like embryo storage protein. |
| 700261558H1 | g483443 | 37 | 13 | gb105pln | *Z. mays* IBP2 mRNA for initiator-binding protein. |
| 700264086H1 | g1129085 | 30 | 8 | gb105pln | Wheat mRNA for protein H2A, complete cds, clone wcH2A-9. |
| 700259692H1 | g1550813 | 61 | −71 | gb105pln | *Z. mays* mRNA for acidic ribosomal protein P0. |
| 700265667H1 | g1532047 | 36 | −40 | gb105pln | *O. sativa* mRNA for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700265132H1 | g20280 | 43 | −47 | gb105pln | S-adenosylmethionine decarboxylase. Rice gene for phenylalanine ammonia-lyase (EC 4.3.1.5). |
| 700260911H1 | g21729 | 13 | 10 | gb105pln | *T. aestivum* Em gene. |
| 700258650H1 | g2688657 | 9 | 5 | gb105allp | pyrophosphate-fructose 6-phosphate 1-phosphotransferase (pfk) |
| 700264372H1 | g22285 | 42 | −83 | gb105pln | *Zea mays* Glb1-S gene for vicilin-like embryo storage protein. |
| 700263088H1 | g971279 | 31 | 10 | gb105pln | Rice mRNA for RAB24 protein, complete cds. |
| 700266749H1 | g2388561 | 30 | 1 | gb105eukp | YUP8H12.2 |
| 700267245H1 | g1532047 | 60 | −49 | gb105pln | *O. sativa* mRNA for S-adenosylmethionine decarboxylase. |
| 700264345H1 | g1302158 | 41 | −13 | gb105eukp | RPS3 |
| 700262507H1 | g435678 | 14 | 8 | gb105pln | *L. esculentum* Mill (cv. Rutgers) mRNA for ribosomal protein S25. |
| 700257726H1 | g555945 | 33 | 7 | gb105allp | ribosomal protein S3 |
| 700267416H1 | g575730 | 17 | −15 | gb105pln | *Z. mays* mRNA for transmembrane protein. |
| 700258638H1 | g22281 | 78 | −83 | gb105pln | *Zea mays* Glb1-0 gene for vicilin-like storage protein (truncated) |
| 700257579H1 | g1724099 | 20 | 16 | gb105pln | *Mesembryanthemum crystallinum* voltage-dependent anion-selective channel protein porin (VDAC) mRNA, complete cds. |
| 700263783H1 | g1749752 | 9 | 6 | gb105eukp | similar to *Saccharomyces cerevisiae* T-complex protein 1, theta subunit, SWISS-PROT Accession Number P47079 |
| 700260602H1 | g18963 | 36 | −4 | gb105pln | *Z. mays* mRNA for dehydrin (dhn3). |
| 700263796H1 | g20250 | 69 | −56 | gb105pln | *Oryza sativa* H3 histone gene H3R-11. |
| 700262932H1 | g532095 | 18 | −11 | gb105eukp | ZC395.7 |
| 700267082H1 | g1620661 | 57 | −36 | gb105pln | *Triticum aestivum* 1,4-alpha-D-glucan 6-alpha-D-(1,4-alpha-D-glucanotransferase mRNA, complete cds. |
| 700267037H1 | g606969 | 39 | −12 | gb105pln | *Arabidopsis thaliana* cytoplasmic ribosomal protein L18 mRNA, complete cds. |
| 700262993H1 | g2351061 | 20 | 6 | gb105pln | *Arabidopsis thaliana* genomic DNA, chromosome 5, P1 clone: MAF19. |
| 700258506H1 | g506138 | 64 | −67 | gb105pln | *Zea mays* Ec metallothionein class II protein mRNA, complete cds. |
| 700264217H1 | g537446 | 32 | −5 | gb105eukp | Athsp101; AtHSP101 |
| 700267249H1 | g415316 | 61 | −66 | gb105pln | Rice mRNA for acidic ribosomal protein P0, complete cds. |
| 700262149H1 | g2370231 | 25 | 6 | gb105pln | *Hordeum vulgare* mRNA for putative acyl-CoA oxidase. |
| 700261238H1 | g205942 | 12 | 6 | gb105allp | liver nuclear protein p47 |
| 700265008H1 | g312180 | 28 | −30 | gb105pln | *Z. mays* GapC4 gene. |
| 700260649H1 | g971279 | 29 | −37 | gb105pln | Rice mRNA for RAB24 protein, complete cds. |
| 700259590H1 | g2791948 | 25 | −8 | gb105eukp | rpl13a0; ribosomal protein L13a |
| 700257078H1 | g2181190 | 31 | −13 | gb105eukp | BRLK; serine/threonine kinase |
| 700260566H1 | g168512 | 62 | 5 | gb105pln | Maize major protein (L3) mRNA from the surface of lipid bodies, 3' end. |
| 700256881H1 | g2213424 | 31 | −22 | gb105pln | *Citrus paradisi* mRNA for hypothetical protein. |
| 700266171H1 | g691752 | 17 | −4 | gb105eukp | preproMP27–MP32 |
| 700265135H1 | g687244 | 59 | −76 | gb105pln | *Zea mays* oil body protein 16 kDa oleosin (ole16) gene, complete cds. |
| 700262251H1 | g2459430 | 17 | −1 | gb105eukp | F4P9.25; putative CUC2 protein |
| 700259740H1 | g2804278 | 60 | −3 | gb105eukp | squalene epoxidase; EC 1.14.99.7 |
| 700258794H1 | g2414402 | 14 | 5 | gb105allp | Y57G11C.15 |
| 700257724H1 | g2702284 | 27 | 1 | gb105eukp | T21L14.12; Argonaute (AGO1)-like protein |
| 700263962H1 | g728592 | 27 | −8 | gb105eukp | AR-h; aldose reductase; EC 1.1.1.21 |
| 700257644H1 | g2668737 | 53 | −27 | gb105pln | *Zea mays* translation initiation factor 5A (TIF5A) mRNA, complete cds. |
| 700263769H1 | g695410 | 34 | −70 | gb105pln | Corn mRNA for glutamate dehydrogenase, complete cds. |
| 700262817H1 | g2393724 | 12 | 6 | gb105allp | glutathione-S-transferase homolog |
| 700261393H1 | g168480 | 36 | −51 | gb105pln | Maize embryo globulin S allele (7S-like) mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700258770H1 | g2832782 | 46 | −36 | gb105pln | *Egeria densa* mRNA for potassium channel beta subunit. |
| 700265830H1 | g644491 | 90 | −16 | gb105pln | Corn mRNA for elongation factor 1A. |
| 700261315H1 | g2613142 | 34 | −38 | gb105pln | *Oryza sativa* tubulin (RiP3) mRNA, complete cds. |
| 700257451H2 | g1871192 | 26 | −11 | gb105eukp | T06D20.20 |
| 700262594H1 | g22237 | 81 | −87 | gb105pln | Maize mRNA for cytosolic GAPDH (GapC) glyceraldehyde-3-phosphate dehydrogenase. |
| 700265487H1 | g493707 | 80 | −68 | gb105pln | Rice mRNA for beta-tubulin, complete cds. |
| 700268042H1 | g2194138 | 6 | 6 | gb105allp | Similar to Arabidopsis receptor-like protein kinase precursor (gb\|M84659). |
| 700257391H1 | g2331300 | 31 | −54 | gb105pln | *Zea mays* ribosomal protein S4 type I (rps4) mRNA, complete cds. |
| 700258238H1 | g487302 | 46 | −27 | gb105pln | Rice mRNA EN3, partial sequence. |
| 700258034H1 | g1171351 | 29 | −14 | gb105pln | *Oryza sativa* 16 kDa oleosin (ole16) mRNA, complete cds. |
| 700260550H2 | g2388585 | 24 | 1 | gb105eukp | YUP8H12.3 |
| 700257872H1 | g3647 | 25 | 0 | gb105eukp | DED1 (SPP81); Ded1p (Spp81p) |
| 700258072H1 | g22285 | 21 | 9 | gb105pln | *Zea mays* Glb1-S gene for vicilin-like embryo storage protein. |
| 700265633H1 | g147144 | 26 | −15 | gb105allp | aminopeptidase N |
| 700261150H1 | g971279 | 39 | −40 | gb105pln | Rice mRNA for RAB24 protein, complete cds. |
| 700260028H1 | g470337 | 23 | 7 | gb105eukp | T26A5.1 |
| 700266320H1 | g520935 | 32 | 4 | gb105pln | *H. vulgare* mRNA for gamma-TIP-like protein. |
| 700258723H1 | g602252 | 42 | −34 | gb105pln | *Zea mays* enolase (eno2) mRNA, complete cds. |
| 700258139H1 | g520935 | 42 | −24 | gb105pln | *H. vulgare* mRNA for gamma-TIP-like protein. |
| 700262483H1 | g2656029 | 21 | −1 | gb105pln | *Arabidopsis thaliana* genomic DNA, chromosome 5, P1 clone: MQB2. |
| 700262245H1 | g1800227 | 18 | 4 | gb105eukp | Bowman-Birk proteinase inhibitor |
| 700257747H1 | g975887 | 39 | −2 | gb105pln | *Mesembryanthemum crystallinum* myo-inositol-1-phosphate synthase mRNA, complete cds |
| 700265735H1 | g971279 | 48 | −46 | gb105pln | Rice mRNA for RAB24 protein, complete cds. |
| 700261315H1 | g602605 | 49 | −47 | gb105pln | *Zea mays* tandem genes for alpha1-tubulin and alpha2-tubulin. |
| 700268189H1 | g606814 | 66 | −54 | gb105pln | *Zea mays* Golden Bantam carbonic anhydrase mRNA, complete cds. |
| 700260246H1 | g471320 | 24 | −33 | gb105pln | *H. vulgare* (cv. Bomi) B15C mRNA. |
| 700256923H1 | g780371 | 22 | 8 | gb105pln | *Oryza sativa* enolase mRNA, complete cds. |
| 700257814H1 | g296203 | 48 | −20 | gb105pln | *P. miliaceum* mRNA for alanine aminotransferase. |
| 700264041H1 | g2326370 | 10 | 8 | gb105pln | *Arabidopsis thaliana* SEB1, ISA1 genes. |
| 700258556H1 | g1515139 | 14 | 7 | gb105allp | F59C6.4 |
| 700261776H1 | g602605 | 47 | −29 | gb105pln | *Zea mays* tandem genes for alpha1-tubulin and alpha2-tubulin. |
| 700259811H1 | g2317730 | 38 | −34 | gb105pln | *Arabidopsis thaliana* reversibly glycosylated polypeptide-2 (AtRGP) mRNA, complete cds. |
| 700267040H1 | g2267592 | 40 | −19 | gb105pln | *Oryza sativa* glycine-rich RNA-binding protein mRNA, complete cds. |
| 700265262H1 | g1747293 | 25 | −30 | gb105pln | Rice mRNA for vacuolar H+-pyrophosphatase, complete cds. |
| 700261607H1 | g2342735 | 24 | −6 | gb105eukp | T14G11.28 |
| 700267694H1 | g1403043 | 20 | 11 | gb105pln | *H. chilense* × *T. turgidum* conv. durum (Tritordeum) mRNA for S-adenosylmethionine decarboxylase. |
| 700261611H1 | g2645162 | 34 | −12 | gb105pln | *Oryza sativa* mRNA, similar to initiation factor eIF-4c. |
| 700264651H1 | g1777312 | 8 | 3 | gb105allp | novel serine/threonine protein kinase |
| 700264625H1 | g398917 | 40 | −24 | gb105pln | *B. napus* cold induced protein (BnC24A) mRNA. |
| 700267356H1 | g1658312 | 51 | −49 | gb105pln | *O. sativa* osr40g2 gene. |
| 700268009H1 | g1403043 | 47 | −38 | gb105pln | *H. chilense* × *T. turgidum* conv. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | durum (Tritordeum) mRNA for S-adenosylmethionine decarboxylase. |
| 700265166H1 | g287398 | 30 | −30 | gb105pln | Rice mRNA for a protein related to chilling tolerance. |
| 700262137H1 | g1171351 | 30 | −17 | gb105pln | Oryza sativa 16 kDa oleosin (ole16) mRNA, complete cds. |
| 700267323H1 | g168440 | 49 | −18 | gb105pln | Zea mays chitinase A (seed chitinase) gene, complete cds. |
| 700264587H1 | g2213583 | 18 | 6 | gb105eukp | T7N9.3 |
| 700267353H1 | g532571 | 60 | −33 | gb105pln | Barley lipoxygenase 1 (LoxA) gene, complete cds. |
| 700265572H1 | g1749658 | 9 | 1 | gb105eukp | similar to Saccharomyces cerevisiae trehalose-phosphatase, SWISS-PROT Accession Number P31688 |
| 700257675H1 | g1151171 | 39 | −10 | gb105pln | Arabidopsis thaliana myo-inositol 1-phosphate synthase Inps1 mRNA, partial cds. |
| 700267161H1 | g1167953 | 9 | 1 | gb105allp | putative 32.6 kDa jasmonate-induced protein |
| 700264955H1 | g2760168 | 10 | 16 | gb105pln | Arabidopsis thaliana genomic DNA, chromosome 5, P1 clone: MEE6, complete sequence. |
| 700264943H1 | g207905 | 8 | 1 | gb105allp | alph globulin B |
| 700261861H1 | g20741 | 27 | 6 | gb105eukp | P protein; EC 2.1.2.10 |
| 700261164H1 | g2384759 | 67 | −33 | gb105pln | Oryza sativa GDP dissociation inhibitor protein OsGDI2 (OsGDI2) mRNA, complete cds. |
| 700267513H1 | g550544 | 28 | 8 | gb105allp | ribosomal protein L16 |
| 700268106H1 | g166573 | 50 | −49 | gb105pln | A. thaliana plastid 60- kDa chaperonin-60 alpha polypeptide (cpn-60 alpha) mRNA, partial cds. |
| 700266210H1 | g2266661 | 39 | −27 | gb105pln | Hordeum vulgare mRNA for 14-3-3 protein (Hv1433c). |
| 700264740H1 | g297877 | 38 | −24 | gb105pln | A. thaliana UBC10 mRNA for ubiquitin conjugating enzyme homolog. |
| 700260920H1 | g1498389 | 38 | −46 | gb105pln | Zea mays actin (Maz81) gene, partial cds. |
| 700262056H1 | g1037129 | 50 | −66 | gb105pln | (gamma-zeinA) = opaque2 modifier {5′ region} [Zea mays = maize, Tuxpeno CMS 450, mRNA Partial, 1889 nt]. |
| 700258646H1 | g22281 | 54 | −78 | gb105pln | Zea mays Glb1-0 gene for vicilin-like storage protein (truncated). |
| 700264596H1 | g396209 | 33 | −26 | gb105pln | S. polyrrhiza mRNA for D-myo-inositol-3-phosphate synthase. |
| 700261174H1 | g312178 | 23 | −66 | gb105pln | Z. mays GapC2 gene. |
| 700266744H1 | g22283 | 52 | −64 | gb105pln | Zea mays Glb1-L gene for vicilin-like embryo storage protein. |
| 700265934H1 | g485099 | 16 | 2 | gb105eukp | mel-32; highly similar to serine hydromethyltransferase |
| 700263133H1 | g21629 | 66 | −14 | gb105pln | Sorghum vulgare mRNA for phosphoenolpyruvate carboxylase (PEPC). |
| 700259358H1 | g1658312 | 31 | −32 | gb105pln | O. sativa osr40g2 gene. |
| 700266847H1 | g471320 | 62 | −31 | gb105pln | H. vulgare (cv. Bomi) B15C mRNA. |
| 700257785H1 | g2244788 | 36 | −13 | gb105pln | Arabidopsis thaliana DNA chromosome 4, ESSA I contig fragment No. 1. |
| 700266183H1 | g1469220 | 19 | −7 | gb105pln | B. oleracea mRNA (unknown). |
| 700256718H1 | g1906827 | 16 | 0 | gb105pln | A. thaliana hsp81.4 gene. |
| 700264165H1 | g2384757 | 43 | −8 | gb105pln | Oryza sativa GDP dissociation inhibitor protein OsGDI1 (OsGDI1) mRNA, complete cds. |
| 700259608H1 | g167112 | 41 | −31 | gb105pln | Bromus inermis aldose reductase-related protein, complete cds. |
| 700262176H1 | g506792 | 26 | 1 | gb105allp | Sec61 protein complex gamma subunit |
| 700260452H1 | g1154953 | 30 | −13 | gb105pln | T. aestivum histone H2A gene. |
| 700259673H1 | g1143444 | 24 | −9 | gb105pln | E. gunnii mRNA for cinnamyl alcohol dehydrogenase. |
| 700261694H1 | g4602 | 6 | 6 | gb105allp | transaldolase (AA 1–335) |
| 700258341H1 | g288062 | 47 | −38 | gb105pln | A. thaliana mRNA for ketol-acid reductoisomerase subunit. |
| 700263291H1 | g22283 | 76 | −69 | gb105pln | Zea mays Glb1-L gene for vicilin-like embryo storage protein. |
| 700266055H1 | g669002 | 52 | −50 | gb105pln | Glycine max calnexin mRNA, complete cds. |
| 700265547H1 | g166379 | 38 | −14 | gb105pln | Alfalfa glucose-regulated |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | endoplasmic reticular protein mRNA, complete cds. |
| 700266501H1 | g644491 | 74 | −79 | gb105pln | Corn mRNA for elongation factor 1A. |
| 700268079H1 | g168679 | 95 | −94 | gb105pln | Maize 19 kDa zein mRNA, clone cZ19C2, complete cds. |
| 700266138H1 | g1480021 | 31 | −38 | gb105pln | Brassica rapa mRNA for putative ribosomal protein, partial cds. |
| 700264566H1 | g2444270 | 14 | 15 | gb105pln | Arabidopsis thaliana putative amino acid or GABA permease mRNA, complete cds. |
| 700261328H1 | g1019410 | 28 | −9 | gb105eukp | SPAC2G11.12; unknown |
| 700268190H1 | g313266 | 38 | −21 | gb105pln | T. aestivum gene for phosphoglycerate kinase. |
| 700266622H1 | g1167827 | 50 | −31 | gb105pln | C. reinhardtii mRNA for ribosomal protein L12. |
| 700256890H1 | g1575127 | 61 | −56 | gb105pln | Zea mays lumenal binding protein cBiPe2 mRNA, complete cds. |
| 700257265H1 | g469147 | 57 | −11 | gb105pln | H. vulgare mRNA for alanine aminotransferase. |
| 700267273H1 | g633889 | 17 | 8 | gb105pln | glucose and ribitol dehydrogenase homolog Hordeum vulgare = barley, Aura, embryo, mRNA, 1170 nt]. |
| 700261955H1 | g485376 | 81 | −55 | gb105pln | Zea mays alpha-3-tubulin gene, complete cds. |
| 700257973H1 | g2331300 | 32 | −46 | gb105pln | Zea mays ribosomal protein S4 type I (rps4) mRNA, complete cds. |
| 700263860H1 | g1945277 | 17 | 0 | gb105allp | branched chain alpha-keto acid dehydrogenase E1-alpha subunit |
| 700257240H1 | g1945140 | 45 | 2 | gb105eukp | abi2; ABI2 protein phosphatase 2C |
| 700267165H1 | g471320 | 50 | −49 | gb105pln | H. vulgare (cv. Bomi) B15C mRNA. |
| 700263706H1 | g1420784 | 11 | −1 | gb105eukp | PRT1 |
| 700267157H1 | g1854386 | 32 | −7 | gb105eukp | similar to soluble NSF attachment protein |
| 700266242H1 | g2160132 | 18 | 8 | gb105pln | Sequence of BAC F19K23 from Arabidopsis thaliana chromosome 1, complete sequence. |
| 700266150H1 | g21492 | 18 | 0 | gb105pln | S. tuberosum mRNA for mitochondrial processing peptidase. |
| 700266075H1 | g168508 | 51 | −77 | gb105pln | Maize oleosin KD18 (KD18; L2) gene, complete cds. |
| 700267330H1 | g2656031 | 28 | −15 | gb105pln | Arabidopsis thaliana genomic DNA, chromosome 5, P1 clone: MXC20. |
| 700265242H1 | g1658314 | 34 | −6 | gb105pln | O. sativa osr40g3 gene. |
| 700257255H1 | g1694832 | 38 | 5 | gb105pln | H. vulgare Per1 gene. |
| 700257538H1 | g1046266 | 59 | −7 | gb105eukp | cct-2; chaperones actin and tubulin folding in vivo, and perhaps other proteins; CCT-2 |
| 700266370H1 | g440374 | 3 | 6 | gb105allp | PC6B |
| 700265827H1 | g1658312 | 41 | −2 | gb105pln | O. sativa osr40g2 gene. |
| 700265704H1 | g520935 | 39 | −26 | gb105pln | H. vulgare mRNA for gamma-TIP-like protein. |
| 700267727H1 | g1694832 | 37 | −0 | gb105pln | H. vulgare Per1 gene. |
| 700266516H1 | g395071 | 46 | −37 | gb105pln | V. faba guanine nucleotide regulatory protein mRNA, complete CDS. |
| 700265576H1 | g960290 | 35 | −25 | gb105pln | Ruta graveolens anthranilate synthase alpha-subunit mRNA, complete cds. |
| 700262839H1 | g2656031 | 24 | 4 | gb105pln | Arabidopsis thaliana genomic DNA, chromosome 5, P1 clone: MXC20. |
| 700260871H1 | g2388565 | 26 | −12 | gb105eukp | YUP8H12.7 |
| 700264627H1 | g599624 | 45 | −35 | gb105pln | A. thaliana mRNA for aconitase (ZAPII). |
| 700263353H1 | g602252 | 30 | −16 | gb105pln | Zea mays enolase (eno2) mRNA, complete cds. |
| 700264379H1 | g1469171 | 13 | 4 | gb105allp | The KIAA0124 gene product is novel. |
| 700256724H1 | g217937 | 38 | −29 | gb105pln | Sweet potato mitochondrial F1-ATPase delta subunit mRNA, complete cds. |
| 700266121H1 | g2245038 | 3 | 7 | gb105eukp | hypothetical protein |
| 700263777H1 | g22231 | 20 | −20 | gb105pln | Maize cat-1 mRNA for catalase-1 isoenzyme (EC 1.11.1.6) |
| 700262265H1 | g147144 | 9 | 6 | gb105allp | aminopeptidase N |
| 700262201H1 | g1658312 | 40 | 7 | gb105pln | O. sativa osr40g2 gene. |
| 700262363H1 | g473978 | 59 | −14 | gb105pln | Rice mRNA, partial homologous to GAmRNA (cloneF). |
| 700258602H1 | g1321660 | 33 | 11 | gb105pln | Rice mRNA for ascorbate |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | peroxidase, complete cds. |
| 700265901H1 | g1622938 | 28 | −11 | gb105pln | *Bromus secalinus* oleosin (ole16) mRNA, complete cds. |
| 700267955H1 | g687244 | 96 | −34 | gb105pln | *Zea mays* oil body protein 16 kDa oleosin (ole16) gene, complete cds. |
| 700261238H1 | g509403 | 11 | 5 | gb105allp | BAT1 gene product |
| 700266621H1 | g710626 | 23 | −2 | gb105eukp | ERD15; ERD15 protein |
| 700266055H1 | g1181330 | 93 | −90 | gb105pln | *Z. mays* CNX mRNA. |
| 700267031H1 | g22119 | 67 | −54 | gb105pln | Maize Adh1-F mRNA for alcohol dehydrogenase. |
| 700257634H1 | g669002 | 50 | −11 | gb105pln | *Glycine max* calnexin mRNA, complete cds. |
| 700262264H1 | g1724111 | 50 | −42 | gb105pln | *Triticum aestivum* ABA induced plasma membrane protein PM-19 (WTABAPM) mRNA, complete cds. |
| 700259676H1 | g960356 | 43 | −32 | gb105pln | Barley mRNA for S-adenosylmethionine synthetase, complete cds. |
| 700262892H1 | g169819 | 49 | 6 | gb105pln | Rice gene encoding three ribosomal RNA's: the 17S, 3' end; 5.8S, complete; 25S, 5' end. |
| 700259382H1 | g168512 | 34 | −35 | gb105pln | Maize major protein (L3) mRNA from the surface of lipid bodies, 3' end. |
| 700267284H1 | g218001 | 22 | 4 | gb105eukp | UDP-glucose pyrophosphorylase precursor; EC 2.7.7.9 |
| 700256925H1 | g288116 | 24 | −12 | gb105eukp | MDL1; mandelonitrile lyase; EC 4.1.2.10 |
| 700265872H1 | g2465430 | 12 | 3 | gb105allp | 32 kDa protein |
| 700258584H1 | g388368 | 14 | 6 | gb105pln | Yeast (*Saccharomyces cerevisiae*) nuclear-encoded mitochondrial heat shock protein 78 (HSP78) gene, complete cds. |
| 700257224H1 | g2511530 | 57 | −53 | gb105pln | *Eleusine indica* alpha tubulin 1 (TUA1) mRNA, complete cds. |
| 700260562H2 | g687244 | 38 | −83 | gb105pln | *Zea mays* oil body protein 16 kDa oleosin (ole16) gene, complete cds. |
| 700259693H1 | g780813 | 23 | 1 | gb105pln | *Arabidopsis thaliana* 3-ketoacyl-acyl carrier protein synthase I (KAS I) mRNA, complete cds. |
| 700266256H1 | g2791947 | 21 | −4 | gb105pln | *Lupinus luteus* mRNA for ribosomal protein L130. |
| 700267553H1 | g22285 | 45 | −55 | gb105pln | *Zea mays* Glb1-S gene for vicilin-like embryo storage protein. |
| 700207168H1 | g2827080 | 27 | 8 | gb105eukp | mmdh; malate dehydrogenase precursor; EC 1.1.1.37 |
| 700261132H1 | g168512 | 39 | −34 | gb105pln | Maize major protein (L3) mRNA from the surface of lipid bodies, 3' end. |
| 700265124H1 | g168480 | 70 | −79 | gb105pln | Maize embryo globulin S allele (7S-like) mRNA, complete cds. |
| 700260779H1 | g21732 | 20 | 3 | gb105pln | Wheat mRNA for Em protein. |
| 700265135H1 | g1171351 | 23 | −4 | gb105pln | *Oryza sativa* 16 kDa oleosin (ole16) mRNA, complete cds. |
| 700263128H1 | g602605 | 31 | −3 | gb105pln | *Zea mays* tandem genes for alpha1-tubulin and alpha2-tubulin. |
| 700259024H1 | g571510 | 14 | −9 | gb105eukp | BIN3; Bin3p |
| 700256705H1 | g1707239 | 9 | 6 | gb105eukp | C07D8.6 |
| 700258431H1 | g2266661 | 33 | −13 | gb105pln | *Hordeum vulgare* mRNA for 14-3-3 protein (Hv1433c). |
| 700267259H1 | g520935 | 40 | −33 | gb105pln | *H. vulgare* mRNA for gamma-TIP-like protein. |
| 700264414H1 | g687244 | 48 | −83 | gb105pln | *Zea mays* oil body protein 16 kDa oleosin (ole16) gene, complete cds. |
| 700261846H1 | g2285801 | 43 | −12 | gb105pln | *Spinacia oleracea* mRNA for 26S proteasome alpha subunit, complete cds. |
| 700263451H1 | g1737492 | 11 | −0 | gb105eukp | wheatpab; poly(A)-binding protein |
| 700256873H1 | g1488042 | 28 | −31 | gb105pln | *Catharanthus roseus* PAPS-reductase-like protein (Crpar) mRNA, complete cds. |
| 700262649H1 | g169818 | 85 | −33 | gb105pln | Rice 25S ribosomal RNA gene. |
| 700261336H1 | g21598 | 17 | −1 | gb105pln | *S.tuberosum* mRNA for UDP-glucose pyrophosphorylase. |
| 700258460H1 | g22340 | 50 | 5 | gb105pln | Maize gene for heat shock protein 70 exon 1 (hsp70; clone pMON 9502). |
| 700267779H1 | g1403043 | 13 | 6 | gb105pln | H. chilense x T. turgidum conv. durum (Tritordeum) mRNA for S-adenosylmethionine decarboxylase. |
| 700264353H1 | g471320 | 61 | −55 | gb105pln | *H. vulgare* (cv. Bomi) B15C |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | mRNA. |
| 700264183H1 | g642163 | 74 | −28 | gb105pln | *B. dictyophylla* ITS2 and 28S rRNA gene (partial). |
| 700264147H1 | g1694833 | 71 | 3 | gb105allp | peroxiredoxin |
| 700263693H1 | g2443471 | 14 | −15 | gb105pln | *Arabidopsis thaliana* ASF/SF2 homolog (SF2) gene, complete cds. |
| 700262830H1 | g1403043 | 23 | <13 | gb105pln | *H. chilense* × *T. turgidum* conv. durum (Tritordeum) mRNA for S-adenosylmethionine decarboxylase. |
| 700257933H1 | g485743 | 36 | −9 | gb105pln | Beta *vulgaris* clone P1 pyrophosphatase mRNA, complete cds. |
| 700266969H1 | g602252 | 88 | −49 | gb105pln | *Zea mays* enolase (eno2) mRNA, complete cds. |
| 700258366H1 | g22281 | 40 | −45 | gb105pln | *Zea mays* Glb1-0 gene for vicilin-like storage protein (truncated). |
| 700263587H1 | g633889 | 61 | −11 | gb105pln | glucose and ribitol dehydrogenase homolog [Hordeum vulgare = barley, Aura, embryo, mRNA, 1170 nt]. |
| 700267579H1 | g533251 | 81 | −85 | gb105pln | *Zea mays* (clone pSM8) sucrose synthase 2 (Sus1) gene, complete cds. |
| 700263952H1 | g168405 | 68 | −12 | gb105pln | maize alcohol dehydrogenase (adh1) mrna 3' end and flank. |
| 700266024H1 | g485376 | 86 | −2 | gb105pln | *Zea mays* alpha-3-tubulin gene, complete cds. |
| 700267979H1 | g777757 | 62 | −55 | gb105pln | Saccharum hybrid (clone SCUB1561) polyubiquitin mRNA, complete cds. |
| 700258720H1 | g1009720 | 7 | 8 | gb105allp | nodulin |
| 700257280H1 | g987122 | 57 | −2 | gb105pln | *Z.mays* mRNA for class II metallothionein. |
| 700263302H1 | g2244802 | 12 | 6 | gb105eukp | retrovirus-related polyprotein homolog |
| 700263062H1 | g167245 | 22 | 8 | gb105allp | elongation factor 2 |
| 700262875H1 | g2098816 | 27 | −31 | gb105pln | *Arabidopsis thaliana* BAC F19G10, complete sequence. |
| 700258808H1 | g500850 | 50 | −60 | gb105pln | *Zea mays* (clone pAKHSDH1) aspartate kinase-homoserine dehydrogenase mRNA, complete cds. |
| 700260246H1 | g971279 | 24 | −34 | gb105pln | Rice mRNA for RAB24 protein, complete cds. |
| 700264931H1 | g1546918 | 45 | −64 | gb105pln | *Z. mays* mRNA for translation initiation factor 5A. |
| 700258985H1 | g1679885 | 13 | 0 | gb105eukp | NADP-malic enzyme |
| 700257261H1 | g168512 | 30 | 15 | gb105pln | Maize major protein (L3) mRNA from the surface of lipid bodies, 3' end. |
| 700257765H1 | g22283 | 59 | −53 | gb105pln | *Zea mays* Glb1-L gene for vicilin-like embryo storage protein. |
| 700267617H1 | g21834 | 47 | −6 | gb105pln | Wheat mRNA for cytosolic phosphoglycerate kinase (EC 2.7.2.3). |
| 700268101H1 | g168584 | 32 | −1 | gb105pln | Corn pyruvate, orthophosphate dikinase gene, exons 2–19. |
| 700267019H1 | g22292 | 57 | −49 | gb105pln | *Z. mays* mRNA for glycine-rich protein. |
| 700263284H1 | g2772610 | 14 | 5 | gb105allp | aminopeptidase P |
| 700261132H1 | g1171351 | 26 | −11 | gb105pln | *Oryza sativa* 16 kDa oleosin (ole16) mRNA, complete cds. |
| 700261021H1 | g2281115 | 15 | −2 | gb105eukp | T10P11.14.1; putative cullin-like 1 protein |
| 700259368H1 | g169990 | 43 | −35 | gb105pln | Soybean protein kinase (SPK-1) mRNA, complete cds. |
| 700263513H1 | g22483 | 39 | 14 | gb105pln | *Z. mays* RNA for superoxide dismutase Sod4. |
| 700258174H1 | g495697 | 18 | −3 | gb105eukp | F54E7.2 |
| 700266972H1 | g170205 | 42 | −33 | gb105pln | *N. plumbaginifolia* H+-translocating ATPase mRNA. |
| 700267610H1 | g2668747 | 100 | −95 | gb105pln | *Zea mays* ribosomal protein L17 (rp117) mRNA, complete cds. |
| 700265556H1 | g687244 | 52 | −82 | gb105pln | *Zea mays* oil body protein 16 kDa oleosin (ole16) gene, complete cds. |
| 700261140H1 | g927239 | 9 | 3 | gb105allp | globulin1 |
| 700265539H1 | g602252 | 44 | −32 | gb105pln | *Zea mays* enolase (eno2) mRNA, complete cds. |
| 700256916H1 | g987125 | 4 | 8 | gb105allp | alpha-1 type VII collagen |
| 700267829H1 | g1616611 | 26 | −7 | gb105pln | *N. plumbaginifolia* mRNA for small GTP-binding protein, clone Np3SAR. |
| 700263862H1 | g21729 | 26 | −4 | gb105pln | *T. aestivum* Em gene. |
| 700263233H1 | g168512 | 30 | 13 | gb105pln | Maize major protein (L3) mRNA |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700262103H1 | g20412 | 29 | −11 | gb105pln | from the surface of lipid bodies, 3′ end. *P. amygdalus* mRNA for alpha-tubulin. |
| 700266254H1 | g167112 | 28 | −30 | gb105pln | *Bromus inermis* aldose reductase-related protein, complete cds. |
| 700266004H1 | g1568511 | 48 | 2 | gb105allp | protein phosphatase 2A |
| 700261216H1 | g20000 | 20 | −28 | gb105pln | *N. tabacum* RL2 mRNA for 60S ribosomal protein L2. |
| 700264285H1 | g2245467 | 18 | −0 | gb105eukp | DUG |
| 700267270H1 | g1001746 | 16 | −6 | gb105allp | hypothetical protein |
| 700259514H1 | g1495248 | 24 | 2 | gb105pln | *A. thaliana* mRNA for unknown protein, eRF1-3 gene. |
| 700263857H1 | g22180 | 52 | −24 | gb105pln | Maize gene for beta 1 tubulin. |
| 700265656H1 | g1072122 | 16 | 5 | gb105allp | Bloom's syndrome protein |
| 700263851H1 | g871513 | 11 | 14 | gb105pln | *P. sativum* mRNA for small G protein. |
| 700257323H1 | g520935 | 54 | −29 | gb105pln | *H. vulgare* mRNA for gamma-TIP-like protein. |
| 700267020H1 | g1791307 | 18 | −0 | gb105eukp | AtPER-X; permease homolog |
| 700266726H1 | g19103 | 30 | 12 | gb105pln | *H. vulgare* mRNA for ribosomal protein L17-2. |
| 700263007H1 | g2104445 | 9 | 1 | gb105allp | unknown |
| 700262485H1 | g1296954 | 28 | −7 | gb105pln | *O.sativa* mRNA for novel protein, osr40c1. |
| 700257675H1 | g1066282 | 39 | −10 | gb105pln | *Phaseolus vulgaris* 1L-myo-inositol 1-phosphate synthase mRNA, complete cds. |
| 700261748H1 | g218241 | 20 | 16 | gb105pln | Rice mRNA for ribosomal protein L3 (T82 gene), partial sequence. |
| 700266847H1 | g971279 | 62 | −31 | gb105pln | Rice mRNA for RAB24 protein, complete cds. |
| 700261371H1 | g457688 | 51 | −35 | gb105pln | *M. crystallinum* mRNA for protein kinase. |
| 700265550H1 | g509769 | 17 | 4 | gb105eukp | seed-specific low molecular weight sulfur-rich protein |
| 700264422H1 | g1591027 | 20 | −11 | gb105allp | ferripyochelin binding protein (fbp) |
| 700261348H1 | g286121 | 52 | −16 | gb105pln | Maize mRNA for glutamine synthetase, complete cds. |
| 700258975H1 | g2656029 | 20 | 8 | gb105pln | *Arabidopsis thaliana* genomic DNA, chromosome 5, P1 clone: MQB2. |
| 700262149H1 | g2370232 | 17 | 3 | gb105eukp | putative acyl-CoA oxidase |
| 700266612H1 | g530207 | 62 | −34 | gb105eukp | SB100; heat shock protein |
| 700264808H1 | g790640 | 21 | −6 | gb105pln | *Hordeum vulgare* gamma-thionin (HTH3) mRNA, complete cds. |
| 700267071H1 | g2058313 | 21 | 6 | gb105eukp | CCR1; cinnamoyl-CoA reductase; EC 1.2.1.44 |
| 700263713H1 | g687244 | 55 | −35 | gb105pln | *Zea mays* oil body protein 16 kDa oleosin (ole16) gene, complete cds. |
| 700261920H1 | g21598 | 12 | 15 | gb105pln | *S. tuberosum* mRNA for UDP-glucose pyrophosphorylase. |
| 700263940H1 | g558648 | 19 | 5 | gb105allp | D-myo-inositol-3-phosphate synthase |
| 700258521H1 | g1171351 | 24 | −2 | gb105pln | *Oryza sativa* 16 kDa oleosin (ole16) mRNA, complete cds. |
| 700265872H1 | g2465426 | 12 | 3 | gb105eukp | JRG1.1; 32 kDa protein |
| 700264654H1 | g440590 | 41 | −33 | gb105pln | *S. tuberosum* cy-F1 mRNA for cytosolic fructose-1, 6-biphosphatase. |
| 700258332H1 | g1872162 | 17 | −1 | gb105pln | *Arabidopsis thaliana* DnaJ homolog (atj) mRNA, complete cds. |
| 700265403H1 | g21598 | 32 | −14 | gb105pln | *S. tuberosum* mRNA for UDP-glucose pyrophosphorylase. |
| 700259934H1 | g2345148 | 26 | 8 | gb105eukp | PsDRG1; developmentally regulated GTP binding protein |
| 700264635H1 | g1652858 | 12 | 7 | gb105allp | membrane protein |
| 700267640H1 | g169818 | 49 | −67 | gb105pln | Rice 25S ribosomal RNA gene. |
| 700264301H1 | g313266 | 34 | −15 | gb105pln | *T. aestivum* gene for phosphoglycerate kinase. |
| 700260335H1 | g1724101 | 15 | −3 | gb105pln | *Mesembryanthemum crystallinum* S-adenosyl-L-homocystein hydrolase mRNA, complete cds. |
| 700263685H1 | g22281 | 51 | −35 | gb105pln | *Zea mays* Glb1-0 gene for vicilin-like storage protein (truncated). |
| 700257303H1 | g1778820 | 45 | −15 | gb105pln | *Oryza sativa* S-adenosyl-L-methionine synthetase (pOS-SAMS2) mRNA, complete cds. |

TABLE 1-continued

LIST OF INCYTE CLONES DERIVED FROM SATMON022023
COPYRIGHT 1998 INCYTE PHARMACEUTICALS, INC.

| Clone | GenBank | Len | Score | Library | Description |
|---|---|---|---|---|---|
| 700263652H1 | g927238 | 67 | −45 | gb105pln | Zea mays globulin1 (Glb1) gene, allele Glb1-Hb, complete cds. |
| 700262507H1 | g435679 | 20 | 5 | gb105allp | ribosomal protein S25 |
| 700261318H1 | g790977 | 40 | −19 | gb105pln | B. juncea msams mRNA. |
| 700268179H1 | g2654380 | 37 | −21 | gb105eukp | probable component of a chaperonin complex containing TCP1; TCP1gamma protein |
| 700267282H1 | g1136119 | 37 | −41 | gb105pln | O. sativa mRNA for alpha-tubulin (clone OSTA-111). |
| 700266881H1 | g687244 | 83 | −32 | gb105pln | Zea mays oil body protein 16 kDa oleosin (ole16) gene, complete cds. |
| 700207229H1 | g2656029 | 24 | −21 | gb105pln | Arabidopsis thaliana genomic DNA, chromosome 5, P1 clone: MQB2. |
| 700207210H1 | g804944 | 10 | 7 | gb105eukp | wpk4; wpk4 protein kinase |
| 700264361H1 | g2384757 | 29 | 0 | gb105pln | Oryza sativa GDP dissociation inhibitor protein OsGDI1 (OsGDI1) mRNA, complete cds. |
| 700257765H1 | g927238 | 58 | −48 | gb105pln | Zea mays globulin1 (Glb1) gene, allele Glb1-Hb, complete cds. |
| 700257137H1 | g2262153 | 17 | −2 | gb105eukp | T10P11.19; putative chloroplast outer envelope 86-like protein |
| 700257780H1 | g602605 | 70 | −56 | gb105pln | Zea mays tandem genes for alpha1-tubulin and alpha2-tubulin. |
| 700264624H1 | g2564051 | 29 | −7 | gb105pln | Arabidopsis thaliana genomic DNA, chromosome 5, P1 clone: MWD9, complete sequence. |
| 700260162H1 | g454872 | 18 | 15 | gb105pln | Maize mRNA for group 3 Lea protein MGL3, complete cds. |
| 700267165H1 | g971279 | 47 | −44 | gb105pln | Rice mRNA for RAB24 protein, complete cds. |
| 700258602H1 | g2274983 | 32 | 12 | gb105pln | Hordeum vulgare mRNA for expressed sequence tag. |
| 700260544H2 | g603269 | 14 | −4 | gb105eukp | YER036C; Yer036cp |
| 700266232H1 | g1667268 | 11 | −2 | gb105eukp | C01G10.9 |
| 700264251H1 | g2267592 | 40 | −17 | gb105pln | Oryza sativa glycine-rich RNA-binding protein mRNA, complete cds. |
| 700266423H1 | g1814401 | 30 | −9 | gb105eukp | phosphoglucomutase; EC 5.4.2.2 |
| 700266127H1 | g1350502 | 11 | 2 | gb105allp | vicilin-like storage protein |
| 700264492H1 | g687244 | 68 | −51 | gb105pln | Zea mays oil body protein 16 kDa oleosin (ole16) gene, complete cds. |
| 700258736H1 | g1019903 | 26 | −30 | gb105pln | Arabidopsis thaliana cell division cycle protein (CDC48) mRNA, complete cds. |
| 700260421H1 | g168512 | 28 | −2 | gb105pln | Maize major protein (L3) mRNA from the surface of lipid bodies, 3' end. |
| 700257011H1 | g20266 | 52 | −18 | gb105pln | O. sativa mRNA for lipoxygenase L-2. |
| 700267384H1 | g20203 | 69 | −24 | gb105pln | Rice mRNA for fructose-diphosphate aldolase (EC 4.1.2.13). |
| 700257102H1 | g1532072 | 9 | 14 | gb105pln | Z. mays mRNA for S-adenosylmethionine decarboxylase. |
| 700265830H1 | g644492 | 90 | −16 | gb105pln | Corn elongation factor 1alpha gene, complete cds. |
| 700263504H1 | g454303 | 54 | 3 | gb105allp | LDJ2 gene product |
| 700264041H1 | g2326371 | 19 | −0 | gb105pln | Arabidopsis thaliana ISA1 gene. |
| 700261906H1 | g169820 | 42 | −32 | gb105pln | Oryza sativa triosephosphate isomerase (Rictpi) mRNA, complete cds. |
| 700264771H1 | g1800227 | 5 | 7 | gb105eukp | Bowman-Birk proteinase inhibitor |
| 700256877H1 | g2244747 | 17 | 2 | gb105pln | Arabidopsis thaliana DNA chromosome 4, ESSA I contig fragment No. 0. |
| 700261010H1 | g2282583 | 59 | −17 | gb105pln | Zea mays elongation factor 1-alpha (EF1-A) mRNA, complete cds. |
| 700257211H1 | g1272634 | 19 | 1 | gb105eukp | K07CS.4 |
| 700258510H1 | g1532047 | 16 | 15 | gb105pln | O. sativa mRNA for S-adenosylmethionine decarboxylase. |
| 700258641H1 | g2282583 | 74 | −80 | gb105pln | Zea mays elongation factor 1-alpha (EP1-A) mRNA, complete cds. |
| 700264989H1 | g168423 | 89 | −77 | gb105pln | Zea mays polypeptide chain-binding protein mRNA, 3' end. |
| 700266346H1 | g2618688 | 24 | 7 | gb105eukp | T32G6.5, putative esterase D |
| 700258192H1 | g248338 | 73 | −55 | gb105pln | polyubiquitin [maize, Genomic, 3439 nt]. |
| 700265643H1 | g1384128 | 17 | 2 | gb105pln | Yeast (Saccharomyces cerevisiae) chromosome V cosmids 9781, 8198, 9115, 9981, and lambda clones 3955 and 6052. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700258608H1 | g2642163 | 14 | −5 | gb105eukp | T5I7.11 |
| 700262692H1 | g520935 | 45 | −7 | gb105pln | *H. vulgare* mRNA for gamma-TIP-like protein. |
| 700257039H1 | g2564051 | 38 | −14 | gb105pln | *Arabidopsis thaliana* genomic DNA, chromosome 5, P1 clone: MWD9, complete sequence. |
| 700257175H1 | g687244 | 54 | −16 | gb105pln | *Zea mays* oil body protein 16 kDa oleosin (ole16) gene, complete cds. |
| 700267647H1 | g687244 | 91 | −3 | gb105pln | *Zea mays* oil body protein 16 kDa oleosin (ole16) gene, complete cds. |
| 700259387H1 | g2160172 | 16 | 3 | gb105eukp | F21M12.20 |
| 700265239H1 | g173231 | 21 | −2 | gb105pln | Yeast (*Saccharomyces cerevisiae*) ribosomal 5S RNA-binding protein (YL3) gene, 5' cds. |
| 700256707H1 | g602564 | 30 | −21 | gb105pln | *C. paradisi* (Macf) INO1 gene. |
| 700264027H1 | g17917 | 8 | −12 | gb105eukp | S-receptor kinase related protein |
| 700267640H1 | g2687432 | 56 | −62 | gb105pln | *Plumbago auriculata* large subunit 26S ribosomal RNA gene, partial sequence. |
| 700265968H1 | g1323491 | 13 | 0 | gb105eukp | YTA7 |
| 700262148H1 | g1185389 | 29 | −15 | gb105pln | *Pisum sativum* alphacpn60 precursor mRNA, nuclear gene encoding chloroplast protein, complete cds. |
| 700261351H1 | g506138 | 71 | −49 | gb105pln | *Zea mays* Ec metallothionein class II protein mRNA, complete cds. |
| 700257890H1 | g387908 | 27 | −3 | gb105pln | *Brassica rapa* S-phase-specific (BIS289) mRNA, complete cds. |
| 700264482H1 | g687244 | 67 | −52 | gb105pln | *Zea mays* oil body protein 16 kDa oleosin (ole16) gene, complete cds. |
| 700259576H1 | g717080 | 15 | −23 | gb105pln | *Zea mays* glyceraldehyde-3-phosphate dehydrogenase (GapC4) gene, promoter region. |
| 700264353H1 | g971279 | 56 | −51 | gb105pln | Rice mRNA for RAB24 protein, complete cds. |
| 700259589H1 | g2459442 | 11 | −3 | gb105eukp | F4P9.39; putative DNA-binding protein PD1 |
| 700257634H1 | g16210 | 45 | −8 | gb105pln | *Arabidopsis thaliana* calnexin homolog. |
| 700258331H1 | g1399563 | 22 | −47 | gb105pln | *Hydrastis canadensis* nuclear 26S ribosomal RNA gene, partial sequence. |
| 700267318H1 | g633889 | 18 | 7 | gb105pln | glucose and ribitol dehydrogenase homolog [*Hordeum vulgare* = barley, Aura, embryo, mRNA, 1170 nt]. |
| 700261663H1 | g397841 | 30 | −12 | gb105pln | Rice mRNA for ferredoxin-NADP + reductase, complete cds. |
| 700263455H1 | g1552830 | 12 | −0 | gb105allp | similar to *S. cerevisiae* YLL062c |
| 700258932H1 | g2282583 | 54 | −48 | gb105pln | *Zea mays* elongation factor 1-alpha (EF1-A) mRNA, complete cds. |
| 700266288H1 | g2589163 | 84 | −80 | gb105pln | *Zea mays* mRNA for aldehyde oxidase-2, complete cds. |
| 700264943H1 | g207906 | 8 | 2 | gb105allp | alph globulin A |
| 700258255H1 | g562086 | 5 | 7 | gb105allp | hyaluronidase |
| 700261613H1 | g1906827 | 65 | −62 | gb105pln | *A. thaliana* hsp81.4 gene. |
| 700262936H1 | g493588 | 29 | −32 | gb105pln | *Hordeum vulgare* disulfide isomerase (PDI) mRNA, complete cds. |
| 700263377H1 | g1019999 | 38 | −19 | gb105pln | *Hordeum vulgare* signal recognition particle 54 kDa subunit (Srp54-1) mRNA, complete cds. |
| 700261285H1 | g168512 | 27 | −50 | gb105pln | Maize major protein (L3) mRNA from the surface of lipid bodies, 3' end. |
| 700266578H1 | g746500 | 30 | −4 | gb105eukp | R144.7 |
| 700267622H1 | g20255 | 32 | −25 | gb105pln | *O. sativa* gene for heat shock protein 82 HSP82. |
| 700257883H1 | g21622 | 31 | 0 | gb105pln | *S. vulgare* mRNA for glycine-rich RNA-binding protein (clone S1). |
| 700265486H1 | g170767 | 43 | −49 | gb105pln | Wheat Nor-D3 locus ribosomal RNA gene. |
| 700267176H1 | g22281 | 49 | −40 | gb105pln | *Zea mays* Glb1-0 gene for vicilin-like storage protein (truncated). |
| 700265352H1 | g19280 | 35 | −25 | gb105pln | *L. esculentum* mRNA for enolase. |
| 700260359H2 | g414549 | 27 | −0 | gb105pln | *Arabidopsis thaliana* Columbia cytosolic triose phosphate isomerase (Atctimc) mRNA, complete cds. |
| 700259493H1 | g471320 | 63 | −5 | gb105pln | *H. vulgare* (cv. Bomi) B15C mRNA. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700262632H1 | g2464894 | 21 | 8 | gb105pln | *Arabidopsis thaliana* DNA chromosome 4, ESSA I AP2 contig fragment No. 2. |
| 700262744H1 | g1009709 | 12 | 12 | gb105pln | *Oryza sativa* pyruvate decarboxylase 2 (Pdc2) mRNA, complete cds. |
| 700261104H1 | g2266661 | 37 | −23 | gb105pln | *Hordeum vulgare* mRNA for 14-3-3 protein (Hv1433c). |
| 700262430H1 | g436782 | 52 | −42 | gb105pln | Rice mRNA for cyc07, complete cds. |
| 700266131H1 | g1136741 | 22 | −1 | gb105allp | predicted protein of 548 amino acids |
| 700263358H1 | g21233 | 44 | −37 | gb105pln | *S. oleracea* AHRI mRNA for acetohydroxy acid reductoisomerase. |
| 700262360H1 | g2317728 | 13 | 6 | gb105pln | *Arabidopsis thaliana* reversibly glycosylated polypeptide-1 (AtRGP) mRNA, complete cds. |
| 700257340H1 | g22283 | 61 | −66 | gb105pln | *Zea mays* Glb1-L gene for vicilin-like embryo storage protein. |
| 700256829H1 | g22283 | 37 | −59 | gb105pln | *Zea mays* Glb1-L gene for vicilin-like embryo storage protein. |
| 700207147H1 | g1778820 | 33 | −29 | gb105pln | *Oryza sativa* S-adenosyl-L-methionine synthetase (pOS-SAMS2) mRNA, complete cds. |
| 700259092H1 | g2828151 | 26 | −8 | gb105allp | cyclophilin-33B |
| 700259419H1 | g1389566 | 27 | 6 | gb105eukp | ER; receptor protein kinase |
| 700257642H1 | g728592 | 43 | 3 | gb105allp | aldose reductase |
| 700261611H1 | g2565420 | 42 | −36 | gb105pln | *Onobrychis viciifolia* eukaryotic translation initiation factor eIF-1A mRNA, complete cds. |
| 700264979H1 | g459894 | 78 | −82 | gb105pln | *Zea mays* sus1 gene, complete cds. |
| 700264685H1 | g166888 | 19 | −7 | gb105eukp | TMK1; protein kinase |
| 700266501H1 | g644492 | 74 | −78 | gb105pln | Corn elongation factor 1alpha gene, complete cds. |
| 700266122H1 | g687244 | 35 | −73 | gb105pln | *Zea mays* oil body protein 16 kDa oleosin (ole16) gene, complete cds. |
| 700264260H1 | g1480670 | 13 | −0 | gb105eukp | tomPRO2; delta 1-pyrroline-5-carboxylate synthetase |
| 700267903H1 | g1592681 | 9 | 6 | gb105eukp | LEA D113 homologue type2 |
| 700265775H1 | g168512 | 30 | −50 | gb105pln | Maize major protein (L3) mRNA from the surface of lipid bodies, 3′ end. |
| 700257547H1 | g168480 | 96 | −36 | gb105pln | Maize embryo globulin S allele (7S-like) mRNA, complete cds. |
| 700261238H1 | g587146 | 11 | 5 | gb105allp | nuclear RNA helicase (DEAD family) |
| 700267716H1 | g1256495 | 21 | 2 | gb105eukp | R10H10.1 |
| 700267590H1 | g473976 | 47 | −31 | gb105pln | Rice mRNA, partial homologous to elongation factor 1-alpha gene. |
| 700257376H1 | g535583 | 20 | −11 | gb105pln | *Medicago sativa* adenosylhomocysteinase mRNA, complete cds. |
| 700261374H1 | g22283 | 96 | −63 | gb105pln | *Zea mays* Glb1-L gene for vicilin-like embryo storage protein. |
| 700265252H1 | g2760084 | 16 | −8 | gb105eukp | G8B7T7; leucine-rich repeat protein |
| 700266616H1 | g758339 | 37 | −18 | gb105pln | *S. tuberosum* mRNA for 76 kDa mitochondrial complex I subunit. |
| 700262201H1 | g1658313 | 38 | 6 | gb105allp | osr40g2 |
| 700257837H1 | g1657762 | 22 | 0 | gb105pln | *Zea mays* retrotransposon Huck-2 5′ LTR and primer binding site DNA sequence. |
| 700266977H1 | g1694832 | 33 | −52 | gb105pln | *H. vulgare* Per1 gene. |
| 700266285H1 | g1200160 | 26 | −10 | gb105pln | *T. gesneriana* mRNA for tonoplast intrinsic protein. |
| 700263320H1 | g687244 | 52 | −77 | gb105pln | *Zea mays* oil body protein 16 kDa oleosin (ole16) gene, complete cds. |
| 700266885H1 | g471320 | 63 | −31 | gb105pln | *H. vulgare* (cv. Bomi) B15C mRNA. |
| 700257066H1 | g425805 | 32 | 4 | gb105pln | Rice mRNA for enolase (gene name AD709), partial cds. |
| 700207227H1 | g22270 | 60 | −21 | gb105pln | Maize mRNA from an embryogenic abscisic acid-inducible gene. |
| 700261239H1 | g303856 | 22 | −24 | gb105pln | Rice mRNA for ubiquitin protein fused to a ribosomal protein, complete cds. |
| 700265219H1 | g20680 | 49 | −13 | gb105pln | *P. sativum* mRNA of cDNA clone 26g. |
| 700265564H1 | g1359497 | 28 | −11 | gb105eukp | seryl-tRNA Synthetase |
| 700268122H1 | g2582645 | 25 | −2 | gb105eukp | RSZp22; RSZp22 protein |
| 700261186H1 | g22285 | 44 | −49 | gb105pln | *Zea mays* Glb1-S gene for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700257078H1 | g2735017 | 27 | −13 | gb105eukp | vicilin-like embryo storage protein. KIK1; KI domain interacting kinase 1 |
| 700257634H1 | g1181330 | 87 | −32 | gb105pln | *Z. mays* CNX mRNA. |
| 700265733H1 | g471320 | 36 | 16 | gb105pln | *H. vulgare* (cv. Bomi) B15C mRNA. |
| 700262446H1 | g687244 | 80 | −7 | gb105pln | *Zea mays* oil body protein 16 kDa oleosin (ole16) gene, complete cds. |
| 700263001H1 | g1353352 | 12 | 4 | gb105eukp | catalyzes the transfer of —NH2 from ala to 2-oxoglutarate; alanine aminotransferase; EC 2.6.1.2 |
| 700258804H1 | g602605 | 60 | −87 | gb105pln | *Zea mays* tandem genes for alpha1-tubulin and alpha2-tubulin. |
| 700265528H1 | g687246 | 17 | −8 | gb105pln | *Zea mays* oil body protein 17 kDa oleosin (ole17) gene, complete cds. |
| 700261719H1 | g1184771 | 62 | −24 | gb105pln | *Zea mays* glyceraldehyde-3-phosphate dehydrogenase GAPC2 (gpc2) mRNA, complete cds. |
| 700261216H1 | g798817 | 13 | 4 | gb105pln | *A. thaliana* mRNA for ribosomal protein L2. |
| 700268173H1 | g147142 | 30 | −10 | gb105allp | peptidase N |
| 700263024H1 | g496385 | 18 | 7 | gb105eukp | protein kinase |
| 700259460H1 | g2274990 | 33 | 6 | gb105pln | *Hordeum vulgare* mRNA for expressed sequence tag. |
| 700260263H1 | g1276758 | 13 | 2 | gb105eukp | rpl13; 50S ribosomal protein L13 |
| 700261055H1 | g312602 | 39 | 8 | gb105pln | *P. obtusangulum* 26S rRNA (partial). |
| 700261437H1 | g248338 | 48 | −30 | gb105pln | polyubiquitin [maize, Genomic, 3439 nt]. |
| 700267772H1 | g21796 | 72 | −71 | gb105pln | Wheat histone H3 gene. |
| 700266568H1 | g1171351 | 31 | −21 | gb105pln | *Oryza sativa* 16 kDa oleosin (ole16) mRNA, complete cds. |
| 700265032H1 | g899607 | 76 | −67 | gb105pln | *Zea mays* polyubiquitin (MubC5) mRNA, complete cds. |
| 700258572H1 | g2760015 | 31 | 6 | gb105allp | 60S ribosomal protein L14 |
| 700266158H1 | g2511530 | 77 | −73 | gb105pln | *Eleusine indica* alpha tubulin 1 (TUA1) mRNA, complete cds. |
| 700263771H1 | g1375074 | 65 | −61 | gb105pln | *Oryza sativa* mRNA for glyoxysomal malate dehydrogenase, complete cds. |
| 700261313H1 | g168480 | 55 | −45 | gb105pln | Maize embryo globulin S allele (7S-like) mRNA, complete cds. |
| 700266104H1 | g166769 | 56 | −32 | gb105pln | *A. thaliana* heat shock protein 83 mRNA, complete cds. |
| 700260134H1 | g1906827 | 41 | −50 | gb105pln | *A. thaliana* hsp81.4 gene. |
| 700266087H1 | g22118 | 50 | −82 | gb105pln | *Z. mays* DNA for Adh1-Cm allele. |
| 700264457H1 | g2668741 | 59 | −29 | gb105pln | *Zea mays* glycine-rich RNA binding protein (GRP) mRNA, complete cds. |
| 700263083H1 | g790640 | 26 | −2 | gb105pln | *Hordeum vulgare* gamma-thionin (HTH3) mRNA, complete cds. |
| 700266150H1 | g21493 | 20 | −8 | gb105eukp | mpp; mitochondrial processing peptidase |
| 700258649H1 | g549984 | 19 | −14 | gb105eukp | possible apospory-associated protein |
| 700258153H1 | g1125641 | 16 | 7 | gb105allp | coat protein delta-cop |
| 700258654H1 | g1185553 | 31 | −80 | gb105pln | *Zea mays* glyceraldehyde-3-phosphate dehydrogenase (gpc2) gene, complete cds. |
| 700266993H1 | g2668741 | 50 | −36 | gb105pln | *Zea mays* glycine-rich RNA binding protein (GRP) mRNA, complete cds. |
| 700263179H1 | g22237 | 68 | −59 | gb105pln | Maize mRNA for cytosolic GAPDH (GapC) glyceraldehyde-3-phosphate dehydrogenase. |
| 700262445H1 | g22302 | 49 | −70 | gb105pln | Maize Gpc1 gene for glyceraldehyde-3-phosphate dehydrogenase (GADPH) subunit C. |
| 700267853H1 | g1185553 | 29 | −67 | gb105pln | *Zea mays* glyceraldehyde-3-phosphate dehydrogenase (gpc2) gene, complete cds. |
| 700266276H1 | g168481 | 6 | 6 | gb105eukp | globulin precursor |
| 700257979H1 | g687244 | 35 | −66 | gb105pln | *Zea mays* oil body protein 16 kDa oleosin (ole16) gene, complete cds. |
| 700257947H1 | g559381 | 6 | −1 | gb105allp | P47K protein |
| 700259574H1 | g22283 | 46 | −64 | gb105pln | *Zea mays* Glb1-L gene for vicilin-like embryo storage protein. |
| 700257246H1 | g2832726 | 19 | −2 | gb105eukp | hmgA; homogentisate dioxygenase; EC 1.13.1.1.15 |
| 700263072H1 | g22283 | 77 | −46 | gb105pln | *Zea mays* Glb1-L gene for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700257053H1 | g1513227 | 49 | −3 | gb105pln | vicilin-like embryo storage protein. *Brassica napus* myo-inositol 1-phosphate synthase mRNA, complete cds. |
| 700266275H1 | g2465430 | 9 | −3 | gb105eukp | JRG1.3; 32 kDa protein |
| 700262301H1 | g170785 | 28 | 4 | gb105eukp | UBC1; ubiquitin carrier protein |
| 700265611H1 | g1532047 | 20 | 8 | gb105pln | *O. sativa* mRNA for S-adenosylmethionine decarboxylase. |
| 700257743H1 | g22237 | 34 | −13 | gb105pln | Maize mRNA for cytosolic GAPDH (GapC) glyceraldehyde-3-phosphate dehydrogenase. |
| 700264860H1 | g1171429 | 15 | −3 | gb105eukp | transcription factor; complements a yeast protein kinase C 1 mutant; Method: conceptual translation supplied by author.; CKC |
| 700266894H1 | g2130520 | 20 | 11 | gb105pln | *Pisum sativum* reversibly glycosylatable polypeptide (RGP1) mRNA, complete cds. |
| 700258602H1 | g1532162 | 30 | 14 | gb105pln | *Arabidopsis thaliana* AT.I.24-1, AT.I.24-2, AT.I.24-3, AT.I.24-4, AT.I.24-5, AT.I.24-6, AT.I.24-9 and AT.I.24-14 genes, partial cds, AT.I.24-7, ascorbate peroxidase (ATHAPX1), EF-1alpha-A1, -A2 and -A3 (EP-1alpha) and AT.I.24-13 genes, complete cds. |
| 700258878H1 | g2342735 | 24 | −6 | gb105eukp | T14G11.28 |
| 700264915H1 | g1694832 | 32 | −52 | gb105pln | *H. vulgare* Per1 gene. |
| 700264459H1 | g35770 | 7 | 6 | gb105allp | polypirimidine tract binding protein |
| 700260534H2 | g22237 | 47 | −90 | gb105pln | Maize mRNA for cytosolic GAPDH (GapC) glyceraldehyde-3-phosphate dehydrogenase. |
| 700265352H1 | g780371 | 51 | −50 | gb105pln | *Oryza sativa* enolase mRNA, complete cds. |
| 700264849H1 | g2252823 | 10 | 15 | gb105pln | *Arabidopsis thaliana* BAC IG005I10. |
| 700262560H1 | g2065531 | 23 | −11 | gb105eukp | Cel3; endo-1,4-beta-glucanase; EC 3.2.1.4 |
| 700258037H1 | g2668741 | 44 | −56 | gb105pln | *Zea mays* glycine-rich RNA binding protein (GRP) mRNA, complete cds. |
| 700260908H1 | g2298901 | 18 | 3 | gb105allp | unnamed protein product |
| 700262121H1 | g2443878 | 20 | 3 | gb105eukp | F11P17.4 |
| 700261141H1 | g22287 | 8 | 7 | gb105allp | vicilin-like embryo storage protein |
| 700258037H1 | g2293479 | 35 | −39 | gb105pln | *Oryza sativa* glycine-rich protein mRNA, complete cds |
| 700267475H1 | g41015 | 10 | 5 | gb105allp | aspartate-tRNA ligase |
| 700266975H1 | g2642157 | 16 | 6 | gb105eukp | T517.5; ankyrin-like protein |
| 700263767H1 | g558649 | 16 | 15 | gb105pln | *T. aestivum* VDAC2 mRNA for voltage dependent anion channel. |
| 700260571H2 | g559768 | 11 | 7 | gb105allp | aldose reductase |
| 700262477H1 | g790640 | 19 | 1 | gb105pln | *Hordeum vulgare* gamma-thionin (HTH3) mRNA, complete cds. |
| 700260542H2 | g2650133 | 9 | 4 | gb105allp | ribonuclease PH (rph) |
| 700268037H1 | g1724103 | 50 | −21 | gb105pln | *Mesembryanthemum crystallinum* methionine adenosyltransferase mRNA, complete cds. |
| 700266775H1 | g144206 | 11 | 7 | gb105allp | DNA gyrase A |
| 700261655H1 | g1171351 | 30 | −16 | gb105pln | *Oryza sativa* 16 kDa oleosin (ole16) mRNA, complete cds. |
| 700258626H1 | g963061 | 25 | −8 | gb105pln | *H. vulgare* Ole-1 mRNA for oleosin. |
| 700258843H1 | g687244 | 50 | −81 | gb105pln | *Zea mays* oil body protein 16 kDa oleosin (ole16) gene, complete cds. |
| 700266194H1 | g166571 | 8 | 16 | gb105pln | *Arabidopsis thaliana* phosphoprotein pbosphatase-type 1 catalytic subunit mRNA, complete cds. |
| 700262702H1 | g998429 | 75 | −30 | gb105pln | GRF1 = general regulatory factor [Zea mays, XL80, Genomic, 5348 nt]. |
| 700266757H1 | g758292 | 12 | 8 | gb105eukp | YPT53 |
| 700265580H1 | g293888 | 92 | −85 | gb105pln | *Zea mays*, glyceraldehyde-3-phosphate dehydrogenase mRNA, 3′ end (clone GAPC2). |
| 700262568H1 | g633889 | 33 | −39 | gb105pln | glucose and ribitol dehydrogenase homolog [Hordeum vulgare = barley, Aura, embryo, mRNA, 1170 nt]. |
| 700264355H1 | g168508 | 94 | −22 | gb105pln | Maize oleosin KD18 (KD18; L2) gene, complete cds. |
| 700266004H1 | g683502 | 50 | 2 | gb105allp | protein phosphatase 2A 65 kDa |

TABLE 1-continued

LIST OF INCYTE CLONES DERIVED FROM SATMON022023
COPYRIGHT 1998 INCYTE PHARMACEUTICALS, INC.

| Clone | GI | | | Library | Description |
|---|---|---|---|---|---|
| | | | | | regulatory subunit |
| 700261563H1 | g168406 | 29 | −21 | gb105pln | *Z. mays* alcohol dehydrogenase (ADH-1 C-m allele) gene, complete cds. |
| 700265689H1 | g22283 | 52 | 0 | gb105pln | *Zea mays* Glb1-L gene for vicilin-like embryo storage protein. |
| 700258967H1 | g557781 | 19 | −2 | gb105eukp | tcp1beta |
| 700258767H1 | g1622938 | 33 | −14 | gb105pln | *Bromus secalinus* oleosin (ole16) mRNA, complete cds. |
| 700263893H1 | g2345153 | 100 | −76 | gb105pln | *Zea mays* ribsomal protein S4 (rps4) mRNA, complete cds. |
| 700260151H1 | g303852 | 56 | −23 | gb105pln | Rice mRNA for ribosomal protein L3, complete cds. |
| 700261522H1 | g1388076 | 6 | 8 | gb105allp | thioredoxin h |
| 700262461H1 | g1524115 | 32 | −4 | gb105eukp | PR-P69; subtilisin-like endoprotease |
| 700266281H1 | g1514638 | 15 | −7 | gb105pln | *S. oleracea* mRNA for alpha-glucan phosphorylase. |
| 700257232H1 | g1842140 | 6 | 5 | gb105eukp | similar to EMBL Accession Number Y08687: *saccharomyces cerevisiae* ORM1 |
| 700261332H1 | g248338 | 85 | −3 | gb105pln | polyubiquitin [maize, Genomic, 3439 nt]. |
| 700262068H1 | g1171351 | 26 | −11 | gb105pln | *Oryza sativa* 16 kDa oleosin (ole16) mRNA, complete cds. |
| 700265117H1 | g1553130 | 50 | −38 | gb105pln | *Gossypium hirsutum* ribosomal protein L44 isoform b (RL44), complete cds. |
| 700262703H1 | g1498385 | 59 | −75 | gb105pln | *Zea mays* actin (Maz87) gene, partial cds. |
| 700262090H1 | g1143863 | 13 | 16 | gb105pln | *Oryza sativa* beta-glucosidase mRNA, nuclear gene encoding chloroplast protein, complete cds. |
| 700260191H1 | g1931637 | 23 | −9 | gb105eukp | T19D16.1; receptor-associated kinase isolog |
| 700267320H1 | g2114206 | 29 | −4 | gb105pln | Rice DNA for glutaredoxin, complete cds. |
| 700267434H1 | g22287 | 7 | 8 | gb105allp | vicilin-like embryo storage protein |
| 700263425H1 | g2282583 | 37 | −21 | gb105pln | *Zea mays* elongation factor 1-alpha (EF1-A) mRNA, complete cds. |
| 700268150H1 | g425802 | 72 | −28 | gb105pln | Rice mRNA for heat shock protein 70 (gene name AD622), partial cds. |
| 700256929H1 | g559921 | 6 | 7 | gb105allp | axi 1 gene product |
| 700266631H1 | g2565304 | 47 | −38 | gb105pln | Hordeum sp. x Triticum sp. glycine decarboxylase P subunit mRNA, complete cds. |
| 700259493H1 | g971279 | 59 | −3 | gb105pln | Rice mRNA for RAB24 protein, complete cds. |
| 700262588H1 | g396209 | 58 | −52 | gb105pln | *S.polyrrhiza* mRNA for D-myo-inositol-3-phosphate synthase. |
| 700259567H1 | g520935 | 37 | −24 | gb105pln | *H. vulgare* mRNA for gamma-TIP-like protein. |
| 700257658H1 | g2465430 | 8 | 1 | gb105allp | 32 kDa protein |
| 700259679H1 | g758352 | 38 | −39 | gb105pln | *Z. mays* mRNA for cysteine synthase. |
| 700263021H1 | g2829918 | 18 | 2 | gb105allp | similar to "tub" protein gp\|U82468\|2072162 |
| 700266224H1 | g1747293 | 16 | −3 | gb105pln | Rice mRNA for vacuolar H+-pyrophosphatase, complete cds. |
| 700257782H1 | g415316 | 37 | −8 | gb105pln | Rice mRNA for acidic ribosomal protein P0, complete cds. |
| 700262129H1 | g1532047 | 32 | −30 | gb105pln | *O. sativa* mRNA for S-adenosylmethionine decarboxylase. |
| 700266275H1 | g2465426 | 9 | −3 | gb105eukp | JRG1.1; 32 kDa protein |
| 700259570H1 | g450484 | 50 | −56 | gb105pln | Rice mRNA for soluble starch synthase, complete cds. |
| 700264713H1 | g1350541 | 10 | 7 | gb105eukp | EMB6; late embryogenesis abundant protein |
| 700207126H1 | g170772 | 22 | 4 | gb105pln | *Triticum aestivum* S-adenosyl-L-homocysteine hydrolase (SH6.2) mRNA, complete cds. |
| 700260111H1 | g18963 | 76 | −40 | gb105pln | *Z. mays* mRNA for dehydrin (dhn3) |
| 700267250H1 | g1129083 | 16 | −9 | gb105pln | Wheat mRNA for protein H2A, complete cds, clone wcH2A-2. |
| 700261956H1 | g168722 | 85 | −37 | gb105pln | *Z. mays* protein phosphatase-1 (ZmPP1) mRNA, complete cds. |
| 700257392H1 | g168608 | 40 | −39 | gb105pln | Maize 17S ribosomal RNA gene |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | and flanks. |
| 700258579H1 | g790507 | 47 | −5 | gb105pln | Z. mays mRNA for 60S acidic ribosomal protein. |
| 700266726H1 | g2668747 | 29 | 6 | gb105pln | Zea mays ribosomal protein L17 (rp117) mRNA, complete cds. |
| 700266886H1 | g21796 | 60 | −25 | gb105pln | Wheat histone H3 gene. |
| 700258770H1 | g1197586 | 60 | −50 | gb105pln | Oryza sativa potassium channel beta subunit protein (KOB1) mRNA, complete cds. |
| 700260571H2 | g1184820 | 12 | 7 | gb105allp | aldose reductase |
| 700258261H1 | g1066282 | 46 | −38 | gb105pln | Phaseolus vulgaris 1L-myo-inositol 1-phosphate synthase mRNA, complete cds. |
| 700259819H1 | g22292 | 69 | −4 | gb105pln | Z. mays mRNA for glycine-rich protein. |
| 700259549H1 | g20834 | 48 | −48 | gb105pln | P. sativum PHSP1 mRNA for HSP70. |
| 700264428H1 | g927239 | 6 | 7 | gb105allp | globulin1 |
| 700265262H1 | g1747295 | 37 | −52 | gb105pln | Rice mRNA for vacuolar H+-pyrophosphatase, complete cds. |
| 700262143H1 | g22312 | 58 | −77 | gb105pln | Maize ABA-inducible gene for glycine-rich protein (ABA = abscisic acid) |
| 700264214H1 | g406310 | 19 | 1 | gb105pln | B. napus (Topas) clpA mRNA. |
| 700265365H1 | g16334 | 20 | −11 | gb105eukp | Athb-3 |
| 700259052H1 | g21233 | 17 | −6 | gb105pln | S. oleracea AHRI mRNA for acetohydroxy acid reductoisomerase. |
| 700267356H1 | g1658314 | 51 | −49 | gb105pln | O. sativa osr40g3 gene. |
| 700207234H1 | g687244 | 86 | −12 | gb105pln | Zea mays oil body protein 16 kDa oleosin (ole16) gene, complete cds. |
| 700266885H1 | g971279 | 62 | −31 | gb105pln | Rice mRNA for RAB24 protein, complete cds. |
| 700266415H1 | g2160158 | 41 | −18 | gb105eukp | F21M12.3 |
| 700266994H1 | g1532072 | 36 | −5 | gb105pln | Z. mays mRNA for s-adenosylmethionine decarboxylase. |
| 700265006H1 | g168512 | 29 | −13 | gb105pln | Maize major protein (L3) mRNA from the surface of lipid bodies, 3' end. |
| 700263386H1 | g1841501 | 63 | −42 | gb105pln | Z. mays mRNA for glutathione-dependent formaldehyde dehydrogenase. |
| 700263065H1 | g2459417 | 52 | −14 | gb105eukp | F4P9.11; putative pre-mRNA splicing factor PRP19 |
| 700257875H1 | g603870 | 33 | −8 | gb105pln | P. hybrida mRNA for MAP/ERK kinase 1. |
| 700265461H1 | g1397292 | 14 | 0 | gb105eukp | dif-1; C. elegans DIF-1 protein (PIR:S55056) |
| 700263439H1 | g2564050 | 13 | 1 | gb105pln | Arabidopsis thaliana genomic DNA, chromosome 5, P1 clone: MuA22, complete sequence. |
| 700259748H1 | g496268 | 60 | −3 | gb105eukp | Ran-A1; GTP-binding protein |
| 700266439H1 | g2565339 | 44 | −42 | gb105pln | Lupinus luteus ribosomal protein S14 (rps14) mRNA, complete cds. |
| 700261626H1 | g927239 | 7 | 6 | gb105allp | globulin1 |
| 700267980H1 | g3972 | 15 | −3 | gb105eukp | mitochondrial release factor 1 |
| 700265733H1 | g971279 | 36 | 16 | gb105pln | Rice mRNA for RAB24 protein, complete cds. |
| 700264524H1 | g2276197 | 12 | −1 | gb105eukp | T04A11.2 |
| 700267717H1 | g963028 | 10 | −2 | gb105eukp | OST48; oligosaccharyltransferase 48 kDa subunit |
| 700260677H1 | g2661071 | 21 | 2 | gb105allp | similar to 26S proteasome subunit p45 |
| 700261133H1 | g2780192 | 12 | 6 | gb105allp | unnamed protein product |
| 700263902H1 | g168512 | 24 | 5 | gb105pln | Maize major protein (L3) mRNA from the surface of lipid bodies, 3' end. |
| 700264546H1 | g431162 | 17 | −7 | gb105eukp | LIM16; ORF |
| 700258520H1 | g671655 | 35 | −29 | gb105pln | S.vulgare gene for gamma-kafirin. |
| 700256918H1 | g1842114 | 44 | −38 | gb105pln | Nicotiana plumbaginifolia non-phosphorylating glyceraldehyde dehydrogenase (GapN) mRNA, complete cds. |
| 700267002H1 | g170224 | 20 | 1 | gb105pln | Nicotiana tabacum 3-deoxy-D-arabino-heptulosonate 7-phosphate synthase, complete cds. |
| 700264455H1 | g22281 | 37 | −27 | gb105pln | Zea mays Glb1-0 gene for vicilin-like storage protein (truncated). |
| 700263389H1 | g1220177 | 13 | 13 | gb105pln | T. ledebourii mRNA for pG31-like dormancy related protein. |
| 700207224H1 | g736271 | 32 | −13 | gb105pln | O. sativa hsp70 gene for heat shock protein 70. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700258689H1 | g168423 | 74 | −80 | gb105pln | *Zea mays* polypeptide chain-binding protein mRNA, 3' end. |
| 700266338H1 | g2244991 | 12 | 17 | gb105pln | *Arabidopsis thaliana* DNA chromosome 4, ESSA I contig fragment No. 6. |
| 700264112H1 | g1100216 | 62 | −9 | gb105pln | *Zea mays* sucrose synthase (SUS1) gene, exons 1–2. |
| 700259358H1 | g1658314 | 32 | −3 | gb105pln | *O. sativa* osr40g3 gene. |
| 700260472H1 | g603359 | 12 | 6 | gb105allp | Scs2p |
| 700265916H1 | g2245136 | 45 | −27 | gb105eukp | trehalose-6-phosphate synthase homolog |
| 700266690H1 | g1513227 | 50 | −45 | gb105pln | *Brassica napus* myo-inositol 1-phosphate synthase mRNA, complete cds. |
| 700264931H1 | g2668737 | 63 | −80 | gb105pln | *Zea mays* translation initiation factor 5A (TIFSA) mRNA, complete cds. |
| 700263049H1 | g19101 | 41 | −18 | gb105pln | *H. vulgare* mRNA for ribosomal protein L17-1. |
| 700260796H1 | g22237 | 98 | −18 | gb105pln | Maize TnRNA for cytosolic GAPDH (GapC) glyceraldehyde-3-phosphate dehydrogenase. |
| 700263866H1 | g2443328 | 11 | 7 | gb105pln | *Arabidopsis thaliana* mRNA for Mei2-like protein, complete cds. |
| 700258324H1 | g166857 | 59 | −52 | gb105pln | *Arabidopsis thaliana* cytoplasmic ribosomal protein mRNA, complete cds. |
| 700261513H1 | g168512 | 25 | −3 | gb105pln | Maize major protein (L3) mRNA from the surface of lipid bodies, 3' end. |
| 700265560H1 | g293888 | 77 | −72 | gb105pln | *Zea mays*, glyceraldehyde-3-phosphate dehydrogenase mRNA, 3' end (clone GAPC2) |
| 700264165H1 | g2384759 | 44 | −5 | gb105pln | *Oryza sativa* GDP dissociation inhibitor protein OsGDI2 (OsGDI2) mRNA, complete cds. |
| 700262314H1 | g300263 | 46 | −43 | gb105pln | HSP68 = 68 kda heat-stress DnaK homolog [*Solanum tuberosum* = potatoes, mRNA, 2418 nt]. |
| 700267944H1 | g168481 | 7 | 8 | gb105allp | globulin precursor |
| 700264142H1 | g973312 | 37 | −9 | gb105pln | *Arabidopsis thaliana* myo-inositol 1-phosphate synthase isozyme-2 mRNA, complete cds. |
| 700263545H1 | g22302 | 58 | 5 | gb105pln | Maize Gpc1 gene for glyceraldehyde-3-phosphate dehydrogenase (GADPH) subunit C. |
| 700263144H1 | g1519250 | 30 | 10 | gb105pln | *Oryza sativa* GF14-c protein mRNA, complete cds. |
| 700259239H1 | g22281 | 62 | −76 | gb105pln | *Zea mays* Glb1-0 gene for vicilin-like storage protein (truncated). |
| 700260620H1 | g633889 | 14 | 11 | gb105pln | glucose and ribitol dehydrogenase homolog [*Hordeum vulgare* = barley, Aura, embryo, mRNA, 1170 nt]. |
| 700263509H1 | g602605 | 60 | −30 | gb105pln | *Zea mays* tandem genes for alpha1-tubulin and alpha2-tubulin. |
| 700267128H1 | g2267592 | 30 | −18 | gb105pln | *Oryza sativa* glycine-rich RNA-binding protein mRNA, complete cds. |
| 700264943H1 | g167371 | 8 | 2 | gb105eukp | vicilin precursor |
| 700258182H1 | g687244 | 86 | −29 | gb105pln | *Zea mays* oil body protein 16 kDa oleosin (ole16) gene, complete cds. |
| 700260112H1 | g21624 | 18 | 1 | gb105pln | *S. vulgare* mRNA for glycine-rich RNA-binding protein (clone S2). |
| 700256890H1 | g1575129 | 67 | −69 | gb105pln | *Zea mays* lumenal binding protein cBiPe3 mRNA, complete cds. |
| 700267592H1 | g1546918 | 41 | −68 | gb105pln | *Z. mays* mRNA for translation initiation factor 5A. |
| 700266691H1 | g633890 | 20 | 4 | gb105allp | glucose and ribitol dehydrogenase homolog [barley, *Hordeum vulgare*, Peptide, 293 aa]. |
| 700261172H1 | g312178 | 14 | −0 | gb105pln | *Z. mays* GapC2 gene. |
| 700265832H1 | g1777312 | 39 | −0 | gb105eukp | ATPK10; novel serine/threonine protein kinase |
| 700265275H1 | g22375 | 32 | −19 | gb105eukp | ORF |
| 700257714H1 | g520935 | 23 | 13 | gb105pln | *H. vulgare* mRNA for gamma-TIP-like protein. |
| 700268189H1 | g606816 | 58 | −46 | gb105pln | *Oryza sativa* chloroplast carbonic anhydrase mRNA, complete cds. |
| 700259156H2 | g968901 | 52 | −62 | gb105pln | Rice mRNA for ribosomal protein S8, complete cds. |
| 700265472H1 | g454913 | 29 | 2 | gb105pln | *A. porrum* LDJ2 mRNA. |
| 700266460H1 | g687246 | 35 | −26 | gb105pln | *Zea mays* oil body protein 17 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | kDa oleosin (ole17) gene, complete cds. |
| 700266676H1 | g1694832 | 32 | −45 | gb105pln | *H. vulgare* Per1 gene. |
| 700264453H1 | g2821955 | 33 | −11 | gb105eukp | spermidine synthase 1; EC 2.5.1.16 |
| 700258680H1 | g1930076 | 39 | −26 | gb105pln | *Carcinia mangsotana* acyl-ACP thioesterase (FatA1) mRNA, nuclear gene encoding chloroplast protein, complete cds. |
| 700257658H1 | g2465426 | 8 | 1 | gb105eukp | JRG1.1; 32 kDa protein |
| 700265514H1 | g2662342 | 65 | −54 | gb105pln | *Oryza sativa* mRNA for EF-1 alpha, complete cds. |
| 700267739H1 | g2345153 | 96 | −88 | gb105pln | *Zea mays* ribsomal protein S4 (rps4) mRNA, complete cds. |
| 700263591H1 | g1184771 | 98 | −85 | gb105pln | *Zea mays* glyceraldehyde-3-phosphate dehydrogenase GAPC2 (gpc2) mRNA, complete cds. |
| 700266095H1 | g18890 | 30 | −10 | gb105pln | *H. vulgare* gene for aldose reductase-related protein. |
| 700265456H1 | g22292 | 71 | −66 | gb105pln | *Z. mays* mRNA for glycine-rich protein |
| 700258215H1 | g1296954 | 81 | −73 | gb105pln | *O. sativa* mRNA for novel protein, osr40c1. |
| 700262260H1 | g1669659 | 26 | −24 | gb105pln | *C. annuum* mRNA for CDC48p-like protein. |
| 700264667H1 | g1542941 | 19 | 2 | gb105eukp | AACT; Acetoacetyl-coenzyme A thiolase; EC 2.3.1.9 |
| 700267323H1 | g168442 | 60 | −29 | gb105pln | *Zea mays* chitinase B (seed chitinase) gene, 3'end. |
| 700265827H1 | g1658314 | 51 | 1 | gb105pln | *O. sativa* osr40g3 gene. |
| 700263148H1 | g1695697 | 57 | −6 | gb105pln | Rice mRNA for C-type cyclin, complete cds. |
| 700256996H1 | g644492 | 34 | 15 | gb105pln | Corn elongation factor 1alpha gene, complete cds. |
| 700264978H1 | g687244 | 71 | 2 | gb105pln | *Zea mays* oil body protein 16 kDa oleosin (ole16) gene, complete cds. |
| 700262589H1 | g902583 | 63 | −73 | gb105pln | *Zea mays* clone MubG1 ubiquitin gene, complete cds. |
| 700257122H1 | g1236258 | 17 | −5 | gb105eukp | peptidyl-prolyl cis-trans isomerase |
| 700260387H2 | g687244 | 47 | −18 | gb105pln | *Zea mays* oil body protein 16 kDa oleosin (ole16) gene, complete cds. |
| 700260775H1 | g168480 | 58 | −34 | gb105pln | Maize embryo globulin S allele (7S-like) mRNA, complete cds. |
| 700262449H1 | g520935 | 57 | −30 | gb105pln | *H. vulgare* mRNA for gamma-TIP-like protein. |
| 700266876H1 | g2832620 | 20 | −0 | gb105eukp | F13C5.90; hypothetical protein |
| 700259101H2 | g2330773 | 15 | 5 | gb105eukp | SPAC23C11.09; alanyl-trna synthetase |
| 700265530H1 | g1166504 | 11 | 2 | gb105allp | HEL64 |
| 700258421H1 | g168419 | 87 | −70 | gb105pln | Maize (*Z. mays*) aldolase mRNA, complete cds. |
| 700262981H1 | g780371 | 27 | −4 | gb105pln | *Oryza sativa* enolase mRNA, complete cds. |
| 700265624H1 | g252483 | 7 | 6 | gb105allp | H beta 58 = essential for embryogenesis [mice, embryo, Peptide Mutant, 327 aa]. |
| 700261315H1 | g1136119 | 48 | −44 | gb105pln | *O. sativa* mRNA for alpha-tubulin (clone OSTA-111). |
| 700261238H1 | g971677 | 11 | 4 | gb105allp | expressed sequence tag |
| 700264370H1 | g2384677 | 32 | −12 | gb105eukp | AtKTS; putative potassium transporter AtKT5p |
| 700260266H1 | g168512 | 30 | −2 | gb105pln | Maize major protein (L3) mRNA from the surface of lipid bodies, 3' end. |
| 700262112H1 | g17931 | 19 | −40 | gb105pln | *B. secalinas* embryo-specific mRNA. |
| 700263732H1 | g435456 | 38 | −36 | gb105pln | Proso millet gene for aspartate aminotransferase, complete cds. |
| 700264883H1 | g687244 | 59 | −70 | gb105pln | *Zea mays* oil body protein 16 kDa oleosin (ole16) gene, complete cds. |
| 700257493H1 | g687246 | 35 | −37 | gb105pln | *Zea mays* oil body protein 17 kDa oleosin (ole17) gene, complete cds. |
| 700264178H1 | g927238 | 57 | −20 | gb105pln | *Zea mays* globulin1 (Glb1) gene, allele Glb1-Hb, complete cds. |
| 700263940H1 | g975888 | 18 | 4 | gb105allp | myo-inositol-1-phosphate synthase |
| 700265117H1 | g218112 | 67 | −56 | gb105pln | Rice mRNA for ribosomal protein L41 (340 gene), partial sequence. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700262654H1 | g20598 | 66 | −61 | gb105pln | *P. miliaceum* mRNA for aspartate aminotransferase (pcAAT2). |
| 700256937H1 | g2662346 | 64 | −60 | gb105pln | *Oryza sativa* mRNA for EF-1 alpha, complete cds. |
| 700259071H1 | g2330773 | 8 | 7 | gb105eukp | SPAC23C11.09; alanyl-trna synthetase |
| 700266393H1 | g606430 | 8 | 7 | gb105eukp | unknown |
| 700268037H1 | g2305013 | 56 | −19 | gb105pln | *Musa acuminata* S-adenosyl-L-methionine synthetase homolog mRNA, complete cds. |
| 700266105H1 | g1200160 | 30 | −20 | gb105pln | *T. gesneriana* mRNA for tonoplast intrinsic protein. |
| 700267493H1 | g168508 | 45 | −9 | gb105pln | Maize oleosin KD18 (KD18; L2) gene, complete cds. |
| 700261393H1 | g22281 | 38 | −54 | gb105pln | *Zea mays* Glb1-0 gene for vicilin-like storage protein (truncated). |
| 700256951H1 | g1724101 | 35 | 4 | gb105pln | *Mesembryanthemum crystallinum* S-adenosyl-L-homocystein hydrolase mRNA, complete cds. |
| 700266570H1 | g506138 | 63 | −58 | gb105pln | *Zea mays* Ec metallothionein class II protein mRNA, complete cds. |
| 700257219H1 | g168480 | 38 | 9 | gb105pln | Maize embryo globulin S allele (7S-like) mRNA, complete cds. |
| 700267953H1 | g687244 | 78 | −40 | gb105pln | *Zea mays* oil body protein 16 kDa oleosin (ole16) gene, complete cds. |
| 700265514H1 | g473976 | 63 | −55 | gb105pln | Rice mRNA, partial homologous to elongation factor 1-alpha gene. |
| 700264507H1 | g687244 | 38 | −66 | gb105pln | *Zea mays* oil body protein 16 kDa oleosin (ole16) gene, complete cds. |
| 700257054H1 | g755784 | 27 | 5 | gb105allp | unknown |
| 700263725H1 | g1212995 | 36 | −24 | gb105pln | *H. vulgare* mRNA for UDP-glucose pyrophosphorylase. |
| 700258664H1 | g1143864 | 19 | −9 | gb105eukp | catalyzes the release of either giberellin or cyanogenic substances from their glucoconjugates; beta glucosidase; EC 3.2.1.21 |
| 700256718H1 | g20255 | 22 | −15 | gb105pln | *O. sativa* gene for heat shock protein 82 HSP82. |
| 700266183H1 | g1469218 | 26 | −12 | gb105pln | *B. oleracea* mRNA (unknown). |
| 700267916H1 | g2662342 | 62 | −51 | gb105pln | *Oryza sativa* mRNA for EF-1 alpha, complete cds. |
| 700262877H1 | g1200160 | 24 | 9 | gb105pln | *T. gesneriana* mRNA for tonoplast intrinsic protein. |
| 700265473H1 | g2738247 | 39 | −37 | gb105pln | *Arabidopsis thaliana* cobalamin-independent methionine synthase (ATCIMS) mRNA, complete cds. |
| 700263818H1 | g2529670 | 26 | 3 | gb105eukp | T30B22.13; ribosomal protein L18-like |
| 700263137H1 | g1498052 | 72 | −9 | gb105pln | *Zea mays* ribosomal protein S8 mRNA, complete cds. |
| 700257503H1 | g12SS711 | 35 | 1 | gb105allp | small nuclear ribonucleoprotein |
| 700258143H1 | g460041 | 21 | −3 | gb105pln | Yeast (*Saccharomyces cerevisiae*) DBE3 gene, complete cds. |
| 700258011H1 | g22138 | 70 | −79 | gb105pln | *Z. mays* gene for acetohydroxyacid synthase (AHAS108). |
| 700261853H1 | g436030 | 47 | 3 | gb105allp | 60S ribosomal protein L34 |
| 700267643H1 | g2738886 | 10 | 14 | gb105pln | *Agrostis stolonifera* var. *palustris* low molecular weight heat shock protein mRNA, complete cds. |
| 700267714H1 | g1845 | 9 | 6 | gb105allp | aminoacylase I |
| 700259658H1 | g1212995 | 25 | −20 | gb105pln | *H. vulgare* mRNA for UDP-glucose pyrophosphorylase. |
| 700260007H1 | g687244 | 42 | −31 | gb105pln | *Zea mays* oil body protein 16 kDa oleosin (ole16) gene, complete cds. |
| 700264748H1 | g1125690 | 24 | −4 | gb105pln | *S. tuberosum* mRNA for DnaJ protein. |
| 700263358H1 | g416251 | 65 | −62 | gb105pln | Rice mRNA for acetohydroxy acid reductoisomerase, partial sequence. |
| 700259631H1 | g22272 | 49 | −65 | gb105pln | Maize mRNA for enolase (2-phospho-D-glycerate hydrolase). |
| 700266734H1 | g450548 | 38 | 8 | gb105pln | *O. sativa* (pRSAM-1) gene for S-adenosyl methionine synthetase. |
| 700207242H1 | g2673870 | 22 | 3 | gb105allp | *fimbriata*-associated protein |
| 700262961H1 | g303852 | 50 | −20 | gb105pln | Rice mRNA for ribosomal protein L3, complete cds. |
| 700265520H1 | g2992 | 31 | −9 | gb105pln | *Neurospora crassa* crp-1 mRNA for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | ribosomal protein homologous to Yeast cyH2 gene encoding L29. |
| 700262266H1 | g633890 | 15 | 5 | gb105allp | glucose and ribitol dehydrogenase homolog [barley, *Hordeum vulgare*, Peptide, 293 aa]. |
| 700263762H1 | g2821955 | 36 | −6 | gb105eukp | spermidine synthase 1; EC 2.5.1.16 |
| 700261173H1 | g22461 | 57 | −64 | gb105pln | Maize RAB-17 gene. |
| 700262261H1 | g2662313 | 61 | −64 | gb105pln | *Hordeum vulgare* mRNA for bpw3, complete cds. |
| 700257813H1 | g396209 | 44 | −17 | gb105pln | *S. polyrrhiza* mRNA for D-myo-inositol-3-phosphate synthase. |
| 700265586H1 | g1125690 | 35 | −22 | gb105pln | *S. tuberosum* mRNA for DnaJ protein. |
| 700258646H1 | g22283 | 63 | −75 | gb105pln | *Zea mays* Glb1-L gene for vicilin-like embryo storage protein. |
| 700266744H1 | g22285 | 49 | −68 | gb105pln | *Zea mays* Glb1-S gene for vicilin-like embryo storage protein. |
| 700260639H1 | g1658312 | 42 | −36 | gb105pln | *O. sativa* osr40g2 gene. |
| 700266105H1 | g520935 | 49 | −43 | gb105pln | *H. vulgare* mRNA for gamma-TIP-like protein. |
| 700263437H1 | g1335965 | 89 | −35 | gb105pln | *Zea mays* acetyl CoA carboxylase mRNA, partial cds. |
| 700258267H1 | g18260 | 30 | −1 | gb105eukp | cs DnaJ-1 |
| 700261141H1 | g469067 | 5 | 7 | gb105allp | NMDA receptor subunit NR2D |
| 700267483H1 | g559395 | 60 | −30 | gb105eukp | dihydrolipoamide acetyltransferase (E2) subunit of PDC |
| 700267733H1 | g2160155 | 11 | 16 | gb105pln | Sequence of BAC F21M12 from *Arabidopsis thaliana* chromosome 1, complete sequence. |
| 700267622H1 | g1906827 | 21 | −23 | gb105pln | *A. thaliana* hsp81.4 gene. |
| 700261178H1 | g2276367 | 22 | −4 | gb105eukp | SPBC30D10.18c; 60s ribosomal protein |
| 700261332H1 | g902583 | 36 | 16 | gb105pln | *Zea mays* clone MubG1 ubiquitin gene, complete cds. |
| 700267867H1 | g295925 | 17 | −9 | gb105eukp | RPG19; ribosomal protein |
| 700267170H1 | g471342 | 48 | −41 | gb105pln | *S. tuberosum* mRNA for ATP-sulfurylase. |
| 700257309H1 | g1185553 | 31 | −76 | gb105pln | *Zea mays* glyceraldehyde-3-phosphate dehydrogenase (gpc2) gene, complete cds. |
| 700265914H1 | g960356 | 62 | −57 | gb105pln | Barley mRNA for S-adenosylmethionine synthetase, complete cds. |
| 700263612H1 | g1208445 | 32 | 4 | gb105pln | Rice (YK426) mRNA, complete cds. |
| 700266892H1 | g415316 | 36 | −9 | gb105pln | Rice mRNA for acidic ribosomal protein P0, complete cds. |
| 700266264H1 | g1171353 | 28 | −10 | gb105pln | *Oryza sativa* 18 kDa oleosin mRNA, complete cds. |
| 700258389H1 | g2282583 | 73 | −69 | gb105pln | *Zea mays* elongation factor 1-alpha (EF1-A) mRNA, complete cds. |
| 700265766H1 | g805003 | 48 | −52 | gb105pln | *O. sativa* SG12 gene. |
| 700264548H1 | g1890154 | 25 | −14 | gb105eukp | alpha-mannosidase precursor |
| 700261729H1 | g927238 | 33 | 16 | gb105pln | *Zea mays* globulin1 (Glb1) gene, allele Glb1-Hb, complete cds. |
| 700263207H1 | g1694832 | 45 | −26 | gb105pln | *H. vulgare* Per1 gene. |
| 700261063H1 | g313026 | 41 | −31 | gb105pln | *L. esculentum* rpl38 mRNA for ribosomal protein L38. |
| 700259302H1 | g168406 | 37 | −77 | gb105pln | *Z. mays* alcohol dehydrogenase (ADH-1 C-m allele) gene, complete cds. |
| 700207140H1 | g1550813 | 51 | −55 | gb105pln | *Z. mays* mRNA for acidic ribosomal protein P0. |
| 700266547H1 | g471320 | 63 | −55 | gb105pln | *H. vulgare (cv. Bomi) B15C* mRNA. |
| 700263080H1 | g687244 | 65 | −53 | gb105pln | *Zea mays* oil body protein 16 kDa oleosin (ole16) gene, complete cds. |
| 700262884H1 | g1061297 | 25 | 7 | gb105eukp | SPAC24B11.09; unknown |
| 700262702H1 | g168602 | 63 | −17 | gb105pln | *Zea mays* regulatory protein GF14-12 mRNA, complete cds. |
| 700258891H1 | g687244 | 41 | −65 | gb105pln | *Zea mays* oil body protein 16 kDa oleosin (ole16) gene, complete cds. |
| 700260518H2 | g168512 | 37 | −37 | gb105pln | Maize major protein (L3) mRNA from the surface of lipid bodies, 3′ end. |
| 700265492H1 | g1532072 | 41 | −66 | gb105pln | *Z. mays* mRNA for S-adenosylmethionine decarboxylase. |
| 700257357H1 | g454303 | 12 | 0 | gb105eukp | LDJ2 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700257428H2 | g1216231 | 16 | 3 | gb105eukp | SES1; seryl-tRNA synthetase |
| 700257751H1 | g536615 | 13 | −7 | gb105eukp | PCS60 |
| 700262728H1 | g1706955 | 37 | −29 | gb105pln | *Gossypium hirsutum* cellulose synthase (celA1) mRNA, complete cds. |
| 700265134H1 | g790640 | 20 | 4 | gb105pln | *Hordeum vulgare* gamma-thionin (HTH3) mRNA, complete cds. |
| 700267272H1 | g1001556 | 26 | −10 | gb105allp | hypothetical protein |
| 700265360H1 | g927239 | 11 | −1 | gb105eukp | Glb1; globulin1 |
| 700259549H1 | g2654209 | 44 | −44 | gb105pln | *Spinacia oleracea* heat shock 70 protein (HSC70-10) mRNA, nuclear gene encoding mitochondrial protein, complete cds. |
| 700264027H1 | g2213581 | 9 | −7 | gb105eukp | T7N9.1 |
| 700263025H1 | g452559 | 43 | −18 | gb105pln | *Zea mays* group 3 Lea protein MGL3 mRNA, complete cds. |
| 700262056H1 | g168484 | 50 | −66 | gb105pln | Maize endosperm glutelin-2 gene, complete cds. |
| 700263586H1 | g2662342 | 79 | −37 | gb105pln | *Oryza sativa* mRNA for EF-1 alpha, complete cds. |
| 700262988H1 | g168236 | 30 | −34 | gb105pln | *Helianthus annuus* hydroxyproline-rich protein gene, complete cds. |
| 700261634H1 | g927238 | 57 | −15 | gb105pln | *Zea mays* globulin1 (Glb1) gene, allele Glb1-Hb, complete cds. |
| 700265471H1 | g687246 | 14 | −10 | gb105pln | *Zea mays* oil body protein 17 kDa oleosin (ole17) gene, complete cds. |
| 700262477H1 | g790641 | 21 | −2 | gb105eukp | HTH3; gamma-thionin |
| 700265032H1 | g777757 | 62 | −58 | gb105pln | Saccharum hybrid (clone SCUBI561) polyubiquitin mRNA, complete cds. |
| 700262559H1 | g1532169 | 28 | −1 | gb105eukp | AT.I.24-7 |
| 700261035H1 | g2829927 | 15 | 8 | gb105eukp | F22K20.7 |
| 700264424H1 | g1403043 | 25 | −16 | gb105pln | *H. chilense* x *T. turgidum* conv. durum (Tritordeum) mRNA for S-adenosylmethionine decarboxylase. |
| 700258808H1 | g500852 | 28 | −26 | gb105pln | *Zea mays* (clone pAKHSDH2) aspartate kinase-homoserine dehydrogenase mRNA, complete cds. |
| 700267577H1 | g1103322 | 18 | −2 | gb105eukp | CKI2; casein kinase I |
| 700266534H1 | g168584 | 42 | −78 | gb105pln | Corn pyruvate, orthophosphate dikinase gene, exons 2–19. |
| 700265558H1 | g2262170 | 21 | 2 | gb105eukp | F5J6.15; predicted glycosyl hydrolase |
| 700262222H1 | g2829211 | 12 | 16 | gb105pln | *Oryza sativa* proteinase inhibitor (Rgpi9) gene, complete cds. |
| 700260344H2 | g1622938 | 30 | −14 | gb105pln | *Bromus secalinus* oleosin (ole16) mRNA, complete cds. |
| 700266537H1 | g1143506 | 43 | −33 | gb105pln | *L.luteus* mRNA for P0 ribosomal protein. |
| 700258171H1 | g168480 | 96 | −86 | gb105pln | Maize embryo globulin S allele (7S-like) mRNA, complete cds. |
| 700266655H1 | g20000 | 31 | −7 | gb105pln | *N. tabacum* RL2 mRNA for 60S ribosomal protein L2. |
| 700264361H1 | g2384759 | 29 | 0 | gb105pln | *Oryza sativa* GDP dissociation inhibitor protein OsGDI2 (OsGDI2) mRNA, complete cds. |
| 700264252H1 | g173269 | 15 | −3 | gb105eukp | ER lumen protein retaining receptor |
| 700267333H1 | g22121 | 86 | −16 | gb105pln | Maize alcohol dehydrogenase 1 gene (Adh1-1F). |
| 700264727H1 | g1532047 | 16 | 15 | gb105pln | *O. sativa* mRNA for S-adenosylmethionine decarboxylase. |
| 700257586H1 | g1200160 | 25 | −3 | gb105pln | *T. gesneriana* mRNA for tonoplast intrinsic protein. |
| 700258779H1 | g1403043 | 11 | 11 | gb105pln | *H. chilense* x *T. turgidum* conv. durum (Tritordeum) mRNA for S-adenosylmethionine decarboxylase. |
| 700261336H1 | g1212995 | 36 | −33 | gb105pln | *H. vulgare* mRNA for UDP-glucose pyrophosphorylase. |
| 700267926H1 | g300263 | 53 | −47 | gb105pln | HSP68 = 68 kda heat-stress DnaK homolog [*Solanum tuberosum* = potatoes, mRNA, 2418 nt]. |
| 700258246H1 | g1171351 | 28 | −14 | gb105pln | *Oryza sativa* 16 kDa oleosin (ole16) mRNA, complete cds. |
| 700264106H1 | g22284 | 14 | 2 | gb105allp | vicilin-like embryo storage protein |
| 700260706H1 | g19280 | 23 | −6 | gb105pln | *L. esculentum* mRNA for enolase. |
| 700260740H1 | g312257 | 20 | −3 | gb105pln | Yeast (*Saccharomyces cerevisiae*) PUP2 gene. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264989H1 | g1575127 | 89 | −76 | gb105pln | *Zea mays* lumenal binding protein cBiPe2 mRNA, complete cds. |
| 700265926H1 | g2623679 | 67 | −72 | gb105pln | *Zea mays* calmodulin (Zmrcalm) mRNA, complete cds. |
| 700267351H1 | g1622938 | 26 | 9 | gb105pln | *Bromus secalinus* oleosin (ole16) mRNA, complete cds. |
| 700260760H1 | g1143392 | 12 | −4 | gb105eukp | uridine diphosphate glucose epimerase; EC 5.1.3.2 |
| 700265978H1 | g2231697 | 23 | −2 | gb105pln | *Arabidopsis thaliana* clathrin assembly protein AP19 mRNA, complete cds. |
| 700264768H1 | g1498596 | 40 | −59 | gb105pln | *Zea mays* phospholipid transfer protein mRNA, complete cds. |
| 700262550H1 | g158308 | 22 | −15 | gb105eukp | Dsub\Rp49 |
| 700259391H1 | g22288 | 58 | 11 | gb105pln | Maize mRNA fragment for endosperm glutelin-2. |
| 700261329H1 | g1015849 | 12 | 3 | gb105allp | ORF YJR123w |
| 700265966H1 | g474009 | 62 | −15 | gb105pln | Rice mRNA, partial homologous to ribosomal protein S19 gene. |
| 700261755H1 | g758352 | 74 | −78 | gb105pln | *Z. mays* mRNA for cysteine synthase. |
| 700265772H1 | g1017823 | 13 | −9 | gb105allp | RNA polymerase II subunit |
| 700263103H1 | g170783 | 17 | 3 | gb105pln | *T. aestivum* ubiquitin carrier protein mRNA. |
| 700258972H1 | g1125690 | 51 | −18 | gb105pln | *S. tuberosum* mRNA for DnaJ protein. |
| 700260886H1 | g2632251 | 37 | −0 | gb105pln | S. bicolor DNA for gene encoding putative protein serine/threonine kinase, clone cSNFL1. |
| 700261319H1 | g533251 | 86 | −32 | gb105pln | *Zea mays* (clone pSM8) sucrose synthase 2 (Sus1) gene, complete cds. |
| 700265957H1 | g1575726 | 27 | −29 | gb105pln | *Glycine max* 14-3-3 related protein SGF14B mRNA, partial cds. |
| 700264090H1 | g1360460 | 11 | 13 | gb105pln | Yeast (*Saccharomyces cerevisiae*) chromosome XII reading frame ORF YLR089c. |
| 700257650H1 | g2815101 | 19 | −15 | gb105eukp | Y39E4A.3 |
| 700258652H1 | g785067 | 15 | 0 | gb105eukp | VPS27; vacuolar protein sorting; Vps27p |
| 700267250H1 | g1129084 | 17 | −10 | gb105pln | Wheat mRNA for protein H2A, complete cds, clone wcH2A-3. |
| 700267243H1 | g168423 | 97 | −77 | gb105pln | *Zea mays* polypeptide chain-binding protein mRNA, 3' end. |
| 700263958H1 | g218082 | 30 | −14 | gb105pln | Rice mRNA for initiation factor eIF-4D (225 gene), partial sequence. |
| 700263377H1 | g556899 | 26 | −5 | gb105pln | *L. esculentum* (cv. Rentita) mRNA for 54- kD signal recognition particle (SRP) specific protein. |
| 700259308H1 | g2464894 | 27 | −16 | gb105pln | *Arabidopsis thaliana* DNA chromosome 4, ESSA I AP2 contig fragment No. 2. |
| 700257022H1 | g498741 | 70 | −31 | gb105pln | *H. vulgare* (pMaW25) mRNA for beta-ketoacyl-ACP synthase. |
| 700267552H1 | g300082 | 27 | −16 | gb105pln | hsp82 = 82 kda heat shock protein [*Zea mays*, seedling, leaves, Genomic, 3468 nt]. |
| 700260377H2 | g2582351 | 10 | −0 | gb105eukp | 1039; unknown |
| 700263433H1 | g687244 | 93 | −7 | gb105pln | *Zea mays* oil body protein 16 kDa oleosin (ole16) gene, complete cds. |
| 700265940H1 | g1301693 | 14 | 2 | gb105eukp | F55A11.3 |
| 700257753H1 | g2104678 | 32 | −22 | gb105pln | *V. faba* mRNA for transcription factor containing HMG-box. |
| 700266550H1 | g1658312 | 17 | 7 | gb105pln | *O. sativa* osr40g2 gene. |
| 700263687H1 | g1136574 | 33 | −21 | gb105pln | Sorghum bicolor heat shock protein 70 (hsp70) pseudogene. |
| 700265148H1 | g2160160 | 42 | −22 | gb105eukp | F21M12.5 |
| 700256749H1 | g172556 | 28 | −31 | gb105pln | Yeast (*Saccharomyces cerevisiae*) succinate dehydrogenase (SDHA) gene, complete cds. |
| 700257183H1 | g687244 | 64 | −68 | gb105pln | *Zea mays* oil body protein 16 kDa oleosin (ole16) gene, complete cds. |
| 700257219H1 | g22281 | 44 | 5 | gb105pln | *Zea mays* Glb1-0 gene for vicilin-like storage protein (truncated). |
| 700259190H2 | g2104535 | 36 | −19 | gb105eukp | T10M13.13; T10M13.13 |
| 700263167H1 | g687246 | 11 | 15 | gb105pln | *Zea mays* oil body protein 17 kDa oleosin (ole17) gene, complete cds. |
| 700261643H1 | g2570121 | 13 | 14 | gb105pln | *S. latifolia* mRNA, clone CCLS 30.1rev. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700262075H1 | g899607 | 51 | −34 | gb105pln | *Zea mays* polyubiquitin (MubC5) mRNA, complete cds. |
| 700207218H1 | g927238 | 60 | 5 | gb105pln | *Zea mays* globulin1 (Glb1) gene, allele Glb1-Hb, complete cds. |
| 700261348H1 | g286123 | 57 | −19 | gb105pln | Maize mRNA for glutamine synthetase, complete cds. |
| 700263386H1 | g1675393 | 14 | 5 | gb105pln | *Oryza sativa* class III ADH enzyme (AdhIII) gene, complete cds. |
| 700262662H1 | g2342676 | 36 | −3 | gb105eukp | F7G19.3 |
| 700262370H1 | g168690 | 91 | −80 | gb105pln | Maize zein mRNA, complete cds, clone ZG124. |
| 700266410H1 | g1778820 | 57 | −52 | gb105pln | *Oryza sativa* S-adenosyl-L-methionine synthetase (pOS-SAMS2) mRNA, complete cds. |
| 700265645H1 | g1402874 | 30 | −20 | gb105pln | *A. thaliana* 81 kb genomic sequence. |
| 700258985H1 | g515759 | 16 | −0 | gb105eukp | malate dehydrogenase (NADP+); EC 1.1.1.40 |
| 700258366H1 | g22283 | 40 | −45 | gb105pln | *Zea mays* Glb1-L gene for vicilin-like embryo storage protein. |
| 700264524H1 | g2276198 | 12 | −1 | gb105eukp | T04A11.5 |
| 700258171H1 | g22281 | 59 | −83 | gb105pln | *Zea mays* Glb1-0 gene for vicilin-like storage protein (truncated). |
| 700266228H1 | g415316 | 74 | −71 | gb105pln | Rice mRNA for acidic ribosomal protein P0, complete cds. |
| 700256856H1 | g2645163 | 32 | −13 | gb105pln | *Oryza sativa* mRNA, similar to ribosomal protein L26. |
| 700265576H1 | g960288 | 37 | −27 | gb105pln | *Ruta graveolens* anthranilate synthase alpha-subunit mRNA, complete cds. |
| 700265353H1 | g2286154 | 81 | −82 | gb105pln | *Zea mays* 6-phosphofructo-2-kinase/fructose-2,6-bisphosphatase mRNA, partial cds. |
| 700257391H1 | g2345153 | 41 | −69 | gb105pln | *Zea mays* ribsomal protein S4 (rps4) mRNA, complete cds. |
| 700263455H1 | g2632527 | 11 | 1 | gb105allp | similar to hypothetical proteins |
| 700261868H1 | g687244 | 40 | −28 | gb105pln | *Zea mays* oil body protein 16 kDa oleosin (ole16) gene, complete cds. |
| 700261253H1 | g396254 | 14 | −7 | gb105eukp | 40S ribosomal protein S5 |
| 700261936H1 | g169818 | 63 | 2 | gb105pln | Rice 25S ribosomal RNA gene. |
| 700257678H1 | g633889 | 45 | −3 | gb105pln | glucose and ribitol dehydrogenase homolog [*Hordeum vulgare* = barley, Aura, embryo, mRNA, 1170 nt]. |
| 700266628H1 | g1480017 | 25 | −10 | gb105pln | *Brassica rapa* mRNA for ribosomal protein, complete cds. |
| 700266596H1 | g1498052 | 89 | −68 | gb105pln | *Zea mays* ribosomal protein S8 mRNA, complete cds. |
| 700261817H1 | g2511530 | 36 | −50 | gb105pln | *Eleusine indica* alpha tubulin 1 (TUA1) mRNA, complete cds. |
| 700263640H1 | g536053 | 21 | 4 | gb105eukp | URA7 |
| 700267533H1 | g1575561 | 50 | −1 | gb105eukp | RpL27a |
| 700260318H2 | g169834 | 46 | −40 | gb105pln | Rye 26S rRNA 3' end and 18S rRNA, 5' end. |
| 700258508H1 | g22292 | 43 | −18 | gb105pln | *Z. mays* mRNA for glycine-rich protein. |
| 700258579H1 | g899609 | 47 | −5 | gb105pln | *Zea mays* acidic ribosomal protein P2 (RPA-2A1) mRNA, complete cds. |
| 700259245H1 | g474009 | 44 | −33 | gb105pln | Rice mRNA, partial homologous to ribosomal protein S19 gene. |
| 700265580H1 | g22237 | 100 | −92 | gb105pln | Maize mRNA for cytosolic GAPDH (GapC) glyceraldehyde-3-phosphate dehydrogenase. |
| 700266826H1 | g1171351 | 16 | 11 | gb105pln | *Oryza sativa* 16 kDa oleosin (ole16) mRNA, complete cds. |
| 700266426H1 | g1498052 | 76 | −80 | gb105pln | *Zea mays* ribosomal protein S8 mRNA, complete cds. |
| 700262305H1 | g471320 | 47 | −51 | gb105pln | *H. vulgare* (cv. Bomi) B15C mRNA. |
| 700260821H1 | g798817 | 19 | −2 | gb105pln | *A. thaliana* mRNA for ribosomal protein L2. |
| 700264416H1 | g471320 | 47 | −52 | gb105pln | *H. vulgare* (cv. Bomi) B15C mRNA. |
| 700264862H1 | g22281 | 33 | −79 | gb105pln | *Zea mays* Glb1-0 gene for vicilin-like storage protein (truncated). |
| 700264342H1 | g170767 | 49 | −54 | gb105pln | Wheat Nor-D3 locus ribosomal RNA gene. |
| 700263866H1 | g2443329 | 17 | −8 | gb105eukp | Mei2-like protein |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700261744H1 | g169834 | 53 | −62 | gb105pln | Rye 26S rRNA 3' end and 18S rRNA, 5' end. |
| 700266581H1 | g169649 | 10 | 5 | gb105eukp | CCoAMT; caffeoyl-CoA 3-O-methyltransferase |
| 700258729H1 | g2282583 | 54 | −42 | gb105pln | Zea mays elongation factor 1-alpha (EF1-A) mRNA, complete cds. |
| 700258784H1 | g21732 | 21 | −11 | gb105pln | Wheat mRNA for Em protein. |
| 700265988H1 | g2191135 | 19 | −8 | gb105eukp | A_IG002N01.14 |
| 700266637H1 | g459894 | 50 | −81 | gb105pln | Zea mays sus1 gene, complete cds. |
| 700257857H1 | g452559 | 27 | −23 | gb105pln | Zea mays group 3 Lea protein MGL3 mRNA, complete cds. |
| 700267070H1 | g168512 | 51 | −48 | gb105pln | Maize major protein (L3) mRNA from the surface of lipid bodies, 3' end. |
| 700264450H1 | g22447 | 13 | 3 | gb105pln | Zea mays ZMPMS2 gene for 19 kDa zein protein. |
| 700257938H1 | g20320 | 36 | 0 | gb105allp | rab25 product |
| 700258890H1 | g168480 | 89 | −79 | gb105pln | Maize embryo globulin S allele (7S-like) mRNA, complete cds. |
| 700262261H1 | g575730 | 66 | −74 | gb105pln | Z. mays mRNA for transmembrane protein. |
| 700258790H1 | g2832684 | 15 | 4 | gb105allp | CDP-diacylglycerol synthetase-like protein |
| 700265783H1 | g168512 | 48 | −45 | gb105pln | Maize major protein (L3) mRNA from the surface of lipid bodies, 3' end. |
| 700263025H1 | g444044 | 43 | −18 | gb105pln | Z. mays mRNA for group 3 Lea protein MGL3. |
| 700260553H2 | g1777311 | 33 | −4 | gb105pln | Arabidopsis thaliana mRNA for novel serine/threonine protein kinase, complete cds. |
| 700267980H1 | g1052800 | 20 | −3 | gb105eukp | SPAC2F7.17; unknown |
| 700256746H1 | g2264312 | 16 | 16 | gb105pln | Arabidopsis thaliana genomic DNA, chromosome 5, P1 clone: MOK16, complete sequence. |
| 700267944H1 | g22287 | 7 | 8 | gb105allp | vicilin-like embryo storage protein |
| 700264448H1 | g168512 | 45 | −42 | gb105pln | Maize major protein (L3) mRNA from the surface of lipid bodies, 3' end. |
| 700259576H1 | g22212 | 14 | −22 | gb105pln | Z. mays DNA for c1 locus. |
| 700260373H2 | g20359 | 48 | −45 | gb105pln | Rice gene for 17S ribosomal RNA. |
| 700261364H1 | g1666172 | 34 | −16 | gb105pln | N. plumbaginifolia mRNA for BTF3-like transcription factor. |
| 700264862H1 | g168480 | 38 | −82 | gb105pln | Maize embryo globulin S allele (7S-like) mRNA, complete cds. |
| 700263856H1 | g2511530 | 42 | −45 | gb105pln | Eleusine indica alpha tubulin 1 (TUA1) mRNA, complete cds. |
| 700267367H1 | g687244 | 63 | −44 | gb105pln | Zea mays oil body protein 16 kDa oleosin (ole16) gene, complete cds. |
| 700258594H1 | g1808684 | 23 | 3 | gb105allp | hypothetical protein |
| 700262088H1 | g396230 | 9 | 2 | gb105eukp | putative ATP synthase subunit |
| 700263116H1 | g168419 | 71 | −10 | gb105pln | Maize (Z. mays) aldolase mRNA, complete cds. |
| 700262018H1 | g20321 | 44 | −35 | gb105pln | Oryza sativa RAc1 mRNA for actin. |
| 700256935H1 | g2244991 | 29 | −17 | gb105pln | Arabidopsis thaliana DNA chromosome 4, ESSA I contig fragment No. 6. |
| 700260407H1 | g1401053 | 7 | 4 | gb105allp | SUPT4H |
| 700266094H1 | g1272405 | 31 | −21 | gb105pln | Arabidopsis thaliana immunophilin (FKBP15-1) mRNA, complete cds. |
| 700257243H1 | g1276793 | 32 | 4 | gb105eukp | ycf25 |
| 700267208H1 | g927238 | 36 | −37 | gb105pln | Zea mays globulin1 (Glb1) gene, allele Glb1-Hb, complete cds. |
| 700263685H1 | g22283 | 51 | −35 | gb105pln | Zea mays Glb1-L gene for vicilin-like embryo storage protein. |
| 700259388H1 | g168480 | 39 | −71 | gb105pln | Maize embryo globulin S allele (7S-like) mRNA, complete cds. |
| 700266547H1 | g971279 | 59 | −50 | gb105pln | Rice mRNA for RAB24 protein, complete cds. |
| 700265252H1 | g2760086 | 15 | −6 | gb105eukp | G8B7T7; leucine-rich repeat protein |
| 700263853H1 | g1185553 | 38 | −54 | gb105pln | Zea mays glyceraldehyde-3-phosphate dehydrogenase (gpc2) gene, complete, cds. |
| 700258729H1 | g644491 | 54 | −42 | gb105pln | Corn mRNA for elongation factor 1A. |
| 700267334H1 | g1694832 | 31 | −43 | gb105pln | H. vulgare Per1 gene. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700262143H1 | g2331130 | 42 | −28 | gb105pln | *Oryza sativa* glycine-rich protein (OSGRP1) mRNA, complete cds. |
| 700258832H1 | g17616 | 17 | 7 | gb105allp | 40S RIBOSOMAL PROTEIN S5 |
| 700261624H1 | g459199 | 31 | −16 | gb105pln | *Gossypium hirsutum* vacuolar H+-ATPase subunit B mRNA, partial cds. |
| 700267053H1 | g2760171 | 43 | −42 | gb105pln | *Arabidopsis thaliana* genomic DNA, chromosome 5, P1 clone: MPA24, complete sequence. |
| 700263352H1 | g1556445 | 78 | −72 | gb105pln | *Hordeum vulgare* alpha tubulin (tubA) mRNA, complete cds. |
| 700258488H1 | g21832 | 34 | −6 | gb105pln | Wheat mRNA for chloroplast phosphoglycerate kinase (EC 2.7.2.3). |
| 700266494H1 | g2759996 | 25 | −7 | gb105pln | *Citrus sinensis* mRNA for protein similar to *fimbriata*-associated protein, partial cds. |
| 700265080H1 | g218112 | 66 | −60 | gb105pln | Rice mRNA for ribosomal protein L41 (340 gene), partial sequence. |
| 700266073H1 | g2408029 | 31 | −21 | gb105eukp | SPAC17G6.16c; hypothetical protein |
| 700261858H1 | g1209258 | 8 | 2 | gb105eukp | protease inhibitor II |
| 700257066H1 | g429020 | 32 | 4 | gb105pln | Rice mRNA for elongation factor 2 (gene name S5519), partial cds. |
| 700262670H1 | g1370186 | 26 | 3 | gb105eukp | rab7C; GTP-binding protein; RAB7C |
| 700261821H1 | g1724111 | 16 | 12 | gb105pln | *Triticum aestivum* ABA induced plasma membrane protein PM-19 (WTABAPM) mRNA, complete cds. |
| 700257973H1 | g2345153 | 43 | −59 | gb105pln | *Zea mays* ribsomal protein S4 (rps4) mRNA, complete cds. |
| 700263312H1 | g1743006 | 38 | −2 | gb105pln | *C. paradoxa* mRNA for ribosomal protein L13a. |
| 700262430H1 | g387908 | 43 | −31 | gb105pln | *Brassica rapa* S-phase-specific (BIS289) mRNA, complete cds. |
| 700262387H1 | g2570341 | 17 | 8 | gb105pln | *Arabidopsis thaliana* glyoxalase II cytoplasmic isozyme (Glx2-2) mRNA, complete cds. |
| 700262979H1 | g2656031 | 23 | 0 | gb105pln | *Arabidopsis thaliana* genomic DNA, chromosome 5, P1 clone: MXC20. |
| 700267513H1 | g550547 | 28 | 8 | gb105eukp | RPL16B; ribosomal protein L16 |
| 700260889H1 | g687244 | 27 | −16 | gb105pln | *Zea mays* oil body protein 16 kDa oleosin (ole16) gene, complete cds. |
| 700265388H1 | g458424 | 27 | −9 | gb105eukp | ARD1; N-terminal acetyltransferase complex subunit |
| 700268067H1 | g168480 | 65 | −11 | gb105pln | Maize embryo globulin S allele (7S-like) mRNA, complete cds. |
| 700266186H1 | g168512 | 48 | −49 | gb105pln | Maize major protein (L3) mRNA from the surface of lipid bodies, 3' end. |
| 700268003H1 | g2414643 | 27 | −12 | gb105pln | Yeast (*Saccharomyces pombe*) chromosome I cosmid c3H5. |
| 700266807H1 | g2623294 | 19 | −3 | gb105pln | *Arabidopsis thaliana* chromosome II BAC T20B5 genomic sequence, complete sequence. |
| 700264091H1 | g22118 | 39 | −74 | gb105pln | *Z. mays* DNA for Adh1-Cm allele. |
| 700262317H1 | g2662346 | 77 | −35 | gb105pln | *Oryza sativa* mRNA for EF-1 alpha, complete cds. |
| 700257937H1 | g2243123 | 29 | −16 | gb105pln | *Brassica juncea* mRNA for O-acetylserine(thiol) lyase, clone OAS-TL6. |
| 700259210H1 | g2565339 | 26 | −29 | gb105pln | *Lupinus luteus* ribosomal protein S14 (rps14) mRNA, complete cds. |
| 700264252H1 | g669010 | 12 | −3 | gb105eukp | C28H8.4 |
| 700258150H1 | g439260 | 18 | −7 | gb105eukp | T26G10.1 |
| 700267262H1 | g1694832 | 31 | −52 | gb105pln | *H. vulgare* Per1 gene. |
| 700258473H1 | g402551 | 37 | −11 | gb105pln | *A. thaliana* gene for acetohydroxy acid isomeroreductase. |
| 700262326H1 | g1167953 | 20 | −3 | gb105eukp | putative 32.6 kDa jasmonate-induced protein |
| 700263491H1 | g533473 | 51 | −42 | gb105pln | *Mesembryanthemum crystallinum* 2-phospho-D-glycerate hydrolase, enolase, mRNA, complete cds. |
| 700261258H1 | g2331300 | 21 | −27 | gb105pln | *Zea mays* ribosomal protein S4 type I (rps4) mRNA, complete cds. |
| 700262284H1 | g2599103 | 17 | 6 | gb105pln | *Dunaliella salina* 60S ribosomal protein (DSRP1) mRNA, complete cds. |
| 700258619H1 | g2564336 | 24 | −4 | gb105pln | *Brassica campestris* mRNA for Tat binding protein 1, complete cds. |
| 700267540H1 | g687244 | 55 | −19 | gb105pln | *Zea mays* oil body protein 16 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | kDa oleosin (ole16) gene, complete cds. |
| 700265176H1 | g2282583 | 28 | −43 | gb105pln | Zea mays elongation factor 1-alpha (EF1-A) mRNA, complete cds. |
| 700257374H1 | g1498052 | 56 | −43 | gb105pln | Zea mays ribosomal protein S8 mRNA, complete cds. |
| 700266428H1 | g1935046 | 10 | 14 | gb105pln | Zea mays helix-loop-helix type transcription factor R (R-d:Catspaw allele) gene, exon 1, inverted repeat, partial cds. |
| 700265687H1 | g167196 | 36 | −41 | gb105pln | C. tinctorius stearoyl-acyl carrier protein desaturase mRNA, complete cds. |
| 700257978H1 | g2318116 | 22 | −4 | gb105pln | Pisum sativum Mg-chelatase subunit D (ChlD) mRNA, complete cds. |
| 700258464H1 | g2257497 | 20 | 5 | gb105pln | Yeast (Schizosaccharomyces pombe) 42.8 kb genomic DNA, clone c973. |
| 700258523H1 | g16210 | 36 | −28 | gb105pln | Arabidopsis thaliana calnexin homolog. |
| 700261972H1 | g21732 | 24 | −19 | gb105pln | Wheat mRNA for Em protein. |
| 700266193H1 | g20321 | 34 | −15 | gb105pln | Oryza sativa RAc1 mRNA for actin. |
| 700262807H1 | g687244 | 64 | −26 | gb105pln | Zea mays oil body protein 16 kDa oleosin (ole16) gene, complete cds. |
| 700258018H1 | g2253278 | 24 | −3 | gb105eukp | rf20; bZIP transcriptional activator; RF2a |
| 700266064H1 | g2160438 | 5 | 7 | gb105allp | glutamate receptor channel subunit epsilon 4 |
| 700265455H1 | g21732 | 24 | −0 | gb105pln | Wheat mRNA for Em protein. |
| 700262569H1 | g1154953 | 27 | 10 | gb105pln | T. aestivum histone H2A gene. |
| 700264405H1 | g1532070 | 12 | 10 | gb105pln | Z. mays grp3 mRNA for glycine-rich protein. |
| 700266721H1 | g2218151 | 35 | −24 | gb105pln | Vigna unguiculata type IIIa membrane protein cp-wap13 mRNA, complete cds. |
| 700258524H1 | g22235 | 70 | −32 | gb105pln | Maize cat-3 mRNA for catalase-3 isoenzyme (EC 1.11.1.6). |
| 700265841H1 | g459894 | 75 | −62 | gb105pln | Zea mays sus1 gene, complete cds. |
| 700266885H1 | g1694832 | 44 | −28 | gb105pln | H. vulgare Per1 gene. |
| 700263406H1 | g577611 | 53 | 4 | gb105pln | Zea mays CRT1 gene for calcium-binding protein. |
| 700259222H1 | g2344885 | 16 | −23 | gb105pln | Arabidopsis thaliana chromosome II BAC T13E15 genomic sequence, complete sequence. |
| 700265581H1 | g396835 | 12 | 4 | gb105allp | male sterility 2 (MS2) protein |
| 700263029H1 | g1000369 | 19 | 7 | gb105allp | vesicle-associated membrane protein/synaptobrevin binding protein |
| 700257122H1 | g2443755 | 41 | −16 | gb105eukp | CYP5; cyclophilin |
| 700258659H1 | g2370536 | 5 | 8 | gb105eukp | SPAC4A8.03c; hypothetical protein phosphatase |
| 700265143H1 | g313266 | 40 | −21 | gb105pln | T. aestivum gene for phosphoglycerate kinase. |
| 700261390H1 | g687244 | 56 | −69 | gb105pln | Zea mays oil body protein 16 kDa oleosin (ole16) gene, complete cds. |
| 700263240H1 | g2623307 | 32 | −14 | gb105eukp | T20B5.13; putative ubiquitin protease |
| 700264491H1 | g722271 | 18 | 12 | gb105pln | Brassica napus chitinase class IV (LSC222) mRNA, partial cds. |
| 700262336H1 | g1314090 | 57 | −33 | gb105eukp | YPR015C; unknown |
| 700256726H1 | g927239 | 7 | 8 | gb105eukp | Glb1; globulin1 |
| 700265136H1 | g551289 | 60 | −67 | gb105pln | Z. mays (W22) phosphoglycerate mutase gene exons 2–8. |
| 700264510H1 | g469147 | 17 | −2 | gb105pln | H. vulgare mRNA for alanine aminotransferase. |
| 700267928H1 | g2262097 | 16 | 8 | gb105pln | Arabidopsis thaliana BAC T19F06 genomic sequence, complete sequence. |
| 700267617H1 | g313266 | 23 | 14 | gb105pln | T. aestivum gene for phosphoglycerate kinase. |
| 700267137H1 | g435648 | 79 | −10 | gb105pln | Rice mRNA for gamma-Tip, complete cds. |
| 700264296H1 | g555941 | 26 | 6 | gb105allp | ribosomal protein S3 |
| 700258766H1 | g16427 | 10 | 4 | gb105allp | protease inhibitor II |
| 700265861H1 | g168481 | 16 | −5 | gb105eukp | globulin precursor |
| 700265136H1 | g168587 | 86 | −71 | gb105pln | Zea mays cofactor-independent phosphoglycerate mutase mRNA, complete cds. |
| 700257857H1 | g444044 | 27 | −23 | gb105pln | Z. mays mRNA for group 3 Lea protein MGL3. |
| 700267281H1 | g168480 | 30 | −50 | gb105pln | Maize embryo globulin S allele (7S-like) mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264916H1 | g2583128 | 15 | 6 | gb105eukp | F4L23.23 |
| 700264501H1 | g452473 | 31 | −31 | gb105pln | *Zea mays* Black Mexican Sweet alpha-tubulin mRNA, complete cds. |
| 700258906H1 | g2462829 | 10 | 5 | gb105eukp | F19G10.8 |
| 700268038H1 | g687244 | 32 | −31 | gb105pln | *Zea mays* oil body protein 16 kDa oleosin (ole16) gene, complete cds. |
| 700266083H1 | g1632784 | 18 | −2 | gb105eukp | Nascent polypeptide associated complex protein alpha subunit |
| 700262892H1 | g642162 | 42 | 7 | gb105pln | *B. chrysogonum* 28S rRNA gene (partial). |
| 700267822H1 | g294845 | 15 | 6 | gb105eukp | unknown; membrane protein |
| 700258895H1 | g18890 | 32 | −13 | gb105pln | *H. vulgare* gene for aldose reductase-related protein. |
| 700261439H1 | g499011 | 35 | −14 | gb105pln | *S. vulgare* SoAc1 mRNA. |
| 700267312H1 | g416150 | 62 | −53 | gb105pln | *Zea mays* beta-8 tubulin (tub8) mRNA, complete cds. |
| 700267811H1 | g1082146 | 16 | −6 | gb105eukp | T18D3.3 |
| 700259092H1 | g2828149 | 26 | −8 | gb105allp | cyclophilin-33A |
| 700260562H2 | g1171351 | 23 | −7 | gb105pln | *Oryza sativa* 16 kDa oleosin (ole16) mRNA, complete cds. |
| 700267749H1 | g596077 | 32 | 4 | gb105pln | *Zea mays* thiamine biosynthetic enzyme (thi1-1) mRNA, complete cds. |
| 700261692H1 | g927238 | 50 | −42 | gb105pln | *Zea mays* globulin1 (Glb1) gene, allele Glb1-Hb, complete cds. |
| 700267666H1 | g402904 | 25 | −9 | gb105eukp | laminin receptor-like protein |
| 700267484H1 | g170775 | 61 | −30 | gb105pln | Wheat translation elongation factor 1 alpha-subunit (TEF1) mRNA, complete cds. |
| 700264532H1 | g1132482 | 28 | −12 | gb105pln | Rice mRNA for ADP-ribosylation factor, complete cds. |
| 700262649H1 | g2687436 | 51 | −17 | gb105pln | *Parnassia fimbriata* large subunit 26S ribosomal RNA gene, partial sequence. |
| 700266612H1 | g537446 | 34 | −31 | gb105eukp | Athsp101; AtHSP101 |
| 700265158H1 | g798817 | 24 | −5 | gb105pln | *A. thaliana* mRNA for ribosomal protein L2. |
| 700257183H1 | g1622938 | 20 | 0 | gb105pln | *Bromus secalinus* oleosin (ole16) mRNA, complete cds. |
| 700262229H1 | g22447 | 15 | 10 | gb105pln | *Zea mays* ZMPMS2 gene for 19 kDa zein protein. |
| 700258606H1 | g310322 | 18 | −30 | gb105pln | *Oryza sativa* triosephosphate isomerase (Rictipi2) gene, exons 1–9. |
| 700263710H1 | g1167953 | 18 | −4 | gb105eukp | putative 32.6 kDa jasmonate-induced protein |
| 700262778H1 | g168512 | 22 | 16 | gb105pln | Maize major protein (L3) mRNA from the surface of lipid bodies, 3′ end. |
| 700256825H1 | g687244 | 50 | −79 | gb105pln | *Zea mays* oil body protein 16 kDa oleosin (ole16) gene, complete cds. |
| 700266734H1 | g450549 | 46 | 8 | gb105eukp | S-adenosyl methionine synthetase |
| 700257828H1 | g453844 | 21 | 7 | gb105allp | selenium binding protein homolog |
| 700266106H1 | g21732 | 18 | −14 | gb105pln | Wheat mRNA for Em protein. |
| 700262461H1 | g1771160 | 26 | 1 | gb105eukp | SBT1; serine protease |
| 700268185H1 | g1370183 | 33 | −19 | gb105pln | *L.japonicus* mRNA for small GTP-binding protein, RAB7B. |
| 700258508H1 | g2331132 | 24 | −1 | gb105pln | *Oryza sativa* glycine-rich protein (OSGRP2) mRNA, complete cds. |
| 700265776H1 | g2463334 | 38 | −47 | gb105pln | *Oryza sativa* mRNA for ribosomal protein S4. |
| 700258287H1 | g22149 | 68 | −67 | gb105pln | *Z. mays* mRNA for alpha-tubulin 3. |
| 700264733H1 | g1724101 | 41 | −31 | gb105pln | *Mesembryanthemum crystallinum* S-adenosyl-L-homocystein hydrolase mRNA, complete cds. |
| 700268173H1 | g147144 | 30 | −10 | gb105allp | aminopeptidase N |
| 700258787H1 | g1420098 | 12 | 5 | gb105eukp | ORF YOR006c |
| 700260896H1 | g16878 | 13 | 4 | gb105allp | 60S ribosomal protein L5 |
| 700263633H1 | g2444419 | 46 | −9 | gb105pln | *Glycine max* ribosome-associated protein p40 mRNA, complete cds. |
| 700262305H1 | g971279 | 45 | −46 | gb105pln | Rice mRNA for RAB24 protein, complete cds. |
| 700267592H1 | g2668737 | 37 | −48 | gb105pln | *Zea mays* translation initiation factor 5A (TIF5A) mRNA, complete cds. |
| 700262113H1 | g1622720 | 44 | −32 | gb105pln | *Kalanchoe daigremontiana* V-type H+-ATPase 16 kDa subunit mRNA, complete cds. |
| 700264416H1 | g971279 | 45 | −47 | gb105pln | Rice mRNA for RAB24 protein, |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | complete cds. |
| 700262173H1 | g218130 | 29 | −28 | gb105pln | Rice mRNA for Ribosomal protein S15. |
| 700258380H1 | g984964 | 36 | −10 | gb105eukp | SIK1; suppressor of toxicity of GAL4-IKB; Sik1p |
| 700265733H1 | g1694832 | 36 | 16 | gb105pln | *H. vulgare* Per1 gene. |
| 700258377H1 | g2660678 | 8 | 2 | gb105eukp | T19K24.13, putative C2 domain-containing protein |
| 700260434H1 | g2668741 | 52 | −41 | gb105pln | *Zea mays* glycine-rich RNA binding protein (GRP) mRNA, complete cds. |
| 700263661H1 | g22461 | 56 | −37 | gb105pln | Maize RAB-17 gene. |
| 700262239H1 | g1155264 | 50 | −35 | gb105pln | *Pennisetum ciliare* possible apospory-associated protein mRNA, complete cds. |
| 700260434H1 | g2293479 | 36 | −25 | gb105pln | *Oryza sativa* glycine-rich protein mRNA, complete cds. |
| 700266171H1 | g1276946 | 16 | −5 | gb105eukp | globulin-like protein |
| 700257784H1 | g2828280 | 39 | 5 | gb105allp | putative protein |
| 700264536H1 | g2809231 | 18 | 3 | gb105pln | Genomic sequence for *Arabidopsis thaliana* BAC F22O13, complete sequence. |
| 700257743H1 | g1184771 | 39 | −18 | gb105pln | *Zea mays* glyceraldehyde-3-phosphate dehydrogenase GAPC2 (gpc2) mRNA, complete cds. |
| 700266567H1 | g1022796 | 30 | −19 | gb105pln | *Arabidopsis thaliana* glutathione reductase mRNA, complete cds. |
| 700265519H1 | g2511530 | 56 | −53 | gb105pln | *Eleusine indica* alpha tubulin 1 (TUA1) mRNA, complete cds. |
| 700263302H1 | g940880 | 22 | 6 | gb105pln | *Z. mays* zag2 gene. |
| 700262585H1 | g2160158 | 41 | −18 | gb105eukp | F21M12.3 |
| 700267210H1 | g1742787 | 8 | 7 | gb105allp | ORF_ID:o322#7; similar to [SwissProt Accession Number Q06373]. |
| 700257537H1 | g22409 | 43 | −25 | gb105pln | *Z. mays* pepcZm2A gene for phosphoenolpyruvate carboxylase, 5' region. |
| 700263019H1 | g2301335 | 19 | 5 | gb105allp | unnamed protein product |
| 700263854H1 | g2618600 | 21 | 6 | gb105pln | *Arabidopsis thaliana* genomic DNA, chromosome 5, P1 clone: MDC12, complete sequence. |
| 700260122H1 | g469067 | 4 | 7 | gb105allp | NMDA receptor subunit NR2D |
| 700267260H1 | g1212995 | 23 | −33 | gb105pln | *H. vulgare* mRNA for UDP-glucose pyrophosphorylase. |
| 700262222H1 | g2829212 | 16 | 5 | gb105allp | proteinase inhibitor |
| 700260596H2 | g2804277 | 46 | 11 | gb105pln | *Panax ginseng* mRNA for squalene epoxidase, complete cds. |
| 700261088H1 | g2462826 | 21 | 8 | gb105eukp | F19G10.11 |
| 700257993H1 | g2586332 | 32 | −21 | gb105pln | *Lycopersicon esculentum* importin alpha (LeKAP alpha) mRNA, partial cds. |
| 700267811H1 | g2815100 | 13 | −4 | gb105eukp | Y39E4A.2b |
| 700262653H1 | g169820 | 54 | −39 | gb105pln | *Oryza sativa* triosephosphate isomerase (Rictpi) mRNA, complete cds. |
| 700257578H1 | g1616741 | 30 | 4 | gb105allp | hASNA-I |
| 700262933H1 | g2331300 | 45 | −67 | gb105pln | *Zea mays* ribosomal protein S4 type I (rps4) mRNA, complete cds. |
| 700256728H1 | g971699 | 5 | 6 | gb105allp | ribosomal protein S7 |
| 700268037H1 | g1770020 | 48 | −19 | gb105pln | *Oryza sativa* S-adenosyl-L-methionine synthetase (pOS-SAMS2) mRNA, complete cds. |
| 700263184H1 | g1151233 | 29 | −7 | gb105eukp | YPL093W; Yp1093wp |
| 700267275H1 | g2564047 | 20 | −4 | gb105pln | *Arabidopsis thaliana* genomic DNA, chromosome 5, P1 clone: MJB21, complete sequence. |
| 700265613H1 | g1513227 | 26 | −16 | gb105pln | *Brassica napus* myo-inositol 1-phosphate synthase mRNA, complete cds. |
| 700258294H1 | g22287 | 8 | 7 | gb105allp | vicilin-like embryo storage protein |
| 700258787H1 | g1151002 | 12 | 5 | gb105allp | hypothetical protein UND313 |
| 700262768H1 | g168512 | 29 | −42 | gb105pln | Maize major protein (L3) mRNA from the surface of lipid bodies, 3' end. |
| 700263637H1 | g474966 | 13 | 7 | gb105allp | ferrochelatase |
| 700258168H1 | g168512 | 47 | −45 | gb105pln | Maize major protein (L3) mRNA from the surface of lipid bodies, 3' end. |
| 700259321H1 | g22283 | 47 | −58 | gb105pln | *Zea mays* Glb1-L gene for vicilin-like embryo storage protein. |
| 700264432H1 | g22573 | 16 | 8 | gb105allp | 12.5 kDa protein |
| 700261320H1 | g435172 | 58 | −41 | gb105pln | *A. sativa* (Pewi) ASTCP-K19 mRNA for t complex polypeptide 1. |
| 700258902H1 | g2271476 | 21 | −31 | gb105pln | *Arabidopsis thaliana* AP47/50p |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | mRNA, complete cds. |
| 700265134H1 | g790641 | 19 | −1 | gb105eukp | HTH3; gamma-thionin |
| 700266224H1 | g1747295 | 27 | −25 | gb105pln | Rice mRNA for vacuolar H+-pyrophosphatase, complete cds. |
| 700267938H1 | g485376 | 96 | −86 | gb105pln | *Zea mays* alpha-3-tubulin gene, complete cds. |
| 700258886H1 | g577818 | 23 | 3 | gb105pln | *Z. mays* gene for H2B histone (gH2B4). |
| 700267032H1 | g435648 | 46 | −13 | gb105pln | Rice mRNA for gamma-Tip, complete cds. |
| 700264414H1 | g1171351 | 30 | −19 | gb105pln | *Oryza sativa* 16 kDa oleosin (ole16) mRNA, complete cds. |
| 700266950H1 | g1171351 | 21 | 3 | gb105pln | *Oryza sativa* 16 kDa oleosin (ole16) mRNA, complete cds. |
| 700266110H1 | g1419948 | 27 | −10 | gb105eukp | WRS1 |
| 700264217H1 | g2244823 | 19 | 2 | gb105eukp | heat shock protein |
| 700264242H1 | g2443890 | 22 | −7 | gb105eukp | F11P17.16 |
| 700207116H1 | g798818 | 9 | 6 | gb105eukp | RPL2; 60S ribosomal protein L2 |
| 700264229H1 | g304108 | 26 | −7 | gb105pln | *Arabidopsis thaliana* poly(A)-binding protein mRNA, complete cds. |
| 700264174H1 | g1788589 | 9 | −1 | gb105allp | o660; This 660 aa ORF is 30 pct identical (9 gaps) to 301 residues of an approx. 320 aa protein FMT_ECOLI SW: P23882 |
| 700264667H1 | g1749576 | 11 | 7 | gb105eukp | similar to *Saccharomyces cerevisiae* acetyl-CoA acetyltransferase, SWISS-PROT Accession Number P41338 |
| 700258360H1 | g791118 | 23 | −5 | gb105eukp | unknown |
| 700261176H1 | g2765316 | 34 | −21 | gb105eukp | AS1; asparagine synthetase 1 |
| 700267173H1 | g2708737 | 12 | 6 | gb105eukp | T13L16.1; putative nuclear protein |
| 700265592H1 | g687244 | 45 | −73 | gb105pln | *Zea mays* oil body protein 16 kDa oleosin (ole16) gene, complete cds. |
| 700267667H1 | g22285 | 69 | −69 | gb105pln | *Zea mays* lb1-S gene for vicilin-like embryo storage protein. |
| 700266585H1 | g927238 | 68 | −68 | gb105pln | *Zea mays* globulin1 (Glb1) gene, allele Glb1-Hb, complete cds. |
| 700258740H1 | g940880 | 29 | −50 | gb105pln | *Z. mays* zag2 gene. |
| 700267983H1 | g170064 | 14 | 2 | gb105eukp | sbp; glucose binding protein |
| 700265012H1 | g603219 | 18 | 8 | gb105allp | glucose-6-phosphate dehydrogenase |
| 700266890H1 | g509548 | 16 | 14 | gb105pln | *Sorghum bicolor* dehydrin (DHN1) mRNA, complete cds. |
| 700258323H1 | g22270 | 24 | −2 | gb105pln | Maize mRNA from an embryogenic abscisic acid-inducible gene. |
| 700259563H1 | g596079 | 16 | −15 | gb105pln | *Zea mays* thiamine biosynthetic enzyme (thi1-2) mRNA, complete cds. |
| 700261010H1 | g644492 | 59 | −17 | gb105pln | Corn elongation factor 1alpha gene, complete cds. |
| 700267060H1 | g168406 | 39 | −77 | gb105pln | *Z. mays* alcohol dehydrogenase (ADH-1 C-m allele) gene, complete cds. |
| 700262282H1 | g886739 | 68 | −55 | gb105pln | *Z. mays* histone H4 gene. |
| 700256974H1 | g2454182 | 41 | 1 | gb105eukp | pyruvate dehydrogenase E1 alpha subunit; EC 1.2.4.1 |
| 700268102H1 | g1877523 | 30 | −13 | gb105pln | *Arabidopsis thaliana* BAC T7I23, complete sequence. |
| 700258323H1 | g19016 | 23 | −0 | gb105pln | *H. vulgare* mRNA for LEA B19.4 protein. |
| 700257382H1 | g168512 | 33 | −31 | gb105pln | Maize major protein (L3) mRNA from the surface of lipid bodies, 3′ end. |
| 700260103H1 | g1778820 | 42 | −10 | gb105pln | *Oryza sativa* S-adenosyl-L-methionine synthetase (pOS-SAMS2) mRNA, complete cds. |
| 700264817H1 | g1245452 | 18 | −12 | gb105pln | *Medicago sativa* 3-deoxy-D-arabino-heptulosonate 7-phosphate synthase (MsDHS1) mRNA, partial cds. |
| 700265180H1 | g1171351 | 19 | −11 | gb105pln | *Oryza sativa* 16 kDa oleosin (ole16) mRNA, complete cds. |
| 700263680H1 | g296691 | 48 | −7 | gb105pln | *S. tuberosum* dpeP mRNA for 4-alpha-glucanotransferase. |
| 700256791H1 | g551287 | 59 | −58 | gb105pln | *Z. mays* (W22) phosphoglycerate mutase gene (exon 1). |
| 700258059H1 | g22140 | 52 | −68 | gb105pln | *Z. mays* gene for acetohydroxyacid synthase (AHAS109). |
| 700258823H1 | g1931636 | 44 | −36 | gb105pln | *Arabidopsis thaliana* BAC T19D16 genomic sequence. |
| 700266380H1 | g1276945 | 23 | −10 | gb105pln | *Daucus carota* globulin-like |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | protein mRNA, somatic embryo clone Gea8, complete cds. |
| 700257642H1 | g18891 | 43 | 3 | gb105eukp | aldose reductase-related protein |
| 700258343H1 | g2281089 | 58 | −23 | gb105eukp | F18019.8; Sm protein F isolog |
| 700265189H1 | g563926 | 16 | 12 | gb105pln | Zea mays xyloglucan endo-transglycosylase homolog mRNA, complete cds. |
| 700265004H1 | g168512 | 88 | −28 | gb105pln | Maize major protein (L3) mRNA from the surface of lipid bodies, 3' end. |
| 700259466H1 | g2264312 | 39 | 6 | gb105pln | Arabidopsis thaliana genomic DNA, chromosome 5, P1 clone: MOK16, complete sequence. |
| 700258762H1 | g409756 | 5 | 5 | gb105eukp | ATP/GTP nucleotide-binding protein |
| 700259374H1 | g21629 | 86 | −76 | gb105pln | Sorghum vulgare mRNA for phosphoenolpyruvate carboxylase (PEPC). |
| 700257221H1 | g2270994 | 28 | 7 | gb105allp | Ca+2-binding EF hand protein |
| 700265663H1 | g22483 | 67 | −63 | gb105pln | Z. mays RNA for superoxide dismutase Sod4. |
| 700261663H1 | g500750 | 58 | −36 | gb105pln | Zea mays ferredoxin-NADP reductase mRNA, partial cds. |
| 700207140H1 | g415316 | 32 | −19 | gb105pln | Rice mRNA for acidic ribosomal protein P0, complete cds. |
| 700258217H1 | g633139 | 40 | −4 | gb105pln | A. thaliana mRNA for phosphoribosyl diphosphate synthetase. |
| 700267812H1 | g471320 | 25 | −44 | gb105pln | H. vulgare (cv. Bomi) B15C mRNA. |
| 700265117H1 | g1553128 | 49 | −38 | gb105pln | Gossypium hirsutum ribosomal protein L44 isoform a (RL44), complete cds. |
| 700261178H1 | g1322706 | 23 | −0 | gb105eukp | SSM2 |
| 700257673H1 | g1899059 | 66 | −19 | gb105pln | Zea mays endosperm C-24 sterol methyltransferase (ESMT1) mRNA, complete cds. |
| 700264832H1 | g20163 | 37 | −50 | gb105pln | O. sativa Rr15 mRNA for 5S ribosomal RNA. |
| 700260335H1 | g2624211 | 17 | −16 | gb105pln | M.acuminata mRNA; clone pBAN UU131. |
| 700267372H1 | g1737218 | 47 | −19 | gb105eukp | vacuolar sorting receptor homolog |
| 700264182H1 | g1694832 | 34 | −48 | gb105pln | H. vulgare Per1 gene. |
| 700263973H1 | g1200160 | 20 | 10 | gb105pln | T. gesneriana mRNA for tonoplast intrinsic protein. |
| 700262434H1 | g1694832 | 15 | −23 | gb105pln | H. vulgare Per1 gene. |
| 700257340H1 | g927238 | 53 | −60 | gb105pln | Zea mays globulin1 (Glb1) gene, allele Glb1-Hb, complete cds. |
| 700268130H1 | g416499 | 6 | 6 | gb105allp | globulin |
| 700261143H1 | g780814 | 14 | 7 | gb105allp | 3-ketoacyl-acyl carrier protein synthase I |
| 700265044H1 | g22270 | 79 | −78 | gb105pln | Maize mRNA from an embryogenic abscisic acid-inducible gene. |
| 700261936H1 | g169819 | 63 | 1 | gb105pln | Rice gene encoding three ribosomal RNA's: the 17S, 3' end; 5.8S, complete; 25S, 5' end. |
| 700265485H1 | g168508 | 59 | −58 | gb105pln | Maize oleosin KD18 (KD18; L2) gene, complete cds. |
| 700259156H2 | g2274990 | 50 | −67 | gb105pln | Hordeum vulgare mRNA for expressed sequence tag. |
| 700267121H1 | g2168137 | 37 | 7 | gb105eukp | PKF1 |
| 700256908H1 | g285633 | 22 | 11 | gb105pln | Barley gene for Ids2, complete cds. |
| 700265044H1 | g19016 | 25 | −8 | gb105pln | H. vulgare mRNA for LEA B19.4 protein. |
| 700259324H1 | g22281 | 54 | −5 | gb105pln | Zea mays Glb1-0 gene for vicilin-like storage protein (truncated). |
| 700257265H1 | g487302 | 41 | 1 | gb105pln | Rice mRNA EN3, partial sequence. |
| 700264360H1 | g169843 | 24 | −14 | gb105pln | Saccarum hybrid phosphoenolpyruvate carboxylase (SCPEPCD1) gene, complete cds. |
| 700258367H1 | g1694832 | 31 | −44 | gb105pln | H. vulgare Per1 gene. |
| 700267220H1 | g312518 | 23 | −12 | gb105pln | T. aestivum Em H2 gene. |
| 700265689H1 | g22285 | 31 | 6 | gb105pln | Zea mays Glb1-S gene for vicilin-like embryo storage protein. |
| 700256829H1 | g927238 | 37 | −56 | gb105pln | Zea mays globulin1 (Glb1) gene, allele Glb1-Hb, complete cds. |
| 700260555H2 | g308905 | 16 | 9 | gb105pln | Lilium longiflorum potential |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | thioredoxin mRNA, complete cds. |
| 700261484H1 | g596077 | 32 | 7 | gb105pln | *Zea mays* thiamine biosynthetic enzyme (thi1-1) mRNA, complete cds. |
| 700257223H1 | g469148 | 21 | −6 | gb105eukp | alanine aminotransferase |
| 700267314H1 | g450353 | 22 | −10 | gb105pln | *H. vulgare* (cv Bomi) gB19.1b gene. |
| 700266161H1 | g602252 | 76 | −75 | gb105pln | *Zea mays* enolase (eno2) mRNA, complete cds. |
| 700263883H1 | g166694 | 12 | 7 | gb105eukp | DNA-damage resistance protein; recombination protein. |
| 700267975H1 | g1181332 | 30 | −24 | gb105pln | *Z. mays* CRH mRNA. |
| 700262757H1 | g22231 | 51 | −29 | gb105pln | Maize cat-1 mRNA for catalase-1 isoenzyme (EC 1.11.1.6). |
| 700266444H1 | g2267005 | 50 | −33 | gb105pln | *Oryza sativa* endosperm lumenal binding protein (BiP) mRNA, complete cds. |
| 700260156H1 | g248336 | 62 | −34 | gb105pln | polyubiquitin [maize, Genomic, 3841 nt]. |
| 700260571H2 | g537593 | 11 | 7 | gb105allp | aldose reductase |
| 700260288H1 | g22281 | 33 | −13 | gb105pln | *Zea mays* Glb1-0 gene for vicilin-like storage protein (truncated). |
| 700257673H1 | g1706964 | 47 | −8 | gb105pln | *Triticum aestivum* delta-24-sterol methyltransferase (TA-MT) mRNA, complete cds. |
| 700265748H1 | g2832658 | 13 | 3 | gb105allp | putative protein |
| 700263965H1 | g16121 | 79 | −76 | gb105pln | Oat TUB1 mRNA for beta-tubulin (partial). |
| 700261856H1 | g1698687 | 17 | 6 | gb105pln | *Cuphea wrightii* beta-ketoacyl-ACP synthase II (CwKASII2) mRNA, complete cds. |
| 700257579H1 | g515360 | 29 | 6 | gb105allp | 36 kDA porin II |
| 700266110H1 | g1052796 | 24 | −6 | gb105eukp | SPAC2F7.13c; unknown |
| 700268176H1 | g510931 | 27 | −11 | gb105pln | *V. faba* mRNA for alpha 1,4-glucan phospborylase type H. |
| 700262075H1 | g777757 | 45 | −28 | gb105pln | Saccharum hybrid (clone SCUBI561) polyubiquitin mRNA, complete cds. |
| 700265206H1 | g1279640 | 19 | −11 | gb105eukp | NAM; apical meristem formation |
| 700262616H1 | g1321660 | 67 | −64 | gb105pln | Rice mRNA for ascorbate peroxidase, complete cds. |
| 700266645H1 | g1396054 | 48 | −6 | gb105eukp | PAT1; phosphoribosylanthranilate transferase; EC 2.4.2.18 |
| 700264749H1 | g1200160 | 32 | −20 | gb105pln | *T. gesneriana* mRNA for tonoplast intrinsic protein. |
| 700256892H1 | g20163 | 34 | −18 | gb105pln | *O. sativa* Rr15 mRNA for 5S ribosomal RNA. |
| 700265295H1 | g1431483 | 31 | −16 | gb105pln | Yeast (*Saccharomyces cerevisiae*) chromosome IV reading frame ORF YDR037w. |
| 700267261H1 | g596077 | 66 | −79 | gb105pln | *Zea mays* thiamine biosynthetic enzyme (thi1-1) mRNA, complete cds. |
| 700262082H1 | g2827524 | 28 | −3 | gb105eukp | F8F16.110; predicted protein |
| 700259354H1 | g1532047 | 60 | −55 | gb105pln | *O. sativa* mRNA for S-adenosylmethionine decarboxylase. |
| 700265727H1 | g22281 | 53 | 1 | gb105pln | *Zea mays* Glb1-0 gene for vicilin-like storage protein (truncated). |
| 700263021H1 | g2477521 | 14 | 17 | gb105pln | *Arabidopsis thaliana* chromosome I BAC F22K20 genomic sequence, complete sequence. |
| 700258016H1 | g393706 | 19 | 5 | gb105pln | *C.sativus* mRNA for 3-ketoacyl-CoA thiolase. |
| 700258814H1 | g22514 | 82 | −82 | gb105pln | Maize Zc1 gene for Zein Zc1 (14 kD zein-2) |
| 700267193H1 | g1749716 | 20 | −15 | gb105eukp | similar to *Saccharomyces cerevisiae* dihydroxy-acid dehydratase precursor, SWISS-PROT Accession Number P39522 |
| 700263121H1 | g1136574 | 28 | 15 | gb105pln | Sorghum bicolor heat shock protein 70 (hsp70) pseudogene. |
| 700265381H1 | g1296954 | 85 | −78 | gb105pln | *O. sativa* mRNA for novel protein, osr40c1. |
| 700258324H1 | g166859 | 39 | −34 | gb105pln | *Arabidopsis thaliana* ribosomal protein gene, complete cds. |
| 700267629H1 | g747886 | 10 | 6 | gb105eukp | unknown |
| 700257541H1 | g2661421 | 26 | −4 | gb105pln | *Arabidopsis thaliana* mRNA for S-phase-specific ribosomal protein. |
| 700267241H1 | g2282583 | 29 | −9 | gb105pln | *Zea mays* elongation factor 1-alpha (EF1-A) mRNA, complete cds. |
| 700265518H1 | g558648 | 14 | −1 | gb105eukp | D-myo-inositol-3-phosphate |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264085H1 | g450548 | 68 | −29 | gb105pln | synthase; EC 5.5.1.4 *O. sativa* (pRSAM-1) gene for S-adenosyl methionine synthetase. |
| 700261845H1 | g854625 | 18 | 9 | gb105pln | *T. aestivum* mRNA for peptidylprolyl cis-trans isomerase, FK506. |
| 700262010H1 | g600768 | 55 | −39 | gb105pln | *Oryza sativa* cyclophilin 2 (Cyp2) mRNA, complete cds. |
| 700258811H1 | g687244 | 42 | −77 | gb105pln | *Zea mays* oil body protein 16 kDa oleosin (ole16) gene, complete cds. |
| 700261186H1 | g168480 | 44 | −50 | gb105pln | Maize embryo globulin S allele (7S-like) mRNA, complete cds. |
| 700268140H1 | g170897 | 21 | −3 | gb105eukp | PMM1; phosphomannomutase |
| 700266566H1 | g22121 | 73 | −70 | gb105pln | Maize alcohol dehydrogenase 1 gene (Adh1-1F). |
| 700260962H1 | g19699 | 40 | −15 | gb105eukp | NeIF-4A3; nicotiana eukaryotic translation initiation factor 4A |
| 700266152H1 | g2351064 | 17 | 2 | gb105pln | *Arabidopsis thaliana* genomic DNA, chromosome 5, Pi clone: MDJ22. |
| 700258052H1 | g2244901 | 23 | 1 | gb105pln | *Arabidopsis thaliana* DNA chromosome 4, ESSA I contig fragment No. 4. |
| 700258196H1 | g166680 | 13 | 4 | gb105allp | protein kinase |
| 700265639H1 | g22285 | 45 | −80 | gb105pln | *Zea mays* Glb1-S gene for vicilin-like embryo storage protein. |
| 700257653H1 | g1136119 | 47 | −48 | gb105pln | *O. sativa* mRNA for alpha-tubulin (clone OSTA-111). |
| 700267271H1 | g459894 | 84 | −90 | gb105pln | *Zea mays* sus1 gene, complete cds. |
| 700266873H1 | g1698581 | 27 | −13 | gb105pln | *Oryza sativa* integral membrane protein (OsNramp3) mRNA, partial cds. |
| 700258729H1 | g644492 | 54 | −42 | gb105pln | Corn elongation factor 1alpha gene, complete cds. |
| 700264785H1 | g1212995 | 56 | −45 | gb105pln | *H. vulgare* mRNA for UDP-glucose pyrophosphorylase. |
| 700263712H1 | g1532047 | 19 | −17 | gb105pln | *O. sativa* mRNA for S-adenosylmethionine decarboxylase. |
| 700262508H1 | g168480 | 55 | −63 | gb105pln | Maize embryo globulin S allele (7S-like) mRNA, complete cds. |
| 700263122H1 | g22292 | 79 | −17 | gb105pln | *Z. mays* mRNA for glycine-rich protein. |
| 700257160H1 | g550543 | 42 | −36 | gb105pln | *A. thaliana* mRNA for ribosomal protein L16. |
| 700259355H1 | g475552 | 5 | 7 | gb105allp | N-methyl-D-aspartate receptor NMDAR2D subunit |
| 700263245H1 | g2661417 | 39 | −1 | gb105pln | *Avena fatua* mRNA for VIVIPAROUS 1 homologue transcription factor. |
| 700264407H1 | g1724111 | 18 | 10 | gb105pln | *Triticum aestivum* ABA induced plasma membrane protein PM-19 (WTABAPM) mRNA, complete cds. |
| 700263256H1 | g973312 | 13 | 9 | gb105pln | *Arabidopsis thaliana* myo-inositol 1-phosphate synthase isozyme-2 mRNA, complete cds. |
| 700257513H1 | g468055 | 62 | −20 | gb105pln | *Zea mays* B73 QM protein mRNA, complete cds. |
| 700256832H1 | g633889 | 27 | −32 | gb105pln | glucose and ribitol dehydrogenase homolog [*Hordeum vulgare* = barley, Aura, embryo, mRNA, 1170 nt]. |
| 700262889H1 | g471320 | 68 | −22 | gb105pln | *H. vulgare* (cv. Bomi) B15C mRNA. |
| 700207219H1 | g2113828 | 12 | 9 | gb105pln | Yeast (*Candida albicans*) TOP2 gene. |
| 700258164H1 | g2351065 | 11 | 13 | gb105pln | *Arabidopsis thaliana* genomic DNA, chromosome 5, P1 clone: MHF15. |
| 700262142H1 | g2511698 | 39 | −30 | gb105pln | *Phaseolus vulgaris* Moldavian encoding legumain-like proteinase precursor (clone p21b). |
| 700266658H1 | g21732 | 24 | −21 | gb105pln | Wheat mRNA for Em protein. |
| 700266435H1 | g643073 | 43 | −33 | gb105pln | *Fragaria x ananassa* putative 40S ribosomal protein s12 mRNA, complete cds. |
| 700263151H1 | g1350502 | 6 | 1 | gb105allp | vicilin-like storage protein |
| 700258036H1 | g2160182 | 14 | 3 | gb105eukp | F21M12.12 |
| 700258634H1 | g18728 | 35 | −23 | gb105eukp | NAD(P)H dependent 6′-deoxychalcone synthase |
| 700266629H1 | g2632128 | 10 | 16 | gb105pln | *Zea mays* mRNA for poly(ADP-ribose) polymerase (3211 bp). |
| 700264567H1 | g2326264 | 13 | 16 | gb105pln | *Arabidopsis thaliana* DNA for CCT alpha/TCP-1, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264086H1 | g473602 | 43 | −7 | gb105pln | *Zea mays* W-22 histone H2A mRNA, complete cds. |
| 700259018H1 | g1944191 | 32 | −26 | gb105eukp | nodulin 35 |
| 700264045H1 | g168508 | 67 | −14 | gb105pln | Maize oleosin KD18 (ND18; L2) gene, complete cds. |
| 700257022H1 | g498738 | 59 | −24 | gb105pln | *H. vulgare* (pMaW20) pseudo mRNA for beta-ketoacyl-ACP synthase (partial). |
| 700259428H1 | g1622938 | 51 | 3 | gb105pln | *Bromus secalinus* oleosin (ole16) mRNA, complete cds. |
| 700258008H1 | g454881 | 19 | −14 | gb105pln | Rice gene for thioredoxin h, complete cds. |
| 700267928H1 | g2583107 | 16 | −6 | gb105eukp | F4L23.1 |
| 700257908H1 | g168481 | 6 | 6 | gb105allp | globulin precursor |
| 700259377H1 | g22118 | 46 | −78 | gb105pln | *Z. mays* DNA for Adh1-Cm allele. |
| 700260416H1 | g16876 | 11 | 8 | gb105allp | vacuolar H+-pyrophosphatase |
| 700261374H1 | g927238 | 96 | −63 | gb105pln | *Zea mays* globulin1 (Glb1) gene, allele Glb1-Hb, complete cds. |
| 700263732H1 | g287297 | 21 | −16 | gb105pln | *Oryza sativa* mRNA for aspartate aminotransferase, complete cds. |
| 700257780H1 | g1136121 | 77 | −51 | gb105pln | *O. sativa* mRNA for alpha-tubulin (clone OSTA-136). |
| 700264455H1 | g22283 | 37 | −27 | gb105pln | *Zea mays* Glb1-L gene for vicilin-like embryo storage protein. |
| 700259170H2 | g633889 | 21 | 10 | gb105pln | glucose and ribitol dehydrogenase homolog [*Hordeum vulgare* = barley, Aura, embryo, mRNA, 1170 nt]. |
| 700267052H1 | g1001579 | 12 | 5 | gb105allp | ABC1-like |
| 700265876H1 | g22270 | 74 | −86 | gb105pln | Maize mRNA from an embryogenic abscisic acid-inducible gene. |
| 700265786H1 | g1532072 | 14 | 14 | gb105pln | *Z. mays* mRNA for S-adenosylmethionine decarboxylase. |
| 700262143H1 | g21624 | 52 | −42 | gb105pln | *S. vulgare* mRNA for glycine-rich RNA-binding protein (clone S2). |
| 700263536H1 | g21800 | 23 | −23 | gb105pln | *T. aestivum* L mRNA for histone H2B. |
| 700263455H1 | g1786456 | 12 | −0 | gb105allp | o310, 100 pct identical to GB: EDU70214_103 Accession U70214; 27 pct identical (34 gaps) to 306 residues from 5-methyl-tetrahydrofolate:homocysteine methyltransferase METH_SALTY SW: P37586 (370 aa) |
| 700256877H1 | g2244755 | 27 | −18 | gb105eukp | hypothetical protein |
| 700260639H1 | g1658314 | 44 | −37 | gb105pln | *O. sativa* osr40g3 gene. |
| 700265876H1 | g19016 | 22 | −11 | gb105pln | *H. vulgare* mRNA for LEA B19.4 protein. |
| 700262740H1 | g2149640 | 8 | 3 | gb105eukp | AGO1; leaf development; Argonaute protein |
| 700258763H1 | g2149050 | 32 | −7 | gb105pln | *Arabidopsis thaliana* small Ras-like GTP-binding protein (Ran3) mRNA, complete cds. |
| 700267107H1 | g2282583 | 86 | −4 | gb105pln | *Zea mays* elongation factor 1-alpha (EF1-A) mRNA, complete cds. |
| 700262319H1 | g2351063 | 35 | 10 | gb105pln | *Arabidopsis thaliana* genomic DNA, chromosome 5, P1 clone: MCL19. |
| 700258406H1 | g168512 | 47 | −43 | gb105pln | Maize major protein (L3) mRNA from the surface of lipid bodies, 3' end. |
| 700263049H1 | g19103 | 50 | −28 | gb105pln | *H. vulgare* mRNA for ribosomal protein L17-2. |
| 700260415H1 | g633889 | 17 | −25 | gb105pln | glucose and ribitol dehydrogenase homolog [*Hordeum vulgare* = barley, Aura, embryo, mRNA, 1170 nt]. |
| 700260182H1 | g22483 | 47 | −61 | gb105pln | *Z. mays* RNA for superoxide dismutase Sod4. |
| 700258867H1 | g168512 | 31 | −42 | gb105pln | Maize major protein (L3) mRNA from the surface of lipid bodies, 3' end. |
| 700259239H1 | g22283 | 70 | −74 | gb105pln | *Zea mays* Glb1-L gene for vicilin-like embryo storage protein. |
| 700266588H1 | g535141 | 10 | 4 | gb105allp | dolichyl-phosphate beta-glucosyltransferase |
| 700257966H1 | g1325967 | 25 | −1 | gb105pln | *T. aestivum* histone H2A gene (clone TH274). |
| 700259658H1 | g21598 | 13 | 10 | gb105pln | *S. tuberosum* mRNA for UDP-glucose pyrophosphorylase. |
| 700262438H1 | g1743007 | 20 | −6 | gb105eukp | ribosomal protein L13a |
| 700260191H1 | g1871186 | 8 | −1 | gb105eukp | T06D20.14 |
| 700268017H1 | g1009709 | 37 | −56 | gb105pln | *Oryza sativa* pyruvate decarboxylase 2 (Pdc2) mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264248H1 | g2749918 | 18 | 10 | gb105pln | *Arabidopsis thaliana* chromosome I BAC F3I6 genomic sequence, complete sequence. |
| 700261292H1 | g2599103 | 16 | 9 | gb105pln | *Dunaliella salina* 60S ribosomal protein (DSRP1) mRNA, complete cds. |
| 700266888H1 | g509769 | 18 | 5 | gb105eukp | seed-specific low molecular weight sulfur-rich protein |
| 700264342H1 | g21856 | 29 | −55 | gb105pln | Wheat rDNA 25S-18S intergenic region EcoRI-BamHI fragment. |
| 700258810H1 | g1658312 | 48 | −37 | gb105pln | *O. sativa* osr40g2 gene. |
| 700261677H1 | g1129144 | 43 | −5 | gb105pln | *M. indica* (Manila) THMF5 mRNA for 3-ketoacyl-coA thiolase B. |
| 700263076H1 | g168508 | 68 | −43 | gb105pln | Maize oleosin KD18 (KD18; L2) gene, complete cds. |
| 700264091H1 | g22119 | 58 | −79 | gb105pln | Maize Adh1-F mRNA for alcohol dehydrogenase. |
| 700266341H1 | g22281 | 53 | −65 | gb105pln | *Zea mays* Glb1-0 gene for vicilin-like storage protein (truncated). |
| 700267867H1 | g603311 | 16 | −2 | gb105eukp | RPS24EA; Rps24eap: 40S ribosomal protein S24E (RP50) |
| 700267786H1 | g514945 | 69 | −21 | gb105pln | *Zea mays* sucrose synthase (Sus1) mRNA, complete cds. |
| 700263716H1 | g533251 | 52 | −52 | gb105pln | *Zea mays* (clone pSM8) sucrose synthase 2 (Sus1) gene, complete cds. |
| 700266379H1 | g790640 | 20 | −7 | gb105pln | *Hordeum vulgare* gamma-thionin (HTH3) mRNA, complete cds. |
| 700264625H1 | g404165 | 38 | −23 | gb105pln | *A. thaliana* gene for BBC1 protein. |
| 700258638H1 | g22285 | 78 | −83 | gb105pln | *Zea mays* Glb1-S gene for vicilin-like embryo storage protein. |
| 700262689H1 | g22151 | 53 | −14 | gb105pln | *Z. mays* (A188) mRNA for alpha-tubulin 4. |
| 700264036H1 | g1707006 | 41 | −7 | gb105pln | *Arabidopsis thaliana* chromosome II BAC T01B08 genomic sequence, complete sequence. |
| 700262892H1 | g642163 | 45 | 7 | gb105pln | *B. dictyophylla* ITS2 and 28S rRNA gene (partial). |
| 700257172H1 | g1017823 | 20 | 7 | gb105allp | RNA polymerase II subunit |
| 700258507H1 | g1519252 | 19 | −17 | gb105pln | *Oryza sativa* GF14-d protein mRNA, complete cds. |
| 700267893H1 | g1203905 | 14 | −2 | gb105eukp | M(1)15D; M(1)15D |
| 700268102H1 | g639494 | 22 | −10 | gb105pln | *Zea mays* Mu3 transposon in alcohol dehydrogenase (adh1) gene. |
| 700267583H1 | g22283 | 46 | −37 | gb105pln | *Zea mays* Glb1-L gene for vicilin-like embryo storage protein. |
| 700265556H1 | g1171351 | 22 | −2 | gb105pln | *Oryza sativa* 16 kDa oleosin (ole16) mRNA, complete cds. |
| 700262282H1 | g170746 | 66 | −53 | gb105pln | Wheat histone H4 TH091 gene, complete cds. |
| 700267812H1 | g971279 | 23 | −40 | gb105pln | Rice mRNA for RAB24 protein, complete cds. |
| 700263361H1 | g1532072 | 11 | 12 | gb105pln | *Z. mays* mRNA for S-adenosylmethionine decarboxylase. |
| 700261853H1 | g436032 | 47 | 3 | gb105eukp | 60S ribosomal protein L34 |
| 700263785H1 | g168512 | 39 | −33 | gb105pln | Maize major protein (L3) mRNA from the surface of lipid bodies, 3' end. |
| 700266877H1 | g22281 | 77 | −45 | gb105pln | *Zea mays* Glb1-0 gene for vicilin-like storage protein (truncated). |
| 700265131H1 | g2815519 | 32 | −28 | gb105pln | *Arabidopsis thaliana* BAC T5J8 from chromosome IV, top arm, complete sequence. |
| 700207243H1 | g1808678 | 10 | 2 | gb105allp | hypothetical protein |
| 700263520H1 | g435678 | 41 | −28 | gb105pln | *L. esculentum* Mill (cv. Rutgers) mRNA for ribosomal protein S25. |
| 700261304H1 | g397400 | 39 | −20 | gb105pln | *B. rapa* mRNA for S phase specific gene. |
| 700265468H1 | g1694832 | 19 | −31 | gb105pln | *H. vulgare* Per1 gene. |
| 700264143H1 | g857572 | 41 | −10 | gb105pln | *Oryza sativa* U2 small nuclear RNA (U2snRNA) gene, complete sequence. |
| 700258972H1 | g299814 | 29 | −15 | gb105pln | tuber-induction gene {3' region} [*Solanum tuberosum* = potatoes, cv. Desiree, leaves, mRNA Partial, 950 nt]. |
| 700261180H1 | g1546918 | 22 | −7 | gb105pln | *Z. mays* mRNA for translation initiation factor 5A. |
| 700267951H1 | g18890 | 54 | −12 | gb105pln | *H. vulgare* gene for aldose reductase-related protein. |
| 700261640H1 | g1658312 | 62 | −60 | gb105pln | *O. sativa* osr40g2 gene. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700266054H1 | g1906825 | 49 | −48 | gb105pln | *A. thaliana* hsp81.2 gene. |
| 700260596H2 | g2804278 | 69 | 5 | gb105allp | squalene epoxidase |
| 700261321H1 | g168579 | 96 | −71 | gb105pln | Maize pyruvate, orthophosphate dikinase mRNA, complete cds. |
| 700265509H1 | g2511530 | 56 | −55 | gb105pln | *Eleusine indica* alpha tubulin 1 (TUA1) mRNA, complete cds. |
| 700264263H1 | g595985 | 20 | −2 | gb105pln | *Dianthus caryophyllus* cysteine proteinase (DCCP1) mRNA, partial cds. |
| 700263284H1 | g1360212 | 18 | 6 | gb105eukp | ORF YLL029w |
| 700265891H1 | g1296954 | 48 | −24 | gb105pln | *O. sativa* mRNA for novel protein, osr40c1. |
| 700262985H1 | g535587 | 25 | −27 | gb105pln | *Arabidopsis thaliana* chaperone protein (atj) mRNA, complete cds. |
| 700256940H1 | g1129083 | 27 | 5 | gb105pln | Wheat mRNA for protein H2A, complete cds, clone wcH2A-2. |
| 700263826H1 | g1931640 | 10 | 8 | gb105eukp | T19D16.4; Serine carboxypeptidase isolog |
| 700261329H1 | g1685071 | 19 | 3 | gb105allp | ribosomal protein S5 |
| 700262616H1 | g2274983 | 60 | −58 | gb105pln | *Hordeum vulgare* mRNA for expressed sequence tag. |
| 700262891H1 | g1136574 | 28 | −8 | gb105pln | *Sorghum bicolor* heat shock protein 70 (hsp70) pseudogene. |
| 700262802H1 | g1929406 | 7 | 6 | gb105allp | protein phosphatase type 1 |
| 700259638H1 | g531096 | 12 | −5 | gb105eukp | TED2 |
| 700264989H1 | g1575129 | 89 | −72 | gb105pln | *Zea mays* lumenal binding protein cBiPe3 mRNA, complete cds. |
| 700260456H1 | g687244 | 18 | −37 | gb105pln | *Zea mays* oil body protein 16 kDa oleosin (ole16) gene, complete cds. |
| 700261141H1 | g469069 | 5 | 7 | gb105allp | NMDA receptor subunit NR2D |
| 700266677H1 | g1050839 | 22 | −2 | gb105pln | *S. tuberosum* mRNA for U1snRNP-specific protein (U1A). |
| 700264122H1 | g22285 | 44 | −66 | gb105pln | *Zea mays* Glb1-S gene for vicilin-like embryo storage protein. |
| 700265978H1 | g2231699 | 13 | 3 | gb105pln | *Arabidopsis thaliana* clathrin assembly protein AP19 homolog (AAP19-1) gene, complete cds. |
| 700263739H1 | g895845 | 7 | 8 | gb105allp | putative start codon |
| 700263380H1 | g927238 | 71 | −19 | gb105pln | *Zea mays* globulin1 (Glb1) gene, allele Glb1-Hb, complete cds. |
| 700260602H1 | g22461 | 36 | −3 | gb105pln | Maize RAB-17 gene. |
| 700258401H1 | g1184771 | 40 | −60 | gb105pln | *Zea mays* glyceraldehyde-3-phosphate dehydrogenase GAPC2 (gpc2) mRNA, complete cds. |
| 700260886H1 | g2632253 | 38 | −0 | gb105pln | *S. bicolor* mRNA for putative protein serine/threonine kinase, clone cSNFL2. |
| 700261004H1 | g2460180 | 9 | 6 | gb105allp | RNA binding protein |
| 700207242H1 | g2673868 | 22 | 3 | gb105eukp | fap1; putative role in cell division control; *fimbriata*-associated protein |
| 700258581H1 | g1143506 | 45 | −38 | gb105pln | *L. luteus* mRNA for P0 ribosomal protein. |
| 700259177H2 | g1777706 | 57 | −49 | gb105pln | *Zea mays* 18S ribosomal RNA gene, partial sequence. |
| 700261876H1 | g790969 | 50 | −43 | gb105pln | Rice mRNA for aldolase C-1, complete cds. |
| 700264329H1 | g836793 | 31 | −14 | gb105eukp | YFR038W |
| 700258640H1 | g463251 | 35 | −25 | gb105pln | *M. sativa* (Nagyszenasi) mRNA for ribosomal protein RL5. |
| 700266390H1 | g1679853 | 11 | 3 | gb105eukp | CCoAOMT-5; methylation of caffeoyl-CoA in lignin biosynthesis; caffeoyl-CoA O-methyltransferase 5; EC 2.1.1.104; S-adenosyl-L-methionine:caffeoyl-CoA O-methyltransferase |
| 700258781H1 | g987122 | 64 | −48 | gb105pln | *Z. mays* ZnRNA for class II metallothionein. |
| 700261393H1 | g22283 | 38 | −54 | gb105pln | *Zea mays* Glb1-L gene for vicilin-like embryo storage protein. |
| 700266550H1 | g1658314 | 13 | 12 | gb105pln | *O. sativa* osr40g3 gene. |
| 700257062H1 | g913941 | 6 | 7 | gb105eukp | btg-26 |
| 700207115H1 | g2209384 | 14 | 5 | gb105allp | glutathione reductase |
| 700258128H1 | g2673867 | 28 | −8 | gb105pln | *Antirrhinum majus* mRNA for *fimbriata*-associated protein 1, partial. |
| 700260178H1 | g687244 | 32 | −71 | gb105pln | *Zea mays* oil body protein 16 kDa oleosin (ole16) gene, complete cds. |
| 700261863H1 | g435239 | 11 | 4 | gb105allp | Auxin-induced mRNA |
| 700259517H1 | g2642446 | 38 | 6 | gb105eukp | T20D16.20; similar to auxin-responsive GH3 protein |
| 700267115H1 | g2288887 | 42 | −7 | gb105eukp | MVD1; mevaionate diphosphate |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | decarboxylase; EC 4.1.1.33 |
| 700260027H1 | g2398679 | 39 | 6 | gb105eukp | DS1; 3-deoxy-D-arabino-heptulosonate 7-phosphate synthase; EC 4.1.2.15 |
| 700266834H1 | g485376 | 63 | −52 | gb105pln | Zea mays alpha-3-tubulin gene, complete cds. |
| 700266410H1 | g790977 | 43 | −33 | gb105pln | B. juncea msams mRNA. |
| 700264748H1 | g1872162 | 21 | 2 | gb105pln | Arabidopsis thaliana DnaJ homolog (atj) mRNA, complete cds. |
| 700266939H1 | g22237 | 96 | −56 | gb105pln | Maize mRNA for cytosolic GAPDH (GapC) glyceraldehyde-3-phosphate dehydrogenase. |
| 700259177H2 | g168608 | 38 | −42 | gb105pln | Maize 17S ribosomal RNA gene and flanks. |
| 700261829H1 | g1777706 | 97 | −90 | gb105pln | Zea mays 18S ribosomal RNA gene, partial sequence. |
| 700258734H1 | g22281 | 53 | −51 | gb105pln | Zea mays Glb1-0 gene for vicilin-like storage protein (truncated). |
| 700266757H1 | g1302004 | 12 | 8 | gb105allp | ORF YNL096c |
| 700258915H1 | g1945282 | 34 | −8 | gb105pln | O. sativa mRNA for myb factor, 1402 bp. |
| 700260994H1 | g2723388 | 21 | 5 | gb105eukp | nMAPKK; mitogen activated protein kinase kinase |
| 700266936H1 | g1177345 | 40 | −11 | gb105eukp | rad15; Rad15 |
| 700265586H1 | g1872162 | 38 | −24 | gb105pln | Arabidopsis thaliana DnaJ homolog (atj) mRNA, complete cds. |
| 700264065H1 | g1532072 | 32 | −5 | gb105pln | Z. mays mRNA for S-adenosylmethionine decarboxylase. |
| 700258273H1 | g1155264 | 32 | −35 | gb105pln | Pennisetum ciliare possible apospory-associated protein mRNA, complete cds. |
| 700264280H1 | g22287 | 8 | 7 | gb105allp | vicilin-like embryo storage protein |
| 700267653H1 | g687244 | 52 | −85 | gb105pln | Zea mays oil body protein 16 kDa oleosin (ole16) gene, complete cds. |
| 700264823H1 | g161172 | 18 | −1 | gb105eukp | elongation factor 1-gamma |
| 700257306H1 | g218180 | 50 | −11 | gb105pln | Rice mRNA for oryzain alpha (EC 3.4.22). |
| 700265168H1 | g2668747 | 30 | −16 | gb105pln | Zea mays ribosomal protein L17 (rp117) mRNA, complete cds. |
| 700264207H1 | g687244 | 73 | −32 | gb105pln | Zea mays oil body protein 16 kDa oleosin (ole16) gene, complete cds. |
| 700257073H1 | g1185553 | 35 | −6 | gb105pln | Zea mays glyceraldehyde-3-phosphate dehydrogenase (gpc2) gene, complete cds. |
| 700266294H1 | g2649395 | 13 | 2 | gb105allp | 3-hydroxyacyl-CoA dehydrogenase (hbd-7) |
| 700266475H1 | g1575127 | 100 | −49 | gb105pln | Zea mays lumenal binding protein cBiPe2 mRNA, complete cds. |
| 700260015H1 | g286011 | 11 | 8 | gb105allp | KIAA0002 |
| 700261817H1 | g602605 | 24 | −76 | gb105pln | Zea mays tandem genes for alpha1-tubulin and alpha2-tubulin. |
| 700258722H1 | g1657854 | 9 | 16 | gb105pln | Triticum aestivum cold acclimation protein WCOR413 (Wcor413) mRNA, complete cds. |
| 700258507H1 | g1519248 | 9 | 11 | gb105pln | Oryza sativa GF14-b protein mRNA, complete cds. |
| 700262345H1 | g168512 | 38 | −34 | gb105pln | Maize major protein (L3) mRNA from the surface of lipid bodies, 3' end. |
| 700257244H1 | g1171351 | 29 | −7 | gb105pln | Oryza sativa 16 kDa oleosin (ole16) mRNA, complete cds. |
| 700258002H1 | g577818 | 70 | −60 | gb105pln | Z. mays gene for H2B histone (gH2B4) |
| 700262942H1 | g290275 | 38 | −11 | gb105eukp | M(3)95A; multifunctional activity and location; ribosomal protein S3/AP endonuclease DNA repair protein |
| 700262889H1 | g971279 | 68 | −23 | gb105pln | Rice mRNA for RAB24 protein, complete cds. |
| 700257793H1 | g168512 | 30 | −13 | gb105pln | Maize major protein (L3) mRNA from the surface of lipid bodies, 3' end. |
| 700266773H1 | g2642427 | 34 | −27 | gb105pln | Arabidopsis thaliana chromosome II BAC T20D16 genomic sequence, complete sequence. |
| 700257103H1 | g902526 | 71 | −83 | gb105pln | Zea mays clone MubG7 ubiquitin fusion protein gene, complete cds. |
| 700258331H1 | g1399567 | 23 | −48 | gb105pln | Podophyllum peitatum nuclear 26S ribosomal RNA gene, partial sequence. |
| 700257032H1 | g558648 | 30 | 4 | gb105eukp | D-myo-inositol-3-phosphate |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | synthase; EC 5.5.1.4 |
| 700256853H1 | g687244 | 37 | −66 | gb105pln | Zea mays oil body protein 16 kDa oleosin (ole16) gene, complete cds. |
| 700264777H1 | g1694832 | 31 | −45 | gb105pln | H. vulgare Per1 gene. |
| 700261439H1 | g168403 | 43 | −40 | gb105pln | Maize actin 1 gene (MAc1), complete cds. |
| 700266251H1 | g514945 | 98 | −96 | gb105pln | Zea mays sucrose synthase (Sus1) mRNA, complete cds. |
| 700264530H1 | g2150129 | 40 | −32 | gb105pln | Arabidopsis thaliana cytoplasmic ribosomal protein S15a mRNA, complete cds. |
| 700264459H1 | g35768 | 7 | 6 | gb105allp | polypirimidine tract binding protein |
| 700258188H1 | g207905 | 10 | 3 | gb105allp | alpha globulin B |
| 700207257H1 | g444046 | 71 | −2 | gb105pln | Z. mays OBF1 mRNA for ocs-element binding factor 1. |
| 700265974H1 | g1620981 | 43 | −36 | gb105pln | N. plumbaginifolia mRNA for 40S ribosomal protein S5. |
| 700259835H1 | g300418 | 39 | −27 | gb105pln | aspartate aminotransferase isozyme 5 [Glycine max = soybeans, cv. Century, mRNA, 1755 nt]. |
| 700266894H1 | g2218151 | 34 | 1 | gb105pln | Vigna unguiculata type IIIa membrane protein cp-wap13 mRNA, complete cds. |
| 700258249H1 | g22270 | 75 | −69 | gb105pln | Maize mRNA from an embryogenic abscisic acid-inducible gene. |
| 700262914H1 | g2647409 | 14 | 10 | gb105pln | Yeast (Schizosaccharomyces pombe) mRNA for ribosomal protein L18, partial cds. |
| 700258249H1 | g19016 | 24 | −2 | gb105pln | H. vulgare mRNA for LEA B19.4 protein. |
| 700258863H1 | g1498628 | 42 | −35 | gb105pln | Arabidopsis thaliana p40 protein homolog mRNA, complete cds. |
| 700261128H1 | g499655 | 16 | 3 | gb105allp | gamma-thionin homolog |
| 700263778H1 | g609287 | 20 | −44 | gb105pln | Z. diploperennis Grandel gene. |
| 700264274H1 | g396209 | 24 | −4 | gb105pln | S. polyrrhiza mRNA for D-myo-inositol-3-phosphate synthase. |
| 700262825H1 | g687244 | 83 | −27 | gb105pln | Zea mays oil body protein 16 kDa oleosin (ole16) gene, complete cds. |
| 700262937H1 | g2264309 | 13 | 13 | gb105pln | Arabidopsis thaliana genomic DNA, chromosome 5, P1 clone: MJJ3, complete sequence. |
| 700256848H1 | g493220 | 5 | 8 | gb105eukp | LHP1 |
| 700265656H1 | g349194 | 13 | 5 | gb105allp | bps. 390 . . . 881 = homology to E. coli recQ; bps. 414 . . . 430 = ATP binding site |
| 700264733H1 | g170772 | 63 | −55 | gb105pln | Triticum aestivum S-adenosyl-L-homocysteine hydrolase (SH6.2) mRNA, complete cds. |
| 700265759H1 | g633889 | 32 | −31 | gb105pln | glucose and ribitol dehydrogenase homolog [Hordeum vulgare = barley, Aura, embryo, mRNA, 1170 nt]. |
| 700263773H1 | g5056 | 25 | −5 | gb105pln | Yeast (Saccharomyces pombe) rpgL29 gene for ribosomal protein L29. |
| 700262985H1 | g18259 | 27 | −28 | gb105pln | C.sativus mRNA for cs DnaJ-1. |
| 700262834H1 | g453188 | 98 | −82 | gb105pln | Z. mays acp mRNA for acyl carrier protein. |
| 700264784H1 | g406050 | 20 | −1 | gb105pln | Yeast (Schizosaccharomyces pombe) Let1 (let1) gene, complete cds. |
| 700265019H1 | g1707366 | 10 | 6 | gb105eukp | RSp31; splicing factor |
| 700267876H1 | g416252 | 31 | −40 | gb105pln | Rice mRNA for 3-deoxy-D-arabino-heptulosonate 7-phosphate synthase, partial sequence. |
| 700256909H1 | g168419 | 86 | −83 | gb105pln | Maize (Z. mays) aidolase mRNA, complete cds. |
| 700260407H1 | g140105S | 7 | 4 | gb105allp | SUPT4H |
| 700266094H1 | g1272407 | 34 | −23 | gb105pln | Arabidopsis thaliana immunophilin (FKBP15-2) mRNA, complete cds. |
| 700264881H1 | g2791540 | 17 | −5 | gb105eukp | H19N07.2a |
| 700263983H1 | g841464 | 26 | −12 | gb105eukp | RFC2; RFC is a DNA binding protein and ATPase that acts as a processivity factor for DNA polymerases delta and epsilon and loads proliferating cell nuclear antigen (PCNA) on DNA; Rfc2p; Replication Factor C subunit 2 |
| 700264542H1 | g2190545 | 47 | 5 | gb105eukp | F5I14.8 |
| 700264341H1 | g2194132 | 42 | −25 | gb105eukp | F20P5.21 |
| 700262548H1 | g1403043 | 14 | 6 | gb105pln | H. chilense × T. turgidum conv. durum (Tritordeum) mRNA for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | S-adenosylmethionine decarboxylase. |
| 700263983H1 | g1039340 | 26 | −14 | gb105eukp | SPAC23D3.C2; unknown |
| 700258294H1 | g168481 | 8 | 7 | gb105eukp | globulin precursor |
| 700258538H1 | g2414402 | 12 | −2 | gb105eukp | Y57G11C.15 |
| 700259656H1 | g1181330 | 59 | −59 | gb105pln | Z. mays CNX mRNA. |
| 700263889H1 | g2766452 | 14 | 7 | gb105eukp | CYP71E1; second multifunctional cytochrome P450 in the biosynthetic pathway of the cyanogenic glucoside dhurrin. Catalyzes the conversion of p-hydroxyphenyl-acetaldoxime to p-hydroxymandelonitrile; cytochrome P450 CYP71E1 |
| 700262348H1 | g2114027 | 14 | 1 | gb105eukp | ntf-2; putative nuclear transport factor 2 |
| 700267192H1 | g2827142 | 35 | −35 | gb105pln | Arabidopsis thaliana cellulose synthase catalytic subunit (Ath-B) mRNA, complete cds. |
| 700259646H1 | g1171351 | 37 | −27 | gb105pln | Oryza sativa 16 kDa oleosin (ole16) mRNA, complete cds. |
| 700266177H1 | g1906603 | 20 | −1 | gb105pln | Zea mays ACCase gene, intron containing colonist1 and colonist2 retrotransposons and reverse transcriptase pseudogene, complete sequence. |
| 700264178H1 | g22281 | 62 | −25 | gb105pln | Zea mays Glb1-0 gene for vicilin-like storage protein (truncated). |
| 700266567H1 | g1370284 | 33 | −22 | gb105pln | P. sativum mRNA for glutathione reductase. |
| 700260555H2 | g308906 | 23 | −10 | gb105eukp | unknown; thioredoxin |
| 700263113H1 | g21732 | 35 | 8 | gb105pln | Wheat mRNA for Em protein. |
| 700261331H1 | g2570504 | 34 | −11 | gb105pln | Oryza sativa proteasome component mRNA, complete cds. |
| 700261762H1 | g2244904 | 22 | 5 | gb105eukp | similar to hypothetical protein C02F5.7 - Caenorha |
| 700259018H1 | g170031 | 34 | −27 | gb105eukp | nodulin 35 |
| 700265663H1 | g22484 | 65 | −62 | gb105pln | Z. mays RNA for superoxide dismutase Sod4A. |
| 700258006H1 | g1321660 | 44 | −54 | gb105pln | Rice mRNA for ascorbate peroxidase, complete cds. |
| 700261729H1 | g22281 | 33 | 16 | gb105pln | Zea mays Glb1-0 gene for vicilin-like storage protein (truncated). |
| 700266058H1 | g2570506 | 36 | −20 | gb105pln | Oryza sativa ribosomal protein mRNA, complete cds. |
| 700268179H1 | g1006731 | 24 | −18 | gb105eukp | CCT3 |
| 700267995H1 | g927239 | 8 | 7 | gb105allp | globulin1 |
| 700261634H1 | g22281 | 58 | −27 | gb105pln | Zea mays Glb1-0 gene for vicilin-like storage protein (truncated). |
| 700268130H1 | g927239 | 6 | 6 | gb105allp | globulin1 |
| 700257513H1 | g575354 | 60 | −19 | gb105pln | O. sativa SC34 mRNA for tumor suppressor. |
| 700256728H1 | g297172 | 5 | 7 | gb105allp | ribosomal protein S7 |
| 700258192H1 | g899607 | 74 | −62 | gb105pln | Zea mays polyubiquitin (MubC5) mRNA, complete cds. |
| 700257033H1 | g18260 | 30 | −2 | gb105eukp | cs DnaJ-1 |
| 700267536H1 | g168508 | 41 | −11 | gb105pln | Maize oleosin KD18 (KD18; L2) gene, complete cds. |
| 700263168H1 | g179057 | 25 | −5 | gb105allp | argininosuccinate synthetase |
| 700257219H1 | g22283 | 44 | 5 | gb105pln | Zea mays Glb1-L gene for vicilin-like embryo storage protein. |
| 700261321H1 | g168584 | 50 | −66 | gb105pln | Corn pyruvate, orthophosphate dikinase gene, exons 2–19. |
| 700263701H1 | g473877 | 28 | −25 | gb105pln | Arabidopsis thaliana Columbia calnexin homolog gene, complete cds. |
| 700257449H2 | g1184771 | 49 | −26 | gb105pln | Zea mays glyceraldehyde-3-phosphate dehydrogenase GAPC2 (gpc2) mRNA, complete cds. |
| 700263872H1 | g687244 | 45 | −82 | gb105pln | Zea mays oil body protein 16 kDa oleosin (ole16) gene, complete cds. |
| 700267015H1 | g886470 | 36 | −11 | gb105pln | C. roseus MetE mRNA for methionine synthase. |
| 700265772H1 | g854177 | 14 | −10 | gb105allp | RNA polymerase II subunit hRPB17 |
| 700264407H1 | g1724112 | 22 | 6 | gb105allp | ABA induced plasma membrane protein PM 19 |
| 700265588H1 | g168512 | 28 | −23 | gb105pln | Maize major protein (L3) mRNA from the surface of lipid bodies, 3' end. |
| 700262360H1 | g1895083 | 60 | −74 | gb105pln | Zea mays golgi associated protein se-wap41 mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700257237H1 | g2618731 | 48 | −1 | gb105eukp | IAA21; IAA21 |
| 700263025H1 | g454872 | 43 | −18 | gb105pln | Maize mRNA for group 3 Lea protein MGL3, complete cds. |
| 700267360H1 | g1067050 | 14 | 5 | gb105eukp | K10G9.1 |
| 700266345H1 | g2642429 | 35 | 2 | gb105allp | putative poly(A)-binding protein |
| 700265857H1 | g1209700 | 47 | −53 | gb105pln | *Zea mays* ribosomal protein L12 mRNA, complete cds. |
| 700257977H1 | g313266 | 31 | −14 | gb105pln | *T. aestivum* gene for phosphoglycerate kinase. |
| 700263778H1 | g1617470 | 45 | −50 | gb105pln | *Z. diploperennis* DNA for Grandel-4 retrotransposon. |
| 700266629H1 | g2632129 | 13 | 4 | gb105allp | poly(ADP-ribose) polymerase |
| 700267188H1 | g2656024 | 15 | 10 | gb105pln | *Arabidopsis thaliana* genomic DNA, chromosome 5, TAC clone: K15E6. |
| 700267613H1 | g2673901 | 18 | −13 | gb105pln | *Arabidopsis thaliana* chromosome II BAC T24P15 genomic sequence, complete sequence. |
| 700257176H1 | g2463334 | 25 | −35 | gb105pln | *Oryza sativa* mRNA for ribosomal protein S4. |
| 700259173H2 | g398498 | 15 | −9 | gb105eukp | FAB1; Fab1p |
| 700260508H1 | g450353 | 19 | 15 | gb105pln | *H. vulgare* (cv Bomi) gB19.1b gene. |
| 700266237H1 | g2668741 | 59 | −59 | gb105pln | *Zea mays* glycine-rich RNA binding protein (GRP) mRNA, complete cds. |
| 700259574H1 | g927238 | 46 | −64 | gb105pln | *Zea mays* globulin1 (Glb1) gene, allele Glb1-Hb, complete cds. |
| 700256988H1 | g169295 | 28 | 15 | gb105pln | Pharbitis nil heat shock protein 83 (Hsp83) gene, complete cds. |
| 700266524H1 | g520935 | 22 | −28 | gb105pln | *H. vulgare* mRNA for gamma-TIP-like protein. |
| 700266237H1 | g2293479 | 40 | −34 | gb105pln | *Oryza sativa* glycine-rich protein mRNA, complete cds. |
| 700265454H1 | g2104446 | 30 | −14 | gb105eukp | SPAC57A7.11; unknown |
| 700268092H1 | g450484 | 70 | −60 | gb105pln | Rice mRNA for soluble starch synthase, complete cds. |
| 700264356H1 | g217826 | 33 | −26 | gb105pln | *A. thaliana* mRNA for AHBP-1b, complete cds. |
| 700257133H1 | g1694832 | 35 | −49 | gb105pln | *H. vulgare* Per1 gene. |
| 700260359H2 | g340520 | 29 | −1 | gb105pln | *Coptis japonica* triosphosphate isomerase mRNA, complete cds. |
| 700266482H1 | g2191134 | 11 | 5 | gb105eukp | A_IG002N01.13 |
| 700258617H1 | g2511530 | 41 | −42 | gb105pln | *Eleusine indica* alpha tubulin 1 (TUA1) mRNA, complete cds. |
| 700266252H1 | g168423 | 69 | −82 | gb105pln | *Zea mays* polypeptide chain-binding protein mRNA, 3' end. |
| 700258617H1 | g602605 | 43 | −56 | gb105pln | *Zea mays* tandem genes for alpha1-tubulin and alpha2-tubulin. |
| 700264428H1 | g22287 | 7 | 8 | gb105allp | vicilin-like embryo storage protein |
| 700263072H1 | g927238 | 66 | −42 | gb105pln | *Zea mays* globulin1 (Glb1) gene, allele Glb1-Hb, complete cds. |
| 700262586H1 | g928931 | 27 | −39 | gb105pln | *A. thaliana* mRNA for putative dTDP-glucose 4-6-dehydratases. |
| 700261692H1 | g22281 | 50 | −46 | gb105pln | *Zea mays* Glb1-0 gene for vicilin-like storage protein (truncated). |
| 700258678H1 | g687246 | 55 | −53 | gb105pln | *Zea mays* oil body protein 17 kDa oleosin (ole17) gene, complete cds. |
| 700267211H1 | g602605 | 36 | −63 | gb105pln | *Zea mays* tandem genes for alpha1-tubulin and alpha2-tubulin. |
| 700259639H1 | g218112 | 66 | −59 | gb105pln | Rice mRNA for ribosomal protein L41 (340 gene), partial sequence |
| 700263263H1 | g2288968 | 72 | −64 | gb105pln | *Zea mays* mRNA for glutathione transferase. |
| 700262515H1 | g2244749 | 17 | −12 | gb105eukp | hydroxymethyltransferase |
| 700266221H1 | g2668739 | 64 | −46 | gb105pln | *Zea mays* translation initiation factor GOS2 (TIF) mRNA, complete cds. |
| 700267310H1 | g19572 | 32 | −19 | gb105pln | *M. sativa* C29 mRNA for snRNP-related protein. |
| 700257993H1 | g2154716 | 29 | −17 | gb105pln | *A. thaliana* mRNA for Kap alpha protein. |
| 700262958H1 | g17127 | 26 | 4 | gb105allp | ribosomal protein S4 like |
| 700257406H2 | g602252 | 96 | −99 | gb105pln | *Zea mays* enolase (eno2) mRNA, complete cds. |
| 700262466H1 | g416499 | 6 | 6 | gb105allp | globulin |
| 700263975H1 | g397395 | 66 | −54 | gb105pln | *Z. mays* MNB1b mRNA for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700258184H1 | g1086831 | 14 | −3 | gb105eukp | DNA-binding protein. F10E7.7 |
| 700258650H1 | g2688822 | 9 | 4 | gb105allp | pyrophosphate-dependent phosphofructo-1-kinase |
| 700267621H1 | g1171351 | 8 | 0 | gb105pln | *Oryza sativa* 16 kDa oleosin (ole16) mRNA, complete cds. |
| 700258381H1 | g2314600 | 13 | −2 | gb105allp | conserved hypothetical protein |
| 700261568H1 | g687244 | 48 | −26 | gb105pln | *Zea mays* oil body protein 16 kDa oleosin (ole16) gene, complete cds. |
| 700266024H1 | g22149 | 86 | −3 | gb105pln | *Z. mays* mRNA for alpha-tubulin 3. |
| 700257022H1 | g498739 | 59 | −24 | gb105pln | *H. vulgare* (pMaW22) mRNA for beta-ketoacyl-ACP synthase. |
| 700258392H1 | g2739010 | 17 | −14 | gb105eukp | CYP77A3; CYP77A3p |
| 700267211H1 | g2511530 | 55 | −52 | gb105pln | *Eleusine indica* alpha tubulin 1 (TUA1) mRNA, complete cds. |
| 700266701H1 | g1546918 | 38 | −8 | gb105pln | *Z. mays* mRNA for translation initiation factor 5A. |
| 700262577H1 | g1514981 | 11 | 5 | gb105eukp | coacts with chalcone synthase to produce 6'-deoxychalcone; polyketide reductase (GGPKR2) |
| 700259586H1 | g20320 | 21 | 4 | gb105allp | rab25 product |
| 700266874H1 | g22284 | 15 | 4 | gb105eukp | Glb1-L; vicilin-like embryo storage protein |
| 700258817H1 | g168512 | 27 | −48 | gb105pln | Maize major protein (L3) mRNA from the surface of lipid bodies, 3' end. |
| 700265568H1 | g2286152 | 67 | −56 | gb105pln | *Zea mays* cytoplasmic malate dehydrogenase mRNA, complete cds. |
| 700264606H1 | g22747 | 15 | 8 | gb105pln | *L. longiflorum* mRNA for actin depolymerizing factor. |
| 700261685H1 | g786322 | 32 | −14 | gb105eukp | VPS4; Vps4p |
| 700257044H1 | g1181672 | 61 | −32 | gb105pln | *Sorghum bicolor* heat shock protein 70 cognate (hsc70) mRNA, partial cds. |
| 700259384H1 | g17931 | 21 | −32 | gb105pln | *B. secalinas* embryo-specific mRNA. |
| 700263958H1 | g1546918 | 40 | −46 | gb105pln | *Z. mays* mRNA for translation initiation factor 5A. |
| 700263915H1 | g2842492 | 18 | 5 | gb105eukp | F21O9.180; protein kinase Xa21 homolog |
| 700261867H1 | g1206013 | 14 | −1 | gb105eukp | glu2; beta-D-glucosidase precursor |
| 700263123H1 | g687244 | 82 | −23 | gb105pln | *Zea mays* oil body protein 16 kDa oleosin (ole16) gene, complete cds. |
| 700265395H1 | g2190991 | 17 | 5 | gb105pln | *Aegilops squarrosa* glutathione S-transferase TSI-1 mRNA, complete cds. |
| 700267925H1 | g927238 | 52 | −63 | gb105pln | *Zea mays* globulin1 (Glb1) gene, allele Glb1-Hb, complete cds. |
| 700258730H1 | g2828278 | 39 | −39 | gb105pln | *Arabidopsis thaliana* DNA chromosome 4, BAC clone T18B16 (ESSAII project). |
| 700262650H1 | g2267005 | 43 | −3 | gb105pln | *Oryza sativa* endosperm lumenal binding protein (BiP) mRNA, complete cds. |
| 700266537H1 | g1550813 | 81 | −82 | gb105pln | *Z. mays* mRNA for acidic ribosomal protein P0. |
| 700266540H1 | g2282583 | 97 | −45 | gb105pln | *Zea mays* elongation factor 1-alpha (EF1-A) mRNA, complete cds. |
| 700264757H1 | g22118 | 43 | −79 | gb105pln | *Z. mays* DNA for Adh1-Cm allele. |
| 700257403H2 | g2828184 | 24 | −31 | gb105pln | *Arabidopsis thaliana* genomic DNA, chromosome 5, P1 clone: MSN9, complete sequence. |
| 700262018H1 | g20323 | 29 | −29 | gb105pln | *O. sativa* RAc1 gene for actin. |
| 700264769H1 | g248336 | 78 | −85 | gb105pln | polyubiquitin [maize, Genomic, 3841 nt]. |
| 700264753H1 | g1770020 | 59 | −48 | gb105pln | *Oryza sativa* S-adenosyl-L-methionine synthetase (pOS-SAMS2) mRNA, complete cds. |
| 700264293H1 | g2668743 | 29 | −9 | gb105pln | *Zea mays* ubiquitin conjugating enzyme (UBC) mRNA, complete cds. |
| 700263019H1 | g2301337 | 19 | 5 | gb105allp | unnamed protein product |
| 700267546H1 | g2244786 | 13 | 4 | gb105eukp | ribonucleoprotein homolog |
| 700262908H1 | g167244 | 20 | −30 | gb105pln | *Chlorella kessleri* elongation factor 2 mRNA, complete cds. |
| 700262292H1 | g1518539 | 40 | −18 | gb105pln | *Glycine max* UDP-glucose dehydrogenase mRNA, complete cds. |
| 700259377H1 | g22119 | 95 | −84 | gb105pln | Maize Adh1-F mRNA for alcohol dehydrogenase. |
| 700256951H1 | g2624211 | 40 | 2 | gb105pln | *M. acuminata* mRNA; clone pBAN |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | UU131. |
| 700257127H1 | g22281 | 72 | −81 | gb105pln | *Zea mays* Glb1-0 gene for vicilin-like storage protein (truncated). |
| 700267720H1 | g1216483 | 37 | −39 | gb105pln | *Arabidopsis thaliana* dual specificity kinase 1 (ADK1) mRNA, complete cds. |
| 700265821H1 | g790640 | 17 | 4 | gb105pln | *Hordeum vulgare* gamma-thionin (HTH3) mRNA, complete cds. |
| 700264296H1 | g555943 | 26 | 6 | gb105allp | ribosomal protein 53 |
| 700265029H1 | g973312 | 18 | 2 | gb105pln | *Arabidopsis thaliana* myo-inositol 1-phosphate synthase isozyme-2 mRNA, complete cds. |
| 700262560H1 | g2190558 | 17 | −7 | gb105eukp | F5I14.14; F5I14.14 |
| 700258323H1 | g168466 | 29 | −18 | gb105pln | Corn late embryogenesis-abundant protein (EMB5) mRNA, complete cds. |
| 700258488H1 | g21834 | 57 | −29 | gb105pln | Wheat mRNA for cytosolic phosphoglycerate kinase (EC 2.7.2.3) |
| 700258038H1 | g886470 | 55 | −42 | gb105pln | *C. roseus* MetE mRNA for methionine synthase. |
| 700257937H1 | g758352 | 83 | −82 | gb105pln | *Z. mays* mRNA for cysteine synthase. |
| 700266288H1 | g2792305 | 22 | −8 | gb105pln | *Arabidopsis thaliana* putative aldehyde oxidase (AO2) mRNA, partial cds. |
| 700263638H1 | g2673868 | 15 | 0 | gb105allp | *fimbriata*-associated protein |
| 700261437H1 | g899607 | 48 | −31 | gb105pln | *Zea mays* polyubiquitin (MubC5) mRNA, complete cds. |
| 700259846H1 | g2529386 | 19 | −16 | gb105pln | *Zea mays* triosephosphate isomerase 1 gene, exon 2-9 and complete cds. |
| 700265046H1 | g438279 | 26 | −2 | gb105allp | Ribosomal protein L7 |
| 700264055H1 | g1370450 | 21 | −7 | gb105eukp | ORF YPL217c |
| 700267749H1 | g596079 | 93 | −40 | gb105pln | *Zea mays* thiamine biosynthetic enzyme (thi1-2) mRNA, complete cds. |
| 700266294H1 | g559411 | 8 | 2 | gb105eukp | B0272.3 |
| 700258134H1 | g927238 | 39 | −45 | gb105pln | *Zea mays* globulin1 (Glb1) gene, allele Glb1-Hb, complete cds. |
| 700257248H1 | g473877 | 49 | −1 | gb105pln | *Arabidopsis thaliana* Columbia calnexin homolog gene, complete cds. |
| 700258895H1 | g1155212 | 27 | −34 | gb105pln | *Avena fatua* aldose reductase-related protein mRNA, complete cds. |
| 700256796H1 | g1532072 | 92 | −85 | gb105pln | *Z. mays* mRNA for S-adenosylmethionine decarboxylase. |
| 700260182H1 | g22484 | 47 | −65 | gb105pln | *Z. mays* RNA for superoxide dismutase Sod4A. |
| 700257857H1 | g454872 | 27 | −23 | gb105pln | Maize mRNA for group 3 Lea protein MGL3, complete cds. |
| 700263504H1 | g1125691 | 52 | 3 | gb105allp | DnaJ protein |
| 700263019H1 | g1055045 | 22 | 3 | gb105eukp | C06A8.1 |
| 700258273H1 | g1842068 | 21 | −13 | gb105pln | *Mesembryanthemum crystallinum* Nt-rab7a homolog mRNA, complete cds. |
| 700266423H1 | g1408296 | 27 | −6 | gb105eukp | pgmA; phosphoglucomutase A |
| 700258735H1 | g473603 | 18 | 7 | gb105eukp | histone H2A |
| 700267772H1 | g1667591 | 72 | −72 | gb105pln | *Oryza sativa* histone 3 mRNA, complete cds. |
| 700262163H1 | g1667593 | 45 | −28 | gb105pln | *Oryza sativa* transmembrane protein mRNA, complete cds. |
| 700256988H1 | g300082 | 36 | 11 | gb105pln | hsp82 = 82 kda heat shock protein [*Zea mays*, seedling, leaves, Genomic, 3468 nt]. |
| 700263311H1 | g1173622 | 10 | 1 | gb105eukp | homeobox protein |
| 700262908H1 | g2369713 | 30 | −43 | gb105pln | *Beta vulgaris* cDNA for elongation factor 2. |
| 700262412H1 | g21832 | 40 | −25 | gb105pln | Wheat mRNA for chloroplast phosphoglycerate kinase (EC 2.7.2.3). |
| 700264564H1 | g1171351 | 20 | 3 | gb105pln | *Oryza sativa* 16 kDa oleosin (ole16) mRNA, complete cds. |
| 700256940H1 | g473602 | 26 | 2 | gb105pln | *Zea mays* W-22 histone H2A mRNA, complete cds. |
| 700265590H1 | g736271 | 71 | −61 | gb105pln | *O. sativa* hsp70 gene for heat shock protein 70. |
| 700207240H1 | g687244 | 85 | −1 | gb105pln | *Zea mays* oil body protein 16 kDa oleosin (ole16) gene, complete cds. |
| 700264837H1 | g2335091 | 20 | −20 | gb105eukp | T11A07.2; GMP kinase isolog |
| 700260255H1 | g2828182 | 36 | −5 | gb105pln | *Arabidopsis thaliana* genomic DNA, chromosome 5, Pi clone: MOJ9, complete sequence. |
| 700263873H1 | g2746231 | 23 | −43 | gb105pln | *Gossypium hirsutum* glutathione |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | peroxidase mRNA, partial cds. |
| 700261176H1 | g2765318 | 33 | −19 | gb105eukp | AS2; asparagine synthetase 2 |
| 700264552H1 | g2244950 | 31 | −19 | gb105pln | *Arabidopsis thaliana* DNA chromosome 4, ESSA I contig fragment No. 5. |
| 700207219H1 | g172556 | 11 | 14 | gb105pln | Yeast (*Saccharomyces cerevisiae*) succinate dehydrogenase (SDHA) gene, complete cds. |
| 700265487H1 | g416146 | 87 | −74 | gb105pln | *Zea mays* beta-6 tubulin (tub6) gene and mRNA, complete cds. |
| 700258473H1 | g21233 | 55 | −22 | gb105pln | *S. oleracea* AHRI mRNA for acetohydroxy acid reductoisomerase. |
| 700258429H1 | g1747418 | 55 | −77 | gb105pln | *Z. mays* mRNA for eukaryotic initiation factor-5. |
| 700264750H1 | g927238 | 38 | −36 | gb105pln | *Zea mays* globulin1 (Glb1) gene, allele Glb1-Hb, complete cds. |
| 700265072H1 | g804655 | 20 | 0 | gb105pln | *Hordeum vulgare* L. beta-glucosidase (BGQ60) gene, complete cds. |
| 700267966H1 | g987122 | 40 | 6 | gb105pln | *Z. mays* mRNA for class II metallothionein. |
| 700262208H1 | g2564051 | 27 | −13 | gb105pln | *Arabidopsis thaliana* genomic DNA, chromosome 5, P1 clone: MWD9, complete sequence. |
| 700267631H1 | g22302 | 39 | −76 | gb105pln | Maize Gpc1 gene for glyceraldehyde-3-phosphate dehydrogenase (GADPH) subunit C. |
| 700265968H1 | g1272680 | 13 | 0 | gb105eukp | YTA7 |
| 700264293H1 | g297877 | 28 | −8 | gb105pln | *A. thaliana* UBC10 mRNA for ubiquitin conjugating enzyme homolog. |
| 700262943H1 | g671655 | 12 | −2 | gb105pln | *S. vulgare* gene for gamma-kafirin. |
| 700257382H1 | g1622938 | 22 | −1 | gb105pln | *Bromus secalinus* oleosin (ole16) mRNA, complete cds. |
| 700266307H1 | g1480017 | 23 | −8 | gb105pln | *Brassica rapa* mRNA for ribosomal protein, complete cds. |
| 700263472H1 | g558364 | 45 | −54 | gb105pln | *Z. mays* mRNA for ADF-glucose pyrophosphorylase. |
| 700264295H1 | g2505865 | 14 | −1 | gb105eukp | putative topoisomerase |
| 700266691H1 | g633889 | 18 | 9 | gb105pln | glucose and ribitol dehydrogenase homolog [*Hordeum vulgare* = barley, Aura, embryo, mRNA, 1170 nt]. |
| 700257338H1 | g311238 | 98 | −47 | gb105pln | Z mays cat1 gene for catalase 1. |
| 700266666H1 | g20000 | 25 | −12 | gb105pln | *N. tabacum* RL2 mRNA for 60S ribosomal protein L2. |
| 700267720H1 | g1103321 | 36 | −37 | gb105pln | *A. thaliana* CK13 mRNA for casein kinase I. |
| 700260122H1 | g469069 | 4 | 7 | gb105allp | NMDA receptor subunit NR2D |
| 700264492H1 | g1171351 | 13 | 14 | gb105pln | *Oryza sativa* 16 kDa oleosin (ole16) mRNA, complete cds. |
| 700264312H1 | g1519248 | 29 | −14 | gb105pln | *Oryza sativa* GF14-b protein mRNA, complete cds. |
| 700266194H1 | g425807 | 29 | −15 | gb105pln | Rice mRNA for protein phosphatase (gene name AD733), partial cds. |
| 700264257H1 | g758246 | 40 | −12 | gb105pln | *Phalaenopsis* sp. mRNA for S-adenosyhomocysteine hydrolase. |
| 700264255H1 | g790969 | 63 | −60 | gb105pln | Rice mRNA for aldolase C-1, complete cds. |
| 700258408H1 | g2282583 | 70 | −61 | gb105pln | *Zea mays* elongation factor 1-alpha (EF1-A) mRNA, complete cds. |
| 700260024H1 | g415314 | 22 | −1 | gb105pln | Rice mRNA for NADP dependent malic enzyme, complete cds. |
| 700267080H1 | g1276758 | 14 | −0 | gb105eukp | rpi13; 50S ribosomal protein L13 |
| 700263675H1 | g1213557 | 8 | 2 | gb105eukp | T14F9.1 |
| 700263630H1 | g168512 | 43 | −50 | gb105pln | Maize major protein (L3) mRNA from the surface of lipid bodies, 3' end. |
| 700261320H1 | g435174 | 59 | −42 | gb105pln | *A. sativa* (Pewi) ASTCP-K36 mRNA for t complex polypeptide 1. |
| 700264504H1 | g168481 | 8 | 7 | gb105allp | globulin precursor |
| 700257148H1 | g2832658 | 20 | −4 | gb105eukp | F28J12.190; putative protein |
| 700262547H1 | g1679852 | 20 | −3 | gb105pln | *N. tabacum* mRNA for caffeoyl-CoA o-methyltransferase 5. |
| 700258280H1 | g468263 | 15 | 12 | gb105pln | *Arabidopsis thaliana* casein kinase II beta subunit CKB1 mRNA, complete cds. |
| 700263640H1 | g463269 | 21 | 4 | gb105eukp | YBL0410 |
| 700257974H1 | g168480 | 57 | −52 | gb105pln | Maize embryo globulin S allele (7S-like) mRNA, complete cds. |
| 700263988H1 | g2246376 | 12 | 6 | gb105allp | b-Zip DNA binding protein |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700262623H1 | g21734 | 17 | −3 | gb105pln | *T. aestivum* (cDNA I) mRNA for EC protein. |
| 700260869H1 | g2738948 | 35 | −14 | gb105pln | *Fragaria × ananassa* cytosolic ascorbate peroxidase (APX-c) mRNA, complete cds. |
| 700263890H1 | g2624219 | 35 | −19 | gb105pln | *M. acuminata* mRNA; clone pBAN UD75. |
| 700262774H1 | g927239 | 13 | 3 | gb105eukp | Glb1; globulin1 |
| 700266593H1 | g1161311 | 42 | −8 | gb105pln | *Arabidopsis thaliana* Columbia myo-inositol-1-phosphate synthase mRNA, complete cds. |
| 700257579H1 | g1724100 | 25 | 7 | gb105allp | porin |
| 700265252H1 | g1946300 | 14 | −8 | gb105eukp | hypothetical protein |
| 700264471H1 | g1256607 | 19 | −18 | gb105pln | *Glycine max* G protein beta subunit mRNA, complete cds. |
| 700258511H1 | g2832620 | 10 | 3 | gb105eukp | F13CS.90; hypothetical protein |
| 700267176H1 | g22285 | 50 | −40 | gb105pln | *Zea mays* Glb1-S gene for vicilin-like embryo storage protein. |
| 700258870H1 | g18748 | 12 | 1 | gb105allp | a protein similar to potato tuber protein p322 homolgous to Bowman-Birk Proteinase Inhibitor |
| 700262586H1 | g2529657 | 16 | −14 | gb105pln | *Arabidopsis thaliana* chromosome II BAC T30B22 genomic sequence, complete sequence. |
| 700265477H1 | g1001579 | 17 | −5 | gb105allp | ABC1-like |
| 700264747H1 | g1208445 | 44 | −31 | gb105pln | Rice (YK426) mRNA, complete cds. |
| 700264453H1 | g2821959 | 37 | −11 | gb105eukp | spermidine synthase; EC 2.5.1.16 |
| 700267687H1 | g1574937 | 31 | −64 | gb105pln | *Zea mays* superoxide dismutase 4 (sod4) gene, partial cds. |
| 700259052H1 | g416251 | 28 | −43 | gb105pln | Rice mRNA for acetohydroxy acid reductoisomerase, partial sequence. |
| 700264519H1 | g599722 | 36 | −46 | gb105pln | *C.melo* mRNA for aconitase (UNI-ZAPxR). |
| 700262306H1 | g469067 | 4 | 7 | gb105allp | NMDA receptor subunit NR2D |
| 700266024H4 | g1136121 | 64 | 4 | gb105pln | *O. sativa* mRNA for alpha-tubulin (clone OSTA-136). |
| 700266073H1 | g577190 | 21 | −18 | gb105eukp | YSH1; Ysh1p: subunit of polyadenylation factor I (PF I) |
| 700262913H1 | g2149093 | 11 | −3 | gb105eukp | FKS; fksp |
| 700258658H1 | g19199 | 13 | 7 | gb105allp | E8 protein |
| 700260660H1 | g1212780 | 24 | −4 | gb105pln | *B. juncea* mRNA for oleate desaturase. |
| 700267345H1 | g184657 | 9 | 3 | gb105allp | transfer RNA-Trp synthetase |
| 700267733H1 | g2160163 | 18 | 3 | gb105allp | No definition line found |
| 700263965H1 | g1743276 | 84 | −80 | gb105pln | *H. vulgare* mRNA for beta tubulin. |
| 700263845H1 | g1531764 | 20 | 3 | gb105pln | *D. stramonium* mRNA for S-adenosylmethionine decarboxylase. |
| 700207140H1 | g18140 | 19 | 7 | gb105pln | *C. rubrum* mRNA for light-induced 34 kD protein. |
| 700259603H1 | g2244753 | 12 | 3 | gb105eukp | hypothetical protein |
| 700261859H1 | g2827001 | 50 | −41 | gb105pln | *Triticum aestivum* 70 kDa heat shock protein (TaHSP70d) mRNA, complete cds. |
| 700258314H1 | g22747 | 16 | 7 | gb105pln | *L. longiflorum* mRNA for actin depolymerizing factor. |
| 700257646H1 | g218082 | 40 | 2 | gb105pln | Rice mRNA for initiation factor eIF-4D (225 gene), partial sequence. |
| 700266111H1 | g20501 | 10 | −0 | gb105eukp | vicilin-like storage protein |
| 700261856H1 | g1698689 | 18 | 5 | gb105pln | *Cuphea wrightii* beta-ketoacyl-ACP synthase II (CwKASII1) mRNA, complete cds. |
| 700264618H1 | g57702 | 17 | −3 | gb105allp | ribosomal protein L35 (AA 1–123) |
| 700256801H1 | g1399274 | 33 | −25 | gb105pln | *Arabidopsis thaliana* calmodulin-domain protein kinase CDPK isoform 6 (CPK6) mRNA, complete cds. |
| 700258213H1 | g1171353 | 13 | 14 | gb105pln | *Oryza sativa* 18 kDa oleosin mRNA, complete cds. |
| 700262842H1 | g218082 | 44 | −11 | gb105pln | Rice mRNA for initiation factor eIF-4D (225 gene), partial sequence. |
| 700266095H1 | g167112 | 26 | −10 | gb105pln | *Bromus inermis* aldose reductase-related protein, complete cds. |
| 700258314H1 | g1419369 | 65 | −76 | gb105pln | *Z. mays* ZmABP3 mRNA for actin depolymerizing factor. |
| 700257411H2 | g167244 | 30 | −25 | gb105pln | *Chlorella kessleri* elongation |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | factor 2 mRNA, complete cds. |
| 700256791H1 | g168587 | 61 | −54 | gb105pln | *Zea mays* cofactor-independent phosphoglycerate mutase mRNA, complete cds. |
| 700263956H1 | g553071 | 21 | −46 | gb105pln | Maize catalase (Cat2) mRNA, 3' end. |
| 700259309H1 | g1791308 | 28 | −18 | gb105pln | *Arabidopsis thaliana* cystathionine gamma-synthase (CGS) mRNA, complete cds. |
| 700261180H1 | g2668737 | 20 | 9 | gb105pln | *Zea mays* translation initiation factor 5A (TIF5A) mRNA, complete cds. |
| 700263622H1 | g1360147 | 39 | −23 | gb105eukp | NBP35; nucleotide-binding protein of 35 kD |
| 700265443H1 | g1262999 | 30 | −4 | gb105eukp | ZK287.5 |
| 700262462H1 | g2288979 | 19 | −0 | gb105pln | *Arabidopsis thaliana* chromosome II BAC T01O24 genomic sequence, complete sequence. |
| 700259001H1 | g530206 | 41 | −25 | gb105pln | Glycine max heat shock protein (SB100) mRNA, complete cds. |
| 700259321H1 | g22285 | 52 | −73 | gb105pln | *Zea mays* Gib1-S gene for vicilin-like embryo storage protein. |
| 700267333H1 | g22119 | 81 | −15 | gb105pln | Maize Adh1-E mRNA for alcohol dehydrogenase. |
| 700260354H1 | g508974 | 23 | −5 | gb105pln | *Triticum aestivum* Chinese spring protein disulfide isomerase (PDI) mRNA, complete cds. |
| 700264184H1 | g927238 | 51 | −19 | gb105pln | *Zea mays* globulin1 (Glb1) gene, allele Glb1-Hb, complete cds. |
| 700262462H1 | g2264367 | 15 | 8 | gb105pln | *Arabidopsis thaliana* BAC F6P23 from chromosome IV, top arm, complete sequence. |
| 700266659H1 | g1103921 | 19 | −14 | gb105eukp | SAL1; 3'(2'),5'-bisphosphate nucleotidase; EC 3.1.3.7.3 |
| 700264073H1 | g5069 | 21 | −9 | gb105pln | Yeast (*Saccharomyces pombe*) rpl7 gene for ribosomal protein L7. |
| 700257069H1 | g296203 | 23 | −6 | gb105pln | *P. miliaceum* mRNA for alanine aminotransferase. |
| 700258785H1 | g963061 | 21 | 4 | gb105pln | *H. vulgare* Ole-1 mRNA for oleosin. |
| 700266180H1 | g168460 | 66 | −61 | gb105pln | *Zea mays* cyclophilin (CyP) mRNA, complete cds. |
| 700257190H1 | g168481 | 7 | 8 | gb105allp | globulin precursor |
| 700262467H1 | g1272684 | 80 | −35 | gb105pln | *Z. mays* mRNA for acetyl CoA carboxylase (partial). |
| 700262266H1 | g633889 | 16 | 9 | gb105pln | glucose and ribitol dehydrogenase homolog [*Hordeum vulgare* = barley, Aura, embryo, mRNA, 1170 nt]. |
| 700261935H1 | g949979 | 19 | 12 | gb105pln | *Z. mays* Glossy2 locus DNA. |
| 700257186H1 | g1532072 | 34 | −4 | gb105pln | *Z. mays* mRNA for S-adenosylmethionine decarboxylase. |
| 700265948H1 | g2641200 | 17 | −7 | gb105pln | *Fritillaria agrestis* ribosomal protein L23a (rpl23a) mRNA, complete cds. |
| 700265018H1 | g1841307 | 18 | 2 | gb105pln | Fission Yeast mRNA for ribosomal protein S16 homolog, partial cds. |
| 700264659H1 | g218241 | 37 | −28 | gb105pln | Rice mRNA for ribosomal protein L3 (T82 gene), partial sequence. |
| 700257225H1 | g168480 | 52 | −70 | gb105pln | Maize embryo globulin S allele (7S-like) mRNA, complete cds. |
| 700256836H1 | g520935 | 46 | −34 | gb105pln | *H. vulgare* mRNA for gamma-TIP-like protein. |
| 700268138H1 | g2330735 | 16 | 1 | gb105allp | uracil phosphoribosyltransferase |
| 700263255H1 | g2267592 | 36 | −15 | gb105pln | *Oryza sativa* glycine-rich RNA-binding protein mRNA, complete cds. |
| 700259562H1 | g22281 | 38 | −53 | gb105pln | *Zea mays* Glb1-0 gene for vicilin-like storage protein (truncated). |
| 700267015H1 | g1814402 | 32 | −8 | gb105pln | *Mesembryanthemum crystallinum* methionine synthase (MetE) mRNA, complete cds. |
| 700267384H1 | g168419 | 91 | −36 | gb105pln | Maize (*Z. mays*) aldolase mRNA, complete cds. |
| 700267254H1 | g927238 | 24 | −62 | gb105pln | *Zea mays* globulin1 (Glb1) gene, allele Glb1-Hb, complete cds. |
| 700265789H1 | g596077 | 28 | 2 | gb105pln | *Zea mays* thiamine biosynthetic enzyme (thi1-1) mRNA, complete cds. |
| 700262857H1 | g790977 | 32 | 2 | gb105pln | *B. juncea* msams mRNA. |
| 700258263H1 | g687244 | 48 | −68 | gb105pln | *Zea mays* oil body protein 16 kDa oleosin (ole16) gene, complete cds. |
| 700258383H1 | g2369713 | 58 | −50 | gb105pln | *Beta vulgaris* cDNA for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | elongation factor 2. |
| 700257338H1 | g22231 | 98 | −48 | gb105pln | Maize cat-1 mRNA for catalase-1 isoenzyme (EC 1.11.1.6). |
| 700257790H1 | g313143 | 52 | −29 | gb105pln | *A. medicago* MSK-1 mRNA for protein kinase. |
| 700258331H1 | g169818 | 29 | −59 | gb105pln | Rice 25S ribosomal RNA gene. |
| 700261484H1 | g596079 | 59 | −28 | gb105pln | *Zea mays* thiamine biosynthetic enzyme (thi1-2) mRNA, complete cds. |
| 700265451H1 | g975887 | 50 | −45 | gb105pln | *Mesembryanthemum crystallinum* myo-inositol-1-phosphate synthase mRNA, complete cds. |
| 700264762H1 | g168512 | 50 | −53 | gb105pln | Maize major protein (L3) mRNA from the surface of lipid bodies, 3' end. |
| 700262311H1 | g2511530 | 26 | −65 | gb105pln | *Eleusine indica* alpha tubulin 1 (TUA1) mRNA, complete cds. |
| 700265166H1 | g2190991 | 22 | −14 | gb105pln | *Aegilops squarrosa* glutathione S-transferase TSI-1 mRNA, complete cds. |
| 700261853H1 | g498908 | 45 | 4 | gb105eukp | RPL34; ribosomal protein L34 homolog |
| 700267447H1 | g1322621 | 38 | −18 | gb105eukp | NBP35 |
| 700266478H1 | g468055 | 87 | −53 | gb105pln | *Zea mays* B73 QM protein mRNA, complete cds. |
| 700258234H1 | g168419 | 96 | −84 | gb105pln | Maize (*Z. mays*) aldolase mRNA, complete cds. |
| 700260319H2 | g2832242 | 17 | −4 | gb105pln | *Zea mays* 22-kDa alpha zein gene cluster, complete sequence. |
| 700258305H1 | g2832620 | 9 | 3 | gb105eukp | F13C5.90; hypothetical protein |
| 700267345H1 | g30821 | 9 | 3 | gb105allp | 471 aa polypeptide (gamma2) |
| 700259091H1 | g313147 | 25 | −41 | gb105pln | *A. medicago* MSK-3 mRNA for protein kinase. |
| 700263762H1 | g2821959 | 36 | −6 | gb105eukp | spermidine synthase; EC 2.5.1.16 |
| 700265085H1 | g556018 | 57 | −49 | gb105pln | Barley glutamate 1-semialdehyde aminotransferase (GSA) mRNA, complete cds. |
| 700265080H1 | g1553130 | 50 | −40 | gb105pln | *Gossypium hirsutum* ribosomal protein L44 isoform b (RL44), complete cds. |
| 700266030H1 | g2827142 | 41 | −33 | gb105pln | *Arabidopsis thaliana* cellulose synthase catalytic subunit (Ath-B) mRNA, complete cds. |
| 700265689H1 | g927238 | 31 | 3 | gb105pln | *Zea mays* globulin1 (Glb1) gene, allele Glb1-Hb, complete cds. |
| 700259471H1 | g168512 | 60 | 1 | gb105pln | Maize major protein (L3) mRNA from the surface of lipid bodies, 3' end. |
| 700264275H1 | g1196896 | 48 | −43 | gb105pln | *Glycine max* acidic ribosomal protein P0 mRNA, complete cds. |
| 700259811H1 | g1895083 | 63 | −63 | gb105pln | *Zea mays* golgi associated protein se-wap41 mRNA, complete cds. |
| 700263238H1 | g169295 | 41 | −11 | gb105pln | Pharbitis nil heat shock protein 83 (Hsp83) gene, complete cds. |
| 700261955H1 | g1136123 | 27 | −1 | gb105pln | *O. sativa* mRNA for alpha-tubulin (clone OSTA-274). |
| 700264532H1 | g2293565 | 24 | −7 | gb105pln | *Oryza sativa* ADP-ribosylation factor 1 (Os-ARF1) mRNA, complete cds. |
| 700264559H1 | g1296954 | 49 | −20 | gb105pln | *O. sativa* mRNA for novel protein, osr40c1. |
| 700262560H1 | g1022807 | 21 | −9 | gb105eukp | cellulase |
| 700258187H1 | g871949 | 18 | −1 | gb105eukp | PRE4; proteosome component PRE4 |
| 700258154H1 | g927239 | 6 | 7 | gb105allp | globulin1 |
| 700267261H1 | g596079 | 71 | −87 | gb105pln | *Zea mays* thiamine biosynthetic enzyme (thi1-2) mRNA, complete cds. |
| 700266273H1 | g887935 | 20 | −2 | gb105eukp | GAST1 protein homolog |
| 700261930H1 | g21734 | 23 | −25 | gb105pln | *T. aestivum* (cDNA I) mRNA for EC protein. |
| 700264535H1 | g22281 | 50 | −78 | gb105pln | *Zea mays* Glb1-0 gene for vicilin-like storage protein (truncated). |
| 700259145H2 | g790507 | 61 | −20 | gb105pln | *Z. mays* mRNA for 60S acidic ribosomal protein. |
| 700264459H1 | g35774 | 7 | 6 | gb105allp | polypyrimidine tract-binding protein (pPTB) |
| 700256945H1 | g396209 | 26 | −12 | gb105pln | *S. polyrrhiza* mRNA for D-myo-inositol-3-phosphate synthase. |
| 700265863H1 | g2827538 | 9 | 15 | gb105pln | *Arabidopsis thaliana* DNA chromosome 4, BAC clone T12H17 (ESSAII project). |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700265687H1 | g976256 | 41 | −45 | gb105pln | Rice mRNA stearyl-ACP desaturase, complete cds. |
| 700264640H1 | g170775 | 29 | −12 | gb105pln | Wheat translation elongation factor 1 alpha-subunit (TEE1) mRNA, complete cds. |
| 700263284H1 | g2760920 | 13 | 6 | gb105allp | cytoplasmic aminopeptidase P |
| 700256858H1 | g170772 | 66 | −60 | gb105pln | *Triticum aestivum* S-adenosyl-L-homocysteine hydrolase (SH6.2) mRNA, complete cds. |
| 700264056H1 | g1155212 | 31 | −35 | gb105pln | *Avena fatua* aldose reductase-related protein mRNA, complete cds. |
| 700261830H1 | g868002 | 47 | −17 | gb105pln | Pumpkin mRNA for aconitase, complete cds. |
| 700257135H1 | g471320 | 48 | −51 | gb105pln | *H. vulgare* (cv. Bomi) B15C mRNA. |
| 700261258H1 | g2345153 | 25 | −51 | gb105pln | *Zea mays* ribsomal protein S4 (rps4) mRNA, complete cds. |
| 700260959H1 | g22283 | 96 | −69 | gb105pln | *Zea mays* Glb1-L gene for vicilin-like embryo storage protein. |
| 700266317H1 | g168481 | 17 | 7 | gb105eukp | globulin precursor |
| 700261850H1 | g1568627 | 17 | 4 | gb105eukp | heat shock protein 110 |
| 700258614H1 | g1574460 | 37 | −23 | gb105allp | aminopeptidase N (pepN) |
| 700267778H1 | g1906830 | 14 | 4 | gb105eukp | hsp88.1; heat shock protein |
| 700267626H1 | g468425 | 18 | 4 | gb105pln | Yeast ribosomal protein S3 (RPS3) gene, complete cds. |
| 700265148H1 | g1947005 | 19 | −6 | gb105eukp | T21G5.5 |
| 700258537H1 | g2624219 | 29 | −10 | gb105pln | *M. acuminata* mRNA; clone pBAN UD75. |
| 700265061H1 | g530206 | 33 | −24 | gb105pln | Glycine max heat shock protein (SB100) mRNA, complete cds. |
| 700266593H1 | g975887 | 48 | −11 | gb105pln | *Mesembryanthemum crystallinum* myo-inositol-1-phosphate synthase mRNA, complete cds. |
| 700265020H1 | g1008297 | 37 | −22 | gb105eukp | CCT7 |
| 700265230H1 | g2244797 | 26 | −6 | gb105eukp | hypothetical protein |
| 700258810H1 | g1658314 | 48 | −37 | gb105pln | *O. sativa* osr40g3 gene. |
| 700261480H1 | g19511 | 13 | 16 | gb105pln | *Lupinus polyphylius* rps16 mRNA for ribosomal protein S16. |
| 700258196H1 | g166682 | 13 | 4 | gb105eukp | CTR1; protein kinase |
| 700259551H1 | g1255798 | 9 | 7 | gb105eukp | F5901.3 |
| 700260105H1 | g1895083 | 29 | −67 | gb105pln | *Zea mays* golgi associated protein se-wap41 mRNA, complete cds. |
| 700261696H1 | g2190991 | 38 | −25 | gb105pln | *Aegilops squarrosa* glutathione S-transferase TSI-1 mRNA, complete cds. |
| 700259306H1 | g1015814 | 10 | 7 | gb105eukp | ORF YJR105w |
| 700265295H1 | g1147584 | 37 | −33 | gb105pln | *L. esculentum* mRNA for lysyl-tRNA synthetase (LysRS). |
| 700262547H1 | g1622925 | 17 | 3 | gb105pln | *Nicotiana tabacum* caffeoyl-CoA O-methyltransferase 3 (CCoAOMT-3) mRNA, complete cds. |
| 700261010H1 | g473976 | 58 | −16 | gb105pln | Rice mRNA, partial homologous to elongation factor 1-alpha gene. |
| 700263850H1 | g1171351 | 12 | 14 | gb105pln | *Oryza sativa* 16 kDa oleosin (ole16) mRNA, complete cds. |
| 700263441H1 | g313266 | 46 | −6 | gb105pln | *T. aestivum* gene for phosphoglycerate kinase. |
| 700260663H1 | g2246532 | 7 | 7 | gb105allp | ORF 73, contains large complex repeat CR 73 |
| 700259324H1 | g22283 | 54 | −5 | gb105pln | *Zea mays* Glb1-L gene for vicilin-like embryo storage protein. |
| 700260554H2 | g19012 | 27 | 6 | gb105pln | *H. vulgare* mRNA for LEA B19.1 protein. |
| 700267309H1 | g21686 | 29 | −9 | gb105pln | *T. aestivum* AGP-S mRNA. |
| 700265184H1 | g493590 | 60 | −55 | gb105pln | *Hordeum vulgare* disulfide isomerase (PDI) mRNA, 3' end. |
| 700262494H1 | g168460 | 78 | −70 | gb105pln | *Zea mays* cyclophilin (CyP) mRNA, complete cds. |
| 700267315H1 | g2266661 | 42 | −30 | gb105pln | *Hordeum vulgare* mRNA for 14-3-3 protein (Hv1433c). |
| 700266172H1 | g2408046 | 19 | −14 | gb105eukp | SPAC29B12.04; hypothetical protein |
| 700207194H1 | g22328 | 50 | −31 | gb105pln | Maize mRNA for a high mobility group protein. |
| 700262250H1 | g602393 | 33 | −15 | gb105eukp | YEL026W; Ye1026wp |
| 700266237H1 | g22292 | 67 | −59 | gb105pln | *Z. mays* mRNA for glycine-rich protein. |
| 700264143H1 | g435458 | 41 | −9 | gb105pln | Proso millet gene for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | aspartate aminotransferase, complete cds. |
| 700258932H1 | g473976 | 53 | −53 | gb105pln | Rice mRNA, partial homologous to elongation factor 1-alpha gene. |
| 700266273H1 | g19247 | 17 | −1 | gb105eukp | gast1 |
| 700264381H1 | g2618601 | 33 | −9 | gb105pln | *Arabidopsis thaliana* genomic DNA, chromosome 5, P1 clone: MHJ24, complete sequence. |
| 700257910H1 | g416146 | 47 | −50 | gb105pln | *Zea mays* beta-6 tubulin (tub6) gene and mRNA, complete cds. |
| 700257032H1 | g975888 | 29 | 5 | gb105allp | myo-inositol-1-phosphate synthase |
| 700258923H1 | g20359 | 73 | −49 | gb105pln | Rice gene for 17S ribosomal RNA. |
| 700260288H1 | g22283 | 33 | −13 | gb105pln | *Zea mays* Glb1-L gene for vicilin-like embryo storage protein. |
| 700267810H1 | g757509 | 26 | −10 | gb105pln | *Neurospora crassa* cys-9 gene for thioredoxin reductase (NADPH), exon1, exon2, exon3 and complete cds. |
| 700262514H1 | g2605606 | 9 | 7 | gb105allp | RANP-1 |
| 700260713H1 | g404325 | 37 | −12 | gb105pln | *P. amygdalus* mRNA for phosphoglycerate mutase. |
| 700258521H1 | g687244 | 57 | −67 | gb105pln | *Zea mays* oil body protein 16 kDa oleosin (ole16) gene, complete cds. |
| 700258126H1 | g168512 | 44 | −37 | gb105pln | Maize major protein (L3) mRNA from the surface of lipid bodies, 3' end. |
| 700266095H1 | g1155212 | 30 | −13 | gb105pln | *Avena fatua* aldose reductase-related protein mRNA, complete cds. |
| 700265908H1 | g1778376 | 15 | 1 | gb105eukp | PsRT17-1 |
| 700261640H1 | g1658314 | 47 | −42 | gb105pln | *O. sativa* osr40g3 gene. |
| 700258224H1 | g173231 | 24 | −8 | gb105pln | Yeast (*Saccharomyces cerevisiae*) ribosomal 5S RNA-binding protein (YL3) gene, 5' cds. |
| 700265128H1 | g2828278 | 16 | 16 | gb105pln | *Arabidopsis thaliana* DNA chromosome 4, BAC clone T18B16 (ESSAII project). |
| 700264855H1 | g257040 | 49 | 0 | gb105pln | hydroxyproline-rich glycoprotein [maize, Genomic, 1703 nt]. |
| 700256940H1 | g1129085 | 29 | 3 | gb105pln | Wheat mRNA for protein H2A, complete cds, clone wcH2A-9. |
| 700257372H1 | g312178 | 46 | −50 | gb105pln | *Z. mays* GapC2 gene. |
| 700267860H1 | g20163 | 53 | −20 | gb105pln | *O. sativa* Rr15 mRNA for 5S ribosomal RNA. |
| 700262932H1 | g1015749 | 6 | 3 | gb105eukp | HAM1 |
| 700262060H1 | g2326265 | 35 | −12 | gb105eukp | chaperonin; CCT alpha/TCP-1 |
| 700261209H1 | g600768 | 31 | −19 | gb105pln | *Oryza sativa* cyclophilin 2 (Cyp2) mRNA, complete cds. |
| 700265727H1 | g22283 | 53 | 1 | gb105pln | *Zea mays* Glb1-L gene for vicilin-like embryo storage protein. |
| 700258327H1 | g2267592 | 38 | −33 | gb105pln | *Oryza sativa* glycine-rich RNA-binding protein mRNA, complete cds. |
| 700265574H1 | g2351373 | 53 | −46 | gb105pln | *Arabidopsis thaliana* putative 26S proteasome subunit athMOV34 mRNA, complete cds. |
| 700261790H1 | g1658312 | 30 | −30 | gb105pln | *O. sativa* osr40g2 gene. |
| 700259168H2 | g560810 | 22 | −6 | gb105eukp | T23F11.1 |
| 700266080H1 | g22469 | 68 | −70 | gb105pln | Maize mRNA for cytoplasmic ribosomal protein S11. |
| 700263836H1 | g927238 | 36 | −2 | gb105pln | *Zea mays* globulin1 (Glb1) gene, allele Glb1-Hb, complete cds. |
| 700258680H1 | g804945 | 33 | −19 | gb105pln | *A. thaliana* mRNA for acyl-(acyl carrier protein) thioesterase. |
| 700262466H1 | g927239 | 6 | 6 | gb105allp | globulin1 |
| 700265020H1 | g2104461 | 42 | −23 | gb105eukp | cct7; Cct7p |
| 700263545H1 | g1185553 | 55 | 6 | gb105pln | *Zea mays* glyceraldehyde-3-phosphate dehydrogenase (gpc2) gene, complete cds. |
| 700262631H1 | g168512 | 52 | −51 | gb105pln | Maize major protein (L3) mRNA from the surface of lipid bodies, 3' end. |
| 700266507H1 | g181995 | 13 | 3 | gb105allp | translational initiation factor eIE-2, alpha subunit |
| 700264064H1 | g2668739 | 64 | −86 | gb105pln | *Zea mays* translation initiation factor GOS2 (TIF) mRNA, complete cds. |
| 700267860H1 | g2599103 | 20 | 9 | gb105pln | *Dunalielia salina* 60S ribosomal protein (DSRP1) mRNA, complete cds. |
| 700267239H1 | g2342477 | 12 | 2 | gb105allp | ATP binding protein |
| 700266174H1 | g450548 | 26 | −1 | gb105pln | *O. sativa* (pRSAM-1) gene for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700259748H1 | g1370203 | 60 | −3 | gb105eukp | S-adenosyl methionine synthetase. ran1A; GTP-binding protein; RAN1A |
| 700264377H1 | g600768 | 47 | −38 | gb105pln | *Oryza sativa* cyclophilin 2 (Cyp2) mRNA, complete cds. |
| 700258128H1 | g2673869 | 30 | −11 | gb105pln | *Antirrhinum majus* mRNA for fimbriata-associated protein 2, partial. |
| 700257530H1 | g22270 | 95 | −37 | gb105pln | Maize mRNA from an embryogenic abscisic acid-inducible gene. |
| 700266138H1 | g2662468 | 31 | −34 | gb105pln | *Arabidopsis thaliana* ribosomal protein S6 (rps6) mRNA, complete cds. |
| 700264770H1 | g387149 | 4 | 8 | gb105allp | envelope glycoprotein |
| 700264259H1 | g2342676 | 26 | −21 | gb105eukp | F7G19.3 |
| 700262222H1 | g1620753 | 16 | 5 | gb105allp | proteinase inhibitor |
| 700265821H1 | g790641 | 16 | −11 | gb105eukp | HTH3; gamma-thionin |
| 700259173H2 | g836774 | 15 | −9 | gb105eukp | FAB1; FAB1 protein |
| 700267324H1 | g596077 | 46 | −60 | gb105pln | *Zea mays* thiamine biosynthetic enzyme (thi1-1) mRNA, complete cds. |
| 700261328H1 | g1684754 | 28 | −9 | gb105eukp | hus2; DNA-helicase |
| 700260591H2 | g16221 | 20 | 7 | gb105allp | chaperonin hsp60 |
| 700262123H1 | g1749464 | 32 | −10 | gb105eukp | similar to *Saccharomyces cerevisiae* putative NDP-hexose pyrophosphopylase, SWISS-PROT Accession Number P41940 |
| 700267661H1 | g2191175 | 16 | −8 | gb105eukp | A_IG002P16.24 |
| 700267204H1 | g168460 | 85 | −85 | gb105pln | *Zea mays* cyclophilin (CyP) mRNA, complete cds. |
| 700265237H1 | g2688979 | 13 | 6 | gb105eukp | AtKUP1; high-affinity potassium transporter |
| 700267632H1 | g168419 | 78 | −19 | gb105pln | Maize (*Z. mays*) aldolase mRNA, complete cds. |
| 700266182H1 | g303848 | 31 | −24 | gb105pln | Rice mRNA for nucleoside diphosphate kinase, complete cds. |
| 700257944H1 | g2252471 | 11 | 14 | gb105pln | *Arabidopsis thaliana* mRNA for argininosuccinate lyase. |
| 700267317H1 | g602898 | 27 | −10 | gb105eukp | YBL0425 |
| 700261575H1 | g600768 | 45 | −9 | gb105pln | *Oryza sativa* cyclophilin 2 (Cyp2) mRNA, complete cds. |
| 700264083H1 | g398607 | 11 | 0 | gb105pln | *A. thaliana* mRNA for elongation factor 1 beta. |
| 700262541H1 | g20680 | 26 | −10 | gb105pln | *P. sativum* mRNA of cDNA clone 26g. |
| 700262967H1 | g2062155 | 17 | 3 | gb105eukp | T02O04.2; mitochondrial processing peptidase alpha subunit precursor isolog |
| 700262406H1 | g927238 | 48 | −68 | gb105pln | *Zea mays* globulin1 (Glb1) gene, allele Glb1-Hb, complete cds. |
| 700260661H1 | g2459417 | 66 | −12 | gb105eukp | F4P9.11; putative pre-mRNA splicing factor PRP19 |
| 700264827H1 | g168512 | 30 | −33 | gb105pln | Maize major protein (L3) mRNA from the surface of lipid bodies, 3′ end. |
| 700262933H1 | g2345153 | 53 | −83 | gb105pln | *Zea mays* ribsomal protein S4 (rps4) mRNA, complete cds. |
| 700266626H1 | g2760165 | 19 | 10 | gb105pln | *Arabidopsis thaliana* genomic DNA, chromosome 5, P1 clone: MAC9, complete sequence. |
| 700258727H1 | g1532072 | 12 | 11 | gb105pln | *Z. mays* mRNA for S-adenosylmethionine decarboxylase. |
| 700264757H1 | g22119 | 93 | −88 | gb105pln | Maize Adh1-F mRNA for alcohol dehydrogenase. |
| 700263129H1 | g168512 | 35 | 14 | gb105pln | Maize major protein (L3) mRNA from the surface of lipid bodies, 3′ end. |
| 700265521H1 | g168481 | 9 | 0 | gb105eukp | globulin precursor |
| 700257579H1 | g515358 | 29 | 6 | gb105allp | 36 kDa porin I |
| 700264571H1 | g2624327 | 24 | −2 | gb105pln | *Oryza sativa* mRNA for glycine rich RNA-binding protein 2 (OsGRP2). |
| 700259822H1 | g1546918 | 45 | −72 | gb105pln | *Z. mays* mRNA for translation initiation factor 5A. |
| 700266811H1 | g927238 | 73 | −54 | gb105pln | *Zea mays* globulin1 (Glb1) gene, allele Glb1-Hb, complete cds. |
| 700265217H1 | g520935 | 37 | −0 | gb105pln | *H. vulgare* mRNA for gamma-TIP-like protein. |
| 700262411H1 | g2463334 | 31 | −33 | gb105pln | *Oryza sativa* mRNA for ribosomal protein S4. |
| 700207103H1 | g296173 | 23 | 3 | gb105pln | *P. sativum* ndk-p1 mRNA for nucleoside diphosphate kinase. |
| 700263366H1 | g567040 | 16 | −0 | gb105allp | phosphoprotein phosphatase |
| 700258409H1 | g2789660 | 22 | −13 | gb105eukp | p105 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700261674H1 | g1906827 | 10 | 3 | gb105pln | *A. thaliana* hsp81.4 gene. |
| 700264691H1 | g190220 | 6 | 7 | gb105allp | protein phosphatase 2A 130 kDa regulatory subunit |
| 700263776H1 | g436782 | 52 | −42 | gb105pln | Rice mRNA for cyc07, complete cds. |
| 700266475H1 | g1575129 | 86 | −41 | gb105pln | *Zea mays* lumenal binding protein cBiPe3 mRNA, complete cds. |
| 700265222H1 | g1171351 | 22 | −4 | gb105pln | *Oryza sativa* 16 kDa oleosin (ole16) mRNA, complete cds. |
| 700257379H1 | g1777706 | 46 | −52 | gb105pln | *Zea mays* 18S ribosomal RNA gene, partial sequence. |
| 700260111H1 | g22461 | 79 | −41 | gb105pln | Maize RAB-17 gene. |
| 700261544H1 | g248336 | 68 | −26 | gb105pln | polyubiquitin [maize, Genomic, 3841 nt]. |
| 700264106H1 | g927239 | 14 | 1 | gb105eukp | Glb1; globulin1 |
| 700266775H1 | g467397 | 11 | 7 | gb105allp | A subunit of DNA gyrase |
| 700260708H1 | g927239 | 7 | 7 | gb105allp | globulin1 |
| 700265286H1 | g683475 | 35 | −28 | gb105pln | *H. vulgare* mRNA for NADPH-protochlorophyllide oxidoreductase. |
| 700267375H1 | g1890153 | 13 | 17 | gb105pln | *A. thaliana* mRNA for alpha-mannosidase precursor. |
| 700264746H1 | g510882 | 11 | 6 | gb105allp | putative succinyl-CoA synthetase alpha subunit |
| 700264482H1 | g1171351 | 14 | 14 | gb105pln | *Oryza sativa* 16 kDa oleosin (ole16) mRNA, complete cds. |
| 700263373H1 | g473602 | 68 | −77 | gb105pln | *Zea mays* W-22 histone H2A mRNA, complete cds. |
| 700261959H1 | g790969 | 47 | −30 | gb105pln | Rice mRNA for aldolase C-1, complete cds. |
| 700267531H1 | g2654121 | 27 | 11 | gb105pln | *Arabidopsis thaliana* ribosomal protein L23a (AtrpL23a) mRNA, complete cds. |
| 700258523H1 | g473877 | 18 | −25 | gb105pln | *Arabidopsis thaliana* Columbia calnexin homolog gene, complete cds. |
| 700267187H1 | g1244752 | 20 | 5 | gb105allp | xyloglucan endotransglycosylase-related protein |
| 700264362H1 | g1055197 | 15 | −6 | gb105eukp | F11H8.1 |
| 700257578H1 | g2745900 | 30 | 4 | gb105allp | arsenite-translocating ATPase |
| 700267191H1 | g168508 | 43 | −3 | gb105pln | Maize oleosin KD18 (KD18; L2) gene, complete cds. |
| 700263451H1 | g304109 | 17 | −5 | gb105eukp | PAB2; poly(A)-binding protein |
| 700261686H1 | g1770020 | 69 | −52 | gb105pln | *Oryza sativa* S-adenosyl-L-methionine synthetase (pOS-SAMS2) mRNA, complete cds. |
| 700266060H1 | g1171351 | 28 | −17 | gb105pln | *Oryza sativa* 16 kDa oleosin (ole16) mRNA, complete cds. |
| 700264870H1 | g1724103 | 46 | −54 | gb105pln | *Mesembryanthemum crystallinum* methionine adenosyltransferase mRNA, complete cds. |
| 700264684H1 | g2653557 | 82 | −20 | gb105pln | *Zea mays* mRNA for ferredoxin-sulfite reductase precursor, complete cds. |
| 700267966H1 | g987123 | 35 | 7 | gb105eukp | class II metallothionein with homology to wheat Ec |
| 700261049H1 | g169540 | 9 | 6 | gb105eukp | pyrophosphate-fructose 6-phosphate 1-phosphotransferase beta-subunit; EC 2.7.1.90 |
| 700264394H1 | g1694832 | 33 | −52 | gb105pln | *H. vulgare* Per1 gene. |
| 700267217H1 | g16211 | 33 | 4 | gb105eukp | CNX1; calnexin homolog |
| 700265822H1 | g2266946 | 58 | −10 | gb105pln | *Gossypium hirsutum* phosphoenolpyruvate carboxylase 1 (PEPC1) mRNA, complete cds. |
| 700262589H1 | g777757 | 62 | −52 | gb105pln | *Saccharum* hybrid (clone SCUBI561) polyubiquitin mRNA, complete cds. |
| 700266395H1 | g2315362 | 3 | 8 | gb105allp | contains similarity to multiple TPR domains |
| 700265453H1 | g1532047 | 15 | −2 | gb105pln | *O. sativa* mRNA for S-adenosylmethionine decarboxylase. |
| 700262613H1 | g1419369 | 17 | 3 | gb105pln | *Z. mays* ZmABP3 mRNA for actin depolymerizing factor. |
| 700259653H1 | g687244 | 35 | −6 | gb105pln | *Zea mays* oil body protein 16 kDa oleosin (ole16) gene, complete cds. |
| 700262465H1 | g218088 | 61 | −76 | gb105pln | Rice mRNA for ribosomal protein 117 (249 gene), partial sequence. |
| 700266516H1 | g1668705 | 40 | −31 | gb105pln | *A. thaliana* mRNA for AtRan2 protein. |
| 700258368H1 | g1737491 | 46 | −42 | gb105pln | *Triticum aestivum* poly(A)-binding protein (wheatpab) mRNA, |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264560H1 | g218340 | 33 | −17 | gb105pln | complete cds.<br>*Triticum aestivum* mRNA for<br>elongation factor 1 beta'. |
| 700257385H1 | g886470 | 40 | −14 | gb105pln | *C. roseus* MetE mRNA for<br>methionine synthase. |
| 700261437H1 | g777757 | 37 | −22 | gb105pln | *Saccharum* hybrid (clone<br>SCUBI561) polyubiquitin mRNA, complete cds. |
| 700266701H1 | g2668737 | 36 | −5 | gb105pln | *Zea mays* translation<br>initiation factor 5A (TIF5A) mRNA, complete cds. |
| 700265364H1 | g167112 | 53 | −50 | gb105pln | *Bromus inermis* aldose<br>reductase-related protein, complete cds. |
| 700257264H1 | g790969 | 46 | −53 | gb105pln | Rice mRNA for aldolase C-1,<br>complete cds. |
| 700265528H1 | g168508 | 25 | −35 | gb105pln | Maize oleosin KD18 (KD18; L2)<br>gene, complete cds. |
| 700257181H1 | g2580607 | 14 | 7 | gb105eukp | TIF32; translation initiation<br>factor 3 p110 subunit |
| 700264432H1 | g927034 | 16 | 8 | gb105eukp | auxin-repressed protein |
| 700262689H1 | g602605 | 86 | −40 | gb105pln | *Zea mays* tandem genes for<br>alpha1-tubulin and alpha2-tubulin. |
| 700260722H1 | g22281 | 48 | −26 | gb105pln | *Zea mays* Glb1-C gene for<br>vicilin-like storage protein (truncated). |
| 700267583H1 | g22285 | 42 | −33 | gb105pln | *Zea mays* Glb1-S gene for<br>vicilin-like embryo storage protein. |
| 700262173H1 | g1107484 | 27 | −10 | gb105pln | *A. thaliana* mRNA for 40S<br>ribosomal protein S15. |
| 700257135H1 | g971279 | 46 | −46 | gb105pln | Rice mRNA for RAB24 protein,<br>complete cds. |
| 700267972H1 | g2687430 | 47 | −63 | gb105pln | *Acorus gramineus* large subunit<br>26S ribosomal RNA gene, partial sequence. |
| 700261677H1 | g1694620 | 34 | 0 | gb105pln | *Cucurbita* sp. mRNA for<br>3-ketoacyl-CoA thiolase, complete cds. |
| 700263958H1 | g2668737 | 43 | −69 | gb105pln | *Zea mays* translation<br>initiation factor 5A (TIF5A) mRNA, complete cds. |
| 700266877H1 | g22283 | 77 | −45 | gb105pln | *Zea mays* Glb1-L gene for<br>vicilin-like embryo storage protein. |
| 700268129H1 | g167196 | 39 | −34 | gb105pln | *C. tinctorius* stearoyl-acyl<br>carrier protein desaturase mRNA, complete cds. |
| 700266094H1 | g1272409 | 31 | −20 | gb105pln | *Vicia faba* immunophilin<br>precursor (FKBP15) mRNA, complete cds. |
| 700264274H1 | g1513227 | 18 | 4 | gb105pln | *Brassica napus* myo-inositol<br>1-phosphate synthase mRNA, complete cds. |
| 700265232H1 | g2160155 | 26 | 5 | gb105pln | Sequence of BAC F21M12 from<br>*Arabidopsis thaliana* chromosome 1,<br>complete sequence. |
| 700257760H1 | g1706956 | 16 | −10 | gb105eukp | celA1; cellulose synthase |
| 700261439H1 | g20321 | 36 | −16 | gb105pln | *Oryza sativa* RAc1 mRNA for<br>actin. |
| 700263334H1 | g1200039 | 16 | 3 | gb105eukp | F57C7.2 |
| 700268133H1 | g8392 | 11 | 3 | gb105allp | puff specific protein Bx42 |
| 700265087H1 | g218000 | 50 | −41 | gb105pln | Potato mRNA for UDP-glucose<br>pyrophosphorylase (EC 2.7.7.9). |
| 700257306H1 | g218182 | 20 | 7 | gb105pln | Rice mRNA for oryzain beta (EC<br>3.4.22). |
| 700266317H1 | g22284 | 16 | 7 | gb105allp | vicilin-like embryo storage<br>protein |
| 700263329H1 | g263500 | 5 | 8 | gb105eukp | ribosomal protein L10 homolog |
| 700260024H1 | g168527 | 26 | −7 | gb105pln | Maize NADP-dependent malic<br>enzyme (Me1) mRNA, complete cds. |
| 700267678H1 | g2285792 | 12 | 0 | gb105eukp | CYN; cyanase; EC 4.3.99.1 |
| 700260659H1 | g2668741 | 52 | −34 | gb105pln | *Zea mays* glycine-rich RNA<br>binding protein (GRP) mRNA, complete cds. |
| 700265875H1 | g2282583 | 89 | −85 | gb105pln | *Zea mays* elongation factor<br>1-alpha (EF1-A) mRNA, complete cds. |
| 700257393H1 | g2149640 | 16 | 1 | gb105eukp | AGO1; leaf development;<br>Argonaute protein |
| 700266604H1 | g1049082 | 16 | −2 | gb105allp | SRp40-3 |
| 700264880H1 | g1526536 | 16 | −5 | gb105pln | *Glycyrrhiaz echinata*<br>suspension-cultured cells mRNA for cytochrome<br>P450 (CYP73A14), complete cds. |
| 700263267H1 | g1185553 | 36 | −83 | gb105pln | *Zea mays*<br>glyceraldehyde-3-phosphate dehydrogenase (gpc2)<br>gene, complete cds. |
| 700262615H1 | g1658312 | 25 | −37 | gb105pln | *O. sativa* osr40g2 gene. |
| 700267159H1 | g22520 | 85 | −86 | gb105pln | *Zea mays* mRNA fragment<br>encoding a zein gene (clone PZ19.1) |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700265135H1 | g168512 | 41 | −33 | gb105pln | (homologous to <ZMZE01>). Maize major protein (L3) mRNA from the surface of lipid bodies, 3' end. |
| 700266843H1 | g2266661 | 39 | −16 | gb105pln | *Hordeum vulgare* mRNA for 14-3-3 protein (Hv1433c). |
| 700266756H1 | g1707867 | 50 | −32 | gb105pln | *Z. mays* mRNA for 40S ribosomal subunit protein S21. |
| 700260659H1 | g2293479 | 36 | −19 | gb105pln | *Oryza sativa* glycine-rich protein mRNA, complete cds. |
| 700263750H1 | g168529 | 60 | −62 | gb105pln | *Zea mays* opaque2 heterodimerizing protein 1 (OHP1) mRNA, complete cds. |
| 700257675H1 | g1161311 | 39 | −10 | gb105pln | *Arabidopsis thaliana* Columbia myo-inositol-1-phosphate synthase mRNA, complete cds. |
| 700260156H1 | g902583 | 62 | −34 | gb105pln | *Zea mays* clone MubG1 ubiquitin gene, complete cds. |
| 700265521H1 | g22284 | 9 | 0 | gb105eukp | Glb1-L; vicilin-like embryo storage protein |
| 700263565H1 | g2345153 | 62 | 10 | gb105pln | *Zea mays* ribosomal protein S4 (rps4) mRNA, complete cds. |
| 700258187H1 | g836805 | 18 | −1 | gb105eukp | PRE4; proteosome component PRE4; EC 3.4.99.46 |
| 700262845H1 | g2145472 | 51 | −39 | gb105pln | *S. tuberosum* mRNA for aconitase/aconitate hydratase. |
| 700261936H1 | g642162 | 56 | 3 | gb105pln | *B. chrysogonum* 28S rRNA gene (partial). |
| 700257445H2 | g173210 | 9 | 4 | gb105eukp | YCK2; casein kinase I |
| 700262230H1 | g2642323 | 27 | −46 | gb105pln | *Zea mays* profilin (PRO4) mRNA, complete cds. |
| 700267045H1 | g460064 | 16 | −2 | gb105eukp | GUA1; GMP synthase; EC 6.3.4.1 |
| 700263152H1 | g1107486 | 36 | −25 | gb105pln | *A. thaliana* mRNA for 60S ribosomal protein L27a. |
| 700266950H1 | g687244 | 60 | −63 | gb105pln | *Zea mays* oil body protein 16 kDa oleosin (ole16) gene, complete cds. |
| 700265503H1 | g551287 | 31 | 10 | gb105pln | *Z. mays* (W22) phosphoglycerate mutase gene (exon 1). |
| 700258875H1 | g1100222 | 30 | −19 | gb105pln | *Pinus sylvestris* chloroplast NAD+-dependent glyceraldehyde-3-phosphate dehydrogenase mRNA, complete cds. |
| 700262616H1 | g600115 | 45 | −39 | gb105pln | *Z. mays* apx gene encoding cytosolic ascorbate peroxidase. |
| 700261161H1 | g1622938 | 14 | 17 | gb105pln | *Bromus secalinus* oleosin (ole16) mRNA, complete cds. |
| 700266478H1 | g575354 | 79 | −47 | gb105pln | *O. sativa* SC34 mRNA for tumor suppressor. |
| 700265465H1 | g312019 | 28 | −18 | gb105pln | Yeast (*Saccharomyces pombe*) type2A-like protein phosphatase. |
| 700264349H1 | g19014 | 22 | −8 | gb105pln | *H. vulgare* mRNA for LEA B19.3 protein. |
| 700259444H1 | g398846 | 32 | −32 | gb105pln | *Z. mays* mRNA for beta 4 tubulin. |
| 700266367H1 | g1724111 | 17 | 9 | gb105pln | *Triticum aestivum* ABA induced plasma membrane protein PM-19 (WTABAPM) mRNA, complete cds. |
| 700262267H1 | g687244 | 51 | −75 | gb105pln | *Zea mays* oil body protein 16 kDa oleosin (ole16) gene, complete cds. |
| 700267951H1 | g673425 | 53 | −12 | gb105pln | *H. vulgare* AR-h gene for aldose reductase. |
| 700266348H1 | g22292 | 93 | −36 | gb105pln | *Z. mays* mRNA for glycine-rich protein. |
| 700261524H1 | g532624 | 66 | −34 | gb105pln | *Zea mays* malate synthase (MS) mRNA, complete cds. |
| 700265940H1 | g1419785 | 14 | 4 | gb105allp | ORF YOL013c |
| 700264811H1 | g600391 | 11 | 6 | gb105eukp | ubiquitin conjugating enzyme E2 |
| 700262219H1 | g1737490 | 15 | 5 | gb105allp | p76 |
| 700258734H1 | g22283 | 53 | −51 | gb105pln | *Zea mays* Glb1-L gene for vicilin-like embryo storage protein. |
| 700265722H1 | g1563718 | 23 | −4 | gb105pln | *D. lanata* mRNA for cyclophilin. |
| 700266442H1 | g1903032 | 21 | −2 | gb105pln | *B. napus* mRNA for acyl-CoA synthetase (2360 bp). |
| 700256961H1 | g924630 | 33 | 3 | gb105allp | leucine aminopeptidase |
| 700263226H1 | g687244 | 73 | 11 | gb105pln | *Zea mays* oil body protein 16 kDa oleosin (ole16) gene, complete cds. |
| 700262894H1 | g602252 | 26 | 12 | gb105pln | *Zea mays* enolase (eno2) mRNA, |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | complete cds. |
| 700258150H1 | g487961 | 10 | 2 | gb105eukp | YHR065c; Yhr065cp |
| 700259675H1 | g895891 | 9 | −0 | gb105eukp | RPS5; ribosomal protein S5 |
| 700267015H1 | g974781 | 35 | −11 | gb105pln | *C. blumei* kinetoplast met gene for cobalamine-independent methionine synthase. |
| 700263750H1 | g168427 | 78 | −85 | gb105pln | *Zea mays* opaque2 heterodimerizing protein 2 mRNA, complete cds. |
| 700258368H1 | g304108 | 26 | −11 | gb105pln | *Arabidopsis thaliana* poly(A)-binding protein mRNA, complete cds. |
| 700266029H1 | g1236619 | 26 | −14 | gb105eukp | CAD2; calcium/calmodulin binding; glutamate decarboxylase |
| 700263675H1 | g1086810 | 5 | 8 | gb105allp | similar to *S. cerevisiae* vacular H(+)-ATPase 54 kda subunit (SP:P41807) |
| 700258477H1 | g1845194 | 80 | −66 | gb105pln | *Z. mays* mRNA for HMGc1 protein. |
| 700266180H1 | g829147 | 69 | −63 | gb105pln | *Z. mays* gene for cyclophilin. |
| 700264023H1 | g1100222 | 61 | −22 | gb105pln | *Pinus sylvestris* chloroplast NAD+-dependent glyceraldehyde-3-phosphate dehydrogenase mRNA, complete cds. |
| 700261687H1 | g2244834 | 25 | −2 | gb105eukp | hypothetical protein |
| 700258378H1 | g2827001 | 72 | −58 | gb105pln | *Triticum aestivum* 70 kDa heat shock protein (TaHSP70d) mRNA, complete cds. |
| 700207150H1 | g170772 | 49 | −34 | gb105pln | *Triticum aestivum* S-adenosyl-L-homocysteine hydrolase (SH6.2) mRNA, complete cds. |
| 700260424H1 | g687244 | 78 | −16 | gb105pln | *Zea mays* oil body protein 16 kDa oleosin (ole16) gene, complete cds. |
| 700257518H1 | g1519252 | 68 | −21 | gb105pln | *Oryza sativa* GF14-d protein mRNA, complete cds. |
| 700257104H1 | g520935 | 40 | −28 | gb105pln | *H. vulgare* mRNA for gamma-TIP-like protein. |
| 700260162H1 | g454878 | 27 | 6 | gb105pln | Rice mRNA for WSI18 protein induced by water stress, complete cds. |
| 700268032H1 | g1526424 | 15 | 7 | gb105eukp | AtECP63; LEA protein in group 3; ABA-inducible gene |
| 700257331H1 | g2191161 | 8 | 1 | gb105eukp | A_IG002P16.6 |
| 700259547H1 | g10399 | 42 | 4 | gb105allp | ald orfU protein (AA 1–190) |
| 700261940H1 | g168406 | 44 | −74 | gb105pln | *Z. mays* alcohol dehydrogenase (ADH-1 C-m allele) gene, complete cds. |
| 700258059H1 | g22138 | 65 | −83 | gb105pln | *Z. mays* gene for acetohydroxyacid synthase (AHAS108). |
| 700261522H1 | g17593 | 8 | 4 | gb105allp | THIOREDOXINE |
| 700257673H1 | g2246457 | 35 | −8 | gb105pln | *Ricinus communis* sterol-C-methyltransferase mRNA, complete cds. |
| 700265580H1 | g1184771 | 92 | −85 | gb105pln | *Zea mays* glyceraldehyde-3-phosphate dehydrogenase GAPC2 (gpc2) mRNA, complete cds. |
| 700266064H1 | g475552 | 5 | 7 | gb105allp | N-methyl-D-aspartate receptor NMDAR2D subunit |
| 700258658H1 | g2809261 | 8 | 5 | gb105allp | F21B7.30 |
| 700260572H2 | g312180 | 60 | −77 | gb105pln | *Z. mays* GapC4 gene. |
| 700264634H1 | g2462745 | 18 | 5 | gb105eukp | F8A5.30 |
| 700264665H1 | g168480 | 51 | −73 | gb105pln | Maize embryo globulin S allele (7S-like) mRNA, complete cds. |
| 700258006H1 | g600115 | 40 | −45 | gb105pln | *Z. mays* apx gene encoding cytosolic ascorbate peroxidase. |
| 700257220H1 | g2632128 | 67 | −20 | gb105pln | *Zea mays* mRNA for poly(ADP-ribose) polymerase (3211 bp). |
| 700261247H1 | g2687432 | 33 | −18 | gb105pln | *Plumbago auriculata* large subunit 26S ribosomal RNA gene, partial sequence. |
| 700263109H1 | g2245622 | 24 | −9 | gb105eukp | SAND1; role in flower senescence; asparagine synthetase |
| 700266065H1 | g474007 | 38 | −24 | gb105pln | Rice mRNA, partial homologous to ribosomal protein S12 gene. |
| 700264335H1 | g1125690 | 26 | −4 | gb105pln | *S. tuberosum* mRNA for DnaJ protein. |
| 700257244H1 | g687244 | 44 | −77 | gb105pln | *Zea mays* oil body protein 16 kDa oleosin (ole16) gene, complete cds. |
| 700262176H1 | g1403188 | 24 | 2 | gb105eukp | F32D8.6 |
| 700257841H1 | g7357 | 16 | 3 | gb105allp | ribosomal protein L7 (AA 1–246) |
| 700259694H1 | g397632 | 31 | −13 | gb105pln | *T. aestivum* translation initiation factor 4A. |
| 700261242H1 | g2154715 | 12 | 7 | gb105eukp | CRK; CDPK-related protein kinase |
| 700268185H1 | g1370187 | 36 | −20 | gb105pln | *L. japonicus* mRNA for small GTP-binding protein, RAB7D. |
| 700266522H1 | g495263 | 24 | −6 | gb105eukp | sec61; sec61 protein |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700257240H1 | g633028 | 56 | −1 | gb105eukp | protein phosphatase 2C |
| 700259671H1 | g435172 | 28 | −42 | gb105pln | *A. sativa* (Pewi) ASTCP-K19 mRNA for t complex polypeptide 1. |
| 700259359H1 | g1302303 | 6 | 0 | gb105eukp | ORF YNL255c |
| 700256964H1 | g20755 | 40 | 1 | gb105pln | *P. sativum* mRNA rab for ras-related GTP-binding protein. |
| 700257286H1 | g2662187 | 39 | 14 | gb105pln | Chlamydomonas sp. mRNA for BBC1 protein, complete cds. |
| 700259714H1 | g169539 | 50 | −5 | gb105pln | Potato pyrophosphate-fructose 6-phosphate 1-phosphotransferase (PFP) beta-subunit mRNA, complete cds. |
| 700257008H1 | g31110 | 42 | 5 | gb105allp | put. eEF-TU (aa 1–94) |
| 700268106H1 | g21090 | 48 | −45 | gb105pln | Castor-bean mRNA for Rubisco subunit binding-protein alpha subunit. |
| 700266756H1 | g1419371 | 86 | −81 | gb105pln | *Z. mays* mRNA for 40S subunit ribosomal protein S21. |
| 700264846H1 | g1532072 | 31 | −0 | gb105pln | *Z. mays* mRNA for S-adenosylmethionine decarboxylase. |
| 700265184H1 | g488779 | 62 | −57 | gb105pln | *T. aestivum* mRNA for isomerase. |
| 700258909H1 | g294667 | 50 | −22 | gb105pln | Castor bean chloroplast beta-ketoacyl-ACP synthase (50 kDa synthase) mRNA, complete cds. |
| 700260677H1 | g2564003 | 21 | 2 | gb105allp | proteasome p45/SUG |
| 700267621H1 | g687244 | 49 | −73 | gb105pln | Zea mays oil body protein 16 kDa oleosin (ole16) gene, complete cds. |
| 700265916H1 | g1546890 | 15 | −12 | gb105eukp | TPS1; trehalose-6-phosphate synthase; EC 2.4.1.15 |
| 700265463H1 | g2098816 | 20 | 1 | gb105pln | *Arabidopsis thaliana* BAC F19G10, complete sequence. |
| 700261813H1 | g396209 | 33 | −23 | gb105pln | *S. polyrrhiza* mRNA for D-myo-inositol-3-phosphate synthase. |
| 700259145H2 | g899609 | 61 | −20 | gb105pln | Zea mays acidic ribosomal protein P2 (RPA-2A1) mRNA, complete cds. |
| 700262364H1 | g20680 | 26 | −11 | gb105pln | *P. sativum* mRNA of cDNA clone 26g. |
| 700261855H1 | g968901 | 41 | −50 | gb105pln | Rice mRNA for ribosomal protein S8, complete cds. |
| 700256892H1 | g1183936 | 12 | 7 | gb105pln | *P. sativum* 5S rRNA gene. |
| 700263708H1 | g169538 | 20 | 4 | gb105allp | pyrophosphate-fructose 6-phosphate 1-phosphotransferase alpha-subunit |
| 700267906H1 | g1469221 | 21 | −2 | gb105eukp | unknown |
| 700258581H1 | g1550813 | 88 | −87 | gb105pln | *Z. mays* mRNA for acidic ribosomal protein P0. |
| 700260359H2 | g169820 | 25 | 2 | gb105pln | *Oryza sativa* triosephosphate isomerase (Rictpi) mRNA, complete cds. |
| 700260426H1 | g20598 | 63 | −24 | gb105pln | *P. miliaceum* mRNA for aspartate aminotransferase (pcAAT2). |
| 700268176H1 | g169472 | 40 | −32 | gb105pln | Potato alpha-glucan phosphorylase type H isozyme mRNA, complete cds. |
| 700261163H1 | g544506 | 5 | 7 | gb105allp | Siklp |
| 700257536H1 | g2661441 | 21 | 1 | gb105allp | 3-dehydroquinate synthetase |
| 700264091H1 | g168406 | 39 | −74 | gb105pln | *Z. mays* alcohol dehydrogenase (ADH-1 C-m allele) gene, complete cds. |
| 700260384H1 | g486112 | 15 | 4 | gb105allp | ORF YKL078w |
| 700261384H1 | g1296954 | 40 | −31 | gb105pln | *O. sativa* mRNA for novel protein, osr40c1. |
| 700266553H1 | g927239 | 6 | 6 | gb105allp | globulin1 |
| 700264178H1 | g22283 | 62 | −25 | gb105pln | Zea mays Glb1-L gene for vicilin-like embryo storage protein. |
| 700207147H1 | g960356 | 27 | −21 | gb105pln | Barley mRNA for S-adenosylmethionine synthetase, complete cds. |
| 700207129H1 | g396209 | 30 | −24 | gb105pln | *S. polyrrhiza* mRNA for D-myo-inositol-3-phosphate synthase. |
| 700259562H1 | g927238 | 37 | −37 | gb105pln | Zea mays globulin1 (Glb1) gene, allele Glb1-Hb, complete cds. |
| 700263065H1 | g2341025 | 52 | −11 | gb105eukp | F19P19.2; F19P19.2 |
| 700226670H1 | g2317874 | 26 | 3 | gb105allp | Rab7 GTP binding protein |
| 700267343H1 | g687244 | 53 | −62 | gb105pln | Zea mays oil body protein 16 kDa oleosin (ole16) gene, complete cds. |
| 700262494H1 | g829147 | 87 | −80 | gb105pln | *Z. mays* gene for cyclophilin. |
| 700266435H1 | g218099 | 26 | −51 | gb105pln | Rice mRNA for ribosomal protein S12 (320 gene), partial sequence. |
| 700258421H1 | g22144 | 70 | −75 | gb105pln | Maize anaerobically regulated gene for fructose bisphosphate aldolase (EC 4.1.2.13). |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264870H1 | g2305013 | 46 | −56 | gb105pln | *Musa acuminata* S-adenosyl-L-methionine synthetase homolog mRNA, complete cds. |
| 700259474H1 | g170155 | 50 | −9 | gb105pln | *Sorghum bicolor* endosperm tissue mRNA, complete CDS. |
| 700262976H1 | g1045304 | 96 | −70 | gb105pln | *Zea mays* acetyl-coenzyme A carboxylase mRNA, complete cds. |
| 700257375H1 | g2463334 | 28 | −22 | gb105pln | *Oryza sativa* mRNA for ribosomal protein S4. |
| 700257044H1 | g2624199 | 53 | −18 | gb105pln | *M. acuminata* mRNA; clone pBAN UU93. |
| 700262955H1 | g600768 | 54 | −36 | gb105pln | *Oryza sativa* cyclophilin 2 (Cyp2) mRNA, complete cds. |
| 700261729H1 | g22283 | 33 | 16 | gb105pln | *Zea mays* Glb1-L gene for vicilin-like embryo storage protein. |
| 700258021H1 | g1439631 | 12 | 2 | gb105eukp | C52B9.8 |
| 700257851H1 | g2446980 | 48 | −23 | gb105pln | *Arabidopsis thaliana* mRNA for AtGDI2, complete cds. |
| 700256728H1 | g1160445 | 6 | 7 | gb105allp | ribosomal protein S7 |
| 700258614H1 | g1651457 | 37 | −23 | gb105allp | Aminopeptidase N |
| 700262334H1 | g2282583 | 71 | −66 | gb105pln | *Zea mays* elongation factor 1-alpha (EF1-A) mRNA, complete cds. |
| 700265083H1 | g2689469 | 33 | −15 | gb105eukp | IAA22 |
| 700258038H1 | g974781 | 53 | −41 | gb105pln | *C. blumei* kinetoplast met gene for cobalamine-independent methionine synthase. |
| 700267955H1 | g168512 | 29 | 15 | gb105pln | Maize major protein (L3) mRNA from the surface of lipid bodies, 3' end. |
| 700261634H1 | g22283 | 58 | −27 | gb105pln | *Zea mays* Glb1-L gene for vicilin-like embryo storage protein. |
| 700258516H1 | g2464917 | 11 | 8 | gb105eukp | hypothetical protein |
| 700258284H1 | g495262 | 22 | −3 | gb105pln | *P. salina* sec61 mRNA. |
| 700261801H1 | g1171347 | 17 | 15 | gb105pln | *Triticum aestivum* pMA1951 mRNA, partial cds. |
| 700268063H1 | g596077 | 32 | 1 | gb105pln | *Zea mays* thiamine biosynthetic enzyme (thi1-1) mRNA, complete cds. |
| 700257732H1 | g19010 | 38 | −3 | gb105pln | *H. vulgare* mRNA for jasmonate-induced protein. |
| 700267856H1 | g2832672 | 18 | 1 | gb105eukp | T10I14.50; nifU-like protein |
| 700263382H1 | g22525 | 49 | −70 | gb105pln | *Zea mays* gene encoding a zein (clone zA1). |
| 700263111H1 | g1403044 | 44 | 1 | gb105allp | S-adenosylmethionine decarboxylase |
| 700259016H1 | g633889 | 22 | −23 | gb105pln | glucose and ribitol dehydrogenase homolog [*Hordeum vulgare* = barley, Aura, embryo, mRNA, 1170 nt]. |
| 700257219H1 | g22285 | 38 | 9 | gb105pln | *Zea mays* Glb1-S gene for vicilin-like embryo storage protein. |
| 700267889H1 | g790969 | 55 | −48 | gb105pln | Rice mRNA for aldolase C-1, complete cds. |
| 700266566H1 | g22119 | 82 | −85 | gb105pln | Maize Adh1-F mRNA for alcohol dehydrogenase. |
| 700264669H1 | g2342735 | 21 | −5 | gb105eukp | T14G11.28 |
| 700263451H1 | g2642429 | 11 | 6 | gb105eukp | T20D16.2; putative poly(A)-binding protein |
| 700262585H1 | g161172 | 17 | −1 | gb105eukp | elongation factor 1-gamma |
| 700257938H1 | g20319 | 25 | 4 | gb105pln | Rice rab25 mRNA. |
| 700266089H1 | g1665777 | 13 | 0 | gb105allp | Similar to *S. cerevisiae* EMP70 protein precursor (S25110) |
| 700263850H1 | g687244 | 35 | −51 | gb105pln | *Zea mays* oil body protein 16 kDa oleosin (ole16) gene, complete cds. |
| 700261845H1 | g1915959 | 13 | 15 | gb105pln | *T. aestivum* mRNA for peptidylprolyl isomerase. |
| 700257944H1 | g2252472 | 14 | 3 | gb105allp | argininosuccinate lyase |
| 700260562H2 | g168512 | 37 | −43 | gb105pln | Maize major protein (L3) mRNA from the surface of lipid bodies, 3' end. |
| 700261144H1 | g459894 | 30 | −10 | gb105pln | *Zea mays* sus1 gene, complete cds. |
| 700266886H1 | g168496 | 59 | −26 | gb105pln | Maize (*Zea mays*) histone H3 gene (H3C4), complete cds. |
| 700261614H1 | g435648 | 46 | −31 | gb105pln | Rice mRNA for gamma-Tip, complete cds. |
| 700263349H1 | g951438 | 13 | 7 | gb105allp | aklavinone C-11 hydroxylase |
| 700262465H1 | g310932 | 42 | −48 | gb105pln | *Nicotiana tabacum* ribosomal protein L17 mRNA, complete cds. |
| 700257536H1 | g1573167 | 21 | 1 | gb105allp | 3-dehydroquinate synthase (aroB) |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700266242H1 | g2656031 | 14 | 10 | gb105pln | *Arabidopsis thaliana* genomic DNA, chromosome 5, P1 clone: MXC20. |
| 700262295H1 | g1019904 | 80 | 6 | gb105allp | cell division cycle protein |
| 700259166H2 | g2623294 | 8 | 13 | gb105pln | *Arabidopsis thaliana* chromosome II BAC T20B5 genomic sequence, complete sequence. |
| 700266460H1 | g168508 | 40 | −71 | gb105pln | Maize oleosin KD18 (KD18; L2) gene, complete cds. |
| 700266247H1 | g549972 | 44 | −39 | gb105pln | *Arabidopsis thaliana* Col-0 casein kinase I-like protein mRNA, complete cds. |
| 700258171H1 | g22285 | 57 | −81 | gb105pln | *Zea mays* Glb1-S gene for vicilin-like embryo storage protein. |
| 700260539H2 | g22281 | 18 | −33 | gb105pln | *Zea mays* Glb1-0 gene for vicilin-like storage protein (truncated). |
| 700265817H1 | g1171351 | 60 | −4 | gb105pln | *Oryza sativa* 16 kDa oleosin (ole16) mRNA, complete cds. |
| 700264414H1 | g168512 | 48 | −47 | gb105pln | Maize major protein (L3) mRNA from the surface of lipid bodies, 3' end. |
| 700266883H1 | g433706 | 49 | −9 | gb105pln | *Z. mays* PRP gene. |
| 700266676H1 | g471320 | 48 | −48 | gb105pln | *H. vulgare* (cv. Bomi) B15C mRNA. |
| 700265222H1 | g687244 | 44 | −70 | gb105pln | *Zea mays* oil body protein 16 kDa oleosin (ole16) gene, complete cds. |
| 700264685H1 | g2213607 | 18 | −4 | gb105eukp | F21J9.1 |
| 700263155H1 | g1079683 | 11 | 7 | gb105eukp | YPL059W; Yp1059wp |
| 700257428H2 | g1359497 | 26 | −3 | gb105eukp | seryl-tRNA Synthetase |
| 700257841H1 | g307388 | 15 | 5 | gb105allp | ribosomal protein L7 |
| 700266596H1 | g168543 | 100 | −36 | gb105pln | *Zea mays* putative ribosomal protein S8 mRNA, partial cds. |
| 700265655H1 | g20163 | 38 | −31 | gb105pln | *O. sativa* Rr15 mRNA for 5S ribosomal RNA. |
| 700267019H1 | g2267592 | 35 | −17 | gb105pln | *Oryza sativa* glycine-rich RNA-binding protein mRNA, complete cds. |
| 700265110H1 | g22118 | 47 | −75 | gb105pln | *Z. mays* DNA for Adh1-Cm allele. |
| 700264380H1 | g607193 | 28 | −20 | gb105pln | *S. oleracea* GAT mRNA for glycerol-3-phosphate O-acyltransferase. |
| 700264296H1 | g555945 | 26 | 6 | gb105allp | ribosomal protein S3 |
| 700264907H1 | g1171351 | 25 | −10 | gb105pln | *Oryza sativa* 16 kDa oleosin (ole16) mRNA, complete cds. |
| 700261692H1 | g22283 | 50 | −46 | gb105pln | *Zea mays* Glb1-L gene for vicilin-like embryo storage protein. |
| 700267375H1 | g1890154 | 16 | −2 | gb105eukp | alpha-mannosidase precursor |
| 700258621H1 | g2668741 | 39 | −45 | gb105pln | *Zea mays* glycine-rich RNA binding protein (GRP) mRNA, complete cds. |
| 700264460H1 | g1532072 | 36 | −7 | gb105pln | *Z. mays* mRNA for S-adenosylmethionine decarboxylase. |
| 700257623H1 | g1694832 | 30 | −8 | gb105pln | *H. vulgare* Per1 gene. |
| 700260174H1 | g168553 | 72 | −43 | gb105pln | *Zea mays* putative cytoplasmic malate dehydrogenase homolog mRNA, partial cds. |
| 700260189H1 | g2197121 | 59 | −32 | gb105pln | *Prunus armeniaca* 26S ribosomal RNA gene, partial sequence. |
| 700267204H1 | g829147 | 88 | −87 | gb105pln | *Z. mays* gene for cyclophilin. |
| 700262412H1 | g313266 | 36 | −20 | gb105pln | *T. aestivum* gene for phosphoglycerate kinase. |
| 700261885H1 | g2282583 | 53 | −68 | gb105pln | *Zea mays* elongation factor 1-alpha (EF1-A) mRNA, complete cds. |
| 700258081H1 | g1181672 | 49 | −38 | gb105pln | Sorghum bicolor heat shock protein 70 cognate (hsc70) mRNA, partial cds. |
| 700258621H1 | g2293479 | 27 | −29 | gb105pln | *Oryza sativa* glycine-rich protein mRNA, complete cds. |
| 700258935H1 | g1171347 | 26 | −5 | gb105pln | *Triticum aestivum* pMA1951 mRNA, partial cds. |
| 700264862H1 | g22285 | 34 | −79 | gb105pln | *Zea mays* Glb1-S gene for vicilin-like embryo storage protein. |
| 700257295H1 | g1632830 | 44 | 0 | gb105pln | *R. communis* mRNA (unknown). |
| 700260550H2 | g1825606 | 18 | 4 | gb105allp | similar to molybdoterin biosynthesis MOEB proteins |
| 700263354H1 | g218176 | 29 | −39 | gb105pln | Rice mRNA for 21 kd polypeptide. |
| 700265838H1 | g603802 | 32 | 2 | gb105allp | Whole ORF continues from bp19 (right after 'tag') to bp1596 ('tga').; similar to chinese hamster phosphatidylserine synthase. |
| 700265641H1 | g2760172 | 16 | 9 | gb105pln | *Arabidopsis thaliana* genomic DNA, chromosome 5, P1 clone: MUB3, complete sequence. |
| 700258689H1 | g1575127 | 74 | −80 | gb105pln | *Zea mays* lumenal binding |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | protein cBiPe2 mRNA, complete cds. |
| 700267484H1 | g2662346 | 65 | −29 | gb105pln | *Oryza sativa* mRNA for EF-1 alpha, complete cds. |
| 700258308H1 | g2832620 | 7 | 7 | gb105eukp | F13C5.90; hypothetical protein |
| 700258051H1 | g21725 | 17 | −16 | gb105pln | *T. aestivum* (cDNA III) mRNA for EC protein. |
| 700263681H1 | g2494111 | 55 | −33 | gb105eukp | T1G11.5 |
| 700265556H1 | g168512 | 37 | −41 | gb105pln | Maize major protein (L3) mRNA from the surface of lipid bodies, 3' end. |
| 700256761H1 | g21894 | 32 | 4 | gb105pln | *T. aestivum* (clone pTAU2.2) U2 snRNA. |
| 700265662H1 | g2827001 | 40 | −38 | gb105pln | *Triticum aestivum* 70 kDa heat shock protein (TaHSP70d) mRNA, complete cds. |
| 700266221H1 | g20237 | 10 | 2 | gb105pln | *O. sativa* (rice) constitutive GOS2 gene. |
| 700266063H1 | g168575 | 55 | −9 | gb105pln | Maize phospholipid transfer protein mRNA, complete cds. of clone 9C2. |
| 700266114H1 | g804655 | 24 | −15 | gb105pln | *Hordeum vulgare* L. beta-glucosidase (BGQ60) gene, complete cds. |
| 700261719H1 | g312178 | 45 | −20 | gb105pln | *Z. mays* GapC2 gene. |
| 700261637H1 | g22281 | 53 | −76 | gb105pln | *Zea mays* Glb1-0 gene for vicilin-like storage protein (truncated). |
| 700263613H1 | g644491 | 49 | −54 | gb105pln | Corn mRNA for elongation factor 1A. |
| 700262639H1 | g602605 | 36 | −75 | gb105pln | *Zea mays* tandem genes for alpha1-tubulin and alpha2-tubulin. |
| 700267262H1 | g471320 | 60 | −56 | gb105pln | *H. vulgare* (cv. Bomi) B15C mRNA. |
| 700259667H1 | g975887 | 23 | −1 | gb105pln | *Mesembryanthemum crystallinum* myo-inositol-1-phosphate synthase mRNA, complete cds. |
| 700257008H1 | g50799 | 42 | 5 | gb105allp | put. eEF-TU (aa 1–94) |
| 700263713H1 | g168512 | 19 | 0 | gb105pln | Maize major protein (L3) mRNA from the surface of lipid bodies, 3' end. |
| 700266772H1 | g1899187 | 24 | −10 | gb105pln | *Nicotiana tabacum* DNA binding protein ACBF mRNA, complete cds. |
| 700257127H1 | g22283 | 84 | −79 | gb105pln | *Zea mays* Glb1-L gene for vicilin-like embryo storage protein. |
| 700259368H1 | g170663 | 60 | −54 | gb105pln | Wheat protein kinase mRNA, partial cds. |
| 700263320H1 | g1171351 | 16 | −2 | gb105pln | *Oryza sativa* 16 kDa oleosin (ole16) mRNA, complete cds. |
| 700264979H1 | g533251 | 78 | −81 | gb105pln | *Zea mays* (clone pSM8) sucrose synthase 2 (Sus1) gene, complete cds. |
| 700263622H1 | g558401 | 24 | −17 | gb105eukp | incomplete orf, len: 160, CAI: 0.09 similar to MRP_ECOLI P21590 39.9 KD PROTEIN |
| 700260945H1 | g836942 | 8 | 3 | gb105allp | calcium-dependent protein kinase |
| 700266747H1 | g1049332 | 92 | −10 | gb105pln | *Koelreuteria paniculata* 18S ribosomal RNA gene, partial sequence. |
| 700267976H1 | g1185553 | 33 | −70 | gb105pln | *Zea mays* glyceraldehyde-3-phosphate dehydrogenase (gpc2) gene, complete cds. |
| 700259823H1 | g167961 | 28 | −9 | gb105pln | *D. caryophyllus* S-adenosylmethionine synthetase (CARSAM2) mRNA, complete cds. |
| 700262270H1 | g2570066 | 45 | −38 | gb105pln | *Pisum sativum* mRNA for second sucrose synthase. |
| 700262086H1 | g170775 | 59 | −50 | gb105pln | Wheat translation elongation factor 1 alpha-subunit (TEF1) mRNA, complete cds. |
| 700266864H1 | g1519248 | 35 | −14 | gb105pln | *Oryza sativa* GF14-b protein mRNA, complete cds. |
| 700260959H1 | g168480 | 95 | −68 | gb105pln | Maize embryo globulin S allele (7S-like) mRNA, complete cds. |
| 700260931H1 | g487295 | 20 | −7 | gb105pln | Rice mRNA EN242, partial sequence. |
| 700258559H1 | g703106 | 17 | 3 | gb105allp | thyroid receptor interactor |
| 700258383H1 | g167787 | 29 | −17 | gb105pln | *D. discoideum* elongation factor 2 mRNA, complete cds. |
| 700257644H1 | g218082 | 39 | 3 | gb105pln | Rice mRNA for initiation factor eIF-4D (225 gene), partial sequence. |
| 700267527H1 | g1777706 | 58 | −74 | gb105pln | *Zea mays* 18S ribosomal RNA gene, partial sequence. |
| 700258285H1 | g2791292 | 9 | 5 | gb105eukp | F26H11.3b |
| 700259743H1 | g695625 | 28 | 5 | gb105allp | CCTtheta, theta subunit of the |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | chaperonin containing TCP-1 (CCT) |
| 700262486H1 | g398921 | 32 | −17 | gb105pln | *B. napus* cold induced protein (BnC24B). |
| 700266881H1 | g168512 | 31 | 6 | gb105pln | Maize major protein (L3) mRNA from the surface of lipid bodies, 3' end. |
| 700262103H1 | g22149 | 74 | −66 | gb105pln | *Z. mays* mRNA for alpha-tubulin 3. |
| 700256890H1 | g2267005 | 55 | −41 | gb105pln | *Oryza sativa* endosperm lumenal binding protein (BiP) mRNA, complete cds. |
| 700260103H1 | g960356 | 36 | −3 | gb105pln | Barley mRNA for S-adenosylmethionine synthetase, complete cds. |
| 700261008H1 | g1556445 | 22 | 13 | gb105pln | *Hordeum vulgare* alpha tubulin (tubA) mRNA, complete cds. |
| 700267720H1 | g1103319 | 34 | −38 | gb105pln | *A. thaliana* CKI2 mRNA for casein kinase I. |
| 700257570H1 | g2275295 | 15 | 13 | gb105pln | Yeast (*Schizosaccharomyces pombe*) 60S ribosomal protein L31 homolog mRNA, partial cds. |
| 700258602H1 | g217832 | 30 | 14 | gb105pln | *Arabidopsis thaliana* DNA for ascorbate peroxidase. |
| 700266936H1 | g2058510 | 46 | −13 | gb105eukp | repD; RepD |
| 700263290H1 | g1842187 | 13 | 14 | gb105pln | *B. pendula* mRNA encoding mitochondrial phosphate translocator. |
| 700267427H1 | g1777929 | 36 | −27 | gb105pln | *Saccharum officinarum* nucleoside diphosphate kinase (SoNDPK1) mRNA, complete cds. |
| 700260585H2 | g8497 | 18 | −2 | gb105eukp | E(Dfd); SRp55 |
| 700264523H1 | g2286150 | 63 | −71 | gb105pln | *Zea mays* translation initiation factor (eIF-4A) mRNA, complete cds. |
| 700256780H1 | g1658312 | 22 | −42 | gb105pln | *O. sativa* osr40g2 gene. |
| 700267893H1 | g1015849 | 10 | −1 | gb105eukp | RPS5 |
| 700261677H1 | g1066162 | 39 | −3 | gb105pln | *B. napus* mRNA for glyoxysomal beta-ketoacyl-thiolase precursor. |
| 700256914H1 | g1498365 | 49 | −20 | gb105pln | *Solanum lycopersicum* actin (Tom51) gene, partial cds. |
| 700265006H1 | g1171351 | 12 | 16 | gb105pln | *Oryza sativa* 16 kDa oleosin (ole16) mRNA, complete cds. |
| 700264182H1 | g471320 | 52 | −50 | gb105pln | *H. vulgare* (cv. Bomi) B15C mRNA. |
| 700262434H1 | g471320 | 20 | −31 | gb105pln | *H. vulgare* (cv. Bomi) B15C mRNA. |
| 700262412H1 | g21834 | 60 | −51 | gb105pln | Wheat mRNA for cytosolic phosphoglycerate kinase (EC 2.7.2.3). |
| 700258233H1 | g169295 | 23 | 17 | gb105pln | Pharbitis nil heat shock protein 83 (Hsp83) gene, complete cds. |
| 700259245H1 | g1841307 | 11 | 11 | gb105pln | Fission Yeast mRNA for ribosomal protein S16 homolog, partial cds. |
| 700267401H1 | g1314409 | 31 | −26 | gb105pln | *Zea mays* ssp. *parviglumis* USDA PI 331783 ITS1, 5.8S ribosomal RNA, ITS2. |
| 700259236H1 | g551266 | 23 | −8 | gb105pln | *P. argentatum* (line 11591) 60S acidic ribosomal protein P2 mRNA. |
| 700266855H1 | g2653012 | 25 | 5 | gb105eukp | eft-2; F25H5.4 |
| 700266474H1 | g2827140 | 45 | −18 | gb105pln | *Arabidopsis thaliana* cellulose synthase cataiytic subunit (Ath-A) mRNA, complete cds. |
| 700264492H1 | g168512 | 30 | −14 | gb105pln | Maize major protein (L3) mRNA from the surface of lipid bodies, 3' end. |
| 700262958H1 | g2262167 | 28 | 5 | gb105allp | cytosolic ribosomal protein S4 |
| 700258824H1 | g22155 | 71 | −79 | gb105pln | *Z. mays* mRNA for alpha-tubulin 5. |
| 700262306H1 | g469069 | 4 | 7 | gb105allp | NMDA receptor subunit NR2D |
| 700258019H1 | g596077 | 72 | −51 | gb105pln | *Zea mays* thiamine biosynthetic enzyme (thi1-1) mRNA, complete cds. |
| 700266659H1 | g1109672 | 27 | −20 | gb105eukp | 3'(2'),5-diphosphonucleoside 3'(2') phosphohydrolase |
| 700261744H1 | g2687433 | 53 | −61 | gb105pln | *Tragopogon dubius* large subunit 26S ribosomal RNA gene, partial sequence. |
| 700267071H1 | g553035 | 33 | 5 | gb105allp | pal protein |
| 700264383H1 | g2351061 | 16 | −3 | gb105pln | *Arabidopsis thaliana* genomic DNA, chromosome 5, P1 clone: MAF19. |
| 700263179H1 | g968995 | 44 | −35 | gb105pln | *Oryza sativa* clone glyceraldehyde-3-phosphate dehydrogenase (Gpc) mRNA, complete cds. |
| 700207203H1 | g2633671 | 11 | 2 | gb105allp | similar to hypothetical proteins |
| 700264360H1 | g429148 | 96 | −92 | gb105pln | *Z. mays* pep gene for (C3 type) phosphoendopyruvate carboxylase. |
| 700265014H1 | g1256424 | 13 | 8 | gb105eukp | BCPI-2; cysteine proteinase |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264678H1 | g2267592 | 33 | −24 | gb105pln | inhibitor<br>*Oryza sativa* glycine-rich<br>RNA-binding protein mRNA, complete cds. |
| 700265221H1 | g168480 | 62 | 4 | gb105pln | Maize embryo globulin S allele<br>(7S-like) mRNA, complete cds. |
| 700258186H1 | g166679 | 18 | 2 | gb105pln | *Arabidopsis thaliana* negative<br>regulator of the ethylene response pathway (CTR1)<br>mRNA, complete cds. |
| 700259576H1 | g168514 | 14 | −22 | gb105pln | *Z. mays* c1 locus myb homologue<br>cDNA, exons 1–3. |
| 700262729H1 | g22281 | 73 | −31 | gb105pln | *Zea mays* Glb1-0 gene for<br>vicilin-like storage protein (truncated). |
| 700262322H1 | g493586 | 18 | −8 | gb105pln | *Hordeum vulgare* disulfide<br>isomerase (PDI) mRNA, complete cds. |
| 700265593H1 | g2389000 | 7 | 3 | gb105eukp | SPAC6F6.10c; hypothetical<br>protein |
| 700262957H1 | g1622938 | 18 | 9 | gb105pln | *Bromus secalinus* oleosin<br>(ole16) mRNA, complete cds. |
| 700261140H1 | g22284 | 10 | 4 | gb105eukp | Glb1-L; vicilin-like embryo<br>storage protein |
| 700264084H1 | g551251 | 6 | 3 | gb105allp | ribosomal protein S7 |
| 700260125H1 | g168480 | 41 | −63 | gb105pln | Maize embryo globulin S allele<br>(7S-like) mRNA, complete cds. |
| 700261936H1 | g642163 | 59 | 2 | gb105pln | *B. dictyophylia* ITS2 and 28S<br>rRNA gene (partial). |
| 700259805H1 | g927427 | 11 | −1 | gb105pln | *L. usitatissimum* mRNA for fis1<br>protein. |
| 700260977H1 | g633889 | 18 | −1 | gb105pln | glucose and ribitol<br>dehydrogenase homolog [*Hordeum vulgare* =<br>barley, Aura, embryo, mRNA, 1170 nt]. |
| 700259454H1 | g22281 | 39 | 11 | gb105pln | *Zea mays* Glb1-0 gene for<br>vicilin-like storage protein (truncated). |
| 700259638H1 | g1617036 | 37 | −16 | gb105eukp | Ted2 |
| 700266062H1 | g563234 | 24 | −10 | gb105pln | *Zea mays* xyloglucan<br>endo-transglycosylase homolog gene, complete cds. |
| 700266972H1 | g758354 | 86 | −79 | gb105pln | *Z. mays* mRNA for plasma<br>membrane H+ ATPase. |
| 700263851H1 | g1370189 | 11 | 14 | gb105pln | *L. japonicus* mRNA for small<br>GTP-binding protein, RAB8A. |
| 700259822H1 | g2668737 | 40 | −61 | gb105pln | *Zea mays* translation<br>initiation factor 5A (TIF5A) mRNA, complete cds. |
| 700265488H1 | g218000 | 42 | −34 | gb105pln | Potato mRNA for UDP-glucose<br>pyrophosphorylase (EC 2.7.7.9). |
| 700265471H1 | g168508 | 57 | −63 | gb105pln | Maize oleosin KD18 (KD18; L2)<br>gene, complete cds. |
| 700263101H1 | g443591 | 48 | 5 | gb105eukp | rpl19, bind calmodulin;<br>ribosomal protein; v14 gene |
| 700267164H1 | g22281 | 56 | −68 | gb105pln | *Zea mays* Glb1-0 gene for<br>vicilin-like storage protein (truncated). |
| 700261181H1 | g347844 | 84 | −34 | gb105pln | *Zea mays* globulin-1 gene,<br>terminator region. |
| 700264219H1 | g1658312 | 30 | −8 | gb105pln | *O. sativa* osr40g2 gene. |
| 700264275H1 | g1550813 | 100 | −91 | gb105pln | *Z. mays* mRNA for acidic<br>ribosomal protein P0. |
| 700263482H1 | g1553130 | 38 | 16 | gb105pln | *Gossypium hirsutum* ribosomal<br>protein L44 isoform b (RL44), complete cds. |
| 700267781H1 | g1125691 | 16 | −0 | gb105eukp | dnaJ; DnaJ protein |
| 700257411H2 | g2369713 | 47 | −47 | gb105pln | *Beta vulgaris* cDNA for<br>elongation factor 2. |
| 700257175H1 | g168512 | 36 | 11 | gb105pln | Maize major protein (L3) mRNA<br>from the surface of lipid bodies, 3' end. |
| 700267647H1 | g168512 | 49 | 15 | gb105pln | Maize major protein (L3) mRNA<br>from the surface of lipid bodies, 3' end. |
| 700265914H1 | g2305013 | 56 | −50 | gb105pln | *Musa acuminata*<br>S-adenosyl-L-methionine synthetase homolog<br>mRNA, complete cds. |
| 700265103H1 | g1196913 | 5 | 7 | gb105allp | unknown protein |
| 700258690H1 | g2618602 | 13 | 6 | gb105pln | *Arabidopsis thaliana* genomic<br>DNA, chromosome 5, P1 clone: MSJ1,<br>complete sequence. |
| 700258064H1 | g868003 | 37 | −6 | gb105eukp | a member for glyoxylate cycle;<br>aconitase; EC 4.2.1.3 |
| 700267423H1 | g2511530 | 74 | −66 | gb105pln | *Eleusine indica* alpha tubulin 1<br>(TUA1) mRNA, complete cds. |
| 700261247H1 | g2687433 | 32 | −17 | gb105pln | *Tragopogon dubius* large<br>subunit 26S ribosomal RNA gene, partial sequence. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264261H1 | g1302371 | 13 | 7 | gb105allp | ORF YNL288w |
| 700262341H1 | g2351063 | 21 | 0 | gb105pln | *Arabidopsis thaliana* genomic DNA, chromosome 5, P1 clone: MCL19. |
| 700267520H1 | g927238 | 62 | −73 | gb105pln | *Zea mays* globulin1 (Glb1) gene, allele Glb1-Hb, complete cds. |
| 700264943H1 | g168481 | 8 | 2 | gb105allp | globulin precursor |
| 700266363H1 | g168480 | 49 | −63 | gb105pln | Maize embryo globulin S allele (7S-like) mRNA, complete cds. |
| 700256720H1 | g2282036 | 15 | −2 | gb105allp | p34-Arc |
| 700266676H1 | g971279 | 45 | −43 | gb105pln | Rice mRNA for RAB24 protein, complete cds. |
| 700267306H1 | g22328 | 50 | −34 | gb105pln | Maize mRNA for a high mobility. group protein. |
| 700266513H1 | g927239 | 6 | 7 | gb105allp | globulin1 |
| 700264482H1 | g168512 | 33 | −15 | gb105pln | Maize major protein (L3) mRNA from the surface of lipid bodies, 3′ end. |
| 700264440H1 | g416499 | 7 | 6 | gb105allp | globulin |
| 700267384H1 | g22144 | 91 | −36 | gb105pln | Maize anaerobically regulated gene for fructose bisphosphate aldolase (EC 4.1.2.13). |
| 700265213H1 | g1532072 | 39 | −46 | gb105pln | *Z. mays* mRNA for S-adenosylmethionine decarboxylase. |
| 700265954H1 | g2316016 | 9 | 4 | gb105eukp | MRP-like ABC transporter |
| 700265281H1 | g415314 | 12 | 17 | gb105pln | Rice mRNA for NADP dependent malic enzyme, complete cds. |
| 700256738H1 | g18963 | 18 | 2 | gb105pln | *Z. mays* mRNA for dehydrin (dhn3). |
| 700267950H1 | g1154858 | 27 | 14 | gb105pln | *H. vulgare* mRNA for L24 ribosomal protein. |
| 700265789H1 | g596079 | 86 | −49 | gb105pln | *Zea mays* thiamine biosynthetic enzyme (thi1-2) mRNA, complete cds. |
| 700266646H1 | g927238 | 69 | −50 | gb105pln | *Zea mays* globulin1 (Glb1) gene, allele Glb1-Hb, complete cds. |
| 700265260H1 | g2827141 | 51 | −11 | gb105eukp | Ath-A; cellulose synthase catalytic subunit |
| 700262711H1 | g452559 | 35 | −52 | gb105pln | *Zea mays* group 3 Lea protein MGL3 mRNA, complete cds. |
| 700257790H1 | g313145 | 53 | −29 | gb105pln | *A. medicago* MSK-2 mRNA for protein kinase. |
| 700257753H1 | g433871 | 37 | −28 | gb105pln | *C. roseus* mRNA for HMG protein. |
| 700257133H1 | g471320 | 52 | −52 | gb105pln | *H. vulgare* (cv. Bomi) B15C mRNA. |
| 700258626H1 | g687246 | 30 | −13 | gb105pln | *Zea mays* oil body protein 17 kDa oleosin (ole17) gene, complete cds. |
| 700259384H1 | g1694832 | 22 | −33 | gb105pln | *H. vulgare* Per1 gene. |
| 700258153H1 | g1314048 | 21 | 4 | gb105pln | *D. sativa* mRNA for archain/delta-COP. |
| 700257743H1 | g312178 | 28 | −13 | gb105pln | *Z. mays* GapC2 gene. |
| 700259391H1 | g1037129 | 58 | 11 | gb105pln | (gamma-zeinA) = opaque2 modifier {5′ region} [Zea mays = maize, Tuxpeno CMS 450, mRNA Partial, 1889 nt]. |
| 700267570H1 | g927239 | 6 | 7 | gb105allp | globulin1 |
| 700264896H1 | g289658 | 52 | −32 | gb105eukp | C50C3.6 protein |
| 700264343H1 | g2191149 | 31 | −14 | gb105eukp | A_IG002N01.22 |
| 700257674H1 | g168480 | 82 | −31 | gb105pln | Maize embryo globulin S allele (7S-like) mRNA, complete cds. |
| 700263778H1 | g1657761 | 86 | −78 | gb105pln | *Zea mays* retrotransposon Grande-Zm 5′ LTR and and primer binding site DNA sequence. |
| 700264085H1 | g1724103 | 58 | −23 | gb105pln | *Mesembryanthemum crystallinum* methionine adenosyltransferase mRNA, complete cds. |
| 700263167H1 | g168508 | 69 | −49 | gb105pln | Maize oleosin KD18 (KD18; L2) gene, complete cds. |
| 700257965H1 | g487286 | 31 | 4 | gb105pln | Rice mRNA EN053, partial sequence. |
| 700264412H1 | g172578 | 14 | 6 | gb105eukp | SEN3; affects tRNA processing |
| 700267269H1 | g1212995 | 48 | −44 | gb105pln | *H. vulgare* mRNA for UDP-glucose pyrophosphorylase. |
| 700258675H1 | g22312 | 64 | −7 | gb105pln | Maize ABA-inducible gene for glycine-rich protein (ABA = abscisic acid). |
| 700267640H1 | g169834 | 48 | −70 | gb105pln | Rye 26S rRNA 3′ end and 18S rRNA, 5′ end. |
| 700267590H1 | g2282583 | 67 | −81 | gb105pln | *Zea mays* elongation factor 1-alpha (EF1-A) mRNA, complete cds. |
| 700264168H1 | g2618600 | 20 | −6 | gb105pln | *Arabidopsis thaliana* genomic |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | DNA, chromosome 5, P1 clone: MDC12, complete sequence. |
| 700258470H1 | g303848 | 46 | −22 | gb105pln | Rice mRNA for nucleoside diphosphate kinase, complete cds. |
| 700261612H1 | g536891 | 39 | −25 | gb105pln | Wheat mRNA for protein H2A, complete cds, clone wcH2A-4. |
| 700267256H1 | g1244652 | 16 | −13 | gb105pln | *Zea mays* copia-type retroelement PREM-2 gag gene, complete cds. |
| 700265994H1 | g22302 | 35 | −22 | gb105pln | Maize Gpc1 gene for glyceraldehyde-3-phosphate dehydrogenase (GADPH) subunit C. |
| 700262060H1 | g217871 | 35 | −12 | gb105eukp | t-complex polypeptide 1 homologue |
| 700262920H1 | g2213424 | 25 | −11 | gb105pln | *Citrus paradisi* mRNA for hypothetical protein. |
| 700264931H1 | g218082 | 33 | −37 | gb105pln | Rice mRNA for initiation factor eIF-4D (225 gene), partial sequence. |
| 700258233H1 | g300082 | 29 | 14 | gb105pln | hsp82 = 82 kda heat shock protein [*Zea mays*, seedling, leaves, Genomic, 3468 nt]. |
| 700261376H1 | g1122443 | 26 | −7 | gb105eukp | Xa21; receptor kinase-like protein |
| 700266273H1 | g887937 | 19 | −2 | gb105eukp | GAST1 protein homolog |
| 700265070H1 | g388052 | 73 | −82 | gb105pln | *Zea mays* alcohol dehydrogenase (Adh1-S) mRNA, complete cds. |
| 700262573H1 | g687244 | 59 | −63 | gb105pln | *Zea mays* oil body protein 16 kDa oleosin (ole16) gene, complete cds. |
| 700261790H1 | g1658314 | 25 | −7 | gb105pln | *O. sativa* osr40g3 gene. |
| 700266125H1 | g436782 | 54 | −52 | gb105pln | Rice mRNA for cyco7, complete cds. |
| 700266122H1 | g168512 | 33 | −37 | gb105pln | Maize major protein (L3) mRNA from the surface of lipid bodies, 3' end. |
| 700264562H1 | g2464938 | 31 | −3 | gb105eukp | mitogen-activated protein kinase 7 |
| 700262486H1 | g398917 | 34 | −18 | gb105pln | *B. napus* cold induced protein (BnC24A) mRNA. |
| 700258506H1 | g987122 | 64 | −67 | gb105pln | *Z. mays* mRNA for class II metallothionein. |
| 700267702H1 | g248336 | 94 | −89 | gb105pln | polyubiquitin [maize, Genomic, 3841 nt]. |
| 700263062H1 | g2369713 | 21 | 11 | gb105pln | Beta *vulgaris* cDNA for elongation factor 2. |
| 700267788H1 | g927238 | 53 | 8 | gb105pln | *Zea mays* globulin1 (Glb1) gene, allele Glb1-Hb, complete cds. |
| 700266248H1 | g1066282 | 51 | −46 | gb105pln | *Phaseolus vulgaris* 1L-myo-inositol 1-phosphate synthase mRNA, complete cds. |
| 700264769H1 | g902583 | 78 | −85 | gb105pln | *Zea mays* clone MubG1 ubiquitin gene, complete cds. |
| 700264475H1 | g2258073 | 20 | 15 | gb105pln | *Hordeum vulgare* var. *distichum* soluble inorganic pyrophosphatase (Ipp) mRNA, complete cds. |
| 700263962H1 | g167113 | 26 | −8 | gb105eukp | aldose reductase-related protein |
| 700262079H1 | g2088662 | 11 | 3 | gb105eukp | T28M21.22 |
| 700256875H1 | g2276354 | 7 | 6 | gb105eukp | SPBC30D10.05c; putative oxidoreductase |
| 700256838H1 | g1532072 | 10 | 14 | gb105pln | *Z. mays* mRNA for S-adenosylmethionine decarboxylase. |
| 700264853H1 | g927239 | 10 | 1 | gb105allp | globulin1 |
| 700265080H1 | g1553128 | 49 | −42 | gb105pln | *Gossypium hirsutum* ribosomal protein L44 isoform a (RL44), complete cds. |
| 700261414H1 | g1185553 | 37 | −58 | gb105pln | *Zea mays* glyceraldehyde-3-phosphate dehydrogenase (gpc2) gene, complete cds. |
| 700257569H1 | g18903 | 55 | −43 | gb105pln | Barley mRNA for aspartic proteinase. |
| 700259748H1 | g1370205 | 60 | −3 | gb105eukp | ran1B; GTP-binding protein; RAN1B |
| 700267262H1 | g971279 | 55 | −51 | gb105pln | Rice mRNA for RAB24 protein, complete cds. |
| 700263954H1 | g1136121 | 32 | −32 | gb105pln | *O. sativa* mRNA for alpha-tubulin (clone OSTA-136). |
| 700263666H1 | g21800 | 48 | −7 | gb105pln | *T. aestivum* L mRNA for histone H2B. |
| 700263521H1 | g1212995 | 28 | −19 | gb105pln | *H. vulgare* mRNA for UDP-glucose |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700266921H1 | g2088647 | 37 | −9 | gb105eukp | pyrophosphorylase. T28M21.10 |
| 700263320H1 | g168512 | 31 | −37 | gb105pln | Maize major protein (L3) mRNA from the surface of lipid bodies, 3' end. |
| 700258901H1 | g168480 | 38 | −71 | gb105pln | Maize embryo globulin S allele (7S-like) mRNA, complete cds. |
| 700266949H1 | g22281 | 47 | −11 | gb105pln | Zea mays Glb1-0 gene for vicilin-like storage protein (truncated). |
| 700262107H1 | g1030715 | 17 | 2 | gb105allp | aspartic protease |
| 700265410H1 | g2335089 | 13 | −0 | gb105pln | Arabidopsis thaliana chromosome II BAC T11A07 genomic sequence, complete sequence. |
| 700256918H1 | g496493 | 48 | −42 | gb105pln | P. sativum (Rosakrone) mRNA for nonphosphorylating, NADP-specific, glyceraldehyde-3-phosphate dehydrogenase. |
| 700259562H1 | g22283 | 38 | −53 | gb105pln | Zea mays Glb1-L gene for vicilin-like embryo storage protein. |
| 700263784H1 | g22281 | 25 | 14 | gb105pln | Zea mays Glb1-0 gene for vicilin-like storage protein (truncated). |
| 700265360H1 | g22284 | 12 | −0 | gb105eukp | Glb1-L; vicilin-like embryo storage protein |
| 700264608H1 | g2286150 | 82 | −72 | gb105pln | Zea mays translation initiation factor (eIF-4A) mRNA, complete cds. |
| 700261385H1 | g170047 | 16 | −2 | gb105eukp | PK6; protein kinase |
| 700266962H1 | g1707235 | 12 | −6 | gb105eukp | C07D8.5 |
| 700263796H1 | g21796 | 69 | −56 | gb105pln | Wheat histone H3 gene. |
| 700259101H2 | g1673365 | 22 | −1 | gb105eukp | AlaRS; mitochondrial tRNA-Ala synthetase |
| 700266425H1 | g22287 | 7 | 8 | gb105allp | vicilin-like embryo storage protein |
| 700263708H1 | g483547 | 22 | 3 | gb105eukp | pyrophosphate-dependent phosphofructokinase alpha subunit |
| 700261485H1 | g1655679 | 31 | 0 | gb105eukp | 3-hydroxy-3-methylglutaryl-CoA-synthase |
| 700264356H1 | g1372965 | 35 | −29 | gb105pln | Vicia faba CREB-like protein mRNA, complete cds. |
| 700265945H1 | g927238 | 43 | −4 | gb105pln | Zea mays globulin1 (Glb1) gene, allele Glb1-Hb, complete cds. |
| 700262421H1 | g790640 | 16 | 7 | gb105pln | Hordeum vulgare gamma-thionin (HTH3) mRNA, complete cds. |
| 700258262H1 | g21234 | 19 | 8 | gb105allp | ketol-acid reductoisomerase |
| 700258867H1 | g1622938 | 19 | −7 | gb105pln | Bromus secalinus oleosin (ole16) mRNA, complete cds. |
| 700262566H1 | g415316 | 27 | −10 | gb105pln | Rice mRNA for acidic ribosomal protein P0, complete cds. |
| 700259166H2 | g2623295 | 19 | −5 | gb105eukp | T20B5.1 |
| 700260813H1 | g998429 | 73 | −72 | gb105pln | GRF1 = general regulatory factor [Zea mays, XL80, Genomic, 5348 nt]. |
| 700264286H1 | g2347143 | 14 | 5 | gb105eukp | spU2AF23 |
| 700261686H1 | g960356 | 62 | −45 | gb105pln | Barley mRNA for S-adenosylmethionine synthetase, complete cds. |
| 700266819H1 | g506138 | 64 | −27 | gb105pln | Zea mays Ec metallothionein class II protein mRNA, complete cds. |
| 700265493H1 | g2160438 | 5 | 7 | gb105allp | glutamate receptor channel subunit epsilon 4 |
| 700261830H1 | g2145472 | 43 | −14 | gb105pln | S. tuberosum mRNA for aconitase/aconitate hydratase. |
| 700265564H1 | g1167474 | 18 | −4 | gb105eukp | C47E12.1 |
| 700262251H1 | g2443890 | 25 | −6 | gb105eukp | F11P17.16 |
| 700265065H1 | g963063 | 46 | −27 | gb105pln | H. vulgare Ole-2 mRNA for oleosin. |
| 700262774H1 | g170696 | 12 | 2 | gb105eukp | Gbl1; storage protein |
| 700259071H1 | g1673365 | 27 | −2 | gb105eukp | AlaRS; mitochondrial tRNA-Ala synthetase |
| 700264268H1 | g2827001 | 57 | −40 | gb105pln | Triticum aestivum 70 kDa heat shock protein (TaHSP70d) mRNA, complete cds. |
| 700257933H1 | g1747295 | 39 | −9 | gb105pln | Rice mRNA for vacuolar H+-pyrophosphatase, complete cds. |
| 700264182H1 | g971279 | 49 | −45 | gb105pln | Rice mRNA for RAB24 protein, complete cds. |
| 700262434H1 | g971279 | 21 | −30 | gb105pln | Rice mRNA for RAB24 protein, complete cds. |
| 700264534H1 | g1171351 | 21 | −12 | gb105pln | Oryza sativa 16 kDa oleosin (ole16) mRNA, complete cds. |
| 700263146H1 | g1044939 | 52 | 2 | gb105pln | Z. mays mRNA for ubiquitin/ribosomal protein S27a fusion protein. |
| 700257449H2 | g312178 | 33 | −29 | gb105pln | Z. mays GapC2 gene. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700267155H1 | g1498052 | 88 | −77 | gb105pln | *Zea mays* ribosomal protein S8 mRNA, complete cds. |
| 700260952H1 | g22281 | 60 | −35 | gb105pln | *Zea mays* Glb1-0 gene for vicilin-like storage protein (truncated). |
| 700261121H1 | g973312 | 12 | 13 | gb105pln | *Arabidopsis thaliana* myo-inositol 1-phosphate synthase isozyme-2 mRNA, complete cds. |
| 700264981H1 | g603189 | 73 | −16 | gb105pln | *Zea mays* translation initiation factor eIF-4A mRNA, complete cds. |
| 700260740H1 | g1502354 | 20 | −2 | gb105pln | Yeast (*Saccharomyces cerevisiae*) genomic sequence from chromosome VII. |
| 700257979H1 | g168512 | 33 | −38 | gb105pln | Maize major protein (L3) mRNA from the surface of lipid bodies, 3' end. |
| 700263794H1 | g1171351 | 21 | 3 | gb105pln | *Oryza sativa* 16 kDa oleosin (ole16) mRNA, complete cds. |
| 700264535H1 | g22283 | 63 | −75 | gb105pln | *Zea mays* Glb1-L gene for vicilin-like embryo storage protein. |
| 700259224H1 | g18296 | 15 | 13 | gb105pln | Water melon mMDH mRNA for mitochondrial malate dehydrogenase (EC 1.1.1.37). |
| 700261609H1 | g1532072 | 9 | 15 | gb105pln | *Z. mays* mRNA for S-adenosylmethionine decarboxylase. |
| 700266342H1 | g2809258 | 48 | −25 | gb105eukp | F21B7.27 |
| 700265760H1 | g463251 | 24 | −5 | gb105pln | *M. sativa* (Nagyszenasi) mRNA for ribosomal protein RL5. |
| 700261827H1 | g20680 | 37 | −7 | gb105pln | *P. sativum* mRNA of CDNA clone 26g. |
| 700257864H1 | g170224 | 48 | −23 | gb105pln | *Nicotiana tabacum* 3-deoxy-D-arabino-heptulosonate 7-phosphate synthase, complete cds. |
| 700262711H1 | g444044 | 35 | −52 | gb105pln | *Z. mays* mRNA for group 3 Lea protein MGL3. |
| 700257890H1 | g397400 | 27 | −3 | gb105pln | *B. rapa* mRNA for S phase specific gene. |
| 700207103H1 | g1777929 | 57 | −39 | gb105pln | *Saccharum officinarum* nucleoside diphosphate kinase (SoNDPK1) mRNA, complete cds. |
| 700264422H1 | g606213 | 24 | −11 | gb105allp | ORF_o256 |
| 700261188H1 | g485376 | 70 | −75 | gb105pln | *Zea mays* alpha-3-tubulin gene, complete cds. |
| 700261105H1 | g498740 | 18 | −1 | gb105eukp | beta-ketoacyl-ACP synthase; ORF 22 |
| 700264052H1 | g2511530 | 80 | −52 | gb105pln | *Eleusine indica* alpha tubulin 1 (TUA1) mRNA, complete cds. |
| 700267284H1 | g21599 | 22 | 4 | gb105allp | UTP-glucose-1-phosphate uridylyltransferase |
| 700266348H1 | g2331132 | 42 | −0 | gb105pln | *Oryza sativa* glycine-rich protein (OSGRP2) mRNA, complete cds. |
| 7002633B2H1 | g22526 | 71 | −67 | gb105pln | *Zea mays* mRNA encoding a zein (clone zA1). |
| 700262966H1 | g1314090 | 39 | −6 | gb105eukp | YPR015C; unknown |
| 700261178H1 | g1123023 | 19 | −2 | gb105eukp | NEDD-6 like protein |
| 700267324H1 | g596079 | 62 | −82 | gb105pln | *Zea mays* thiamine biosynthetic enzyme (thi1-2) mRNA, complete cds. |
| 700266088H1 | g1532047 | 53 | −49 | gb105pln | *O. sativa* mRNA for S-adenosylmethionine decarboxylase. |
| 700266556H1 | g2191157 | 16 | 6 | gb105pln | *Arabidopsis thaliana* BAC IG002P16. |
| 700264379H1 | g1679772 | 10 | 6 | gb105allp | Bop1 |
| 700262049H1 | g2511530 | 46 | −57 | gb105pln | *Eleusine indica* alpha tubulin 1 (TUA1) mRNA, complete cds. |
| 700259467H1 | g457689 | 62 | −3 | gb105eukp | protein kinase |
| 700259309H1 | g2198850 | 74 | −83 | gb105pln | *Zea mays* cystathionine gamma-synthase (CGS1) mRNA, complete cds. |
| 700265596H1 | g2642157 | 10 | 6 | gb105eukp | T5I7.5; ankyrin-like protein |
| 700263776H1 | g387908 | 42 | −31 | gb105pln | *Brassica rapa* S-phase-specific (BIS289) mRNA, complete cds. |
| 700263265H1 | g22113 | 30 | −3 | gb105eukp | ORFa |
| 700264380H1 | g18064 | 26 | −17 | gb105pln | Squash mRNA for glycerol-3-phosphate acyltransferase; EC 2.3.1.15. |
| 700258355H1 | g596077 | 21 | −22 | gb105pln | *Zea mays* thiamine biosynthetic enzyme (thi1-1) mRNA, complete cds. |
| 700259363H1 | g533473 | 50 | −43 | gb105pln | *Mesembryanthemum crystallinum* 2-phospho-D-glycerate hydrolase, enolase, mRNA, complete cds. |
| 700265901H1 | g687244 | 42 | −86 | gb105pln | *Zea mays* oil body protein 16 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700267972H1 | g2687432 | 48 | −64 | gb105pln | kDa oleosin (ole16) gene, complete cds. *Plumbago auriculata* large subunit 26S ribosomal RNA gene, partial sequence. |
| 700258843H1 | g168512 | 50 | −50 | gb105pln | Maize major protein (L3) mRNA from the surface of lipid bodies, 3' end. |
| 700265063H1 | g1212995 | 65 | −61 | gb105pln | *H. vulgare* mRNA for UDP-glucose pyrophosphorylase. |
| 700262685H1 | g854625 | 37 | −27 | gb105pln | *T. aestivum* mRNA for peptidylproiyl cis-trans isomerase, FK506. |
| 700258870H1 | g16427 | 12 | 1 | gb105eukp | protease inhibitor II |
| 700259001H1 | g537445 | 28 | −11 | gb105pln | *Arabidopsis thaliana* heat shock protein AtHSP101 (Athsp101) mRNA, complete cds. |
| 700265008H1 | g1184773 | 70 | −53 | gb105pln | *Zea mays* glyceraldehyde-3-phosphate dehydrogenase GAPC3 (gpc3) mRNA, complete cds. |
| 700261817H1 | g1638836 | 36 | −49 | gb105pln | *H. vulgare* mRNA for alpha-tubulin 2. |
| 700257203H1 | g596077 | 56 | −9 | gb105pln | *Zea mays* thiamine biosynthetic enzyme (thi1-1) mRNA, complete cds. |
| 700260970H1 | g1622938 | 24 | 2 | gb105pln | *Bromus secalinus* oleosin (ole16) mRNA, complete cds. |
| 700266485H1 | g973312 | 12 | 12 | gb105pln | *Arabidopsis thaliana* myo-inositol 1-phosphate synthase isozyme-2 mRNA, complete cds. |
| 700257817H1 | g22281 | 67 | −48 | gb105pln | *Zea mays* Glb1-0 gene for vicilin-like storage protein (truncated). |
| 700257760H1 | g1706958 | 14 | −11 | gb105eukp | celA2; cellulose synthase |
| 700265948H1 | g310934 | 12 | −0 | gb105pln | *Nicotiana tabacum* ribosomal protein L25, complete cds. |
| 700263018H1 | g736292 | 11 | 6 | gb105allp | ribophorin I |
| 700260386H2 | g18891 | 32 | 6 | gb105eukp | aldose reductase-related protein |
| 700267579H1 | g514945 | 98 | −89 | gb105pln | *Zea mays* sucrose synthase (Sus1) mRNA, complete cds. |
| 700265625H1 | g758246 | 45 | −42 | gb105pln | *Phalaenopsis* sp. mRNA for S-adenosyhomocysteine hydrolase. |
| 700267324H1 | g1289203 | 23 | −17 | gb105pln | *A. glutinosa* mRNA for thiazole biosynthetic enzyme. |
| 700265391H1 | g887570 | 35 | −25 | gb105pln | *P. sativum* mRNA for starch synthase (2035 bp) |
| 700262102H1 | g504489 | 40 | 7 | gb105allp | alpha-galactosidase |
| 700264691H1 | g190222 | 6 | 6 | gb105allp | protein phosphatase 2A 72 kDa regulatory subunit |
| 700264221H1 | g397395 | 59 | −36 | gb105pln | *Z. mays* MNB1b mRNA for DNA-binding protein. |
| 700263637H1 | g2460251 | 13 | 7 | gb105allp | ferrochelatase |
| 700262630H1 | g391874 | 17 | 1 | gb105pln | Rice mRNA for 40S subunit ribosomal protein, complete cds. |
| 700262163H1 | g1632821 | 45 | −28 | gb105pln | *O. sativa* mRNA for transmembrane protein. |
| 700261920H1 | g1212995 | 19 | −26 | gb105pln | *H. vulgare* mRNA for UDP-glucose pyrophosphorylase. |
| 700261823H1 | g22144 | 53 | −19 | gb105pln | Maize anaerobically regulated gene for fructose bisphosphate aldolase (EC 4.1.2.13). |
| 700265722H1 | g405128 | 24 | −6 | gb105pln | *Arabidopsis thaliana* cytosolic cyclophilin (ROC1) mRNA, complete cds. |
| 700261544H1 | g248338 | 81 | −33 | gb105pln | polyubiquitin (maize, Genomic, 3439 nt]. |
| 700265110H1 | g22119 | 96 | −83 | gb105pln | Maize Adh1-F mRNA for alcohol dehydrogenase. |
| 700262438H1 | g2791948 | 40 | −22 | gb105eukp | rpl130; ribosomal protein L13a |
| 700262615H1 | g1658314 | 27 | 1 | gb105pln | *O. sativa* osr40g3 gene. |
| 700257414H1 | g1255714 | 11 | 5 | gb105eukp | Wx; UDPG glucosyl transferase; granule-bound starch synthase precursor; EC 2.4.1.11 |
| 700265657H1 | g2264321 | 12 | 16 | gb105pln | *Arabidopsis thaliana* genomic DNA, chromosome 5, P1 clone: MXM12, complete sequence. |
| 700262554H1 | g1694832 | 30 | −48 | gb105pln | *H. vulgare* Per1 gene. |
| 700257133H1 | g971279 | 50 | −47 | gb105pln | Rice mRNA for RAB24 protein, complete cds. |
| 700258377H1 | g2827662 | 10 | −5 | gb105eukp | F18F4.180; Phosphoribosylanthranilate transferase |
| 700265727H1 | g22285 | 40 | 7 | gb105pln | *Zea mays* Glb1-S gene for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700262879H1 | g2266661 | 69 | −30 | gb105pln | vicilin-like embryo storage protein. *Hordeum vulgare* mRNA for 14-3-3 protein (Hv1433c). |
| 700263857H1 | g398844 | 42 | −19 | gb105pln | *Z. mays* mRNA for beta 3 tubulin. |
| 700263117H1 | g1045044 | 53 | 0 | gb105eukp | KNAT4 homeobox protein |
| 700257978H1 | g2239150 | 22 | −8 | gb105pln | *N. tabacum* mRNA for CHLD magnesium chelatase subunit. |
| 700259505H1 | g486007 | 15 | 4 | gb105eukp | DIP1 |
| 700263151H1 | g170064 | 7 | 2 | gb105allp | glucose binding protein |
| 700257885H1 | g2511581 | 34 | −5 | gb105pln | *Arabidopsis thaliana* mRNA for proteasome subunit prc6c. |
| 700259456H1 | g998429 | 59 | −87 | gb105pln | GRP1 = general regulatory factor [*Zea mays*, XL80, Genomic, 5348 nt]. |
| 700264880H1 | g1044867 | 18 | −10 | gb105pln | *Glycine max* mRNA for cinnamic acid 4-hydroxylase (CYP73). |
| 700207178H1 | g687244 | 87 | −28 | gb105pln | *Zea mays* oil body protein 16 kDa oleosin (ole16) gene, complete cds. |
| 700263290H1 | g1842188 | 10 | 5 | gb105eukp | mitochondrial phosphate translocator |
| 700265477H1 | g1208478 | 13 | −2 | gb105allp | ABC1-like |
| 700258875H1 | g1100224 | 30 | −19 | gb105pln | *Pinus sylvestris* chloroplast NAD+-dependent glyceraldehyde-3-phosphate dehydrogenase mRNA, complete cds. |
| 700266874H1 | g22287 | 15 | 4 | gb105allp | vicilin-like embryo storage protein |
| 700264666H1 | g687246 | 9 | −11 | gb105pln | *Zea mays* oil body protein 17 kDa oleosin (ole17) gene, complete cds. |
| 700264151H1 | g452559 | 35 | −36 | gb105pln | *Zea mays* group 3 Lea protein MGL3 mRNA, complete cds. |
| 700263285H1 | g2394230 | 14 | 15 | gb105pln | *Arabidopsis thaliana* WD-40 repeat protein (MSI2) mRNA, complete cds. |
| 700261216H1 | g19342 | 10 | 10 | gb105pln | *L. esculentum* mRNA for ribosomal protein L2. |
| 700268006H1 | g22121 | 62 | −81 | gb105pln | Maize alcohol dehydrogenase 1 gene (Adh1-1F). |
| 700265168H1 | g19101 | 36 | −22 | gb105pln | *H. vulgare* mRNA for ribosomal protein L17-1. |
| 700262594H1 | g22302 | 34 | −78 | gb105pln | Maize Gpc1 gene for glyceraldehyde-3-phosphate dehydrogenase (GADPH) subunit C. |
| 700258303H1 | g450353 | 24 | −7 | gb105pln | *H. vulgare* (cv Bomi) gB19.1b gene. |
| 700257983H1 | g2828011 | 31 | −17 | gb105pln | *Zea mays* starch synthase I precursor (Ss1) mRNA, nuclear gene encoding plastid protein, complete cds. |
| 700207180H1 | g485743 | 42 | −34 | gb105pln | *Beta vulgaris* clone P1 pyrophosphatase mRNA, complete cds. |
| 700265727H1 | g168480 | 40 | 6 | gb105pln | Maize embryo globulin S allele (7S-like) mRNA, complete cds. |
| 700256761H1 | g21895 | 36 | 0 | gb105pln | *T. aestivum* (clone pTAU2.3) U2 snRNA. |
| 700263221H1 | g1246822 | 24 | −13 | gb105pln | *P. dactylifera* mRNA for unknown protein (1456 bp). |
| 700266247H1 | g1216483 | 34 | −26 | gb105pln | *Arabidopsis thaliana* dual specificity kinase 1 (ADK1) mRNA, complete cds. |
| 700268129H1 | g22681 | 41 | −36 | gb105pln | *L. usitatissimum* mRNA for stearoyl-(acyl-carrier-protein) desaturase. |
| 700263342H1 | g2264306 | 17 | −0 | gb105pln | *Arabidopsis thaliana* genomic DNA, chromosome 5, P1 clone: MBK5, complete sequence. |
| 700262685H1 | g1354206 | 13 | 9 | gb105pln | *Arabidopsis thaliana* FK506 binding protein FKBP62 (ROF1) mRNA, complete cds. |
| 700262441H1 | g20680 | 38 | −24 | gb105pln | *P. sativum* mRNA of cDNA clone 26g. |
| 700264412H1 | g556872 | 14 | 6 | gb105eukp | sen3 |
| 700258481H1 | g19776 | 21 | 15 | gb105pln | Tobacco acetolactate synthase gene, ALS SuRA (EC 4.1.3.18). |
| 700258761H1 | g1136574 | 45 | −53 | gb105pln | *Sorghum bicolor* heat shock protein 70 (hsp70) pseudogene. |
| 700263202H1 | g2266989 | 53 | −7 | gb105pln | *Arabidopsis thaliana* vacuolar type ATPase subunit A mRNA, complete cds. |
| 700259020H1 | g158315 | 18 | 4 | gb105eukp | snRNP27D |
| 700266851H1 | g168508 | 69 | −48 | gb105pln | Maize oleosin KD18 (KD18; L2) gene, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264835H1 | g1575594 | 29 | −13 | gb105pln | *Triticum aestivum* fimbrin/plastin-like mRNA, partial cds. |
| 700264952H1 | g1293783 | 62 | −52 | gb105pln | *Oryza sativa* QM gene, complete cds. |
| 700264256H1 | g1171351 | 23 | −36 | gb105pln | *Oryza sativa* 16 kDa oleosin (ole16) mRNA, complete cds. |
| 700264085H1 | g2305013 | 58 | −23 | gb105pln | *Musa acuminata* S-adenosyl-L-methionine synthetase homolog mRNA, complete cds. |
| 700262766H1 | g2274990 | 45 | −12 | gb105pln | *Hordeum vulgare* mRNA for expressed sequence tag. |
| 700258767H1 | g687244 | 47 | −76 | gb105pln | *Zea mays* oil body protein 16 kDa oleosin (ole16) gene, complete cds. |
| 700262814H1 | g22119 | 96 | −52 | gb105pln | Maize Adh1-F mRNA for alcohol dehydrogenase. |
| 700262480H1 | g1296954 | 33 | −33 | gb105pln | *O. sativa* mRNA for novel protein, osr40c1. |
| 700264412H1 | g763271 | 14 | 6 | gb105allp | Sen3p |
| 700262084H1 | g2827079 | 17 | 12 | gb105pln | *Medicago sativa* mitochondrial malate dehydrogenase precursor (mmdh) mRNA, nuclear gene encoding mitochondrial protein, complete cds. |
| 700258477H1 | g1845196 | 40 | −44 | gb105pln | *Z. mays* mRNA for HMGc2 protein. |
| 700267027H1 | g2673901 | 41 | −18 | gb105pln | *Arabidopsis thaliana* chromosome II BAC T24P15 genomic sequence, complete sequence. |
| 700207161111 | g18963 | 48 | −31 | gb105pln | *Z. mays* mRNA for dehydrin (dhn3). |
| 700267270H1 | g2621088 | 13 | −4 | gb105allp | aspartate aminotransferase related protein |
| 700265684H1 | g531096 | 9 | 1 | gb105eukp | TED2 |
| 700258676H1 | g1129144 | 33 | −26 | gb105pln | *M. indica* (Manila) THMF5 mRNA for 3-ketoacyl-coA thiolase B. |
| 700265087H1 | g21598 | 49 | −40 | gb105pln | *S. tuberosum* mRNA for UDP-glucose pyrophosphorylase. |
| 700264023H1 | g1100224 | 61 | −22 | gb105pln | *Pinus sylvestris* chloroplast NAD+-dependent glyceraldehyde-3-phosphate dehydrogenase mRNA, complete cds. |
| 700262781H1 | g1184771 | 67 | −73 | gb105pln | *Zea mays* glyceraldehyde-3-phosphate dehydrogenase GAPC2 (gpc2) mRNA, complete cds. |
| 700265061H1 | g537445 | 33 | −24 | gb105pln | *Arabidopsis thaliana* heat shock protein AtHSP101 (Athsp101) mRNA, complete cds. |
| 700264527H1 | g1293783 | 66 | −58 | gb105pln | *Oryza sativa* QM gene, complete cds. |
| 700258487H1 | g998429 | 52 | −18 | gb105pln | GRF1 = general regulatory factor [*Zea mays*, XL80, Genomic, 5348 nt]. |
| 700259349H1 | g927239 | 7 | 6 | gb105allp | globulin1 |
| 700261823H1 | g168419 | 67 | −28 | gb105pln | Maize (*Z. mays*) aldolase mRNA, complete cds. |
| 700262872H1 | g2828151 | 22 | −5 | gb105allp | cyclophilin-33B |
| 700262843H1 | g1296954 | 24 | 1 | gb105pln | *O. sativa* mRNA for novel protein, osr40c1. |
| 700264782H1 | g633681 | 15 | 2 | gb105eukp | cr14; ubiquinol-cytochrome c reductase; EC 1.10.2.2 |
| 700258016H1 | g1694620 | 21 | −1 | gb105pln | *Cucurbita* sp. mRNA for 3-ketoacyl-CoA thiolase, complete cds. |
| 700267845H1 | g19012 | 23 | −18 | gb105pln | *H. vulgare* mRNA for LEA B19.1 protein. |
| 700266293H1 | g927239 | 6 | 7 | gb105allp | globulin1 |
| 700266062H1 | g1890574 | 30 | −25 | gb105pln | *H. vulgare* mRNA for xyloglucan endotransglycosylase-like protein (XEA). |
| 700265633H1 | g1651457 | 26 | −15 | gb105allp | Aminopeptidase N |
| 700262379H1 | g2654121 | 45 | −10 | gb105pln | *Arabidopsis thaliana* ribosomal protein L23a (AtrpL23a) mRNA, complete cds. |
| 700259516H1 | g1296954 | 69 | −52 | gb105pln | *O. sativa* mRNA for novel protein, osr40c1. |
| 700258668H1 | g425805 | 61 | −45 | gb105pln | Rice mRNA for enolase (gene name AD709), partial cds. |
| 700261349H1 | g2062402 | 30 | −17 | gb105pln | *Borago officinalis* delta 6 desaturase mRNA, complete cds. |
| 700267437H1 | g2160756 | 15 | −4 | gb105eukp | CLAVATA1; CLV1 receptor kinase |
| 700265018H1 | g474009 | 69 | −62 | gb105pln | Rice mRNA, partial homologous to ribosomal protein S19 gene. |
| 700257959H1 | g20501 | 10 | 3 | gb105eukp | vicilin-like storage protein |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700257588H1 | g599623 | 37 | −18 | gb105pln | *A. thaliana* Aco gene. |
| 700267641H1 | g2668747 | 64 | −62 | gb105pln | *Zea mays* ribosomal protein L17 (rpl17) mRNA, complete cds. |
| 700265567H1 | g218097 | 55 | −41 | gb105pln | Rice mRNA for catalase (273 gene), partial sequence. |
| 700264292H1 | g1907269 | 22 | −5 | gb105pln | *S. stapfianus* mRNA for sulphate transporter protein. |
| 700260740H1 | g1323459 | 20 | −2 | gb105pln | Yeast (*Saccharomyces cerevisiae*) chromosome VII reading frame ORF YGR253c. |
| 700267926H1 | g20834 | 51 | −45 | gb105pln | *P. sativum* PHSP1 mRNA for HSP70. |
| 700264802H1 | g1171351 | 14 | 12 | gb105pln | *Oryza sativa* 16 kDa oleosin (ole16) mRNA, complete cds. |
| 700261649H1 | g218161 | 20 | 7 | gb105allp | elongation factor 1 beta' |
| 700257726H1 | g347527 | 33 | 5 | gb105allp | ribosomal protein S3 |
| 700268108H1 | g168481 | 8 | 7 | gb105allp | globulin precursor |
| 700262031H1 | g664900 | 32 | −9 | gb105pln | *C. plantagineum* tkt3 gene for transketolase. |
| 700262533H1 | g687244 | 50 | −78 | gb105pln | *Zea mays* oil body protein 16 kDa oleosin (ole16) gene, complete cds. |
| 700266543H1 | g608675 | 24 | −2 | gb105eukp | AAT1; amino acid transporter |
| 700266392H1 | g687244 | 49 | −83 | gb105pln | *Zea mays* oil body protein 16 kDa oleosin (ole16) gene, complete cds. |
| 700264456H1 | g1498246 | 20 | 4 | gb105pln | *S. oleracea* mRNA for bas1 protein. |
| 700266341H1 | g22285 | 51 | −63 | gb105pln | *Zea mays* Glb1-S gene for vicilin-like embryo storage protein. |
| 700265957H1 | g1519252 | 42 | −54 | gb105pln | *Oryza sativa* GF14-d protein mRNA, complete cds. |
| 700265468H1 | g17931 | 20 | −33 | gb105pln | *B. secalinas* embryo-specific mRNA. |
| 700267475H1 | g1736513 | 10 | 5 | gb105allp | Aspartate-tRNA ligase (EC 6.1.1.12) |
| 700266089H1 | g2435604 | 12 | 1 | gb105eukp | F08F1.7 |
| 700264122H1 | g927238 | 44 | −66 | gb105pln | *Zea mays* globulin1 (Glb1) gene, allele Glb1-Hb, complete cds. |
| 700264052H1 | g393400 | 83 | −54 | gb105pln | *Z. mays* mRNA for alpha-tubulin. |
| 700258153H1 | g1314049 | 26 | 3 | gb105allp | archain/deita-COP |
| 700266495H1 | g2078350 | 42 | −0 | gb105eukp | PotTal1; transaidolase; EC 2.2.1.2 |
| 700260722H1 | g22283 | 48 | −26 | gb105pln | *Zea mays* Glb1-L gene for vicilin-like embryo storage protein. |
| 700265403H1 | g1212995 | 51 | −32 | gb105pln | *H. vulgare* mRNA for UDP-glucose pyrophosphorylase. |
| 700262321111 | g2341023 | 40 | −36 | gb105pln | Sequence of BAC F19P19 from *Arabidopsis thaliana* chromosome 1, complete sequence. |
| 700258182H1 | g168512 | 29 | 14 | gb105pln | Maize major protein (L3) mRNA from the surface of lipid bodies, 3' end. |
| 700267351H1 | g687244 | 52 | −44 | gb105pln | *Zea mays* oil body protein 16 kDa oleosin (ole16) gene, complete cds. |
| 700261842H1 | g687244 | 70 | −43 | gb105pln | *Zea mays* oil body protein 16 kDa oleosin (ole16) gene, complete cds. |
| 700261235H1 | g22285 | 61 | −54 | gb105pln | *Zea mays* Glb1-S gene for vicilin-like embryo storage protein. |
| 700267496H1 | g1403043 | 54 | −14 | gb105pln | *H. chilense* × *T. turgidum* conv. durum (Tritordeum) mRNA for S-adenosylmethionine decarboxylase. |
| 700258804H1 | g1136119 | 48 | −53 | gb105pln | *O. sativa* mRNA for alpha-tubulin (clone OSTA-111). |
| 700259329H1 and flanks. | g168608 | 83 | −36 | gb105pln | Maize 17S ribosomal RNA gene |
| 700265766H1 | g20311 | 61 | −56 | gb105pln | *O. sativa* R22 mRNA. |
| 700262963H1 | g22312 | 50 | −56 | gb105pln | Maize ABA-inducible gene for glycine-rich protein (ABA = abscisic acid). |
| 700258556H1 | g2414605 | 17 | 2 | gb105allp | hypothetical protein |
| 700264881H1 | g798946 | 19 | −9 | gb105eukp | unknown |
| 700264077H1 | g218340 | 35 | −24 | gb105pln | *Triticum aestivum* mRNA for elongation factor 1 beta'. |
| 700265934H1 | g2191159 | 11 | 5 | gb105eukp | A_IG002P16.3 |
| 700265296H1 | g434342 | 26 | −6 | gb105pln | *A. thaliana* (C24) mRNA for S18 ribosomal protein. |
| 700263509H1 | g167441 | 52 | −9 | gb105pln | *Chlamydomonas reinhardtii* alpha-1 tubulin gene, complete cds. |
| 700261387H1 | g1212995 | 29 | −19 | gb105pln | *H. vulgare* mRNA for UDP-glucose |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | pyrophosphorylase. |
| 700267484H1 | g473976 | 64 | −31 | gb105pln | Rice mRNA, partial homologous to elongation factor 1-alpha gene. |
| 700263285H1 | g2394226 | 36 | −23 | gb105pln | *Lycopersicon esculentum* WD-40 repeat protein (LeMSI1) mRNA, complete cds. |
| 700262727H1 | g1171351 | 24 | −7 | gb105pln | *Oryza sativa* 16 kDa oleosin (ole16) mRNA, complete cds. |
| 700261660H1 | g1171347 | 33 | 4 | gb105pln | *Triticum aestivum* pMA1951 mRNA, partial cds. |
| 700262355H1 | g469148 | 26 | −10 | gb105eukp | alanine aminotransferase |
| 700265365H1 | g499164 | 27 | −13 | gb105eukp | orf |
| 700263127H1 | g1173905 | 31 | 5 | gb105allp | spliceosome associated protein |
| 700256710H1 | g168608 | 74 | −83 | gb105pln | Maize 17S ribosomal RNA gene and flanks. |
| 700263202H1 | g1049252 | 89 | −25 | gb105pln | *Zea mays* vacuolar ATPase 69 kDa subunit mRNA, partial cds. |
| 700266673H1 | g2347186 | 9 | 17 | gb105pln | *Arabidopsis thaliana* chromosome II BAC T09D09 genomic sequence, complete sequence. |
| 700260688H1 | g2239259 | 13 | 13 | gb105pln | *Zea mays* mRNA for cinnamoyl CoA reductase. |
| 700261076H1 | g435648 | 30 | 6 | gb105pln | Rice mRNA for gamma-Tip, complete cds. |
| 700267436H1 | g687244 | 45 | −75 | gb105pln | *Zea mays* oil body protein 16 kDa oleosin (ole16) gene, complete cds. |
| 700260387H2 | g168512 | 50 | −20 | gb105pln | Maize major protein (L3) mRNA from the surface of lipid bodies, 3' end. |
| 700263536H1 | g473986 | 21 | −20 | gb105pln | Rice mRNA, partial homologous to histone H2B gene. |
| 700261992H1 | g1808655 | 36 | 14 | gb105pln | *N. tabaccum* mRNA for ubiquitin activating enzyme E1. |
| 700263349H1 | g1001311 | 38 | −0 | gb105allp | hypothetical protein |
| 700259620H1 | g167007 | 44 | −51 | gb105pln | Barley cam gene encoding calmodulin, complete cds. |
| 700264151H1 | g444044 | 35 | −36 | gb105pln | *Z. mays* mRNA for group 3 Lea protein MGL3. |
| 700260775H1 | g22281 | 59 | −35 | gb105pln | *Zea mays* Glb1-0 gene for vicilin-like storage protein (truncated). |
| 700261049H1 | g169538 | 29 | −10 | gb105eukp | pyrophosphate-fructose 6-phosphate 1-phosphotransferase alpha-subunit; EC 2.7.1.90 |
| 700263062H1 | g2369714 | 33 | 5 | gb105allp | elongation factor 2 |
| 700258503H1 | g927238 | 47 | −79 | gb105pln | *Zea mays* globulin1 (Glb1) gene, allele Glb1-Hb, complete cds. |
| 700265106H1 | g293886 | 86 | −76 | gb105pln | *Zea mays* glyceraldehyde-3-phosphate dehydrogenase mRNA, 3' end, (clone GAPC3). |
| 700266382H1 | g687244 | 90 | −75 | gb105pln | *Zea mays* oil body protein 16 kDa oleosin (ole16) gene, complete cds. |
| 700264637H1 | g2281705 | 11 | 8 | gb105allp | ethylene responsive factor |
| 700258739H1 | g1381153 | 12 | 12 | gb105pln | *Triticum aestivum* actin-binding protein WCOR719 (Wcor719) mRNA, complete cds. |
| 700262695H1 | g218229 | 35 | −16 | gb105pln | Rice mRNA for Aspartate aminotransferase. |
| 700262621H1 | g1213276 | 36 | 2 | gb105pln | *Z. mays* ZEMa gene. |
| 700265281H1 | g168527 | 23 | 6 | gb105pln | Maize NADP-dependent malic enzyme (Me1) mRNA, complete cds. |
| 700259361H1 | g1652400 | 15 | 4 | gb105allp | 50S ribosomal protein L13 |
| 700264440H1 | g927239 | 7 | 6 | gb105allp | globulin1 |
| 700264349H1 | g22270 | 50 | −74 | gb105pln | Maize mRNA from an embryogenic abscisic acid-inducible gene. |
| 700256955H1 | g596079 | 35 | −15 | gb105pln | *Zea mays* thiamine biosynthetic enzyme (thi1-2) mRNA, complete cds. |
| 700258843H1 | g1171351 | 32 | −21 | gb105pln | *Oryza sativa* 16 kDa oleosin (ole16) mRNA, complete cds. |
| 700260706H1 | g780371 | 35 | −30 | gb105pln | *Oryza sativa* enolase mRNA, complete cds. |
| 700258047H1 | g596077 | 24 | −27 | gb105pln | *Zea mays* thiamine biosynthetic enzyme (thi1-1) mRNA, complete cds. |
| 700257033H1 | g454303 | 26 | −1 | gb105eukp | LDJ2 |
| 700259101H2 | g1673366 | 22 | −1 | gb105eukp | AlaRS; cytosolic tRNA-Ala synthetase |
| 700264349H1 | g19016 | 24 | −11 | gb105pln | *H. vulgare* mRNA for LEA B19.4 protein. |
| 700259671H1 | g435174 | 28 | −42 | gb105pln | *A. sativa* (Pewi) ASTCP-K36 mRNA |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | for t complex polypeptide 1. |
| 700264883H1 | g168512 | 51 | −39 | gb105pln | Maize major protein (L3) mRNA from the surface of lipid bodies, 3' end. |
| 700207157H1 | g459267 | 60 | −15 | gb105pln | *Z. mays* gene for HMG protein. |
| 700266391H1 | g453188 | 91 | −88 | gb105pln | *Z. mays* acp mRNA for acyl carrier protein. |
| 700267704H1 | g687244 | 39 | 12 | gb105pln | *Zea mays* oil body protein 16 kDa oleosin (ole16) gene, complete cds. |
| 700259224H1 | g473205 | 27 | −2 | gb105pln | *E. gunnii* mRNA for mitochondrial malate dehydrogenase. |
| 700266721H1 | g2317728 | 24 | −10 | gb105pln | *Arabidopsis thaliana* reversibly glycosylated polypeptide-1 (AtRGP) mRNA, complete cds. |
| 700262015H1 | g1711035 | 33 | −19 | gb105pln | *Pisum sativum* hydroxyproline rich glycoprotein PsHRGP1 mRNA, partial cds. |
| 700257166H1 | g805003 | 47 | −50 | gb105pln | *O. sativa* SG12 gene. |
| 700260174H1 | g2341023 | 28 | −19 | gb105pln | Sequence of BAC F19P19 from *Arabidopsis thaliana* chromosome 1, complete sequence. |
| 700261764H1 | g1177320 | 24 | −13 | gb105eukp | efa27; EFA27 for EF hand, abscisic acid, 27 kD |
| 700263669H1 | g304217 | 9 | 8 | gb105pln | *Hordeum vulgare* abscisic acid and stress inducible (A22) gene. |
| 700257693H1 | g687244 | 39 | −10 | gb105pln | *Zea mays* oil body protein 16 kDa oleosin (ole16) gene, complete cds. |
| 700260489H1 | g469067 | 4 | 7 | gb105allp | NMDA receptor subunit NR2D |
| 700258734H1 | g22285 | 51 | −50 | gb105pln | *Zea mays* Glb1-S gene for vicilin-like embryo storage protein. |
| 700258002H1 | g531055 | 36 | −32 | gb105pln | Wheat mRNA for protein H2B-6, complete cds. |
| 700264019H1 | g596077 | 67 | −27 | gb105pln | *Zea mays* thiamine biosynthetic enzyme (thi1-1) mRNA, complete cds. |
| 700267953H1 | g168512 | 78 | −38 | gb105pln | Maize major protein (L3) mRNA from the surface of lipid bodies, 3' end. |
| 700266292H1 | g1171353 | 14 | 12 | gb105pJn | *Oryza sativa* 18 kDa oleosin mRNA, complete cds. |
| 700258884H1 | g22292 | 77 | −39 | gb105pln | *Z. mays* mRNA for glycine-rich protein. |
| 700264507H1 | g168512 | 34 | −34 | gb105pln | Maize major protein (L3) mRNA from the surface of lipid bodies, 3' end. |
| 700267080H1 | g170133 | 11 | 5 | gb105eukp | ribosomal protein L13 |
| 700267368H1 | g2829896 | 25 | 0 | gb105eukp | T26J12.7 |
| 700259071H1 | g1673366 | 27 | −2 | gb105eukp | AlaRS; cytosolic tRNA-Ala synthetase |
| 700268188H1 | g1532072 | 10 | 14 | gb105pln | *Z. mays* mRNA for S-adenosylmethionine decarboxylase. |
| 700266337H1 | g508974 | 56 | −48 | gb105pln | *Triticum aestivum* Chinese spring protein disulfide isomerase (PDI) mRNA, complete cds. |
| 700265914H1 | g1770020 | 77 | −72 | gb105pln | *Oryza sativa* S-adenosyl-L-methionine synthetase (pOS-SAMS2) mRNA, complete cds. |
| 700262915H1 | g596077 | 45 | −53 | gb105pln | *Zea mays* thiamine biosynthetic enzyme (thi1-1) mRNA, complete cds. |
| 700265262H1 | g285637 | 26 | −38 | gb105pln | *Hordeum vulgare* mRNA for vacuolar membrane proton-translocating inorganic pyrophosphat. |
| 700259428H1 | g687244 | 62 | −1 | gb105pln | *Zea mays* oil body protein 16 kDa oleosin (ole16) gene, complete cds. |
| 700264142H1 | g975887 | 35 | −7 | gb105pln | *Mesembryanthemum crystallinum* myo-inositol-1-phosphate synthase mRNA, complete cds. |
| 700265128H1 | g2828290 | 22 | 6 | gb105allp | ankyrin-like protein |
| 700263223H1 | g2707976 | 57 | −16 | gb105pln | *Zea mays* phytoene desaturase mRNA, complete cds. |
| 700264640H1 | g644492 | 30 | −11 | gb105pln | Corn elongation factor 1alpha gene, complete cds. |
| 700268153H1 | g1184773 | 80 | −72 | gb105pln | *Zea mays* glyceraldehyde-3-phosphate dehydrogenase GAPC3 (gpc3) mRNA, complete cds. |
| 700260007H1 | g168512 | 22 | 8 | gb105pln | Maize major protein (L3) mRNA from the surface of lipid bodies, 3' end. |
| 700259602H1 | g415314 | 34 | 3 | gb105pln | Rice mRNA for NADP dependent malic enzyme, complete cds. |
| 700266941H1 | g19902 | 19 | 5 | gb105allp | pollen specific protein |
| 700256843H1 | g927238 | 54 | −58 | gb105pln | *Zea mays* globulin1 (Glb1) |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | gene, allele Glb1-Hb, complete cds. |
| 700264362H1 | g984708 | 11 | −4 | gb105eukp | SPAC24H6.12c; unknown |
| 700265176H1 | g949877 | 25 | −16 | gb105pln | *H. vulgare* mRNA for elongation factor 1-alpha. |
| 700259126H2 | g1694832 | 17 | −45 | gb105pln | *H. vulgare* Per1 gene. |
| 700258208H1 | g1799607 | 9 | −3 | gb105allp | METHIONYL-TRNA FORMYLTRANSFERASE (EC 2.1.2.9). |
| 700262421H1 | g790641 | 16 | 2 | gb105allp | gamma-thionin |
| 700258429H1 | g295678 | 11 | 16 | gb105pln | Yeast (*Saccharomyces cerevisiae*) (clones 1c14, 1c16) translation initiation factor 5 gene, complete mRNA. |
| 700265612H1 | g2444419 | 44 | −38 | gb105pln | Glycine max ribosome-associated protein p40 mRNA, complete cds. |
| 700265560H1 | g22237 | 100 | −90 | gb105pln | Maize mRNA for cytosolic GAPDH (GapC) glyceraldehyde-3-phosphate dehydrogenase. |
| 700258365H1 | g2392762 | 27 | −1 | gb105pln | *Arabidopsis thaliana* BAC T32N15 from chromsome V, complete sequence. |
| 700263777H1 | g311238 | 28 | −63 | gb105pln | *Z. mays* catl gene for catalase 1. |
| 700264937H1 | g22281 | 54 | −59 | gb105pln | *Zea mays* Glb1-0 gene for vicilin-like storage protein (truncated). |
| 700264166H1 | g399663 | 34 | −21 | gb105pln | Rice mRNA of strong gravity stress responsible gene, partial cds. |
| 700258479H1 | g1498052 | 95 | −90 | gb105pln | *Zea mays* ribosomal protein S8 mRNA, complete cds. |
| 700266378H1 | g22483 | 69 | −78 | gb105pln | *Z. mays* RNA for superoxide dismutase Sod4. |
| 700267714H1 | g1122777 | 7 | 4 | gb105eukp | C10C5.4 |
| 700266331H1 | g444023 | 6 | 5 | gb105allp | pyruvate kinase |
| 700258689H1 | g1575129 | 75 | −84 | gb105pln | *Zea mays* lumenal binding protein cBiPe3 mRNA, complete cds. |
| 700265050H1 | g2829887 | 22 | −10 | gb105eukp | F3I6.27 |
| 700261238H1 | g1905998 | 10 | 6 | gb105allp | nuclear RNA helicase |
| 700257875H1 | g406750 | 36 | −11 | gb105pln | *N. tabacum* NTF3 mRNA. |
| 700265439H1 | g2645163 | 29 | −19 | gb105pln | *Oryza sativa* mRNA, similar to ribosomal protein L26. |
| 700256933H1 | g1777454 | 23 | −19 | gb105pln | *Oryza sativa* pyruvate decarboxylase 2 (pdc2) gene, complete cds. |
| 700263524H1 | g22237 | 36 | 8 | gb105pln | Maize mRNA for cytosolic GAPDH (GapC) glyceraldehyde-3-phosphate dehydrogenase. |
| 700268063H1 | g596079 | 92 | −44 | gb105pln | *Zea mays* thiamine biosynthetic enzyme (thi1-2) mRNA, complete cds. |
| 700261321H1 | g2443401 | 59 | −42 | gb105pln | *Oryza sativa* mRNA for orthophosphate dikinase, complete cds. |
| 700264424H1 | g1531764 | 11 | −2 | gb105pln | *D. stramonium* mRNA for S-adenosylmethionine decarboxylase. |
| 700262113H1 | g857573 | 61 | −48 | gb105pln | *Oryza sativa* vacuolar H+-ATPase (vatp-P1) mRNA, complete cds. |
| 700268163H1 | g1322676 | 27 | −5 | gb105pln | Yeast (*Saccharomyces cerevisiae*) chromosome VII reading frame ORF YGL120c. |
| 700266637H1 | g533251 | 50 | −81 | gb105pln | *Zea mays* (clone pSM8) sucrose synthase 2 (Sus1) gene, complete cds. |
| 700258360H1 | g1743007 | 25 | −4 | gb105eukp | ribosomal protein L13a |
| 700257747H1 | g396209 | 45 | −6 | gb105pln | *S. polyrrhiza* mRNA for D-myo-inositol-3-phosphate synthase. |
| 700265772H1 | g287826 | 4 | 3 | gb105allp | RNA polymerase subunit RPB8 |
| 700266547H1 | g1694832 | 33 | −52 | gb105pln | *H. vulgare* Per1 gene. |
| 700258779H1 | g1531764 | 11 | 13 | gb105pln | *D. stramonium* mRNA for S-adenosylmethionine decarboxylase. |
| 700258256H1 | g1296954 | 46 | −59 | gb105pln | *O. sativa* mRNA for novel protein, osr40c1. |
| 700264849H1 | g2252836 | 19 | −8 | gb105eukp | A_IG005I10.16 |
| 700267916H1 | g170775 | 61 | −51 | gb105pln | Wheat translation elongation factor 1 alpha-subunit (TEF1) mRNA, complete cds. |
| 700265461H1 | g829102 | 14 | 0 | gb105allp | DIF-1 |
| 700261351H1 | g987122 | 71 | −49 | gb105pln | *Z. mays* mRNA for class II metallothionein. |
| 700264742H1 | g2244991 | 27 | −32 | gb105pln | *Arabidopsis thaliana* DNA chromosome 4, ESSA I contig fragment No. 6. |
| 700265044H1 | g21732 | 26 | −9 | gb105pln | Wheat mRNA for Em protein. |
| 700265255H1 | g1711035 | 32 | −20 | gb105pln | *Pisum sativum* hydroxyproline rich glycoprotein PsHRGP1 mRNA, partial cds. |
| 700256833H1 | g471320 | 30 | −30 | gb105pln | *H. vulgare* (cv. Bomi) B15C mRNA. |
| 700263080H1 | g168512 | 26 | −17 | gb105pln | Maize major protein (L3) mRNA |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264785H1 | g21598 | 39 | −27 | gb105pln | from the surface of lipid bodies, 3′ end. *S. tuberosum* mRNA for UDP-glucose pyrophosphorylase. |
| 700267435H1 | g168480 | 41 | −23 | gb105pln | Maize embryo globulin S allele (7S-like) mRNA, complete cds. |
| 700261632H1 | g22149 | 72 | −22 | gb105pln | *Z. mays* mRNA for alpha-tubulin 3. |
| 700258891H1 | g168512 | 41 | −33 | gb105pln | Maize major protein (L3) mRNA from the surface of lipid bodies, 3′ end. |
| 700258081H1 | g2624199 | 38 | −23 | gb105pln | *M. acuminata* mRNA; clone pBAN UU93. |
| 700261859H1 | g1181672 | 59 | −57 | gb105pln | Sorghum bicolor heat shock protein 70 cognate (hsc70) mRNA, partial cds. |
| 700264651H1 | g2246625 | 12 | 1 | gb105eukp | protein kinase |
| 700257087H1 | g294525 | 42 | 5 | gb105allp | casein kinase I delta |
| 700258877H1 | g1403024 | 16 | −2 | gb105eukp | hnRNP protein |
| 700259708H1 | g21856 | 16 | −41 | gb105pln | Wheat rDNA 25S-18S intergenic region EcoRI-BamHI fragment. |
| 700265472H1 | g18259 | 30 | 2 | gb105pln | *C. sativus* mRNA for cs DnaJ-1. |
| 700260621H1 | g2292977 | 24 | −4 | gb105pln | *O. sativa* panC gene. |
| 700258637H1 | g22281 | 63 | −75 | gb105pln | *Zea mays* Glb1-0 gene for vicilin-like storage protein (truncated). |
| 700259460H1 | g168543 | 41 | −14 | gb105pln | *Zea mays* putative ribosomal protein S8 mRNA, partial cds. |
| 700262892H1 | g642168 | 44 | 7 | gb105pln | *C. apiifolia* 28S rRNA gene (partial). |
| 700265934H1 | g2244749 | 20 | −5 | gb105eukp | hydroxymethyltransferase |
| 700259836H1 | g22312 | 86 | 5 | gb105pln | Maize ABA-inducible gene for glycine-rich protein (ABA = abscisic acid). |
| 700262857H1 | g1770020 | 45 | −9 | gb105pln | *Oryza sativa* S-adenosyl-L-methionine synthetase (pOS-SAMS2) mRNA, complete cds. |
| 700258184H1 | g4392 | 15 | −1 | gb105eukp | RPL37A; ribosomal protein L37a |
| 700264005H1 | g22469 | 53 | −13 | gb105pln | Maize mRNA for cytoplasmic ribosomal protein S11. |
| 700257364H1 | g2668741 | 96 | −65 | gb105pln | *Zea mays* glycine-rich RNA binding protein (GRP) mRNA, complete cds. |
| 700266239H1 | g2275203 | 83 | −43 | gb105eukp | T08I13.9; RNA helicase isolog |
| 700266743H1 | g1136119 | 49 | −51 | gb105pln | *O. sativa* mRNA for alpha-tubulin (clone OSTA-111). |
| 700263771H1 | g695310 | 43 | −38 | gb105pln | *Cucumis sativus* glyoxysomal malate dehydrogenase (mdhG) mRNA, complete cds. |
| 700268095H1 | g22281 | 61 | −23 | gb105pln | *Zea mays* Glb1-0 gene for vicilin-like storage protein (truncated). |
| 700257936H1 | g22281 | 36 | −54 | gb105pln | *Zea mays* Glb1-0 gene for vicilin-like storage protein (truncated). |
| 700263644H1 | g1864000 | 82 | −5 | gb105pln | Maize DNA for Fd III, complete cds. |
| 700258409H1 | g2789659 | 19 | 6 | gb105pln | *Arabidopsis thaliana* p105 mRNA, complete cds. |
| 700261729H1 | g22285 | 33 | 16 | gb105pln | *Zea mays* Glb1-S gene for vicilin-like embryo storage protein. |
| 700266747H1 | g20359 | 98 | −11 | gb105pln | Rice gene for 17S ribosomal RNA. |
| 700265536H1 | g2342735 | 12 | 8 | gb105eukp | T14G11.28 |
| 700267445H1 | g596077 | 77 | −51 | gb105pln | *Zea mays* thiamine biosynthetic enzyme (thi1-1) mRNA, complete cds. |
| 700261855H1 | g1498052 | 71 | −87 | gb105pln | *Zea mays* ribosomal protein S8 mRNA, complete cds. |
| 700256780H1 | g1658314 | 24 | −21 | gb105pln | *O. sativa* osr40g3 gene. |
| 700258952H1 | g2225877 | 18 | 5 | gb105allp | TIP49 |
| 700263343H1 | g1015315 | 37 | 4 | gb105pln | *Pisum sativum* (clone PsRCI35-2) ribosomal protein L41 mRNA, complete cds. |
| 700265932H1 | g558364 | 70 | −75 | gb105pln | *Z. mays* mRNA for ADP-glucose pyrophosphorylase. |
| 700258982H1 | g288062 | 34 | −44 | gb105pln | *A. thaliana* mRNA for ketol-acid reductoisomerase subunit. |
| 700266474H1 | g2827142 | 44 | −17 | gb105pln | *Arabidopsis thaliana* cellulose synthase catalytic subunit (Ath-B) mRNA, complete cds. |
| 700259456H1 | g168602 | 41 | −43 | gb105pln | *Zea mays* regulatory protein GF14-12 mRNA, complete cds. |
| 700265062H1 | g2760173 | 36 | −22 | gb105pln | *Arabidopsis thaliana* genomic DNA, chromosome 5, P1 clone: MYH19, complete sequence. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700259586H1 | g20319 | 18 | 8 | gb105pln | Rice rab25 mRNA. |
| 700260273H1 | g398328 | 25 | 6 | gb105pln | *H. annuus* mRNA for protein phosphatase type 2A. |
| 700264746H1 | g780694 | 11 | 6 | gb105allp | succinyl coenzyme A synthetase alpha subunit |
| 700257055H1 | g1183961 | 25 | −11 | gb105eukp | N1945; RNA elicase; DBP |
| 700259692H1 | g415316 | 38 | −27 | gb105pln | Rice mRNA for acidic ribosomal protein P0, complete cds. |
| 700265205H1 | g1944416 | 14 | 5 | gb105allp | similar to *D. melanogaster* pumilio protein (S22026): similar to human KIAA0099 protein (D43951) |
| 700259743H1 | g2300247 | 28 | 5 | gb105allp | unnamed protein product |
| 700264322H1 | g2832620 | 7 | 4 | gb105eukp | F13C5.90; hypothetical protein |
| 700262749H1 | g963063 | 17 | 14 | gb105pln | *H. vulgare* Ole-2 mRNA for oleosin. |
| 700267552H1 | g20255 | 28 | −21 | gb105pln | *O. sativa* gene for heat shock protein 82 HSP82. |
| 700257567H1 | g1694832 | 21 | 4 | gb105pln | *H. vulgare* Per1 gene. |
| 700262802H1 | g575672 | 7 | 6 | gb105allp | potentially catalitic subunit of the ser/thr protein phosphatase 1 |
| 700264058H1 | g687244 | 66 | −92 | gb105pln | *Zea mays* oil body protein 16 kDa oleosin (ole16) gene, complete cds. |
| 700207272H1 | g1698548 | 39 | 2 | gb105eukp | TCB60, calmodulin-binding protein |
| 700207160H1 | g1532072 | 26 | 4 | gb105pln | *Z. mays* mRNA for S-adenosylmethionine decarboxylase. |
| 700266257H1 | g312178 | 36 | −84 | gb105pln | *Z. mays* GapC2 gene. |
| 700258975H1 | g1151134 | 18 | 6 | gb105allp | permease 1 |
| 700257183H1 | g168512 | 36 | −31 | gb105pln | Maize major protein (L3) mRNA from the surface of lipid bodies, 3' end. |
| 700258475H1 | g1296954 | 36 | 13 | gb105pln | *O. sativa* mRNA for novel protein, osr40c1. |
| 700262496H1 | g312178 | 34 | −18 | gb105pln | *Z. mays* GapC2 gene. |
| 700267282H1 | g2511530 | 43 | −47 | gb105pln | *Eleusine indica* alpha tubulin 1 (TUA1) mRNA, complete cds. |
| 700259305H1 | g22237 | 92 | −95 | gb105pln | Maize mRNA for cytosolic GAPDH (GapC) glyceraldehyde-3-phosphate dehydrogenase. |
| 700264994H1 | g2370548 | 25 | −11 | gb105eukp | SPAC4A8.16c; hypothetical protein |
| 700260539H2 | g22283 | 18 | −33 | gb105pln | *Zea mays* Glb1-L gene for vicilin-like embryo storage protein. |
| 700263921H1 | g1217993 | 33 | −3 | gb105pln | Glycine max dynamin-like protein SDL12A mRNA, complete cds. |
| 700262382H1 | g436782 | 54 | −15 | gb105pln | Rice mRNA for cyc07, complete cds. |
| 700264711H1 | g2264318 | 31 | −20 | gb105pln | *Arabidopsis thaliana* genomic DNA, chromosome 5, P1 clone: MUP24, complete sequence. |
| 700267267H1 | g1171351 | 9 | 16 | gb105pln | *Oryza sativa* 16 kDa oleosin (ole16) mRNA, complete cds. |
| 700257323H1 | g1794146 | 25 | 5 | gb105pln | Carrot mRNA for root specific gene, complete cds. |
| 700262265H1 | g1574460 | 10 | 5 | gb105allp | aminopeptidase N (pepN) |
| 700264734H1 | g2760323 | 13 | 7 | gb105eukp | F1N21.8 |
| 700265841H1 | g533251 | 77 | −64 | gb105pln | *Zea mays* (clone pSM8) sucrose synthase 2 (Sus1) gene, complete cds. |
| 700261662H1 | g1155212 | 36 | −21 | gb105pln | *Avena fatua* aldose reductase-related protein mRNA, complete cds. |
| 700268003H1 | g463856 | 30 | −19 | gb105pln | *Chlamydomonas reinhardtii* 21gr ribosomal protein S14 (CRY1) gene, complete cds. |
| 700264682H1 | g1289203 | 14 | 13 | gb105pln | *A. glutinosa* mRNA for thiazole biosynthetic enzyme. |
| 700264219H1 | g1658314 | 23 | 2 | gb105pln | *O. sativa* osr40g3 gene. |
| 700261206H1 | g20185 | 35 | −27 | gb105pln | *O. sativa* mRNA for calmodulin. |
| 700266960H1 | g558651 | 65 | −61 | gb105pln | *T. aestivum* VDAC3 mRNA for voltage dependent anion channel. |
| 700264832H1 | g1206016 | 18 | −3 | gb105pln | Yeast (*Schizosaccharomyces pombe*) ribosomal protein L5 gene, complete cds. |
| 700257032H1 | g416460 | 25 | 5 | gb105allp | unidentified protein |
| 700261868H1 | g168512 | 26 | −0 | gb105pln | Maize major protein (L3) mRNA from the surface of lipid bodies, 3' end. |
| 700263392H1 | g567040 | 15 | 2 | gb105allp | phosphoprotein phospnatase |
| 700257569H1 | g1255684 | 58 | −45 | gb105pln | Rice mRNA for aspartic protease, complete cds. |
| 700259608H1 | g1155212 | 42 | −35 | gb105pln | *Avena fatua* aldose reductase-related protein mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700258584H1 | g530206 | 36 | −29 | gb105pln | Glycine max heat shock protein (SB100) mRNA, complete cds. |
| 700261133H1 | g2459430 | 15 | 7 | gb105allp | putative CUC2 protein |
| 700207116H1 | g17260 | 8 | 6 | gb105allp | 60S ribosomal protein KD4/L2 |
| 700265872H1 | g1167953 | 12 | 3 | gb105allp | putative 32.6 kDa jasmonate-induced protein |
| 700261161H1 | g687244 | 52 | −50 | gb105pln | *Zea mays* oil body protein 16 kDa oleosin (ole16) gene, complete cds. |
| 700268092H1 | g1373149 | 73 | −62 | gb105pln | *Triticum aestivum* soluble starch synthase mRNA, partial cds. |
| 700259551H1 | g2435510 | 12 | 14 | gb105pln | *Arabidopsis thaliana* BAC TM017A05. |
| 700262906H1 | g1770020 | 54 | −44 | gb105pln | *Oryza sativa* S-adenosyl-L-methionine synthetase (pOS-SAMS2) mRNA, complete cds. |
| 700266080H1 | g166866 | 41 | −41 | gb105pln | *A. thaliana* ribosomal protein S11 mRNA, 3' end. |
| 700266361H1 | g16427 | 20 | 1 | gb105eukp | protease inhibitor II |
| 700265746H1 | g687244 | 52 | −2 | gb105pln | *Zea mays* oil body protein 16 kDa oleosin (ole16) gene, complete cds. |
| 700264944H1 | g1296954 | 37 | −15 | gb105pln | *O. sativa* mRNA for novel protein, osr40c1. |
| 700267049H1 | g2618605 | 43 | −23 | gb105pln | *Arabidopsis thaliana* genomic DNA, chromosome 5, P1 clone: MUK11, complete sequence. |
| 700262373H1 | g22469 | 87 | −62 | gb105pln | Maize mRNA for cytoplasmic ribosomal protein S11. |
| 700264048H1 | g687244 | 44 | −30 | gb105pln | *Zea mays* oil body protein 16 kDa oleosin (ole16) gene, complete cds. |
| 700262005H1 | g169818 | 52 | −55 | gb105pln | Rice 25S ribosomal RNA gene. |
| 700265260H1 | g2827143 | 46 | −9 | gb105eukp | Ath-B; cellulose synthase catalytic subunit |
| 700256761H1 | g21896 | 32 | 4 | gb105pln | *T. aestivum* (clone pTAU2.1) U2 snRNA. |
| 700257764H1 | g2443401 | 51 | −30 | gb105pln | *Oryza sativa* mRNA for orthophosphate dikinase, complete cds. |
| 700257914H1 | g1763311 | 65 | −63 | gb105pln | *Zea mays* phytase (phyS11) mRNA, complete cds. |
| 700258019H1 | g596079 | 27 | −28 | gb105pln | *Zea mays* thiamine biosynthetic enzyme (thi1-2) mRNA, complete cds. |
| 700261573H1 | g459894 | 85 | −13 | gb105pln | *Zea mays* sus1 gene, complete cds. |
| 700266993H1 | g22292 | 80 | −54 | gb105pln | *Z. mays* mRNA for glycine-rich protein. |
| 700258208H1 | g1799612 | 9 | −3 | gb105allp | METHIONYL-TRNA FORMYLTRANSFERASE (EC 2.1.2.9). |
| 700260128H1 | g927238 | 33 | −64 | gb105pln | *Zea mays* globulin1 (Glb1) gene, allele Glb1-Hb, complete cds. |
| 700257588H1 | g599624 | 37 | −18 | gb105pln | *A. thaliana* mRNA for aconitase (ZAPII). |
| 700262322H1 | g493588 | 18 | −8 | gb105pln | *Hordeum vulgare* disulfide isomerase (PDI) mRNA, complete cds. |
| 700264536H1 | g308906 | 35 | −13 | gb105eukp | unknown; thioredoxin |
| 700264838H1 | g963061 | 18 | 12 | gb105pln | *H. vulgare* Ole-1 mRNA for oleosin. |
| 700265227H1 | g577824 | 17 | −28 | gb105pln | *Z. mays* gene for H2B histone (gH2B3). |
| 700257885H1 | g16444 | 34 | −3 | gb105pln | *A. thaliana* mRNA for proteasome alpha subunit. |
| 700258836H1 | g22272 | 90 | −83 | gb105pln | Maize mRNA for enolase (2-phospho-D-glycerate hydrolase). |
| 700265457H1 | g2529668 | 33 | −20 | gb105eukp | T30B22.11; putative photolyase/blue-light receptor |
| 700260177H1 | g1107903 | 32 | −18 | gb105eukp | SPAC11D3.14c; unknown |
| 700259666H1 | g2443886 | 36 | −4 | gb105eukp | F11P17.12 |
| 700261757H1 | g633890 | 21 | 4 | gb105allp | glucose and ribitol dehydrogenase homolog [barley, *Hordeum vulgare*, Peptide, 293 aa]. |
| 700258016H1 | g1066162 | 20 | 1 | gb105pln | *B. napus* mRNA for glyoxysomal beta-ketoacyl-thiolase precursor. |
| 700266313H1 | g431163 | 38 | −5 | gb105pln | Lily mRNA for ORF, partial cds. |
| 700261890H1 | g687244 | 37 | −15 | gb105pln | *Zea mays* oil body protein 16 kDa oleosin (ole16) gene, complete cds. |
| 700267367H1 | g168512 | 26 | −9 | gb105pln | Maize major protein (L3) mRNA from the surface of lipid bodies, 3' end. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700258076H1 | g520596 | 17 | −3 | gb105eukp | MRE2; Mre2 protein |
| 700261320H1 | g1486286 | 45 | −29 | gb105pln | *C. sativus* mRNA for T-complex polypeptide 1. |
| 700264740H1 | g2668743 | 45 | −33 | gb105pln | *Zea mays* ubiquitin conjugating enzyme (UBC) mRNA, complete cds. |
| 700258646H1 | g927238 | 57 | −72 | gb105pln | *Zea mays* globulin1 (Glb1) gene, allele Glb1-Hb, complete cds. |
| 700258693H1 | g218237 | 26 | −18 | gb105pln | Rice mRNA for ribosomal protein S22 (T47 gene), partial sequence. |
| 700267670H1 | g1272684 | 100 | −90 | gb105pln | *Z. mays* mRNA for acetyl CoA carboxylase (partial). |
| 700264619H1 | g572634 | 41 | −27 | gb105pln | *C. breweri* mRNA for isopentenyl pyrophosphate isomerase. |
| 700267531H1 | g310934 | 21 | 16 | gb105pln | *Nicotiana tabacum* ribosomal protein L25, complete cds. |
| 700266516H1 | g496267 | 40 | −31 | gb105pln | *Nicotiana tabacum* GTP-binding protein (Ran-A1) mRNA, complete cds. |
| 700261972H1 | g450353 | 23 | −17 | gb105pln | *H. vulgare* (cv Bomi) gB19.1b gene. |
| 700267023H1 | g687244 | 35 | −50 | gb105pln | *Zea mays* oil body protein 16 kDa oleosin (ole16) gene, complete cds. |
| 700263262H1 | g687244 | 52 | −86 | gb105pln | *Zea mays* oil body protein 16 kDa oleosin (ole16) gene, complete cds. |
| 700264296H1 | g32532 | 26 | 6 | gb105allp | ribosomal protein s3 |
| 700264519H1 | g599624 | 31 | −35 | gb105pln | *A. thaliana* mRNA for aconitase (ZAPII). |
| 700263709H1 | g286238 | 4 | 7 | gb105allp | N-methyl-D-aspartate receptor subunit |
| 700267325H1 | g471320 | 34 | −5 | gb105pln | *H. vulgare* (cv. Bomi) B15C mRNA. |
| 700207249H1 | g1184771 | 56 | −24 | gb105pln | *Zea mays* glyceraldehyde-3-phosphate dehydrogenase GAPC2 (gpc2) mRNA, complete cds. |
| 700267232H1 | g396254 | 26 | −12 | gb105eukp | 40S ribosomal protein S5 |
| 700260162H1 | g21636 | 19 | 14 | gb105pln | Wheat mRNA for a group 3 late embryogenesis abundant protein (LEA). |
| 700262312H1 | g21834 | 75 | −71 | gb105pln | Wheat mRNA for cytosolic phosphoglycerate kinase (EC 2.7.2.3). |
| 700264665H1 | g22281 | 48 | −83 | gb105pln | *Zea mays* Glb1-0 gene for vicilin-like storage protein (truncated). |
| 700264785H1 | g218000 | 39 | −27 | gb105pln | Potato mRNA for UDP-glucose pyrophosphorylase (EC 2.7.7.9). |
| 700263855H1 | g587562 | 10 | 6 | gb105allp | mitochondrial processing peptidase |
| 700257518H1 | g20061 | 57 | −14 | gb105pln | *O. hookeri* mRNA for protein kinase C inhibitor homologue. |
| 700263482H1 | g1553128 | 48 | 13 | gb105pln | *Gossypium hirsutum* ribosomal protein L44 isoform a (RL44), complete cds. |
| 700266604H1 | g1049090 | 16 | −2 | gb105allp | SRp40-2 |
| 700257841H1 | g55489 | 14 | 4 | gb105allp | ribosomal protein L7 |
| 700259572H1 | g2282583 | 83 | −78 | gb105pln | *Zea mays* elongation factor 1-alpha (EF1-A) mRNA, complete cds. |
| 700261318H1 | g960356 | 47 | −27 | gb105pln | Barley mRNA for S-adenosylmethionine synthetase, complete cds. |
| 700258346H1 | g1495273 | 14 | 5 | gb105eukp | sugar transporter |
| 700264624H1 | g2276349 | 26 | −5 | gb105pln | Yeast (*Saccharomyces pombe*) chromosome II cosmid c30D10. |
| 700262334H1 | g949877 | 70 | −64 | gb105pln | *H. vulgare* mRNA for elongation factor 1-alpha. |
| 700263876H1 | g2599103 | 20 | −3 | gb105pln | *Dunaliella salina* 60S ribosomal protein (DSRP1) mRNA, complete cds. |
| 700258524H1 | g168434 | 70 | −32 | gb105pln | *Z. mays* catalase isozyme 3 (CAT-3) mRNA, complete cds. |
| 700258169H1 | g397395 | 65 | −51 | gb105pln | *Z. mays* MNB1b mRNA for DNA-binding protein. |
| 700262729H1 | g22283 | 73 | −31 | gb105pln | *Zea mays* Glb1-L gene for vicilin-like embryo storage protein. |
| 700259141H2 | g927238 | 77 | −21 | gb105pln | *Zea mays* globulin1 (Glb1) gene, allele Glb1-Hb, complete cds. |
| 700265509H1 | g1638836 | 57 | −49 | gb105pln | *H. vulgare* mRNA for alpha-tubulin 2. |
| 700257248H1 | g669002 | 39 | 3 | gb105pln | *Glycine max* calnexin mRNA, complete cds. |
| 700261049H1 | g483547 | 30 | −13 | gb105eukp | pyrophosphate-dependent phosphofructokinase alpha subunit |
| 700260175H1 | g20681 | 23 | 0 | gb105allp | 508 aa peptide |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700266125H1 | g387908 | 43 | −40 | gb105pln | *Brassica rapa* S-phase-specific (BIS289) mRNA, complete cds. |
| 700257190H1 | g22287 | 7 | 8 | gb105allp | vicilin-like embryo storage protein |
| 700259554H1 | g2651316 | 20 | −8 | gb105eukp | T2P4.5 |
| 700263059H1 | g22237 | 90 | −81 | gb105pln | Maize mRNA for cytosolic GAPDH (GapC) glyceraldehyde-3-phosphate dehydrogenase. |
| 700267540H1 | g168512 | 26 | 3 | gb105pln | Maize major protein (L3) mRNA from the surface of lipid bodies, 3′ end. |
| 700265957H1 | g20061 | 26 | −28 | gb105pln | *O. hookeri* mRNA for protein kinase C inhibitor homologue. |
| 700263006H1 | g289117 | 20 | −2 | gb105pln | *Allium cepa* cyclophilin mRNA, complete cds. |
| 700258303H1 | g22270 | 73 | −72 | gb105pln | Maize mRNA from an embryogenic abscisic acid-inducible gene. |
| 700259454H1 | g22283 | 39 | 11 | gb105pln | *Zea mays* Glb1-L gene for vicilin-like embryo storage protein. |
| 700262569H1 | g536891 | 31 | 6 | gb105pln | Wheat mRNA for protein H2A, complete cds, clone wcH2A-4. |
| 700263290H1 | g2564050 | 12 | 17 | gb105pln | *Arabidopsis thaliana* genomic DNA, chromosome 5, P1 clone: MUA22, complete sequence. |
| 700257060H1 | g439585 | 50 | −33 | gb105pln | *Hordeum vulgare* calreticulin (CRH1) mRNA, partial cds. |
| 700266865H1 | g21832 | 50 | −25 | gb105pln | Wheat mRNA for chloroplast phosphoglycerate kinase (EC 2.7.2.3). |
| 700264532H1 | g556685 | 24 | −12 | gb105pln | *Z. mays* mRNA for ADP-ribosylation factor. |
| 700264491H1 | g168440 | 51 | −19 | gb105pln | *Zea mays* chitinase A (seed chitinase) gene, complete cds. |
| 700260121H1 | g2282583 | 44 | −25 | gb105pln | *Zea mays* elongation factor 1-alpha (EF1-A) mRNA, complete cds. |
| 700260713H1 | g551289 | 50 | −34 | gb105pln | *Z. mays* (W22) phosphoglycerate mutase gene exons 2–8. |
| 700262807H1 | g168512 | 21 | 9 | gb105pln | Maize major protein (L3) mRNA from the surface of lipid bodies, 3′ end. |
| 700264196H1 | g19570 | 21 | 12 | gb105pln | *M. sativa* aat-1 mRNA for aspartate aminotransferase. |
| 700258002H1 | g473604 | 27 | −23 | gb105pln | *Zea mays* W-22 histone H2B mRNA, complete cds. |
| 700265819H1 | g296204 | 12 | 5 | gb105eukp | pAlaAT-2; alanine aminotransferase; EC 2.6.1.2 |
| 700260713H1 | g168587 | 71 | −37 | gb105pln | *Zea mays* cofactor-independent phosphoglycerate mutase mRNA, complete cds. |
| 700258537H1 | g451192 | 47 | −24 | gb105pln | *Triticum aestivum* (wali7) mRNA, 3′ end, partial cds. |
| 700267164H1 | g22283 | 60 | −66 | gb105pln | *Zea mays* Glb1-L gene for vicilin-like embryo storage protein. |
| 700262869H1 | g303856 | 44 | −13 | gb105pln | Rice mRNA for ubiquitin protein fused to a ribosomal protein, complete cds. |
| 700267474H1 | g687244 | 78 | −7 | gb105pln | *Zea mays* oil body protein 16 kDa oleosin (ole16) gene, complete cds. |
| 700265221H1 | g22281 | 71 | 0 | gb105pln | *Zea mays* Glb1-D gene for vicilin-like storage protein (truncated). |
| 700265875H1 | g644491 | 89 | −85 | gb105pln | Corn mRNA for elongation factor 1A. |
| 700267702H1 | g248338 | 79 | −76 | gb105pln | polyubiquitin [maize, Genomic, 3439 nt]. |
| 700261390H1 | g168512 | 44 | −33 | gb105pln | Maize major protein (L3) mRNA from the surface of lipid bodies, 3′ end. |
| 700264332H1 | g2668747 | 55 | −59 | gb105pln | *Zea mays* ribosomal protein L17 (rpl17) mRNA, complete cds. |
| 700267821H1 | g454303 | 11 | 6 | gb105eukp | LDJ2 |
| 700257729H1 | g2522194 | 57 | −15 | gb105pln | *Triticum aestivum* ornithine/acetylornithine aminotransferase mRNA, partial cds. |
| 700263179H1 | g22302 | 33 | −53 | gb105pln | Maize Gpc1 gene for glyceraldehyde-3-phosphate dehydrogenase (GADPH) subunit C. |
| 700264590H1 | g1622938 | 24 | 1 | gb105pln | *Bromus secalinus* oleosin (ole16) mRNA, complete cds. |
| 700261261H1 | g457686 | 21 | −13 | gb105eukp | possible mitochondrial processing peptidase coding sequence |
| 700261388H1 | g1848211 | 40 | −22 | gb105pln | *N. tabacum* mRNA for protein disulfide-isomerase precursor. |
| 700265443H1 | g2388937 | 33 | −6 | gb105eukp | SPAC23H4.18c; hypothetical |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | protein |
| 700267353H1 | g2429086 | 64 | −35 | gb105pln | *Hordeum vulgare* lipoxygenase 2 (LoxC) mRNA, complete cds. |
| 700266363H1 | g22281 | 53 | −72 | gb105pln | *Zea mays* Glb1-0 gene for vicilin-like storage protein (truncated). |
| 700263058H1 | g2668741 | 42 | −13 | gb105pln | *Zea mays* glycine-rich RNA binding protein (GRP) mRNA, complete cds. |
| 700265521H1 | g22287 | 9 | 0 | gb105allp | vicilin-like embryo storage protein |
| 700267428H1 | g22284 | 7 | 4 | gb105allp | vicilin-like embryo storage protein |
| 700266766H1 | g454913 | 27 | −17 | gb105pln | *A. porrum* LDJ2 mRNA. |
| 700268038H1 | g168512 | 23 | 3 | gb105pln | Maize major protein (L3) mRNA from the surface of lipid bodies, 3' end. |
| 700263029H1 | g1314164 | 14 | 4 | gb105eukp | SPAC17C9.12; unknown |
| 700266341H1 | g168480 | 74 | −66 | gb105pln | Maize embryo globulin S allele (7S-like) mRNA, complete cds. |
| 700261138H1 | g1568510 | 34 | −4 | gb105pln | *N. tabacum* mRNA for protein phosphatase 2A, 65 kD regulatory subunit. |
| 700258925H1 | g485376 | 67 | −64 | gb105pln | *Zea mays* alpha-3-tubulin gene, complete cds. |
| 700266358H1 | g1532072 | 36 | −9 | gb105pln | *Z. mays* mRNA for S-adenosylmethionine decarboxylase. |
| 700257780H1 | g393400 | 93 | −63 | gb105pln | *Z. mays* mRNA for alpha-tubulin. |
| 700259309H1 | g2198852 | 58 | −91 | gb105pln | *Zea mays* cystathionine gamma-synthase (CGS1) gene, complete cds. |
| 700261582H1 | g1399512 | 12 | −4 | gb105eukp | repE; repE |
| 700264022H1 | g391876 | 38 | −0 | gb105pln | Rice mRNA for adenylate kinase. |
| 700256825H1 | g168512 | 45 | −40 | gb105pln | Maize major protein (L3) mRNA from the surface of lipid bodies, 3' end. |
| 700261485H1 | g1143390 | 31 | −2 | gb105eukp | HMGS; hydroxymethylglutaryl-CoA synthase; EC 4.1.3.5 |
| 700257166H1 | g20311 | 51 | −58 | gb105pln | *O. sativa* R22 mRNA. |
| 700264630H1 | g1212995 | 21 | −22 | gb105pln | *H. vulgare* mRNA for UDP-glucose pyrophosphorylase. |
| 700259191H2 | g1515155 | 10 | 1 | gb105eukp | K09E9.2 |
| 700260534H2 | g22302 | 23 | −74 | gb105pln | Maize Gpc1 gene for glyceraldehyde-3-phosphate dehydrogenase (GADPH) subunit C. |
| 700258249H1 | g21732 | 25 | −3 | gb105pln | Wheat mRNA for Em protein. |
| 700266266H1 | g293890 | 32 | −83 | gb105pln | *Zea mays* alcohol dehydrogenase 1 (Adh1) gene, exons 4 through 10. |
| 700266052H1 | g1575127 | 71 | −90 | gb105pln | *Zea mays* lumenal binding protein cBiPe2 mRNA, complete cds. |
| 700266115H1 | g992610 | 21 | −2 | gb105eukp | trans-caffeoyl-CoA 3-O-methyltransferase; CCoAOMT; EC 2.1.1.104; S-adenosyl-L-methionine:trans-caffeoyl-CoA 3-O-methyltransferase |
| 700266023H1 | g1498629 | 17 | 3 | gb105allp | p40 protein homolog |
| 700265008H1 | g1184775 | 41 | −24 | gb105pln | *Zea mays* glyceraldehyde-3-phosphate dehydrogenase GAPC4 (gpc4) mRNA, complete cds. |
| 700267248H1 | g474889 | 26 | −10 | gb105pln | *Arabidopsis thaliana* topoisomerase II mRNA, complete cds. |
| 700267656H1 | g1706957 | 27 | −15 | gb105pln | *Gossypium hirsutum* cellulose synthase (celA2) mRNA, partial cds. |
| 700264295H1 | g2618600 | 19 | 1 | gb105pln | *Arabidopsis thaliana* genomic DNA, chromosome 5, P1 clone: MDC12, complete sequence. |
| 700257371H1 | g303834 | 38 | −29 | gb105pln | Rice mRNA for 21 kd polypeptide, complete cds. |
| 700263991H1 | g1016206 | 12 | 7 | gb105eukp | groES-B; heat-shock protein; protein folding; GroES |
| 700266217H1 | g22328 | 54 | −41 | gb105pln | Maize mRNA for a high mobility group protein. |
| 700256918H1 | g474407 | 87 | −87 | gb105pln | *Z. mais* (KW5330) mRNA for nonphosphorylating glyceraldehyde-3-phosphate dehydrogenase. |
| 700258727H1 | g1155241 | 11 | 17 | gb105pln | *Dianthus caryophyllus* S-adenosylmethionine 2 decarboxylase mRNA, complete cds. |
| 700261272H1 | g169127 | 26 | −22 | gb105pln | *Pisum sativum* (clone pCLp) nuclear encoded precursor to chloroplast protein mRNA, complete cds. |
| 700264259H1 | g1235569 | 25 | −18 | gb105eukp | rbohA; NAD(P)H oxidase |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264776H1 | g168480 | 25 | −35 | gb105pln | Maize embryo globulin S allele (7S-like) mRNA, complete cds. |
| 700265364H1 | g1155212 | 48 | −44 | gb105pln | *Avena fatua* aldose reductase-related protein mRNA, complete cds. |
| 700265731H1 | g1136121 | 81 | −12 | gb105pln | *O. sativa* mRNA for alpha-tubulin (clone OSTA-136). |
| 700257008H1 | g1814372 | 53 | 5 | gb105allp | elongation factor 1 alpha |
| 700261863H1 | g287399 | 15 | 5 | gb105eukp | ORF |
| 700267247H1 | g963061 | 14 | 16 | gb105pln | *H. vulgare* Ole-1 mRNA for oleosin. |
| 700257781H1 | g531031 | 12 | 11 | gb105pln | *Pennisetum ciliare* apomixis-associated mRNA. |
| 700257011H1 | g532571 | 62 | −27 | gb105pln | Barley lipoxygenase 1 (LoxA) gene, complete cds. |
| 700257243H1 | g1001602 | 27 | 7 | gb105allp | cell division protein FtsH |
| 700259602H1 | g168527 | 44 | −1 | gb105pln | Maize NADP-dependent malic enzyme (Me1) mRNA, complete cds. |
| 700257287H1 | g2738247 | 29 | 5 | gb105pln | *Arabidopsis thaliana* cobalamin-independent methionine synthase (ATCIMS) mRNA, complete cds. |
| 700267810H4 | g2262155 | 25 | −12 | gb105pln | DNA sequence of *Arabidopsis thaliana* BAC F5J6 from chromosome IV, complete sequence. |
| 700267694H1 | g1532047 | 13 | 17 | gb105pln | *O. sativa* mRNA for S-adenosylmethionine decarboxylase. |
| 700257793H1 | g1622938 | 17 | 15 | gb105pln | *Bromus secalinus* oleosin (ole16) mRNA, complete cds. |
| 700264479H1 | g687244 | 63 | −51 | gb105pln | *Zea mays* oil body protein 16 kDa oleosin (ole16) gene, complete cds. |
| 700264851H1 | g1568634 | 23 | −31 | gb105pln | *Arabidopsis thaliana* AtKAP alpha mRNA, complete cds. |
| 700258285H1 | g2791295 | 9 | 5 | gb105allp | F26H11.3a |
| 700257046H1 | g2351061 | 23 | 5 | gb105pln | *Arabidopsis thaliana* genomic DNA, chromosome 5, P1 clone: MAF19. |
| 700263117H1 | g1045046 | 49 | −1 | gb105eukp | KNAT5 homeobox protein |
| 700268009H1 | g1532047 | 58 | −54 | gb105pln | *O. sativa* mRNA for S-adenosylmethionine decarboxylase. |
| 700258094H1 | g248338 | 66 | −56 | gb105pln | polyubiquitin [maize, Genomic, 3439 nt]. |
| 700263991H1 | g170107 | 21 | −1 | gb105eukp | CPN10; chaperonin 10 |
| 700266285H1 | g435648 | 48 | −36 | gb105pln | Rice mRNA for gamma-Tip, complete cds. |
| 700264360H1 | g22592 | 47 | −49 | gb105pln | *S. vulgare* PEPC gene for phosphoenolpyruvate carboxylase. |
| 700266378H1 | g22484 | 76 | −97 | gb105pln | *Z. mays* RNA for superoxide dismutase Sod4A. |
| 700265612H1 | g402903 | 38 | −29 | gb105pln | *Arabidopsis thaliana* Columbia laminin receptor-like protein mRNA, complete cds. |
| 700258678H1 | g168508 | 79 | −69 | gb105pln | Maize oleosin KD18 (KD18; L2) gene, complete cds. |
| 700264250H1 | g459894 | 43 | −58 | gb105pln | *Zea mays* sus1 gene, complete cds. |
| 700265141H1 | g2262135 | 23 | −29 | gb105pln | *Arabidopsis thaliana* BAC T10P11, complete sequence. |
| 700258381H1 | g1162959 | 9 | 2 | gb105allp | homologous to HI0365 in *Haemophilus influenzae*; ORF1 |
| 700261235H1 | g168480 | 61 | −55 | gb105pln | Maize embryo globulin S allele (7S-like) mRNA, complete cds. |
| 700267715H1 | g20834 | 49 | −47 | gb105pln | *P. sativum* PHSP1 mRNA for HSP70. |
| 700261963H1 | g1550813 | 50 | −28 | gb105pln | *Z. mays* mRNA for acidic ribosomal protein P0. |
| 700267487H1 | g1532072 | 67 | −58 | gb105pln | *Z. mays* mRNA for S-adenosylmethionine decarboxylase. |
| 700267263H1 | g469067 | 4 | 7 | gb105allp | NMDA receptor subunit NR2D |
| 700264301H1 | g21832 | 37 | −20 | gb105pln | Wheat mRNA for chloroplast phosphoglycerate kinase (EC 2.7.2.3). |
| 700265908H1 | g2781348 | 11 | 3 | gb105allp | F24O1.4 |
| 700267970H1 | g485376 | 66 | −56 | gb105pln | *Zea mays* alpha-3-tubulin gene, complete cds. |
| 700266265H1 | g1872472 | 16 | −2 | gb105pln | *Triticuin aestivum* delta-24-sterol methyltransferase (TA-MT) gene, complete cds. |
| 700263427H1 | g469148 | 18 | −7 | gb105eukp | alanine aminotransferase |
| 700264005H1 | g474006 | 52 | −14 | gb105pln | Rice mRNA, partial homologous to ribosomal protein S11 gene. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700263784H1 | g22283 | 25 | 14 | gb105pln | *Zea mays* Glb1-L gene for vicilin-like embryo storage protein. |
| 700262430H1 | g397400 | 43 | −31 | gb105pln | *B. rapa* mRNA for S phase specific gene. |
| 700262711H1 | g454872 | 35 | −52 | gb105pln | Maize mRNA for group 3 Lea protein MGL3, complete cds. |
| 700258178H1 | g1814402 | 61 | −54 | gb105pln | *Mesembryanthemum crystallinum* methionine synthase (MetE) mRNA, complete cds. |
| 700263107H1 | g2668741 | 51 | −0 | gb105pln | *Zea mays* glycine-rich RNA binding protein (GRP) mRNA, complete cds. |
| 700258224H1 | g20163 | 52 | −41 | gb105pln | *O. sativa* Rrl5 mRNA for 5S ribosomal RNA. |
| 700264878H1 | g1129083 | 40 | −24 | gb105pln | Wheat mRNA for protein H2A, complete cds, clone wcH2A-2. |
| 700265176H1 | g644492 | 29 | −27 | gb105pln | Corn elongation factor 1alpha gene, complete cds. |
| 700263107H1 | g2293479 | 39 | 6 | gb105pln | *Oryza sativa* glycine-rich protein mRNA, complete cds. |
| 700257933H1 | g285637 | 47 | −15 | gb105pln | *Hordeum vulgare* mRNA for vacuolar membrane proton-translocating inorganic pyrophosphat. |
| 700258355H1 | g596079 | 64 | −78 | gb105pln | *Zea mays* thiamine biosynthetic enzyme (thi1-2) mRNA, complete cds. |
| 700264083H1 | g535743 | 17 | −16 | gb105pln | *Oryza sativa* unknown ORF mRNA, complete cds. |
| 700266780H1 | g167112 | 37 | −4 | gb105pln | *Bromus inermis* aldose reductase-related protein, complete cds. |
| 700267309H1 | g1143499 | 29 | −8 | gb105pln | *H. vulgare* mRNA for ADP-glucose pyrophosphorylase small subunit. |
| 700266390H1 | g169649 | 11 | 3 | gb105eukp | CCoAMT; caffeoyl-CoA 3-O-methyltransferase |
| 700267271H1 | g533251 | 84 | −90 | gb105pln | *Zea mays* (clone pSM8) sucrose synthase 2 (Sus1) gene, complete cds. |
| 700266291H1 | g2662340 | 77 | −74 | gb105pln | *Oryza sativa* mRNA for EF-1 alpha, complete cds. |
| 700257203H1 | g596079 | 68 | −15 | gb105pln | *Zea mays* thiamine biosynthetic enzyme (thi1-2) mRNA, complete cds. |
| 700260476H1 | g22484 | 28 | −57 | gb105pln | *Z. mays* RNA for superoxide dismutase Sod4A. |
| 700256732H1 | g395157 | 12 | 3 | gb105eukp | PRP8; pre-mRNA splicing factor, U5 snRNP protein; PRP8 |
| 700265776H1 | g2331300 | 49 | −83 | gb105pln | *Zea mays* ribosomal protein S4 type I (rps4) mRNA, complete cds. |
| 700260334H2 | g19101 | 24 | −11 | gb105pln | *H. vulgare* mRNA for ribosomal protein L17-1. |
| 700263260H1 | g2821955 | 35 | −9 | gb105eukp | spermidine synthase 1; EC 2.5.1.16 |
| 700266213H1 | g22118 | 42 | −82 | gb105pln | *Z. mays* DNA for Adh1-Cm allele. |
| 700265667H1 | g1532072 | 36 | −43 | gb105pln | *Z. mays* mRNA for S-adenosylmethionine decarboxylase. |
| 700257337H1 | g313266 | 22 | 12 | gb105pln | *T. aestivum* gene for phosphoglycerate kinase. |
| 700265066H1 | g142256 | 7 | 0 | gb105allp | PGL ORF |
| 700263373H1 | g1129084 | 25 | −18 | gb105pln | Wheat mRNA for protein H2A, complete cds, clone wcH2A-3. |
| 700267245H1 | g1532072 | 83 | −70 | gb105pln | *Z. mays* mRNA for S-adenosylmethionine decarboxylase. |
| 700265592H1 | g168512 | 45 | −41 | gb105pln | Maize major protein (L3) mRNA from the surface of lipid bodies, 3' end. |
| 700259484H1 | g974781 | 21 | 12 | gb105pln | *C. blumei* kinetoplast met gene for cobalamine-independent methionine synthase. |
| 700207194H1 | g397395 | 58 | −35 | gb105pln | *Z. mays* MNB1b mRNA for DNA-binding protein. |
| 700258339H1 | g18259 | 25 | 5 | gb105pln | *C. sativus* mRNA for cs DnaJ-1. |
| 700266457H1 | g169295 | 33 | −6 | gb105pln | Pharbitis nil heat shock protein 83 (Hsp83) gene, complete cds. |
| 700266655H1 | g19342 | 26 | 0 | gb105pln | *L. esculentum* mRNA for ribosomal protein L2. |
| 700266570H1 | g987122 | 63 | −58 | gb105pln | *Z. mays* mRNA for class II metallothionein. |
| 700258877H1 | g1044856 | 16 | −3 | gb105eukp | W02B12.3 |
| 700266020H1 | g1020408 | 63 | −83 | gb105pln | *Zea mays* mRNA for phospholipase D, complete cds. |
| 700265065H1 | g687244 | 65 | −77 | gb105pln | *Zea mays* oil body protein 16 kDa oleosin (ole16) gene, complete cds. |
| 700257803H1 | g1100062 | 15 | 11 | gb105pln | *Arabidopsis thaliana* IMP |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | dehydrogenase (IMPDH) gene exons 1–5, complete cds. |
| 700267946H1 | g169538 | 20 | 4 | gb105allp | pyrophosphate-fructose 6-phosphate 1-phosphotransferase alpha-subunit |
| 700265666H1 | g485376 | 72 | −73 | gb105pln | *Zea mays* alpha-3-tubulin gene, complete cds. |
| 700258668H1 | g429020 | 61 | −45 | gb105pln | Rice mRNA for elongation factor 2 (gene name SS519), partial cds. |
| 700262877H1 | g435648 | 43 | −5 | gb105pln | Rice mRNA for gamma-Tip, complete cds. |
| 700257609H1 | g18591 | 26 | 4 | gb105eukp | GH3; auxin-responsive GH3 product |
| 700260363H2 | g471320 | 45 | −47 | gb105pln | *H. vulgare* (cv. Bomi) B15C mRNA. |
| 700267876H1 | g169474 | 30 | −31 | gb105pln | *S. tuberosum* 3-deoxy-D-arabino-heptulosonate 7-phosphate synthase (aro1) mRNA, complete cds. |
| 700267539H1 | g687244 | 42 | −74 | gb105pln | *Zea mays* oil body protein 16 kDa oleosin (ole16) gene, complete cds. |
| 700267715H1 | g300263 | 48 | −45 | gb105pln | HSP68 = 68 kda heat-stress DnaK homolog [*Solanum tuberosum* = potatoes, mRNA, 2418 nt]. |
| 700263255H1 | g22292 | 79 | −45 | gb105pln | *Z. mays* mRNA for glycine-rich protein. |
| 700267906H1 | g2760327 | 19 | −1 | gb105eukp | F1N21.12 |
| 700258066H1 | g1200160 | 29 | −12 | gb105pln | *T. gesneriana* mRNA for tonoplast intrinsic protein. |
| 700258292H1 | g1931637 | 25 | −11 | gb105eukp | T19D16.1; receptor-associated kinase isolog |
| 700261319H1 | g514945 | 86 | −32 | gb105pln | *Zea mays* sucrose synthase (Sus1) mRNA, complete cds. |
| 700267192H1 | g2781432 | 40 | −38 | gb105pln | *Oryza sativa* subsp. *japonica* RSW1-like cellulose synthase catalytic subunit mRNA, partial cds. |
| 700258327H1 | g22292 | 54 | −54 | gb105pln | *Z. mays* mRNA for glycine-rich protein. |
| 700264776H1 | g22281 | 26 | −44 | gb105pln | *Zea mays* Glb1-0 gene for vicilin-like storage protein (truncated). |
| 700267809H1 | g1054844 | 18 | 3 | gb105pln | Yeast (*Saccharomyces cerevisiae*) END13 gene. |
| 700259024H1 | g557781 | 14 | −9 | gb105eukp | tcp1beta |
| 700266025H1 | g1053056 | 36 | −34 | gb105pln | *Triticum aestivum* histone H3 gene, partial cds, clone W1. |
| 700257586H1 | g435648 | 44 | −24 | gb105pln | Rice mRNA for gamma-Tip, complete cds. |
| 700261262H1 | g1155264 | 32 | −56 | gb105pln | *Pennisetum ciliare* possible apospory-associated protein mRNA, complete cds. |
| 700261772H1 | g2739308 | 21 | −4 | gb105pln | *Arabidopsis thaliana* pgp3 gene. |
| 700264880H1 | g169324 | 22 | −18 | gb105pln | *Phaseolus aureus* cinnamate 4-hydroxylase mRNA, complete cds. |
| 700260354H1 | g493588 | 21 | −3 | gb105pln | *Hordeum vulgare* disulfide isomerase (PDI) mRNA, complete cds. |
| 700259334H1 | g1155217 | 22 | −10 | gb105eukp | Pti1; serine/threonine protein kinase; Pto kinase interactor 1 |
| 700260554H2 | g22270 | 95 | −54 | gb105pln | Maize mRNA from an embryogenic abscisic acid-inducible gene. |
| 700264920H1 | g687244 | 48 | −79 | gb105pln | *Zea mays* oil body protein 16 kDa oleosin (ole16) gene, complete cds. |
| 700266023H1 | g1345503 | 13 | 5 | gb105eukp | p40; 40 kD protein |
| 700266158H1 | g602605 | 77 | −73 | gb105pln | *Zea mays* tandem genes for alpha1-tubulin and alpha2-tubulin. |
| 700259696H1 | g2618599 | 21 | −4 | gb105pln | *Arabidopsis thaliana* genomic DNA, chromosome 5, P1 clone: MBD2, complete sequence. |
| 700263829H1 | g20647 | 44 | −7 | gb105pln | *P. sativum* ApxI mRNA for ascorbate peroxidase. |
| 700260796H1 | g22302 | 89 | −13 | gb105pln | Maize Gpc1 gene for glyceraldehyde-3-phosphate dehydrogenase (GADPH) subunit C. |
| 700263263H1 | g287398 | 21 | −2 | gb105pln | Rice mRNA for a protein related to chilling tolerance. |
| 700258048H1 | g1498315 | 30 | 1 | gb105eukp | IAP100 |
| 700267002H1 | g166689 | 18 | 0 | gb105pln | *A. thaliana* 3-deoxy-D-arabino-heptulosonate 7-phosphate synthase (DHS2) mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700263683H1 | g687244 | 72 | −69 | gb105pln | *Zea mays* oil body protein 16 kDa oleosin (ole16) gene, complete cds. |
| 700260677H1 | g2564007 | 21 | 2 | gb105allp | proteasome p45/SUG |
| 700266690H1 | g1161311 | 48 | −43 | gb105pln | *Arabidopsis thaliana* Columbia myo-inositol-1-phosphate synthase mRNA, complete cds. |
| 700261210H1 | g758292 | 8 | 7 | gb105allp | ORF N2212 |
| 700262339H1 | g415314 | 46 | −55 | gb105pln | Rice mRNA for NADP dependent malic enzyme, complete cds. |
| 700258188H1 | g167375 | 10 | 3 | gb105eukp | vicilin precursor |
| 700257817H1 | g22283 | 67 | −48 | gb105pln | *Zea mays* Glb1-L gene for vicilin-like embryo storage protein. |
| 700262751H1 | g1296954 | 24 | −4 | gb105pln | *O. sativa* mRNA for novel protein, osr40c1. |
| 7002610SSH1 | g312571 | 38 | 7 | gb105pln | *L. angustifolius* 26S rRNA (partial). |
| 700263285H1 | g2394228 | 40 | −28 | gb105pln | *Arabidopsis thaliana* WD-40 repeat protein (MSI1) mRNA, complete cds. |
| 700267649H1 | g22270 | 95 | −20 | gb105pln | Maize mRNA from an embryogenic abscisic acid-inducible gene. |
| 700266275H1 | g1167953 | 9 | −3 | gb105eukp | putative 32.6 kDa jasmonate-induced protein |
| 700265876H1 | g450353 | 22 | −10 | gb105pln | *H. vulgare* (cv Bomi) gB19.1b gene. |
| 700267269H1 | g218000 | 32 | −20 | gb105pln | Potato mRNA for UDP-glucose pyrophosphorylase (EC 2.7.7.9). |
| 700257066H1 | g1841461 | 23 | 10 | gb105pln | *N. tabacum* mRNA for elongation factor 2. |
| 700261657H1 | g687244 | 45 | −30 | gb105pln | *Zea mays* oil body protein 16 kDa oleosin (ole16) gene, complete cds. |
| 700262265H1 | g1651457 | 9 | 6 | gb105allp | Aminopeptidase N |
| 700267485H1 | g596079 | 36 | −10 | gb105pln | *Zea mays* thiamine biosynthetic enzyme (thi1-2) mRNA, complete cds. |
| 700260722H1 | g927238 | 46 | −23 | gb105pln | *Zea mays* globulin1 (Glb1) gene, allele Glb1-Hb, complete cds. |
| 700262148H1 | g21863 | 54 | −44 | gb105pln | Wheat mRNA for Rubisco subunit binding-protein alpha subunit. |
| 700263768H1 | g687244 | 36 | −68 | gb105pln | *Zea mays* oil body protein 16 kDa oleosin (ole16) gene, complete cds. |
| 700261840H1 | g687244 | 69 | −44 | gb105pln | *Zea mays* oil body protein 16 kDa oleosin (ole16) gene, complete cds. |
| 700256816H1 | g1890152 | 20 | −5 | gb105eukp | allene oxide synthase |
| 700264502H1 | g533706 | 26 | −9 | gb105pln | *Arabidopsis thaliana* 3-methylcrotonyl-CoA carboxylase precursor mRNA, complete cds. |
| 700267779H1 | g1532047 | 14 | −1 | gb105pln | *O. sativa* mRNA for S-adenosylmethionine decarboxylase. |
| 700266788H1 | g21834 | 65 | −60 | gb105pln | Wheat mRNA for cytosolic phosphoglycerate kinase (EC 2.7.2.3). |
| 700263251H1 | g596077 | 38 | −43 | gb105pln | *Zea mays* thiamine biosynthetic enzyme (thi1-1) mRNA, complete cds. |
| 700258566H1 | g505583 | 36 | −17 | gb105eukp | Dbp25F |
| 700259143H2 | g2511583 | 14 | −5 | gb105pln | *Arabidopsis thaliana* mRNA for proteasome subunit prc9. |
| 700262085H1 | g508544 | 59 | −71 | gb105pln | *Zea mays* 24-kD alpha-zein gene (floury2), complete cds. |
| 700262830H1 | g1532047 | 21 | 14 | gb105pln | *O. sativa* mRNA for S-adenosylmethionine decarboxylase. |
| 700267629H1 | g469148 | 17 | −2 | gb105eukp | alanine aminotransferase |
| 700258230H1 | g1800277 | 15 | 4 | gb105eukp | translation initiation factor |
| 700258652H1 | g1302478 | 15 | 0 | gb105allp | ORF YNR006w |
| 700262836H1 | g577824 | 29 | −32 | gb105pln | *Z. mays* gene for H2B histone (gH2B3). |
| 700260407H1 | g1401066 | 7 | 4 | gb105allp | Supt4h |
| 700265063H1 | g218000 | 45 | −40 | gb105pln | Potato mRNA for UDP-glucose pyrophosphorylase (EC 2.7.7.9). |
| 700267184H1 | g1216011 | 20 | 3 | gb105allp | NAP57 homologue |
| 700267353H1 | g2182266 | 55 | −28 | gb105pln | *Hordeum vulgare* lipoxygenase (LoxB) mRNA, complete cds. |
| 700261379H1 | g687244 | 56 | −70 | gb105pln | *Zea mays* oil body protein 16 kDa oleosin (ole16) gene, complete cds. |
| 700262621H1 | g1213278 | 36 | −7 | gb105pln | *Z. mays* ZEMb gene. |
| 700265183H1 | g2443401 | 64 | −58 | gb105pln | *Oryza sativa* mRNA for orthophosphate dikinase, complete cds. |
| 700267052H1 | g1652223 | 14 | 7 | gb105allp | ABC1-like |
| 700266014H1 | g22284 | 11 | 2 | gb105eukp | Glb1-L; vicilin-like embryo |

TABLE 1-continued

LIST OF INCYTE CLONES DERIVED FROM SATMON022023
COPYRIGHT 1998 INCYTE PHARMACEUTICALS, INC.

| | | | | |
|---|---|---|---|---|
| | | | | storage protein |
| 700257038H1 | g22125 | 34 | −33 | gb105pln | *Zea mays* Adh2-N gene for alcohol dehydrogenase 2. |
| 700262872H1 | g2828149 | 22 | −5 | gb105allp | cyclophilin-33A |
| 700267426H1 | g313266 | 36 | −21 | gb105pln | *T. aestivum* gene for phosphoglycerate kinase. |
| 700266581H1 | g2511737 | 11 | 5 | gb105allp | caffeoyl-CoA 3-O-methyltransferase 5 |
| 700265168H1 | g19103 | 27 | −11 | gb105pln | *H. vulgare* mRNA for ribosomal protein L17-2. |
| 700207164H1 | g1653253 | 17 | −1 | gb105allp | glucose-6-phosphate isomerase |
| 700261876H1 | g22144 | 61 | −71 | gb105pln | Maize anaerobically regulated gene for fructose bisphosphate aldolase (EC 4.1.2.13). |
| 700263296H1 | g927239 | 6 | 8 | gb105eukp | Glb1; globulin1 |
| 700266457H1 | g300082 | 38 | −7 | gb105pln | hsp82 = 82 kda heat shock protein [*Zea mays*, seedling, leaves, Genomic, 3468 nt]. |
| 700258811H1 | g168512 | 28 | −83 | gb105pln | Maize major protein (L3) mRNA from the surface of lipid bodies, 3' end. |
| 700262385H1 | g633889 | 62 | −52 | gb105pln | glucose and ribitol dehydrogenase homolog [*Hordeum vulgare* = barley, Aura, embryo, mRNA, 1170 nt]. |
| 700267159H1 | g168692 | 87 | −84 | gb105pln | Maize zein mRNA, complete cds, clone ZG7. |
| 700262894H1 | g22272 | 67 | −16 | gb105pln | Maize mRNA for enolase (2-phospho-D-glycerate hydrolase). |
| 700267702H1 | g902583 | 94 | −89 | gb105pln | *Zea mays* clone MubG1 ubiquitin gene, complete cds. |
| 700258868H1 | g1752830 | 16 | −28 | gb105pln | Rice DNA for metallothionein-like protein, complete cds. |
| 700263365H1 | g2104525 | 18 | −15 | gb105eukp | T10M13.2; T10M13.2 |
| 700267890H1 | g1196896 | 16 | 8 | gb105pln | Glycine max acidic ribosomal protein P0 mRNA, complete cds. |
| 700259190H2 | g440583 | 18 | −4 | gb105eukp | ura7; CTP synthetase |
| 700262948H1 | g2739168 | 13 | 3 | gb105eukp | GP40; aldose-1-epimerase-like protein |
| 700264247H1 | g3265 | 9 | −5 | gb105eukp | GAL 10; UDP-galactose-4-epimerase; EC 5.1.3.2 |
| 700267717H1 | g1019386 | 10 | −3 | gb105eukp | Ost48; oligosaccharyltransferase subunit |
| 700266029H1 | g1184960 | 26 | −14 | gb105eukp | GAD2; glutamate decarboxylase 2 |
| 700267486H1 | g20255 | 72 | −25 | gb105pln | *O. sativa* gene for heat shock protein 82 HSP82. |
| 700259237H1 | g1272684 | 99 | −96 | gb105pln | *Z. mays* mRNA for acetyl CoA carboxylase (partial). |
| 700265296H1 | g434344 | 28 | −10 | gb105pln | *A. thaliana* (Columbia) mRNA for S18 ribosomal protein (641 bp). |
| 700259733H1 | g2668741 | 30 | 11 | gb105pln | *Zea mays* glycine-rich RNA binding protein (GRP) mRNA, complete cds. |
| 700257443H2 | g886737 | 49 | −24 | gb105pln | *Z. mays* histone H3 gene. |
| 700267696H1 | g1272684 | 70 | −63 | gb105pln | *Z. mays* mRNA for acetyl CoA carboxylase (partial). |
| 700262927H1 | g452559 | 47 | −64 | gb105pln | *Zea mays* group 3 Lea protein MGL3 mRNA, complete cds. |
| 700259733H1 | g2293479 | 25 | 14 | gb105pln | *Oryza sativa* glycine-rich protein mRNA, complete cds. |
| 700262233H1 | g18963 | 54 | −67 | gb105pln | *Z. mays* mRNA for dehydrin (dhn3). |
| 700268153H1 | g1184775 | 74 | −62 | gb105pln | *Zea mays* glyceraldehyde-3-phosphate dehydrogenase GAPC4 (gpc4) mRNA, complete cds. |
| 700261138H1 | g683503 | 35 | −4 | gb105pln | *A. thaliana* mRNA for 65 kDa regulatory subunit of protein phosphatase 2A. |
| 700263829H1 | g600115 | 44 | −7 | gb105pln | *Z. mays* apx gene encoding cytosolic ascorbate peroxidase. |
| 700258676H1 | g1694620 | 29 | −21 | gb105pln | Cucurbita sp. mRNA for 3-ketoacyl-CoA thiolase, complete cds. |
| 700259018H1 | g170037 | 31 | −26 | gb105eukp | N-35; nodulin-35 |
| 700261624H1 | g167107 | 36 | −28 | gb105pln | *Hordeum vulgare* vacuolar ATPase B subunit isoform mRNA, complete cds. |
| 700264656H1 | g471320 | 18 | −23 | gb105pln | *H. vulgare* (cv. Bomi) B15C mRNA. |
| 700260518H2 | g1171351 | 23 | −10 | gb105pln | *Oryza sativa* 16 kDa oleosin (ole16) mRNA, complete cds. |
| 700257658H1 | g1167953 | 8 | 1 | gb105allp | putative 32.6 kDa |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | jasmonate-induced protein |
| 700267424H1 | g687244 | 28 | −68 | gb105pln | *Zea mays* oil body protein 16 kDa oleosin (ole16) gene, complete cds. |
| 700258061H1 | g1592681 | 10 | 6 | gb105eukp | LEA D113 homologue type2 |
| 700263073H1 | g2331300 | 75 | −44 | gb105pln | *Zea mays* ribosomal protein S4 type I (rps4) mRNA, complete cds. |
| 700264151H1 | g454872 | 35 | −36 | gb105pln | Maize mRNA for group 3 Lea protein MGL3, complete cds. |
| 700262305H1 | g1694832 | 31 | −48 | gb105pln | *H. vulgare* Per1 gene. |
| 700267278H1 | g22281 | 52 | −60 | gb105pln | *Zea mays* Glb1-0 gene for vicilin-like storage protein (truncated). |
| 700258047H1 | g596079 | 60 | −69 | gb105pln | *Zea mays* thiamine biosynthetic enzyme (thi1-2) mRNA, complete cds. |
| 700261776H1 | g2511530 | 40 | −3 | gb105pln | *Eleusine indica* alpha tubulin 1 (TUA1) mRNA, complete cds. |
| 700266655H1 | g798817 | 31 | −6 | gb105pln | *A. thaliana* mRNA for ribosomal protein L2. |
| 700261480H1 | g538427 | 36 | −15 | gb105pln | *Oryza sativa* ribosomal protein S16 mRNA, complete cds. |
| 700262372H1 | g1931637 | 17 | −3 | gb105eukp | T19D16.1; receptor-associated kinase isolog |
| 700256761H1 | g601834 | 32 | 4 | gb105pln | (wU2.1) = U2 snRNA [*Triticum aestivum* = wheat, snRNA, 194 nt]. |
| 700262922H1 | g22284 | 6 | 7 | gb105eukp | Glb1-L; vicilin-like embryo storage protein |
| 700258658H1 | g599622 | 8 | 5 | gb105allp | 2A6 gene product |
| 700264416H1 | g1694832 | 31 | −49 | gb105pln | *H. vulgare* Per1 gene. |
| 700266040H1 | g248336 | 54 | −17 | gb105pln | polyubiquitin [maize, Genomic, 3841 nt]. |
| 700265875H1 | g644492 | 55 | −81 | gb105pln | Corn elongation factor 1alpha gene, complete cds. |
| 700258523H1 | g669002 | 41 | −33 | gb105pln | *Glycine max* calnexin mRNA, complete cds. |
| 700260363H2 | g971279 | 44 | −42 | gb105pln | Rice mRNA for RAB24 protein, complete cds. |
| 700265206H1 | g2780192 | 22 | −14 | gb105eukp | nap |
| 700260489H1 | g469069 | 4 | 7 | gb105allp | NMDA receptor subunit NR2D |
| 700263006H1 | g170439 | 21 | −2 | gb105pln | *Lycopersicon esculentum* cyclophilin (CyP) mRNA, complete cds. |
| 700260156H1 | g777757 | 57 | −18 | gb105pln | *Saccharum* hybrid (clone SCUBI561) polyubiquitin mRNA, complete cds. |
| 700264019H1 | g596079 | 82 | −35 | gb105pln | *Zea mays* thiamine biosynthetic enzyme (thi1-2) mRNA, complete cds. |
| 700267054H1 | g18259 | 27 | −9 | gb105pln | *C. sativus* mRNA for cs DnaJ-1. |
| 700258133H1 | g170775 | 68 | −54 | gb105pln | Wheat translation elongation factor 1 alpha-subunit (TEF1) mRNA, complete cds. |
| 700261140H1 | g22287 | 10 | 4 | gb105allp | vicilin-like embryo storage protein |
| 700264949H1 | g1694832 | 20 | −20 | gb105pln | *H. vulgare* Per1 gene. |
| 700258150H1 | g2618603 | 12 | 3 | gb105pln | *Arabidopsis thaliana* genomic DNA, chromosome 5, P1 clone: MSL3, complete sequence. |
| 700258577H1 | g2736379 | 11 | −3 | gb105eukp | T22B11.5 |
| 700264466H1 | g1914683 | 17 | 0 | gb105eukp | assembly factor of the complex for nucleotide excision repair of V-damaged DNA; RAD23, isoform I |
| 700265132H1 | g20243 | 32 | −16 | gb105pln | *O. sativa* GP28 gene (partial). |
| 700258952H1 | g755784 | 15 | 8 | gb105eukp | unknown |
| 700266013H1 | g168480 | 84 | −80 | gb105pln | Maize embryo globulin S allele (7S-like) mRNA, complete cds. |
| 700261735H1 | g1621306 | 5 | 7 | gb105eukp | F21G4.2 |
| 700262915H1 | g596079 | 55 | −70 | gb105pln | *Zea mays* thiamine biosynthetic enzyme (thi1-2) mRNA, complete cds. |
| 700258859H1 | g2668741 | 31 | −12 | gb105pln | *Zea mays* glycine-rich RNA binding protein (GRP) mRNA, complete cds. |
| 700267082H1 | g168482 | 95 | −65 | gb105pln | Corn starch branching enzyme II mRNA, complete cds. |
| 700260238H1 | g722271 | 12 | 14 | gb105pln | *Brassica napus* chitinase class IV (LSC222) mRNA, partial cds. |
| 700258072H1 | g22447 | 18 | 7 | gb105pln | *Zea mays* ZMPMS2 gene for 19 kDa zein protein. |
| 700261827H1 | g1848282 | 75 | −33 | gb105pln | *Sorghum bicolor* aldehyde dehydrogenase (Dha1) mRNA, partial cds. |
| 700260373H2 | g168608 | 48 | −45 | gb105pln | Maize 17S ribosomal RNA gene and flanks. |
| 700260490H1 | g22149 | 65 | −63 | gb105pln | *Z. mays* mRNA for alpha-tubulin 3. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700265020H1 | g728699 | 37 | −22 | gb105eukp | TCP-1 homologue |
| 700267983H1 | g1350502 | 12 | 1 | gb105allp | vicilin-like storage protein |
| 700258572H1 | g1711035 | 33 | 7 | gb105pln | *Pisum sativum* hydroxyproline rich glycoprotein PsHRGP1 mRNA, partial cds. |
| 700262478H1 | g2160438 | 5 | 7 | gb105allp | glutamate receptor channel subunit epsilon 4 |
| 700267546H1 | g296650 | 12 | 4 | gb105allp | hnrnp a1 protein |
| 700265648H1 | g595816 | 18 | −7 | gb105eukp | mudrA |
| 700267223H1 | g601833 | 38 | −4 | gb105pln | (wU1.1) = U1 snRNA [Triticum aestivum = wheat, snRNA, 162 nt]. |
| 700262334H1 | g644492 | 71 | −66 | gb105pln | Corn elongation factor 1alpha gene, complete cds. |
| 700265590H1 | g1181672 | 81 | −72 | gb105pln | Sorghum bicolor heat shock protein 70 cognate (hsc70) mRNA, partial cds. |
| 700257332H1 | g1323444 | 13 | 0 | gb105allp | ORF YGR245c |
| 700257379H1 | g168608 | 46 | −54 | gb105pln | Maize 17S ribosomal RNA gene and flanks. |
| 700256831H1 | g471320 | 35 | −8 | gb105pln | *H. vulgare* (cv. Bormi) B15C mRNA. |
| 700264861H1 | g1854579 | 21 | −5 | gb105allp | Int-6 |
| 700262963H1 | g21624 | 19 | 9 | gb105pln | *S. vulgare* mRNA for glycine-rich RNA-binding protein (clone S2). |
| 700266855H1 | g156279 | 25 | 5 | gb105eukp | eft-2; elongation factor |
| 700261586H1 | g166572 | 25 | 2 | gb105eukp | phosphoprotein phosphatase 1; EC 3.1.3.16 |
| 700261919H1 | g1129083 | 23 | −26 | gb105pln | Wheat mRNA for protein H2A, complete cds, clone wcH2A-2. |
| 700261685H1 | g1019404 | 32 | −14 | gb105eukp | SPAC2G11.06; unknown |
| 700264661H1 | g168423 | 98 | −94 | gb105pln | *Zea mays* polypeptide chain-binding protein mRNA, 3' end. |
| 700267243H1 | g1575127 | 98 | −78 | gb105pln | *Zea mays* lumenal binding protein cBiPe2 mRNA, complete cds. |
| 700263942H1 | g968901 | 43 | −46 | gb105pln | Rice mRNA for ribosomal protein S8, complete cds. |
| 700257647H1 | g443960 | 30 | −4 | gb105eukp | RIBOSOMAL PROTEIN S4 |
| 700260456H1 | g168512 | 14 | 7 | gb105pln | Maize major protein (L3) mRNA from the surface of lipid bodies, 3' end. |
| 700257102H1 | g1403043 | 11 | 11 | gb105pln | *H. chilense* × *T. turgidum* conv. durum (Tritordeum) mRNA for S-adenosylmethionine decarboxylase. |
| 700262962H1 | g687244 | 62 | −72 | gb105pln | *Zea mays* oil body protein 16 kDa oleosin (ole16) gene, complete cds. |
| 700264769H1 | g899607 | 62 | −54 | gb105pln | *Zea mays* polyubiquitin (MubC5) mRNA, complete cds. |
| 700265547H1 | g2529657 | 22 | −8 | gb105pln | *Arabidopsis thaliana* chromosome II BAC T30B22 genomic sequence, complete sequence. |
| 700256705H1 | g1835701 | 13 | 2 | gb105eukp | m6pr; NADPH-dependent mannose 6-phosphate reductase; EC 1.1.1.224 |
| 700261627H1 | g687244 | 61 | −58 | gb105pln | *Zea mays* oil body protein 16 kDa oleosin (ole16) gene, complete cds. |
| 700265052H1 | g2366750 | 28 | −12 | gb105eukp | RGP-3; RNA binding protein |
| 700266681H1 | g2463334 | 32 | −34 | gb105pln | *Oryza sativa* mRNA for ribosomal protein S4. |
| 700262695H1 | g20598 | 40 | −18 | gb105pln | *P. miliaceum* mRNA for aspartate aminotransferase (pcAAT2). |
| 700257113H1 | g168508 | 47 | 9 | gb105pln | Maize oleosin KD18 (KD18; L2) gene, complete cds. |
| 700258956H1 | g2815905 | 15 | 1 | gb105eukp | sug-1; Sug-1 proteosome subunit homolog |
| 700264878H1 | g1129084 | 39 | −23 | gb105pln | Wheat mRNA for protein H2A, complete cds, clone wcH2A-3. |
| 700261763H1 | g505135 | 23 | −5 | gb105pln | Rice gene for ferredoxin, complete cds. |
| 700258203H1 | g927238 | 98 | −68 | gb105pln | *Zea mays* globulin1 (Glb1) gene, allele Glb1-Hb, complete cds. |
| 700266242H1 | g2160153 | 26 | −2 | gb105eukp | F19K23.7 |
| 700256812H1 | g1658312 | 22 | −22 | gb105pln | *O. sativa* osr40g2 gene. |
| 700263065H1 | g809513 | 20 | 12 | gb105pln | Rice mRNA for ferredoxin-nitrite reductase, complete cds. |
| 700266631H1 | g20740 | 34 | −11 | gb105pln | *Pisum sativum* mRNA for P protein, a part of glycine cleavage complex. |
| 700258661H1 | g722271 | 12 | 13 | gb105pln | *Brassica napus* chitinase class IV (LSC222) mRNA, partial cds. |
| 700262927H1 | g444044 | 47 | −64 | gb105pln | *Z. mays* mRNA for group 3 Lea protein MGL3. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700265832H1 | g2246625 | 54 | −4 | gb105eukp | protein kinase |
| 700260178H1 | g168512 | 34 | −49 | gb105pln | Maize major protein (L3) mRNA from the surface of lipid bodies, 3' end. |
| 700259224H1 | g2827079 | 19 | 8 | gb105pln | *Medicago sativa* mitochondrial malate dehydrogenase precursor (mmdh) mRNA, nuclear gene encoding mitochondrial protein, complete cds. |
| 700267609H1 | g218177 | 43 | −29 | gb105pln | Rice mRNA for ribosomal protein L35 (NH77 gene), partial sequence. |
| 700259179H2 | g2624201 | 20 | 14 | gb105pln | *M. acuminata* mRNA; clone pBAN UU90. |
| 700257286H1 | g398921 | 33 | 16 | gb105pln | *B. napus* cold induced protein (BnC24B). |
| 700266771H1 | g2827698 | 21 | −7 | gb105pln | *Arabidopsis thaliana* DNA chromosome 4, BAC clone F6H11 (ESSAII project). |
| 700265275H1 | g595816 | 32 | −19 | gb105eukp | mudrA |
| 700261626H1 | g22287 | 8 | 7 | gb105allp | vicilin-like embryo storage protein |
| 700263373H1 | g1129085 | 24 | −18 | gb105pln | Wheat mRNA for protein H2A, complete cds, clone wcH2A-9. |
| 700257272H1 | g2668741 | 35 | 7 | gb105pln | *Zea mays* glycine-rich RNA binding protein (GRP) mRNA, complete cds. |
| 700257159H1 | g633889 | 23 | 7 | gb105pln | glucose and ribitol dehydrogenase homolog [*Hordeum vulgare* = barley, Aura, embryo, mRNA, 1170 nt]. |
| 700267889H1 | g22144 | 64 | −78 | gb105pln | Maize anaerobically regulated gene for fructose bisphosphate aldolase (EC 4.1.2.13). |
| 700266987H1 | g407800 | 24 | 6 | gb105pln | *G. hirsutum* mRNA for ribosomal protein 41, large subunit (RL41). |
| 700261262H1 | g1842068 | 22 | −32 | gb105pln | *Mesembryanthemum crystallinum* Nt-rab70 homolog mRNA, complete cds. |
| 700264614H1 | g687246 | 9 | 10 | gb105pln | *Zea mays* oil body protein 17 kDa oleosin (ole17) gene, complete cds. |
| 700257272H1 | g2293479 | 31 | 9 | gb105pln | *Oryza sativa* glycine-rich protein mRNA, complete cds. |
| 700261122H1 | g19012 | 24 | 0 | gb105pln | *H. vulgare* mRNA for LEA B19.1 protein. |
| 700264659H1 | g166857 | 20 | −23 | gb105pln | *Arabidopsis thaliana* cytoplasmic ribosomal protein mRNA, complete cds. |
| 700259388H1 | g22283 | 32 | −32 | gb105pln | *Zea mays* Glb1-L gene for vicilin-like embryo storage protein. |
| 700261485H1 | g488134 | 23 | 5 | gb105eukp | HMG-CoA; hydroxymethylglutaryl-CoA synthase; EC 4.1.3.5 |
| 700262623H1 | g506138 | 49 | −40 | gb105pln | *Zea mays* Ec metallothionein class II protein mRNA, complete cds. |
| 700257910H1 | g1743276 | 51 | −55 | gb105pln | *H. vulgare* mRNA for beta tubulin. |
| 700260023H1 | g170432 | 25 | 2 | gb105pln | Tomato ATP-dependent protease (CD4A) gene, complete cds. |
| 700257111H1 | g1929412 | 18 | 5 | gb105eukp | npp5; protein phosphatase type 2A |
| 700258909H1 | g780813 | 49 | −22 | gb105pln | *Arabidopsis thaliana* 3-ketoacyl-acyl carrier protein synthase I (KAS I) mRNA, complete cds. |
| 700259322H1 | g1122844 | 24 | 1 | gb105allp | W09C2.3 |
| 700257803H1 | g1100063 | 27 | −2 | gb105eukp | IMPDH; IMP dehydrogenase |
| 700263313H1 | g248336 | 62 | −44 | gb105pln | polyubiquitin [maize, Genomic, 3841 nt]. |
| 700266585H1 | g22281 | 76 | −75 | gb105pln | *Zea mays* Glb1-0 gene for vicilin-like storage protein (truncated). |
| 700259485H1 | g20163 | 52 | 2 | gb105pln | *O. sativa* Rrl5 mRNA for 5S ribosomal RNA. |
| 700267653H1 | g168512 | 44 | −41 | gb105pln | Maize major protein (L3) mRNA from the surface of lipid bodies, 3' end. |
| 700262660H1 | g312516 | 22 | −10 | gb105pln | *T. aestivum* Em mRNA. |
| 700267002H1 | g169474 | 21 | −1 | gb105pln | *S. tuberosum* 3-deoxy-D-arabino-heptulosonate 7-phosphate synthase (aro1) mRNA, complete cds. |
| 700264207H1 | g168512 | 29 | 0 | gb105pln | Maize major protein (L3) mRNA from the surface of lipid bodies, 3' end. |
| 700264937H1 | g22283 | 53 | −61 | gb105pln | *Zea mays* Glb1-L gene for vicilin-like embryo storage protein. |
| 700261850H1 | g1495251 | 43 | −12 | gb105eukp | heat-shock protein |
| 700264383H1 | g474009 | 67 | −59 | gb105pln | Rice mRNA, partial homologous |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | to ribosomal protein S19 gene. |
| 700266470H1 | g2149640 | 9 | 8 | gb105eukp | AGO1; leaf development; Argonaute protein |
| 700265656H1 | g1931649 | 15 | 4 | gb105eukp | T19D16.15; DNA helicase isolog |
| 700257402H2 | g1931637 | 19 | 1 | gb105eukp | T19D16.1; receptor-associated kinase isolog |
| 700267445H1 | g596079 | 89 | −63 | gb105pln | Zea mays thiamine biosynthetic enzyme (thi1-2) mRNA, complete cds. |
| 700266257H1 | g1184771 | 100 | −99 | gb105pln | Zea mays glyceraldehyde-3-phosphate dehydrogenase GAPC2 (gpc2) mRNA, complete cds. |
| 700207196H1 | g22118 | 47 | −74 | gb105pln | Z. mays DNA for Adh1-Cm allele. |
| 700264386H1 | g499011 | 86 | −79 | gb105pln | S. vulgare SoAc1 mRNA. |
| 700261086H1 | g2213547 | 34 | 1 | gb105eukp | SPCC4G3.04c; putative ubiquinone biosynthesis methyltransferase |
| 700256853H1 | g168512 | 39 | −39 | gb105pln | Maize major protein (L3) mRNA from the surface of lipid bodies, 3′ end. |
| 700262496H1 | g1184771 | 50 | −17 | gb105pln | Zea mays glyceraldehyde-3-phosphate dehydrogenase GAPC2 (gpc2) mRNA, complete cds. |
| 700258975H1 | g2739376 | 13 | 6 | gb105allp | putative permease |
| 700265360H1 | g22287 | 12 | −1 | gb105eukp | Glb1-S; vicilin-like embryo storage protein |
| 700265495H1 | g168480 | 67 | −53 | gb105pln | Maize embryo globulin S allele (7S-like) mRNA, complete cds. |
| 700259725H1 | g1256607 | 41 | −0 | gb105pln | Glycine max G protein beta subunit mRNA, complete cds. |
| 700258401H1 | g22237 | 46 | −69 | gb105pln | Maize mRNA for cytosolic GAPDH (GapC) glyceraldehyde-3-phosphate dehydrogenase. |
| 700262382H1 | g387908 | 50 | −11 | gb105pln | Brassica rapa S-phase-specific (BIS289) mRNA, complete cds. |
| 700267731H1 | g1103627 | 42 | 9 | gb105pln | Z. mays Fer1 gene. |
| 700259607H1 | g2088803 | 22 | −13 | gb105eukp | D1007.6 |
| 700263146H1 | g168650 | 50 | 3 | gb105pln | Zea mays ubiquitin fusion protein (UBF9) gene, complete cds. |
| 700263783H1 | g695625 | 8 | 8 | gb105allp | CCTtheta, theta subunit of the chaperonin containing TCP-1 (CCT) |
| 700264656H1 | g971279 | 17 | −24 | gb105pln | Rice mRNA for RAB24 protein, complete cds. |
| 700261256H1 | g2511591 | 28 | −13 | gb105pln | Arabidopsis thaliana mRNA for proteasome subunit prc8. |
| 700260318H2 | g21856 | 29 | −39 | gb105pln | Wheat rDNA 25S-18S intergenic region EcoRI-BamHI fragment. |
| 700262825H1 | g168512 | 27 | 15 | gb105pln | Maize major protein (L3) mRNA from the surface of lipid bodies, 3′ end. |
| 700264365H1 | g790640 | 21 | −10 | gb105pln | Hordeum vulgare gamma-thionin (HTH3) mRNA, complete cds. |
| 700267946H1 | g483547 | 22 | 3 | gb105eukp | pyrophosphate-dependent phosphofructokinase alpha subunit |
| 700207179H1 | g2589161 | 93 | −84 | gb105pln | Zea mays mRNA for aldehyde oxidase, complete cds. |
| 700258728H1 | g1314049 | 19 | 6 | gb105eukp | archain/delta-COP |
| 700266773H1 | g304108 | 27 | −19 | gb105pln | Arabidopsis thaliana poly(A)-binding protein mRNA, complete cds. |
| 700262313H1 | g746540 | 8 | 2 | gb105eukp | F41C3.4 |
| 700265663H1 | g1574937 | 28 | −66 | gb105pln | Zea mays superoxide dismutase 4 (sod4) gene, partial cds. |
| 700261245H1 | g431270 | 31 | −2 | gb105eukp | UBC5; ubiquitin conjugating enzyme |
| 700263365H1 | g2505874 | 26 | −14 | gb105eukp | putative kinase |
| 700266213H1 | g22119 | 95 | −91 | gb105pln | Maize Adh1-F mRNA for alcohol dehydrogenase. |
| 700257172H1 | g854177 | 22 | 6 | gb105allp | RNA polymerase II subunit hRPB17 |
| 700257650H1 | g1945276 | 18 | 3 | gb105pln | L. esculentum mRNA for branched chain alpha-keto acid dehydrogenase E1-alpha subunit. |
| 700261076H1 | g473997 | 29 | 7 | gb105eukp | yk333; gamma-Tip |
| 700262967H1 | g21493 | 14 | 1 | gb105eukp | mpp; mitochondrial processing peptidase |
| 700264456H1 | g1783180 | 23 | −3 | gb105pln | Wheat mRNA for Thiol-specific antioxidant protein, partial cds. |
| 700267794H1 | g471320 | 61 | −54 | gb105pln | H. vulgare (cv. Bomi) B15C mRNA. |
| 700265557H1 | g1518539 | 32 | −34 | gb105pln | Glycine max UDP-glucose dehydrogenase mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700259420H1 | g1165206 | 34 | −16 | gb105eukp | MBP1; MBF1 |
| 700258637H1 | g22283 | 60 | −70 | gb105pln | *Zea mays* Glb1-L gene for vicilin-like embryo storage protein. |
| 700263683H1 | g1622938 | 26 | −3 | gb105pln | *Bromus secalinus* oleosin (ole16) mRNA, complete cds. |
| 700258510H1 | g1532072 | 11 | 12 | gb105pln | *Z. mays* mRNA for S-adenosylmethionine decarboxylase. |
| 700260661H1 | g2341025 | 38 | −11 | gb105eukp | F19P19.2; F19P19.2 |
| 700264312H1 | g998429 | 72 | −74 | gb105pln | GRF1 = general regulatory factor [*Zea mays*, XL80, Genomic, 5348 nt]. |
| 700264242H1 | g1279640 | 13 | 1 | gb105eukp | NAM; apical meristem formation |
| 700267550H1 | g1220177 | 18 | 7 | gb105pln | *T. ledebourii* mRNA for pG31-like dormancy related protein. |
| 700268095H1 | g22283 | 61 | −23 | gb105pln | *Zea mays* Glb1-L gene for vicilin-like embryo storage protein. |
| 700257936H1 | g22283 | 36 | −54 | gb105pln | *Zea mays* Glb1-L gene for vicilin-like embryo storage protein. |
| 700257959H1 | g1350502 | 11 | 3 | gb105allp | vicilin-like storage protein |
| 700266030H1 | g2781432 | 41 | −33 | gb105pln | *Oryza sativa* subsp. *japonica* RSW1-like cellulose synthase catalytic subunit mRNA, partial cds. |
| 700257308H1 | g2160438 | 4 | 7 | gb105allp | glutamate receptor channel subunit epsilon 4 |
| 700260688H1 | g2599561 | 13 | 14 | gb105pln | *Fragaria × ananassa* dihydroflavonol 4-reductase mRNA, complete cds. |
| 700266892H1 | g18140 | 20 | 12 | gb105pln | *C. rubrum* mRNA for light-induced 34 kD protein. |
| 700266080H1 | g166868 | 39 | −39 | gb105pln | *Arabidopsis thaliana* ribosomal protein S11 (RPS11-beta) mRNA, complete cds. |
| 700261761H1 | g168565 | 64 | −19 | gb105pln | *Zea mays* putative RNA polymerase II 140 kD subunit mRNA, partial cds. |
| 700262230H1 | g1229168 | 16 | −10 | gb105pln | *Hordeum vulgare* profilin (Hvpro1) mRNA, complete cds. |
| 700256848H1 | g527562 | 5 | 7 | gb105allp | putative La homologue |
| 700256734H1 | g1575127 | 53 | −76 | gb105pln | *Zea mays* lumenal binding protein cBiPe2 mRNA, complete cds. |
| 700261491H1 | g975887 | 61 | −16 | gb105pln | *Mesembryanthemum crystallinum* myo-inositol-1-phosphate synthase mRNA, complete cds. |
| 700260387H2 | g1171351 | 44 | −7 | gb105pln | *Oryza sativa* 16 kDa oleosin (ole16) mRNA, complete cds. |
| 700264471H1 | g563334 | 16 | −14 | gb105pln | *B. napus* (Naehan) bgb1 mRNA for guanine nucleotide regulatory protein. |
| 700268006H1 | g22119 | 62 | −83 | gb105pln | Maize Adh1-F mRNA for alcohol dehydrogenase. |
| 700258888H1 | g687244 | 46 | −80 | gb105pln | *Zea mays* oil body protein 16 kDa oleosin (ole16) gene, complete cds. |
| 700263623H1 | g687244 | 81 | 2 | gb105pln | *Zea mays* oil body protein 16 kDa oleosin (ole16) gene, complete cds. |
| 700266165H1 | g312989 | 11 | 3 | gb105eukp | beta-tubulin |
| 700256831H1 | g971279 | 35 | −7 | gb105pln | Rice mRNA for RAB24 protein, complete cds. |
| 700262339H1 | g168527 | 57 | −65 | gb105pln | Maize NADP-dependent malic enzyme (Me1) mRNA, complete cds. |
| 700262609H1 | g452559 | 22 | −50 | gb105pln | *Zea mays* group 3 Lea protein MGL3 mRNA, complete cds. |
| 700258772H1 | g396209 | 45 | −34 | gb105pln | *S. polyrrhiza* mRNA for D-myo-inositol-3-phosphate synthase. |
| 700258366H1 | g927238 | 38 | −41 | gb105pln | *Zea mays* globulin1 (Glb1) gene, allele Glb1-Hb, complete cds. |
| 700264750H1 | g22281 | 38 | −39 | gb105pln | *Zea mays* Glb1-0 gene for vicilin-like storage protein (truncated). |
| 700258011H1 | g16244 | 31 | −31 | gb105pln | *Arabidopsis thaliana* Csr 1.2 gene for acetolactate synthase (EC 4.1.3.18). |
| 700261864H1 | g2224911 | 24 | 0 | gb105eukp | somatic embryogenesis receptor-like kinase |
| 700262386H1 | g687244 | 96 | −12 | gb105pln | *Zea mays* oil body protein 16 kDa oleosin (ole16) gene, complete cds. |
| 700257286H1 | g398917 | 39 | 14 | gb105pln | *B. napus* cold induced protein (BnC24A) mRNA. |
| 700262831H1 | g1008444 | 20 | −11 | gb105pln | *T. aestivum* mRNA for profilin (clone TaPRO3). |
| 700257094H1 | g22151 | 82 | −48 | gb105pln | *Z. mays* (A188) mRNA for alpha-tubulin 4. |
| 700266217H1 | g950052 | 22 | −23 | gb105pln | *H. vulgare* mRNA for HMG1/2-like protein. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700262749H1 | g687244 | 87 | −46 | gb105pln | *Zea mays* oil body protein 16 kDa oleosin (ole16) gene, complete cds. |
| 700263872H1 | g168512 | 45 | −44 | gb105pln | Maize major protein (L3) mRNA from the surface of lipid bodies, 3' end. |
| 700258017H1 | g1524259 | 29 | −14 | gb105allp | unknown |
| 700258057H1 | g1184991 | 18 | −5 | gb105eukp | NTGB3 |
| 700265655H1 | g172423 | 22 | −8 | gb105pln | Yeast (*Saccharomyces cerevisiae*) ribosomal protein L1 gene, complete cds. |
| 700264260H1 | g1419036 | 16 | −2 | gb105eukp | P5CS-1; delta-1-pyrroline-5-carboxylate synthase |
| 700258895H1 | g167112 | 31 | −32 | gb105pln | *Bromus inermis* aldose reductase-related protein, complete cds. |
| 700257168H1 | g973312 | 13 | 10 | gb105pln | *Arabidopsis thaliana* myo-inositol 1-phosphate synthase isozyme-2 mRNA, complete cds. |
| 700262020H1 | g1171351 | 24 | −7 | gb105pln | *Oryza sativa* 16 kDa oleosin (ole16) mRNA, complete cds. |
| 700266677H1 | g1050429 | 20 | 1 | gb105pln | *A. thaliana* mRNA for U1snRNP-specific protein (U1A). |
| 700263739H1 | g2584785 | 6 | 7 | gb105allp | p64 bovine chloride channel-like protein |
| 700264896H1 | g2440191 | 17 | −12 | gb105eukp | hypothetical protein |
| 700262015H1 | g1928865 | 32 | −22 | gb105pln | *Triticum aestivum* root abundant protein mRNA, complete cds. |
| 700261388H1 | g166379 | 44 | −27 | gb105pln | Alfalfa glucose-regulated endoplasmic reticular protein mRNA, complete cds. |
| 700263960H1 | g1899026 | 27 | −41 | gb105pln | *Zea mays* superoxide dismutase 4A (sod4A) gene, complete cds. |
| 700262373H1 | g474006 | 66 | −44 | gb105pln | Rice mRNA, partial homologous to ribosomal protein S11 gene. |
| 700266137H1 | g2654868 | 18 | −2 | gb105eukp | RbohAp108 |
| 700258687H1 | g2102696 | 14 | −2 | gb105allp | karyopherin beta 3 |
| 700267423H1 | g602605 | 74 | −65 | gb105pln | *Zea mays* tandem genes for alpha1-tubulin and alpha2-tubulin. |
| 700261257H1 | g1928990 | 39 | −38 | gb105pln | *Citrullus lanatus* heat shock protein 70 precursor mRNA, complete cds. |
| 700267626H1 | g435469 | 18 | 4 | gb105pln | Yeast mRNA for ribosomal protein YS3, complete cds. |
| 700265385H1 | g2245037 | 17 | 5 | gb105eukp | nuclear antigen homolog |
| 700257841H1 | g53912 | 14 | 4 | gb105allp | ribosomal protein L7 |
| 700257580H1 | g927238 | 51 | 1 | gb105pln | *Zea mays* globulin1 (Glb1) gene, allele Glb1-Hb, complete cds. |
| 700258072H1 | g347844 | 21 | 9 | gb105pln | *Zea mays* globulin-1 gene, terminator region. |
| 700264844H1 | g2331130 | 21 | 9 | gb105pln | *Oryza sativa* glycine-rich protein (OSGRP1) mRNA, complete cds. |
| 700265768H1 | g558648 | 11 | 4 | gb105eukp | D-myo-inositol-3-phosphate synthase; EC 5.5.1.4 |
| 700263431H1 | g2463334 | 41 | 0 | gb105pln | *Oryza sativa* mRNA for ribosomal protein S4. |
| 700267739H1 | g433215 | 60 | −60 | gb105pln | Rice mRNA for scar protein (gene name SS620), partial cds. |
| 700262774H1 | g167004 | 12 | 2 | gb105allp | embryo globulin |
| 700261568H1 | g168512 | 26 | 14 | gb105pln | Maize major protein (L3) mRNA from the surface of lipid bodies, 3' end. |
| 700258956H1 | g406051 | 19 | −2 | gb105eukp | let1; Let1 |
| 700266020H1 | g1020414 | 42 | −55 | gb105pln | *Oryza sativa* mRNA for phospholipase D, complete cds. |
| 700264221H1 | g22328 | 51 | −32 | gb105pln | Maize mRNA for a high mobility group protein. |
| 700257306H1 | g2425065 | 56 | −20 | gb105pln | *Zea mays* cysteine proteinase Mir3 (mir3) mRNA, complete cds. |
| 700207267H1 | g2244870 | 14 | 2 | gb105pln | *Arabidopsis thaliana* DNA chromosome 4, ESSA I contig fragment No. 3. |
| 700264621H1 | g168423 | 54 | −68 | gb105pln | *Zea mays* polypeptide chain-binding protein mRNA, 3' end. |
| 700265950H1 | g556685 | 22 | −27 | gb105pln | *Z. mays* mRNA for ADP-ribosylation factor. |
| 700266052H1 | g1575129 | 60 | −62 | gb105pln | *Zea mays* lumenal binding protein cBiPe3 mRNA, complete cds. |
| 700265588H1 | g1622938 | 18 | 8 | gb105pln | *Bromus secalinus* oleosin (ole16) mRNA, complete cds. |
| 700264832H1 | g2414643 | 18 | −1 | gb105pln | Yeast (*Saccharomyces pombe*) chromosome I cosmid c3H5. |
| 700264421H1 | g393706 | 25 | −14 | gb105pln | *C. sativus* mRNA for 3-ketoacyl-CoA thiolase. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700258524H1 | g168436 | 91 | −44 | gb105pln | *Zea mays* catalase (Cat3) gene, complete cds. |
| 700262049H1 | g602605 | 31 | −64 | gb105pln | *Zea mays* tandem genes for alpha1-tubulin and alpha2-tubulin. |
| 700257233H1 | g2104532 | 20 | 2 | gb105allp | T10M13.9 |
| 700258824H1 | g452473 | 70 | −77 | gb105pln | *Zea mays* Black Mexican Sweet alpha-tubulin mRNA, complete cds. |
| 700261245H1 | g431266 | 26 | 1 | gb105eukp | UBC4; ubiguitin conjugating enzyme |
| 700261637H1 | g22285 | 51 | −74 | gb105pln | *Zea mays* Glb1-S gene for vicilin-like embryo storage protein. |
| 700266426H1 | g968901 | 46 | −43 | gb105pln | Rice mRNA for ribosomal protein S8, complete cds. |
| 700266129H1 | g2465430 | 11 | −2 | gb105eukp | JRG1.3; 32 kDa protein |
| 700262407H1 | g22284 | 8 | 7 | gb105eukp | Glb1-L; vicilin-like embryo storage protein |
| 700263788H1 | g1513227 | 31 | −29 | gb105pln | *Brassica napus* myo-inositol 1-phosphate synthase mRNA, complete cds. |
| 700261612H1 | g536895 | 40 | −26 | gb105pln | Wheat mRNA for protein H2A, complete cds, clone wcH2A-10. |
| 700258676H1 | g1066162 | 33 | −26 | gb105pln | *B. napus* mRNA for glyoxysomal beta-ketoacyl-thiolase precursor. |
| 700259481H1 | g166687 | 23 | 15 | gb105pln | *A. thaliana* 3-deoxy-D-arabino-heptulosonate y-phosphate synthase (DHS1) mRNA, complete cds. |
| 700264491H1 | g168442 | 62 | −29 | gb105pln | *Zea mays* chitinase B (seed chitinase) gene, 3'end. |
| 700266254H1 | g1155212 | 31 | −34 | gb105pln | *Avena fatua* aldose reductase-related protein mRNA, complete cds. |
| 700266864H1 | g998429 | 46 | −52 | gb105pln | GRF1 = general regulatory factor [*Zea mays*, XL80, Genomic, 5348 nt]. |
| 700256833H1 | g1694832 | 30 | −29 | gb105pln | *H. vulgare* Per1 gene. |
| 700258572H1 | g1711036 | 52 | 1 | gb105allp | hydroxyproline rich glycoprotein PsHRGP1 |
| 700265211H1 | g2827650 | 18 | −1 | gb105eukp | F18F4.60; potassium transporter-like protein |
| 700267138H1 | g2656031 | 27 | 1 | gb105pln | *Arabidopsis thaliana* genomic DNA, chromosome 5, P1 clone: MXC20. |
| 700266960H1 | g558649 | 20 | −18 | gb105pln | *T. aestivum* VDAC2 mRNA for voltage dependent anion channel. |
| 700259204H1 | g2191144 | 38 | −10 | gb105eukp | A_IG002N01.24 |
| 700258262H1 | g402552 | 25 | 5 | gb105allp | ketol-acid reductoisomerase |
| 700259062H1 | g1724111 | 19 | 6 | gb105pln | *Triticum aestivum* ABA induced plasma membrane protein PM-19 (WTABAPM) mRNA, complete cds. |
| 700261852H1 | g2511540 | 48 | −18 | gb105pln | *Oryza sativa* DNA-binding protein GBP16 (Rgbp16) mRNA, complete cds. |
| 700264350H1 | g171830 | 13 | 1 | gb105eukp | LCB1; required for biosynthesis of the long-chain base component of sphingolipids; serine palmitoyltransferase; EC 2.3.1.50 |
| 700261328H1 | g2276199 | 31 | −10 | gb105eukp | T04A11.6 |
| 700262606H1 | g2623294 | 34 | −30 | gb105pln | *Arabidopsis thaliana* chromosome II BAC T20B5 genomic sequence, complete sequence. |
| 700257176H1 | g2331300 | 47 | −77 | gb105pln | *Zea mays* ribosomal protein S4 type I (rps4) mRNA, complete cds. |
| 700257094H1 | g2511530 | 52 | −48 | gb105pln | *Eleusine indica* alpha tubulin 1 (TUA1) mRNA, complete cds. |
| 700259377H1 | g168406 | 46 | −78 | gb105pln | *Z. mays* alcohol dehydrogenase (ADH-1 C-m allele) gene, complete cds. |
| 700265572H1 | g2239209 | 9 | 1 | gb105eukp | SPAC19G12.16c; hypothetical protein |
| 700258380H1 | g544506 | 36 | −10 | gb105eukp | SIK1; Sik1p |
| 700261919H1 | g1129084 | 22 | −24 | gb105pln | Wheat mRNA for protein H2A, complete cds, clone wcH2A-3. |
| 700265991H1 | g2281102 | 8 | 8 | gb105eukp | F18O19.21; SF16 isolog |
| 700265413H1 | g19289 | 24 | 6 | gb105allp | pectin esterase precursor (AA −57 to 332) |
| 700256923H1 | g602252 | 22 | 8 | gb105pln | *Zea mays* enolase (eno2) mRNA, complete cds. |
| 700261852H1 | g1657616 | 21 | 10 | gb105pln | *Arabidopsis thaliana* putative nuclear DNA-binding protein G2p (AtG2) mRNA, complete cds. |
| 700265255H1 | g1928865 | 34 | −15 | gb105pln | *Triticum aestivum* root abundant protein mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700256789H1 | g1658312 | 41 | −53 | gb105pln | *O. sativa* osr40g2 gene. |
| 700265242H1 | g1296954 | 50 | −17 | gb105pln | *O. sativa* mRNA for novel protein, osr40c1. |
| 700267728H1 | g168508 | 39 | −11 | gb105pln | Maize oleosin KD18 (KD18; L2) gene, complete cds. |
| 700257583H1 | g1381153 | 13 | 12 | gb105pln | *Triticum aestivum* actin-binding protein WCOR719 (Wcor719) mRNA, complete cds. |
| 700265611H1 | g1532072 | 38 | −11 | gb105pln | *Z. mays* mRNA for S-adenosylmethionine decarboxylase. |
| 700266775H1 | g2632274 | 11 | 7 | gb105allp | DNA gyrase (subunit A) |
| 700257792H1 | g457708 | 34 | −11 | gb105pln | *S. oleracea* mRNA for protein kinase. |
| 700262609H1 | g444044 | 22 | −50 | gb105pln | *Z. mays* mRNA for group 3 Lea protein MGL3. |
| 700267249H1 | g1196896 | 48 | −42 | gb105pln | Glycine max acidic ribosomal protein P0 mRNA, complete cds. |
| 700263918H1 | g2739365 | 26 | −6 | gb105eukp | T9J22.7 |
| 700264665H1 | g22283 | 59 | −80 | gb105pln | *Zea mays* Glb1-L gene for vicilin-like embryo storage protein. |
| 700267794H1 | g971279 | 56 | −50 | gb105pln | Rice mRNA for RAB24 protein, complete cds. |
| 700257292H1 | g471320 | 47 | 14 | gb105pln | *H. vulgare* (cv. Bomi) B15C mRNA. |
| 700258785H1 | g687246 | 23 | −13 | gb105pln | *Zea mays* oil body protein 17 kDa oleosin (ole17) gene, complete cds. |
| 700260386R2 | g1155213 | 32 | 6 | gb105eukp | aldose reductase-related protein; EC 1.1.1.21 |
| 700207128H1 | g1143392 | 45 | 2 | gb105allp | uridine diphosphate glucose epimerase |
| 700264878H1 | g1129085 | 41 | −25 | gb105pln | Wheat mRNA for protein H2A, complete cds, clone wcR2A-9. |
| 700262906H1 | g790977 | 42 | −30 | gb105pln | *B. juncea* msams mRNA. |
| 700264022H1 | g391878 | 38 | −2 | gb105pln | Rice mRNA for adenylate kinase. |
| 700266747H1 | g168608 | 98 | −11 | gb105pln | Maize 17S ribosomal RNA gene and flanks. |
| 700263716H1 | g514945 | 80 | −56 | gb105pln | *Zea mays* sucrose synthase (Sus1) mRNA, complete cds. |
| 700262301H1 | g166422 | 28 | 4 | gb105allp | ubiquitin carrier protein |
| 700264883H1 | g1171351 | 30 | −9 | gb105pln | *Oryza sativa* 16 kDa oleosin (ole16) mRNA, complete cds. |
| 700266535H1 | g297175 | 13 | 14 | gb105pln | *S. longipes* mRNA of ORF. |
| 700266994H1 | g1403043 | 17 | 16 | gb105pln | *H. chilense* × *T. turgidum* conv. durum (Tritordeum) mRNA for S-adenosylmethionine decarboxylase. |
| 700264262H1 | g1694832 | 35 | −52 | gb105pln | *H. vulgare* Per1 gene. |
| 700266291H1 | g2662342 | 77 | −74 | gb105pln | *Oryza sativa* mRNA for EF-1 alpha, complete cds. |
| 700264248H1 | g2194132 | 31 | −20 | gb105eukp | F20P5.21 |
| 70a262884H1 | g2832681 | 41 | −2 | gb105eukp | T10I14.140; putative protein |
| 700259351H1 | g1542941 | 15 | 6 | gb105eukp | AACT; Acetoacetyl-coenzyme A thiolase; EC 2.3.1.9 |
| 700262045H1 | g1532047 | 16 | 16 | gb105pln | *O. sativa* mRNA for S-adenosylmethionine decarboxylase. |
| 700264631H1 | g18888 | 59 | −52 | gb105pln | *H. vulgare* agpp mRNA for ADP-glucose pyrophosphorylase large subunit. |
| 700258584H1 | g537445 | 39 | −33 | gb105pln | *Arabidopsis thaliana* heat shock protein AtHSP101 (Athsp101) mRNA, complete cds. |
| 700260553H2 | g2246624 | 41 | −10 | gb105pln | *Oryza sativa* protein kinase mRNA, complete cds. |
| 700263184H1 | g2702365 | 31 | −10 | gb105eukp | T07A9.9 |
| 700268085H1 | g168541 | 29 | 9 | gb105pln | *Zea mays* putative proteolipid subunit of vacuolar H+ ATPase mRNA, partial cds. |
| 700262163H1 | g575730 | 56 | −57 | gb105pln | *Z. mays* mRNA for transmembrane protein. |
| 700266044H1 | g22275 | 29 | −56 | gb105pln | Maize mRNA for ferritin (clone FM1). |
| 700266646H1 | g22281 | 81 | −54 | gb105pln | *Zea mays* Glb1-0 gene for vicilin-like storage protein (truncated). |
| 700262112H1 | g471320 | 19 | −39 | gb105pln | *H. vulgare* (cv. Bomi) B15C mRNA. |
| 700266865H1 | g21834 | 70 | −41 | gb105pln | Wheat mRNA for cytosolic phosphoglycerate kinase (EC 2.7.2.3). |
| 700256706H1 | g431263 | 21 | 3 | gb105pln | *Arabidopsis thaliana* 16 kDa |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | ubiquitin conjugating enzyme (UBC2) gene, complete cds. |
| 700258034H1 | g687244 | 53 | −78 | gb105pln | *Zea mays* oil body protein 16 kDa oleosin (ole16) gene, complete cds. |
| 700259355H1 | g927239 | 7 | 7 | gb105allp | globulin1 |
| 700264719H1 | g2246624 | 17 | 8 | gb105pln | *Oryza sativa* protein kinase mRNA, complete cds. |
| 700258169H1 | g22328 | 58 | −48 | gb105pln | Maize mRNA for a high mobility group protein. |
| 700262062H1 | g2058281 | 18 | 7 | gb105pln | *A. thaliana* mRNA for AtRanBPia protein. |
| 700265477H1 | g1652223 | 15 | −3 | gb105allp | ABC1-like |
| 700262550H1 | g1519359 | 22 | −15 | gb105eukp | RP49; ribosomal protein 49 |
| 700258768H1 | g2459406 | 31 | −36 | gb105pln | *Arabidopsis thaliana* chromosome II BAC F4P9 genomic sequence, complete sequence. |
| 700257337H1 | g21832 | 22 | 12 | gb105pln | Wheat mRNA for chloroplast phosphoglycerate kinase (EC 2.7.2.3). |
| 700258553H1 | g22281 | 46 | −71 | gb105pln | *Zea mays* Glb1-0 gene for vicilin-like storage protein (truncated). |
| 700264351H1 | g167064 | 32 | −33 | gb105pln | *Hordeum vulgare* beta-ketoacyl-ACP synthase I (Kas12) mRNA, complete cds. |
| 700259702H1 | g218365 | 13 | 9 | gb105pln | Yeast (*Candida tropicalis*) CTPACTA gene for acetoacetyl-CoA thiolase A. |
| 700268127H1 | g1724111 | 26 | −1 | gb105pln | *Triticum aestivum* ABA induced plasma membrane protein PM-19 (WTABAPM) mRNA, complete cds. |
| 700267911H1 | g168406 | 45 | −82 | gb105pln | *Z. mays* alcohol dehydrogenase (ADH-1 C-m allele) gene, complete cds. |
| 700267788H1 | g22281 | 53 | 8 | gb105pln | *Zea mays* Glb1-0 gene for vicilin-like storage protein (truncated). |
| 700262486H1 | g404165 | 33 | −18 | gb105pln | *A. thaliana* gene for BBC1 protein. |
| 700266213H1 | g168406 | 42 | −82 | gb105pln | *Z. mays* alcohol dehydrogenase (ADH-1 C-m allele) gene, complete cds. |
| 700257503H1 | g1354466 | 35 | 0 | gb105eukp | U1 snRNP 70K truncated protein |
| 700258768H1 | g218088 | 50 | −70 | gb105pln | Rice mRNA for ribosomal protein 117 (249 gene), partial sequence. |
| 700265945H1 | g22281 | 54 | −7 | gb105pln | *Zea mays* Glb1-0 gene for vicilin-like storage protein (truncated). |
| 700258556H1 | g1420040 | 9 | 6 | gb105eukp | ORF YOL142w |
| 700261121H1 | g1513227 | 17 | 7 | gb105pln | *Brassica napus* myo-inositol 1-phosphate synthase mRNA, complete cds. |
| 700263754H1 | g1171347 | 18 | 11 | gb105pln | *Triticum aestivum* pMA1951 mRNA, partial cds. |
| 700264781H1 | g1183936 | 15 | 3 | gb105pln | *P. sativum* 5S rRNA gene. |
| 700265221H1 | g22283 | 71 | 0 | gb105pln | *Zea mays* Glb1-L gene for vicilin-like embryo storage protein. |
| 700263420H1 | g2612940 | 27 | −6 | gb105pln | *Oryza sativa* CLA1 transketolase-like protein (CLA1) mRNA, nuclear gene encoding putative chloroplast protein, partial cds. |
| 700265916H1 | g1488038 | 14 | −10 | gb105eukp | tpsB; trehalose-6-phosphate synthase |
| 700264555H1 | g2735007 | 68 | −85 | gb105pln | *Zea mays* kinase associated protein phosphatase (KAPP) mRNA, complete cds. |
| 700266129H1 | g2465426 | 11 | −2 | gb105eukp | JRG1.1; 32 kDa protein |
| 700262975H1 | g1694832 | 38 | −41 | gb105pln | *H. vulgare* Per1 gene. |
| 700266363H1 | g22283 | 54 | −83 | gb105pln | *Zea mays* Glb1-L gene for vicilin-like embryo storage protein. |
| 700264023H1 | g296130 | 50 | −15 | gb105pln | *P. patens* gapC1 mRNA. |
| 700264158H1 | g2582664 | 37 | −5 | gb105pln | *C. sinensis* thi mRNA. |
| 700265731H1 | g1136119 | 83 | −13 | gb105pln | *O. sativa* mRNA for alpha-tubulin (clone OSTA-111). |
| 700266337H1 | g488779 | 55 | −48 | gb105pln | *T. aestivum* mRNA for isomerase. |
| 700264308H1 | g471320 | 28 | −27 | gb105pln | *H. vulgare* (cv. Bomi) B15C mRNA. |
| 700259308H1 | g464136 | 29 | −24 | gb105pln | *Arabidopsis thaliana* mRNA for ATMPK1, complete cds. |
| 700263756H1 | g18890 | 41 | −30 | gb105pln | *H. vulgare* gene for aldose reductase-related protein. |
| 700267263H1 | g469069 | 4 | 7 | gb105allp | NMDA receptor subunit NR2D |
| 700263750H1 | g1144535 | 59 | −62 | gb105pln | *Zea mays* opaque-2 heterodimerizing protein 1b (ohp1b) mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264120H1 | g1155212 | 41 | −10 | gb105pln | *Avena fatua* aldose reductase-related protein mRNA, complete cds. |
| 700266025H1 | g1053058 | 34 | −32 | gb105pln | *Triticum aestivum* histone H3 gene, partial cds, clone W2. |
| 700257947H1 | g216854 | 7 | 1 | gb105allp | P47K |
| 700259173H2 | g1065686 | 12 | −5 | gb105eukp | C05E7.5 |
| 700265114H1 | g644491 | 99 | −86 | gb105pln | Corn mRNA for elongation factor 1A. |
| 700263101H1 | g295737 | 48 | 5 | gb105allp | V14 gene product |
| 700261544H1 | g899607 | 80 | −33 | gb105pln | *Zea mays* polyubiquitin (MubC5) mRNA, complete cds. |
| 700265469H1 | g556685 | 59 | −47 | gb105pln | *Z. mays* mRNA for ADP-ribosylation factor. |
| 700259020H1 | g1255711 | 27 | −0 | gb105eukp | RNU1; small nuclear ribonucleoprotein |
| 700207184H1 | g443591 | 37 | −1 | gb105eukp | rpl19; bind calmodulin; ribosomal protein; v14 gene |
| 700258339H1 | g1125690 | 31 | −2 | gb105pln | *S. tuberosum* mRNA for DnaJ protein. |
| 700263603H1 | g577735 | 99 | −0 | gb105eukp | PRL1 |
| 700265463H1 | g2462837 | 40 | −17 | gb105eukp | F19G10.17 |
| 700262540H1 | g2160155 | 18 | 7 | gb105pln | Sequence of BAC F21M12 from *Arabidopsis thaliana* chromosome 1, complete sequence. |
| 700257189H1 | g596077 | 41 | 6 | gb105pln | *Zea mays* thiamine biosynthetic enzyme (thi1-1) mRNA, complete cds. |
| 700262129H1 | g1532072 | 50 | −43 | gb105pln | *Z. mays* mRNA for S-adenosylmethionine decarboxylase. |
| 700265643H1 | g971283 | 64 | −62 | gb105pln | Rice mRNA for ribosomal protein S31, complete cds. |
| 700267476H1 | g927238 | 32 | −43 | gb105pln | *Zea mays* globulin1 (Glb1) gene, allele Glb1-Hb, complete cds. |
| 700259656H1 | g16210 | 28 | −20 | gb105pln | *Arabidopsis thaliana* calnexin homolog. |
| 700258503H1 | g22281 | 47 | −79 | gb105pln | *Zea mays* Glb1-0 gene for vicilin-like storage protein (truncated). |
| 700257521H1 | g2463334 | 58 | 2 | gb105pln | *Oryza sativa* mRNA for ribosomal protein S4. |
| 700267953H1 | g1171351 | 51 | −12 | gb105pln | *Oryza sativa* 16 kDa oleosin (ole16) mRNA, complete cds. |
| 700257650H1 | g1945277 | 30 | −27 | gb105eukp | branched chain alpha-keto acid dehydrogenase E1-alpha subunit; EC 1.2.4.4 |
| 700262689H1 | g2511530 | 52 | −18 | gb105pln | *Eleusine indica* alpha tubulin 1 (TUA1) mRNA, complete cds. |
| 700264887H1 | g2463334 | 57 | −47 | gb105pln | *Oryza sativa* mRNA for ribosomal protein S4. |
| 700263952H1 | g22121 | 77 | −16 | gb105pln | Maize alcohol dehydrogenase 1 gene (Adh1-1F). |
| 700267885H1 | g2791498 | 24 | 5 | gb105allp | putative transferase |
| 700258291H1 | g927239 | 16 | −6 | gb105eukp | Glb1; globulin1 |
| 700265374H1 | g556685 | 22 | 4 | gb105pln | *Z. mays* mRNA for ADP-ribosylation factor. |
| 700266953H1 | g16210 | 33 | −8 | gb105pln | *Arabidopsis thaliana* calnexin homolog. |
| 700265581H1 | g1491615 | 20 | 0 | gb105eukp | male sterility 2-like protein |
| 700258329H1 | g1171351 | 26 | −13 | gb105pln | *Oryza sativa* 16 kDa oleosin (ole16) mRNA, complete cds. |
| 700267278H1 | g168480 | 57 | −56 | gb105pln | Maize embryo globulin S allele (7S-like) mRNA, complete cds. |
| 700264507H1 | g1171351 | 21 | −6 | gb105pln | *Oryza sativa* 16 kDa oleosin (ole16) mRNA, complete cds. |
| 700257078H1 | g836954 | 17 | −10 | gb105eukp | IRK1; receptor protein kinase |
| 700264861H1 | g2114363 | 21 | −5 | gb105allp | similar to mouse Int-6 |
| 700256738H1 | g22461 | 15 | 3 | gb105pln | Maize RAB-17 gene. |
| 700261232H1 | g973313 | 16 | −1 | gb105eukp | myo-inositol 1-phosphate synthase isozyme-2 |
| 700263921H1 | g1218003 | 33 | −2 | gb105pln | *Glycine max* dynamin-like protein SDL5A mRNA, complete cds. |
| 700267447H1 | g1360147 | 38 | −18 | gb105eukp | NBP35; nucleotide-binding protein of 35 kD |
| 700266568H1 | g687244 | 50 | −87 | gb105pln | *Zea mays* oil body protein 16 kDa oleosin (ole16) gene, complete cds. |
| 700266513H1 | g22287 | 7 | 7 | gb105eukp | Glb1-S; vicilin-like embryo storage protein |
| 700264475H1 | g2668745 | 98 | −57 | gb105pln | *Zea mays* inorganic pyrophosphatase (IPP) mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700265548H1 | g506138 | 64 | −55 | gb105pln | *Zea mays* Ec metallothionein class II protein mRNA, complete cds. |
| 700266954H1 | g2829911 | 26 | −13 | gb105eukp | F22K20.10 |
| 700267918H1 | g2529249 | 26 | 3 | gb105eukp | rpb10; RNA polymerase II subunit Rpb10; EC 2.7.7.6 |
| 700265546H1 | g2191182 | 11 | 8 | gb105eukp | A_TM021B04.2 |
| 700258985H1 | g2150027 | 15 | 0 | gb105eukp | LeME1; NADP-malic enzyme; EC 1.1.1.40 |
| 700265586H1 | g18259 | 37 | −22 | gb105pln | *C. sativus* mRNA for cs DnaJ-1. |
| 700258606H1 | g169820 | 42 | −36 | gb105pln | *Oryza sativa* triosephosphate isomerase (Rictpi) mRNA, complete cds. |
| 700263085H1 | g248338 | 74 | −36 | gb105pln | polyubiquitin [maize, Genomic, 3439 nt]. |
| 700265528H1 | g5056 | 29 | −5 | gb105pln | Yeast (*Saccharomyces pombe*) rpgL29 gene for ribosomal protein L29. |
| 700268183H1 | g2564051 | 39 | −13 | gb105pln | *Arabidopsis thaliana* genomic DNA, chromosome 5, P1 clone: MWD9, complete sequence. |
| 700267631H1 | g1184771 | 73 | −64 | gb105pln | *Zea mays* glyceraldehyde-3-phosphate dehydrogenase GAPC2 (gpc2) mRNA, complete cds. |
| 700264312H1 | g168602 | 56 | −57 | gb105pln | *Zea mays* regulatory protein GF14-12 mRNA, complete cds. |
| 700261655H1 | g687244 | 49 | −75 | gb105pln | *Zea mays* oil body protein 16 kDa oleosin (ole16) gene, complete cds. |
| 700257574H1 | g556559 | 45 | −26 | gb105pln | Rice mRNA for homologue of Tat binding protein, complete cds. |
| 700262314H1 | g2695678 | 42 | −37 | gb105pln | *Spinacia oleracea* heat shock 70 protein (HSC70-11) mRNA, nuclear gene encoding mitochondrial protein, complete cds. |
| 700265039H1 | g927239 | 6 | 6 | gb105allp | globulin1 |
| 700207196H1 | g22119 | 93 | −80 | gb105pln | Maize Adh1-F mRNA for alcohol dehydrogenase. |
| 700264301H1 | g21834 | 53 | −50 | gb105pln | Wheat mRNA for cytosolic phosphoglycerate kinase (EC 2.7.2.3). |
| 700266949H1 | g22285 | 73 | −39 | gb105pln | *Zea mays* Glb1-S gene for vicilin-like embryo storage protein. |
| 700256933H1 | g22393 | 16 | −5 | gb105pln | *Z. mays* RNA for pyruvat decarboxylase. |
| 700256892H1 | g2599103 | 18 | 4 | gb105pln | *Dunaliella salina* 60S ribosomal protein (DSRP1) mRNA, complete cds. |
| 700261635H1 | g2431770 | 15 | 10 | gb105pln | *Zea mays* acidic ribosomal protein P2b (rpp2b) mRNA, complete cds. |
| 700261696H1 | g287398 | 12 | −2 | gb105pln | Rice mRNA for a protein related to chilling tolerance. |
| 700262068H1 | g687244 | 44 | −81 | gb105pln | *Zea mays* oil body protein 16 kDa oleosin (ole16) gene, complete cds. |
| 700263876H1 | g20163 | 42 | −32 | gb105pln | *O. sativa* Rr15 mRNA for 5S ribosomal RNA. |
| 700207270H1 | g2829211 | 20 | 7 | gb105pln | *Oryza sativa* proteinase inhibitor (Rgpi9) gene, complete cds. |
| 700258292H1 | g1321686 | 12 | −3 | gb105eukp | lrrpk; light repressible receptor protein kinase |
| 700264428H1 | g168481 | 7 | 8 | gb105allp | globulin precursor |
| 700257879H1 | g687244 | 85 | −48 | gb105pln | *Zea mays* oil body protein 16 kDa oleosin (ole16) gene, complete cds. |
| 700261639H1 | g1770020 | 52 | −37 | gb105pln | *Oryza sativa* S-adenosyl-L-methionine synthetase (pOS-SAMS2) mRNA, complete cds. |
| 700264847H1 | g2267592 | 36 | −18 | gb105pln | *Oryza sativa* glycine-rich RNA-binding protein mRNA, complete cds. |
| 700262936H1 | g625147 | 58 | −74 | gb105pln | *Zea mays* protein disulfide isomerase (pdi) mRNA, complete cds. |
| 700263917H1 | g695362 | 11 | −5 | gb105allp | X-associated protein 1 |
| 700261832H1 | g22270 | 95 | −18 | gb105pln | Maize mRNA from an embryogenic abscisic acid-inducible gene. |
| 700267666H1 | g2102657 | 25 | −9 | gb105eukp | unnamed protein product |
| 700268030H1 | g2760173 | 17 | −13 | gb105pln | *Arabidopsis thaliana* genomic DNA, chromosome 5, P1 clone: MYH19, complete sequence. |
| 700207167H1 | g2370231 | 34 | 1 | gb105pln | *Hordeum vulgare* mRNA for putative acyl-CoA oxidase. |
| 700267447H1 | g763343 | 27 | −10 | gb105eukp | unknown |
| 700266985H1 | g644491 | 77 | −71 | gb105pln | Corn mRNA for elongation factor 1A. |
| 700256858H1 | g2624211 | 58 | −52 | gb105pln | *M. acuminata* mRNA; clone pBAN |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | UU131. |
| 700261626H1 | g168481 | 8 | 7 | gb105allp | globulin precursor |
| 700261662H1 | g167112 | 35 | −18 | gb105pln | *Bromus inermis* aldose reductase-related protein, complete cds. |
| 700264263H1 | g2425065 | 22 | −6 | gb105pln | *Zea mays* cysteine proteinase Mir3 (mir3) mRNA, complete cds. |
| 700257818H1 | g506138 | 59 | −26 | gb105pln | *Zea mays* Ec metallothionein class II protein mRNA, complete cds. |
| 700266078H1 | g2058281 | 18 | 10 | gb105pln | *A. thaliana* mRNA for AtRanBP1a protein. |
| 700258263H1 | g168512 | 34 | −28 | gb105pln | Maize major protein (L3) mRNA from the surface of lipid bodies, 3' end. |
| 700260334H2 | g19103 | 30 | −18 | gb105pln | *H. vulgare* mRNA for ribosomal protein L17-2. |
| 700268110H1 | g2828188 | 22 | −2 | gb105pln | *Arabidopsis thaliana* genomic DNA, chromosome 5, TAC clone: K3I3, complete sequence. |
| 700267928H1 | g2262102 | 17 | −7 | gb105eukp | T19F06.5 |
| 700267890H1 | g1550813 | 47 | −68 | gb105pln | *Z. mays* mRNA for acidic ribosomal protein P0. |
| 700267332H1 | g2760170 | 10 | 16 | gb105pln | *Arabidopsis thaliana* genomic DNA, chromosome 5, P1 clone: MIO24, complete sequence. |
| 700256706H1 | g431259 | 20 | 4 | gb105pln | *Arabidopsis thaliana* 16 kDa ubiquitin conjugating enzyme (UBC1) gene, complete cds. |
| 700258051H1 | g506138 | 65 | −57 | gb105pln | *Zea mays* Ec metallothionein class II protein mRNA, complete cds. |
| 700262429H1 | g18890 | 41 | −26 | gb105pln | *H. vulgare* gene for aldose reductase-related protein. |
| 700257292H1 | g971279 | 47 | 14 | gb105pln | Rice mRNA for RAB24 protein, complete cds. |
| 700264242H1 | g1944132 | 14 | 1 | gb105eukp | CUC2 |
| 700264314H1 | g2505874 | 8 | −2 | gb105eukp | putative kinase |
| 700265083H1 | g1711205 | 34 | −15 | gb105eukp | IAA23; IAA23 |
| 700257094H1 | g602605 | 36 | −52 | gb105pln | *Zea mays* tandem genes for alpha1-tubulin and alpha2-tubulin. |
| 700258261H1 | g975887 | 45 | −39 | gb105pln | *Mesembryanthemum crystallinum* myo-inositol-1-phosphate synthase mRNA, complete cds. |
| 700265928H1 | g312258 | 15 | −12 | gb105eukp | PUP2 |
| 700257522H1 | g1100216 | 85 | −29 | gb105pln | *Zea mays* sucrose synthase (SUS1) gene, exons 1–2. |
| 700257403H2 | g2182285 | 10 | 15 | gb105pln | Sequence of BAC F5I14 from *Arabidopsis thaliana* chromosome 1, complete sequence. |
| 700260407H1 | g295667 | 6 | 5 | gb105allp | zinc finger protein |
| 700261862H1 | g927238 | 81 | 4 | gb105pln | *Zea mays* globulin1 (Glb1) gene, allele Glb1-Hb, complete cds. |
| 700262272H1 | g2369713 | 28 | −13 | gb105pln | *Beta vulgaris* cDNA for elongation factor 2. |
| 700261516H1 | g1498596 | 26 | 17 | gb105pln | *Zea mays* phospholipid transfer protein mRNA, complete cds. |
| 700261308H1 | g1805654 | 19 | 1 | gb105allp | calmodulin-stimulated calcium-ATPase |
| 700263251H1 | g596079 | 40 | −59 | gb105pln | *Zea mays* thiamine biosynthetic enzyme (thi1-2) mRNA, complete cds. |
| 700267263H1 | g2160438 | 4 | 7 | gb105allp | glutamate receptor channel subunit epsilon 4 |
| 700257965H1 | g861204 | 12 | 14 | gb105pln | *Chlamydomonas reinhardtii* ADP-ribosylation factor (ARF) mRNA, complete cds. |
| 700258528H1 | g1143499 | 32 | −12 | gb105pln | *H. vulgare* mRNA for ADP-glucose pyrophosphorylase small subunit. |
| 700259368H1 | g2055372 | 19 | −41 | gb105pln | *Triticum aestivum* serine-threonine protein kinase (TaPK3) gene, exons 3 through 9 and complete cds. |
| 700267248H1 | g2330650 | 32 | −16 | gb105pln | *Pisum sativum* mRNA for topoisomerase II. |
| 700258008H1 | g426441 | 35 | −17 | gb105pln | Rice mRNA for thioredoxin h, complete cds. |
| 700261639H1 | g790977 | 39 | −23 | gb105pln | *B. juncea* msams mRNA. |
| 700264440H1 | g22287 | 8 | 6 | gb105allp | vicilin-like embryo storage protein |
| 700257653H1 | g2511530 | 52 | −50 | gb105pln | *Eleusine indica* alpha tubulin 1 (TUA1) mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700262913H1 | g1491929 | 11 | −2 | gb105eukp | fksA; glucan synthesis; 1,3-beta-D-glucan synthase catalytic subunit |
| 700261936H1 | g642168 | 59 | 2 | gb105pln | *C. apiifolia* 28S rRNA gene (partial). |
| 700268164H1 | g1037164 | 10 | 3 | gb105allp | 26S proteasome subunit p31 |
| 700256737H1 | g170107 | 14 | 3 | gb105eukp | CPN10; chaperonin 10 |
| 700263103H1 | g2641618 | 14 | 9 | gb105pln | *Zea mays* ubiquitin-conjugating enzyme protein E2 (ubc7) mRNA, complete cds. |
| 700264335H1 | g454913 | 19 | 5 | gb105pln | *A. porrum* LDJ2 mRNA. |
| 700264909H1 | g312257 | 22 | −4 | gb105pln | Yeast (*Saccharomyces cerevisiae*) PUP2 gene. |
| 700264320H1 | g168498 | 79 | −63 | gb105pln | Corn histone H4 (H4C13) gene, complete cds. |
| 700264776H1 | g22283 | 30 | −53 | gb105pln | *Zea mays* Glb1-L gene for vicilin-like embryo storage protein. |
| 700265086H1 | g452559 | 38 | −71 | gb105pln | *Zea mays* group 3 Lea protein MGL3 mRNA, complete cds. |
| 700258875H1 | g21142 | 22 | −10 | gb105pln | Mustard mRNA for cytosolic glyceraldehyde-3-phosphate dehydrogenase (GAPDH, NAD-specific; EC 1.2.1.12). |
| 700264017H1 | g2459435 | 31 | −3 | gb105eukp | F4P9.30; putative serine carboxypeptidase |
| 700266826H1 | g687244 | 64 | −55 | gb105pln | *Zea mays* oil body protein 16 kDa oleosin (ole16) gene, complete cds. |
| 700266721H1 | g1895083 | 87 | −89 | gb105pln | *Zea mays* golgi associated protein se-wap41 mRNA, complete cds. |
| 700258779H1 | g1532047 | 16 | 15 | gb105pln | *O. sativa* mRNA for S-adenosylmethionine decarboxylase. |
| 700267233H1 | g2264311 | 18 | 6 | gb105pln | *Arabidopsis thaliana* genomic DNA, chromosome 5, P1 clone: MLN1, complete sequence. |
| 700267531H1 | g2641200 | 22 | 14 | gb105pln | *Fritillaria agrestis* ribosomal protein L23a (rpl23a) mRNA, complete cds. |
| 700267206H1 | g575916 | 23 | 6 | gb105eukp | SUP46; controls fidelity of translation; ribosomal protein S13; YBR1317 |
| 700262103H1 | g485376 | 56 | −71 | gb105pln | *Zea mays* alpha-3-tubulin gene, complete cds. |
| 700264088H1 | g577219 | 4 | 8 | gb105eukp | UBC12; Ubc12p: ubiquitin-conjugating enzyme |
| 700265492H1 | g1403043 | 23 | −22 | gb105pln | *H. chilense* × *T. turgidum* conv. durum (Tritordeum) mRNA for S-adenosylmethionine decarboxylase. |
| 700266506H1 | g1632830 | 25 | 3 | gb105pln | *R. communis* mRNA (unknown). |
| 700265193H1 | g470126 | 36 | −24 | gb105pln | *N. tabacum* (cv. Samsun NN) L19 mRNA for ribosomal protein L19. |
| 700265493H1 | g286238 | 5 | 7 | gb105allp | N-methyl-D-aspartate receptor subunit |
| 700264422H1 | g1789673 | 24 | −11 | gb105allp | o256 |
| 700262027H1 | g396209 | 55 | −44 | gb105pln | *S. polyrrhiza* mRNA for D-myo-inositol-3-phosphate synthase. |
| 700267060H1 | g22121 | 38 | −77 | gb105pln | Maize alcohol dehydrogenase 1 gene (Adh1-1F). |
| 700207120H1 | g2706449 | 15 | 12 | gb105pln | *Solanum tuberosum* mRNA for magnesium dependent soluble inorganic pyrophosphatase. |
| 700264308H1 | g971279 | 24 | −24 | gb105pln | Rice mRNA for RAB24 protein, complete cds. |
| 700264466H1 | g1914685 | 37 | −14 | gb105eukp | assembly factor of the complex for nucleotide excision repair of V-damaged DNA; RAD23 protein, isoform II |
| 700264093H1 | g168480 | 47 | −25 | gb105pln | Maize embryo globulin S allele (7S-like) mRNA, complete cds. |
| 700265205H1 | g158191 | 13 | 6 | gb105eukp | pum; pumilio protein |
| 700262914H1 | g428999 | 30 | −44 | gb105pln | Rice mRNA for ribosomal protein L18a (gene name SS128), partial cds. |
| 700267070H1 | g1171351 | 31 | −19 | gb105pln | *Oryza sativa* 16 kDa oleosin (ole16) mRNA, complete cds. |
| 700258709H1 | g168608 | 95 | −94 | gb105pln | Maize 17S ribosomal RNA gene and flanks. |
| 700267184H1 | g2739325 | 17 | 6 | gb105allp | NAP57 |
| 700260157H1 | g22284 | 7 | 6 | gb105allp | vicilin-like embryo storage protein |
| 700262976H1 | g1335965 | 88 | −64 | gb105pln | *Zea mays* acetyl CoA carboxylase mRNA, partial cds. |
| 700266662H1 | g2645163 | 49 | −21 | gb105pln | *Oryza sativa* mRNA, similar to ribosomal protein L26. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700265581H1 | g2297091 | 12 | 4 | gb105allp | unnamed protein product |
| 700267348H1 | g1592681 | 8 | 5 | gb105eukp | LEA D113 homologue type2 |
| 700262667H1 | g21583 | 16 | 3 | gb105eukp | threonine dehydratase; EC 4.2.1.16 |
| 700264395H1 | g453872 | 15 | 2 | gb105allp | LEA D34 homolog |
| 700263911H1 | g1132482 | 40 | −42 | gb105pln | Rice mPNA for ADP-ribosylation factor, complete cds. |
| 700259062H1 | g1724112 | 22 | 3 | gb105allp | ABA induced plasma membrane protein PM 19 |
| 700262691H1 | g1495251 | 22 | −17 | gb105eukp | heat-shock protein |
| 700258521H1 | g168512 | 40 | −30 | gb105pln | Maize major protein (L3) mRNA from the surface of lipid bodies, 3′ end. |
| 700256945H1 | g1513227 | 19 | −1 | gb105pln | *Brassica napus* myo-inositol 1-phosphate synthase mRNA, complete cds. |
| 700267284H1 | g1388021 | 22 | 4 | gb105eukp | UGPase; UDP-glucase pyrophosphorylase; EC 2.7.7.9 |
| 700262363H1 | g1208445 | 58 | −12 | gb105pln | Rice (YK426) mRNA, complete cds. |
| 700261624H1 | g167109 | 36 | −20 | gb105pln | *Hordeum vulgare* vacuolar ATPase B subunit mRNA, complete cds. |
| 700261919H1 | g1129085 | 23 | −26 | gb105pln | Wheat mRNA for protein H2A, complete cds, clone wcH2A-9. |
| 700263873H1 | g2388884 | 36 | −39 | gb105pln | *Lycopersicon esculentum* mRNA for glutathione peroxidase. |
| 700267856H1 | g1573346 | 16 | 1 | gb105allp | nitrogen fixation protein (nifU) |
| 700263756H1 | g1155212 | 37 | −32 | gb105pln | *Avena fatua* aldose reductase-related protein mRNA, complete cds. |
| 700264530H1 | g2130984 | 39 | −29 | gb105pln | *B. napus* mRNA for ribosomal protein S15a (pA813). |
| 700267243H1 | g1575129 | 87 | −70 | gb105pln | *Zea mays* lumenal binding protein cBiPe3 mRNA, complete cds. |
| 700264406H1 | g396209 | 26 | −9 | gb105pln | *S. polyrrhiza* mRNA for D-myo-inositol-3-phosphate synthase. |
| 700264779H1 | g168608 | 83 | −82 | gb105pln | Maize 17S ribosomal RNA gene and flanks. |
| 700263685H1 | g927238 | 50 | −32 | gb105pln | *Zea mays* globulin1 (Glb1) gene, allele Glb1-Hb, complete cds. |
| 700264165H1 | g2275006 | 41 | −3 | gb105pln | *Hordeum vulgare* mRNA for expressed sequence tag. |
| 700265622H1 | g452559 | 34 | −55 | gb105pln | *Zea mays* group 3 Lea protein MCL3 mRNA, complete cds. |
| 700264511H1 | g927239 | 7 | 6 | gb105allp | globulin1 |
| 700266222H1 | g1235568 | 56 | −68 | gb105pln | *O. sativa* mRNA for NAD(P)H oxidase. |
| 700258768H1 | g310932 | 34 | −43 | gb105pln | *Nicotiana tabacum* ribosomal protein L17 mRNA, complete cds. |
| 700259460H1 | g1498052 | 41 | −8 | gb105pln | *Zea mays* ribosomal protein S8 mRNA, complete cds. |
| 700266119H1 | g473984 | 44 | −53 | gb105pln | Rice mRNA, partial homologous to heat shock protein 90 gene. |
| 700262695H1 | g287297 | 35 | −15 | gb105pln | *Oryza sativa* mRNA for aspartate aminotransferase, complete cds. |
| 700257814H1 | g469147 | 39 | −13 | gb105pln | *H. vulgare* mRNA for alanine aminotransferase. |
| 700257580H1 | g22281 | 71 | −1 | gb105pln | *Zea mays* Glb1-0 gene for vicilin-like storage protein (truncated). |
| 700258064H1 | g2145473 | 34 | −5 | gb105eukp | aconitate hydratase; EC 4.2.1.3 |
| 700268121H1 | g167244 | 39 | −34 | gb105pln | *Chlorella kessleri* elongation factor 2 mRNA, complete cds. |
| 700265783H1 | g1171351 | 31 | −9 | gb105pln | *Oryza sativa* 16 kDa oleosin (ole16) mRNA, complete cds. |
| 700262822H1 | g2827656 | 15 | −6 | gb105eukp | F18F4.120; DAG-like protein |
| 700264088H1 | g1480353 | 4 | 8 | gb105allp | ubiquitin-conjugating enzyme |
| 700267155H1 | g968901 | 55 | −44 | gb105pln | Rice mRNA for ribosomal protein S8, complete cds. |
| 700268182H1 | g1399272 | 41 | −14 | gb105pln | *Arabidopsis thaliana* calmodulin-domain protein kinase CDPK isoform 5 (CPKS) mRNA, complete cds. |
| 700256812H1 | g1658314 | 24 | 4 | gb105pln | *C. sativa* osr40g3 gene. |
| 700262744H1 | g1777454 | 12 | 12 | gb105pln | *Oryza sativa* pyruvate decarboxylase 2 (pdc2) gene, complete cds. |
| 700262604H1 | g2853092 | 37 | −29 | gb105pln | Yeast (*Saccharomyces pombe*) chromosome II cosmid c16C6. |
| 700264501H1 | g450292 | 31 | −31 | gb105pln | *Zea mays* alpha-tubulin mRNA, |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | complete cds. |
| 700266147H1 | g152898 | 22 | 5 | gb105allp | ORF 2 |
| 700266395H1 | g1209391 | 4 | 7 | gb105allp | TPR protein |
| 700207177H1 | g452559 | 34 | −33 | gb105pln | *Zea mays* group 3 Lea protein MGL3 mRNA, complete cds. |
| 700262086H1 | g473976 | 59 | −50 | gb105pln | Rice mRNA, partial homologous to elongation factor 1-alpha gene. |
| 700265950H1 | g1132482 | 24 | −35 | gb105pln | Rice mRNA for ADP-ribosylation factor, complete cds. |
| 700261356H1 | g2267217 | 18 | 6 | gb105allp | serine palmitoyltransferase LCB2 subunit |
| 700258052H1 | g1703574 | 12 | 0 | gb105eukp | C43E11.9 |
| 700261055H1 | g312569 | 37 | 6 | gb105pln | *I. latifolius* 26S rRNA (partial). |
| 700258292H1 | g1871186 | 10 | −2 | gb105eukp | T06D20.14 |
| 700261630H1 | g1881536 | 53 | −10 | gb105eukp | ATML1; meristem L1 layer homeobox protein |
| 700258626H1 | g168508 | 30 | −61 | gb105pln | Maize oleosin KD18 (KD18; L2) gene, complete cds. |
| 700258736H1 | g862479 | 27 | −36 | gb105pln | *Glycine max* valosin-containing protein mRNA, complete cds. |
| 700262331H1 | g22576 | 6 | 2 | gb105eukp | pyruvate kinase; EC 2.7.1.40 |
| 700263283H1 | g2736120 | 46 | −40 | gb105pln | *Magnolia virginiana* RPB140 (RPB2) mRNA, partial cds. |
| 700265476H1 | g22270 | 51 | −76 | gb105pln | Maize mRNA from an embryogenic abscisic acid-inducible gene. |
| 700258772H1 | g1066282 | 41 | −29 | gb105pln | *Phaseolus vulgaris* 1L-myo-inositol 1-phosphate synthase mRNA, complete cds. |
| 700263019H1 | g945023 | 19 | 5 | gb105allp | methylenetetrahydrofolate reductase |
| 700265476H1 | g19016 | 23 | −16 | gb105pln | *H. vulgare* mRNA for LEA B19.4 protein. |
| 700267313H1 | g1864002 | 37 | −29 | gb105pln | *Nicotiana tabacum* mRNA for 21D7, complete cds. |
| 700266415H1 | g161172 | 17 | −1 | gb105eukp | elongation factor 1-gamma |
| 700268121H1 | g2369713 | 58 | −55 | gb105pln | *Beta vulgaris* cDNA for elongation factor 2. |
| 700257890H1 | g469247 | 30 | −1 | gb105pln | *Helianthus annuus* ribosomal protein S3a mRNA, complete cds. |
| 700264448H1 | g1171351 | 27 | −14 | gb105pln | *Oryza sativa* 16 kDa oleosin (ole16) mRNA, complete cds. |
| 700264818H1 | g218160 | 34 | −7 | gb105pln | *Oryza sativa* mRNA for elongation factor 1 beta'. |
| 700266485H1 | g1513227 | 16 | 7 | gb105pln | *Brassica napus* myo-inositol 1-phosphate synthase mRNA, complete cds. |
| 700258735H1 | g498896 | 16 | 7 | gb105eukp | histone H2A homolog |
| 700264173H1 | g1730474 | 50 | −45 | gb105pln | *H. vulgare* mRNA for transcription factor vp1. |
| 700266145H1 | g1155264 | 42 | −46 | gb105pln | *Pennisetum ciliare* possible apospory-associated protein mRNA, complete cds. |
| 700258437H1 | g1694832 | 17 | −36 | gb105pln | *H. vulgare* Per1 gene. |
| 700267845H1 | g22270 | 67 | −79 | gb105pln | Maize mRNA from an embryogenic abscisic acid-inducible gene. |
| 700267345H1 | g340368 | 9 | 3 | gb105allp | transfer RNA-Trp synthetase |
| 700257574H1 | g732814 | 22 | 2 | gb105pln | *L. esculentum* LeMA-1 mRNA for putatve Mg-dependent ATPase 1. |
| 700260112H1 | g2331132 | 15 | 6 | gb105pln | *Oryza sativa* glycine-rich protein (OSGRP2) mRNA, complete cds. |
| 700266939H1 | g22302 | 45 | −47 | gb105pln | Maize Gpc1 gene for glyceraldehyde-3-phosphate dehydrogenase (GADPH) subunit C. |
| 700266172H1 | g297176 | 17 | −17 | gb105eukp | expressed ORF |
| 700258445H1 | g790969 | 60 | −50 | gb105pln | Rice mRNA for aidolase C-1, complete cds. |
| 700207126H1 | g758246 | 22 | 4 | gb105pln | *Phalaenopsis sp.* mRNA for S-adenosyhomocysteine hydrolase. |
| 700264290H1 | g515608 | 17 | 6 | gb105allp | *C. sativus* 3-ketoacyl-CoA thiolase |
| 700262207H1 | g927239 | 6 | 7 | gb105allp | globulin1 |
| 700266289H1 | g2641208 | 36 | −20 | gb105pln | *Fritillaria agrestis* ribosomal protein S16 (rps16) mRNA, complete cds. |
| 700265378H1 | g2369713 | 45 | −34 | gb105pln | *Beta vulgaris* cDNA for elongation factor 2. |
| 700262745H1 | g1770020 | 59 | −48 | gb105pln | *Oryza sativa* S-adenosyl-L-methionine synthetase (pOS-SAMS2) |

TABLE 1-continued

LIST OF INCYTE CLONES DERIVED FROM SATMON022023
COPYRIGHT 1998 INCYTE PHARMACEUTICALS, INC.

| | | | | |
|---|---|---|---|---|
| 700265086H1 | g444044 | 38 | −71 | gb105pln |
| | | | | mRNA, complete cds.<br>*Z. mays* mRNA for group 3 Lea protein MGL3. |
| 700262731H1 | g2791947 | 23 | −3 | gb105pln |
| | | | | *Lupinus luteus* mRNA for ribosomal protein L13a. |
| 700264817H1 | g410487 | 20 | −13 | gb105pln |
| | | | | *L. esculentum* DAHP synthase 2 precursor. |
| 700261188H1 | g1136121 | 59 | −53 | gb105pln |
| | | | | *O. sativa* mRNA for alpha-tubulin (clone OSTA-136). |
| 700262085H1 | g168683 | 67 | −79 | gb105pln |
| | | | | Maize 22 kd (Mw = 26.53 kd) zein protein 1, mRNA. |
| 700263128H1 | g2511530 | 31 | 2 | gb105pln |
| | | | | *Eleusine indica* alpha tubulin 1 (TUA1) mRNA, complete cds. |
| 700264352H1 | g529353 | 21 | 4 | gb105eukp |
| | | | | monolignol polymerization; lignin biosynthesis; laccase; EC 1.10.3.2 |
| 700207126H1 | g169660 | 21 | 5 | gb105pln |
| | | | | Parsley S-adenosylhomocysteine hydrolase (SHH) mRNA, complete cds. |
| 700207212H1 | g312178 | 31 | −73 | gb105pln |
| | | | | *Z. mays* GapC2 gene. |
| 700261874H1 | g1911765 | 12 | 0 | gb105eukp |
| | | | | iEP4; iEP4 |
| 700262270H1 | g459894 | 20 | −28 | gb105pln |
| | | | | *Zea mays* sus1 gene, complete cds. |
| 700268092H1 | g2828011 | 88 | −75 | gb105pln |
| | | | | *Zea mays* starch synthase I precursor (Ss1) mRNA, nuclear gene encoding plastid protein, complete cds. |
| 700267975H1 | g927571 | 30 | −24 | gb105pln |
| | | | | *Z. mays* mRNA for calreticulin precursor. |
| 700257020H1 | g1181330 | 34 | −75 | gb105pln |
| | | | | *Z. mays* CNX mRNA. |
| 700261757H1 | g633889 | 17 | 9 | gb105pln |
| | | | | glucose and ribitol dehydrogenase homolog [*Hordeum vulgare* = barley, Aura, embryo, mRNA, 1170 nt]. |
| 700264881H1 | g1052534 | 18 | −8 | gb105eukp |
| | | | | SPAC8A4.01c; unknown |
| 700258453H1 | g1171351 | 18 | −2 | gb105pln |
| | | | | *Oryza sativa* 16 kDa oleosin (ole16) mRNA, complete cds. |
| 700257788H1 | g927238 | 59 | −55 | gb105pln |
| | | | | *Zea mays* globulin1 (Glb1) gene, allele Glb1-Hb, complete cds. |
| 700259514H1 | g1155260 | 27 | −3 | gb105pln |
| | | | | *Arabidopsis thaliana* eukaryotic release factor 1 homolog (eRF1) mRNA, complete cds. |
| 700264079H1 | g1899059 | 52 | −32 | gb105pln |
| | | | | *Zea mays* endosperm C-24 sterol methyltransferase (ESMT1) mRNA, complete cds. |
| 700259168H2 | g609656 | 23 | −6 | gb105eukp |
| | | | | osmoregulation and cell shape control; protein phosphatase 2C (ptc2+) |
| 700258025H1 | g443817 | 30 | −18 | gb105pln |
| | | | | *A. thaliana* pyrE-F mRNA. |
| 700257372H1 | g1185553 | 45 | −51 | gb105pln |
| | | | | *Zea mays* glyceraldehyde-3-phosphate dehydrogenase (gpc2) gene, complete cds. |
| 700256848H1 | g1431044 | 5 | 8 | gb105eukp |
| | | | | LHP1 |
| 700258155H1 | g2351062 | 15 | −8 | gb105pln |
| | | | | *Arabidopsis thaliana* genomic DNA, chromosome 5, P1 clone: MAH20. |
| 700263873H1 | g19738 | 40 | −43 | gb105pln |
| | | | | *N. sylvestris* mRNA for 6P229 polypeptide homologous to animal glutathione peroxidases. |
| 700257781H1 | g549983 | 12 | 11 | gb105pln |
| | | | | *Pennisetum ciliare* possible apospory-associated mRNA clone pSUB C, complete cds. |
| 700261729H1 | g168480 | 33 | 16 | gb105pln |
| | | | | Maize embryo globulin S allele (7S-like) mRNA, complete cds. |
| 700264843H1 | g2190991 | 22 | 9 | gb105pln |
| | | | | *Aegilops squarrosa* glutathione S-transferase TSI-1 mRNA, complete cds. |
| 700267278H1 | g22283 | 74 | −58 | gb105pln |
| | | | | *Zea mays* Glb1-L gene for vicilin-like embryo storage protein. |
| 700267083H1 | g22281 | 26 | −67 | gb105pln |
| | | | | *Zea mays* Glb1-0 gene for vicilin-like storage protein (truncated). |
| 700258629H1 | g2829895 | 23 | −4 | gb105eukp |
| | | | | T26J12.1; hypothetical protein |
| 700267991H1 | g19012 | 24 | −6 | gb105pln |
| | | | | *H. vulgare* mRNA for LEA B19.1 protein. |
| 700259361H1 | g1155337 | 14 | 6 | gb105allp |
| | | | | ScoL13 |
| 700207161H1 | g22461 | 32 | −47 | gb105pln |
| | | | | Maize RAB-17 gene. |
| 700262935H1 | g166956 | 52 | 1 | gb105eukp |
| | | | | fructose-1,6-bisphosphatase; fructose-1,6-bisphosphatase; EC 3.1.3.11 |
| 700265776H1 | g2345153 | 43 | −65 | gb105pln |
| | | | | *Zea mays* ribosomal protein S4 (rps4) mRNA, complete cds. |
| 700264727H1 | g1532072 | 9 | 15 | gb105pln |
| | | | | *Z. mays* mRNA for S-adenosylmethionine decarboxylase. |
| 700263593H1 | g2341023 | 32 | −20 | gb105pln |
| | | | | Sequence of BAC F19P19 from *Arabidopsis thaliana* chromosome 1, |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | complete sequence. |
| 700267661H1 | g2335096 | 17 | −12 | gb105eukp | T11A07.7 |
| 700267131H1 | g1155212 | 36 | −1 | gb105pln | *Avena fatua* aldose reductase-related protein mRNA, complete cds. |
| 700266690H1 | g975887 | 50 | −45 | gb105pln | *Mesembryanthemum crystallinum* myo-inositol-1-phosphate synthase mRNA, complete cds. |
| 700264788H1 | g218088 | 38 | −29 | gb105pln | Rice mRNA for ribosomal protein 117 (249 gene), partial sequence. |
| 700265076H1 | g1575127 | 93 | −84 | gb105pln | *Zea mays* lumenal binding protein cBiPe2 mRNA, complete cds. |
| 700259653H1 | g168512 | 22 | 5 | gb105pln | Maize major protein (L3) mRNA from the surface of lipid bodies, 3' end. |
| 700262487H1 | g549848 | 55 | −5 | gb105eukp | eft-1 |
| 700261930H1 | g506138 | 68 | −60 | gb105pln | *Zea mays* Ec metallothionein class II protein mRNA, complete cds. |
| 700262109H1 | g1622938 | 28 | −8 | gb105pln | *Bromus secalinus* oleosin (ole16) mRNA, complete cds. |
| 700261105H1 | g1698690 | 17 | −0 | gb105eukp | CwKASII1, beta-ketoacyl-ACP synthase II |
| 700266730H1 | g168480 | 69 | −78 | gb105pln | Maize embryo globulin S allele (7S-like) mRNA, complete cds. |
| 700257087H1 | g2828154 | 38 | 6 | gb105allp | casein kinase 1 alpha isoform |
| 700207179H1 | g2589163 | 43 | −55 | gb105pln | *Zea mays* mRNA for aldehyde oxidase-2, complete cds. |
| 700259036H1 | g218088 | 57 | −33 | gb105pln | Rice mRNA for ribosomal protein 117 (249 gene), partial sequence. |
| 700263176H1 | g166604 | 31 | 2 | gb105allp | anthranilate synthase alpha subunit |
| 700265456H1 | g2267592 | 35 | −30 | gb105pln | *Oryza sativa* glycine-rich RNA-binding protein mRNA, complete cds. |
| 700257929H1 | g22099 | 8 | 10 | gb105pln | *Z. mays* 27 kDa zein locus DNA. |
| 700260035H1 | g1658312 | 42 | −1 | gb105pln | *O. sativa* osr40g2 gene. |
| 700265147H1 | g602605 | 64 | −80 | gb105pln | *Zea mays* tandem genes for alpha1-tubulin and alpha2-tubulin. |
| 700257966H1 | g473602 | 70 | −70 | gb105pln | *Zea mays* W-22 histone H2A mRNA, complete cds. |
| 700262927H1 | g454872 | 47 | −64 | gb105pln | Maize mRNA for group 3 Lea protein MGL3, complete cds. |
| 700264232H1 | g218088 | 48 | −39 | gb105pln | Rice mRNA for ribosomal protein 117 (249 gene), partial sequence. |
| 700266666H1 | g19342 | 21 | −8 | gb105pln | *L. esculentum* mRNA for ribosomal protein L2. |
| 700264752H1 | g633632 | 25 | −8 | gb105eukp | probable thioredoxin |
| 700265114H1 | g644492 | 99 | −86 | gb105pln | Corn elongation factor 1alpha gene, complete cds. |
| 700257534H1 | g435648 | 27 | 13 | gb105pln | Rice mRNA for gamma-Tip, complete cds. |
| 700256724H1 | g294086 | 34 | −24 | gb105pln | *Pisum sativum* F1-ATPase delta-prime subunit gene, complete cds. |
| 700266507H1 | g1256944 | 13 | 2 | gb105eukp | sui2; translation initiation factor 2 alpha subunit |
| 700260023H1 | g170434 | 21 | 15 | gb105pln | Tomato ATP-dependent protease (CD4B) gene, complete cds. |
| 700261202H1 | g248338 | 35 | −41 | gb105pln | polyubiquitin [maize, Genomic, 3439 nt]. |
| 700263637H1 | g439480 | 19 | 15 | gb105pln | Barley mRNA for ferrochelatase. |
| 700267548H1 | g397632 | 56 | −61 | gb105pln | *T. aestivum* translation initiation factor 4A. |
| 700267131H1 | g167112 | 26 | 8 | gb105pln | *Bromus inermis* aldose reductase-related protein, complete cds. |
| 700207114H1 | g687244 | 78 | 2 | gb105pln | *Zea mays* oil body protein 16 kDa oleosin (ole16) gene, complete cds. |
| 700261005H1 | g2462154 | 20 | −2 | gb105eukp | F32B6.3 |
| 700265627H1 | g2632037 | 8 | 8 | gb105allp | YkoA |
| 700263313H1 | g248338 | 67 | −49 | gb105pln | polyubiquitin [maize, Genomic, 3439 nt]. |
| 700265622H1 | g444044 | 34 | −55 | gb105pln | *Z. mays* mRNA for group 3 Lea protein MGL3. |
| 700258267H1 | g1125691 | 30 | −3 | gb105eukp | dnaJ; DnaJ protein |
| 700260775H1 | g22285 | 58 | −34 | gb105pln | *Zea mays* Glb1-S gene for vicilin-like embryo storage protein. |
| 700264844H1 | g22312 | 81 | −39 | gb105pln | Maize ABA-inducible gene for glycine-rich protein (ABA = abscisic acid). |
| 700267466H1 | g1881536 | 11 | 2 | gb105eukp | ATML1; meristem L1 layer |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700257080H1 | g763277 | 27 | 4 | gb105allp | homeobox protein unknown |
| 700266758H1 | g1724111 | 18 | 9 | gb105pln | *Triticum aestivum* ABA induced plasma membrane protein PM-19 (WTABAPM) mRNA, complete cds. |
| 700258196H1 | g2370253 | 11 | 1 | gb105allp | putative protein kinase |
| 700258360H1 | g2791948 | 27 | −10 | gb105eukp | rpl13a; ribosomal protein L13a |
| 700262411H1 | g2331300 | 35 | −47 | gb105pln | *Zea mays* ribosomal protein S4 typeI (rps4) mRNA, complete cds. |
| 700263283H1 | g2736116 | 73 | −66 | gb105pln | *Hordeum vulgare* RPB140 (RPB2) mRNA, partial cds. |
| 700260821H1 | g20000 | 26 | −14 | gb105pln | *N. tabacum* RL2 mRNA for 60S ribosomal protein L2. |
| 700264090H1 | g296203 | 40 | −32 | gb105pln | *P. miliaceum* mRNA for alanine aminotransferase. |
| 700267428H1 | g22287 | 7 | 4 | gb105allp | vicilin-like embryo storage protein |
| 700257357H1 | g1125691 | 15 | −2 | gb105eukp | dnaJ; DnaJ protein |
| 700262478H1 | g286238 | 5 | 7 | gb105allp | N-methyl-D-aspartate receptor subunit |
| 700263672H1 | g790640 | 20 | −0 | gb105pln | *Hordeum vulgare* gamma-thionin (HTH3) mRNA, complete cds. |
| 700258186H1 | g2370252 | 20 | −1 | gb105pln | *Lycopersicon esculentum* mRNA for putative protein kinase. |
| 700264121H1 | g20255 | 62 | −51 | gb105pln | *O. sativa* gene for heat shock protein 82 HSP82. |
| 700207177H1 | g444044 | 34 | −33 | gb105pln | *Z. mays* mRNA for group 3 Lea protein MGL3. |
| 700256732H1 | g2463577 | 25 | −6 | gb105allp | PRP8 protein |
| 700267065H1 | g304637 | 30 | 6 | gb105eukp | CARSAM2; S-adenosylmethionine synthetase |
| 700256734H1 | g1575129 | 42 | −47 | gb105pln | *Zea mays* lumenal binding protein cBiPe3 mRNA, complete cds. |
| 700267170H1 | g2738749 | 88 | −78 | gb105pln | *Zea mays* ATP sulfurylase mRNA, complete cds. |
| 700258504H1 | g747916 | 96 | −93 | gb105pln | *Z. mays* CaM2 mRNA for calmodulin. |
| 700263586H1 | g2282583 | 85 | −40 | gb105pln | *Zea mays* elongation factor 1-alpha (EF1-A) mRNA, complete cds. |
| 700264523H1 | g2341060 | 81 | −81 | gb105pln | *Zea mays* translational initiation factor eIF-4A (tif-4A3) mRNA, complete cds. |
| 700263954H1 | g485376 | 48 | −52 | gb105pln | *Zea mays* alpha-3-tubulin gene, complete cds. |
| 700207218H1 | g168480 | 60 | 4 | gb105pln | Maize embryo globulin S allele (7S-like) mRNA, complete cds. |
| 700258667H1 | g1946371 | 20 | 3 | gb105allp | regulatory protein Viviparous-1 isolog |
| 700264395H1 | g167385 | 17 | 2 | gb105eukp | storage protein |
| 700266950H1 | g168512 | 39 | −26 | gb105pln | Maize major protein (L3) mRNA from the surface of lipid bodies, 3' end. |
| 700260911H1 | g450353 | 12 | 11 | gb105pln | *H. vulgare* (cv Bomi) gB19.1b gene. |
| 700207256H1 | g1217993 | 43 | −5 | gb105pln | *Glycine max* dynamin-like protein SDL12A mRNA, complete cds. |
| 700265516H1 | g2429086 | 48 | −41 | gb105pln | *Hordeum vulgare* lipoxygenase 2 (LoxC) mRNA, complete cds. |
| 700260434H1 | g22292 | 71 | −65 | gb105pln | *Z. mays* mRNA for glycine-rich protein. |
| 700265224H1 | g2760165 | 27 | −17 | gb105pln | *Arabidopsis thaliana* genomic DNA, chromosome 5, P1 clone: MAC9, complete sequence. |
| 700266338H1 | g2245015 | 18 | −13 | gb105eukp | unnamed protein product |
| 700266060H1 | g687244 | 49 | −85 | gb105pln | *Zea mays* oil body protein 16 kDa oleosin (ole16) gene, complete cds. |
| 700265158H1 | g20000 | 25 | −12 | gb105pln | *N. tabacum* RL2 mRNA for 60S ribosomal protein L2. |
| 700258046H1 | g22281 | 63 | −61 | gb105pln | *Zea mays* Glb1-0 gene for vicilin-like storage protein (truncated). |
| 700261906H1 | g217973 | 28 | −65 | gb105pln | *Zea mays* gene for triosephosphate isomerase, complete cds. |
| 700257385H1 | g1814402 | 46 | −19 | gb105pln | *Mesembryanthemum crystallinum* methionine synthase (MetE) mRNA, complete cds. |
| 700267526H1 | g459894 | 72 | 15 | gb105pln | *Zea mays* sus1 gene, complete cds. |
| 700261144H1 | g533251 | 30 | −10 | gb105pln | *Zea mays* (clone PSM8) sucrose |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | synthase 2 (Sus1) gene, complete cds. |
| 700263208H1 | g429021 | 66 | −35 | gb105pln | Rice mRNA for ribosomal protein S4 (gene name SS536), partial cds. |
| 700262267H1 | g168512 | 35 | −35 | gb105pln | Maize major protein (L3) mRNA from the surface of lipid bodies, 3' end. |
| 700263654H1 | g473130 | 16 | 1 | gb105pln | Yeast (*Saccharomyces cerevisiae*) URA1, SAC1, RSD1 and TRP3 genes and 6 new orfs. |
| 700264331H1 | g168480 | 57 | −60 | gb105pln | Maize embryo globulin S allele (7S-like) mRNA, complete cds. |
| 700257280H1 | g21723 | 37 | 9 | gb105pln | *T. aestivum* (cDNA II) mRNA for EC protein. |
| 700262902H1 | g2821955 | 36 | −6 | gb105eukp | spermidine synthase 1; EC 2.5.1.16 |
| 700267533H1 | g1107487 | 70 | −8 | gb105eukp | 60S ribosomal protein L27a |
| 700258401H1 | g293888 | 40 | −61 | gb105pln | *Zea mays*, glyceraldehyde-3-phosphate dehydrogenase mRNA, 3' end (clone GAPC2). |
| 700258656H1 | g1209407 | 6 | 8 | gb105eukp | F40E10.6 |
| 700265613H1 | g975887 | 27 | −13 | gb105pln | *Mesembryanthemum crystallinum* myo-inositol-1-phosphate synthase mRNA, complete cds. |
| 700259388H1 | g22285 | 39 | −70 | gb105pln | *Zea mays* Glb1-S gene for vicilin-like embryo storage protein. |
| 700260945H1 | g836948 | 8 | 3 | gb105allp | calcium-dependent protein kinase |
| 700258792H1 | g22237 | 94 | −83 | gb105pln | Maize mRNA for cytosolic GAPDH (GapC) glyceraldehyde-3-phosphate dehydrogenase. |
| 700263484H1 | g296203 | 85 | −77 | gb105pln | *P. miliaceum* mRNA for alanine aminotransferase. |
| 700265352H1 | g602252 | 75 | −84 | gb105pln | *Zea mays* enolase (eno2) mRNA, complete cds. |
| 700263080H1 | g1171351 | 12 | 14 | gb105pln | *Oryza sativa* 16 kDa oleosin (ole16) mRNA, complete cds. |
| 700266673H1 | g169588 | 17 | 8 | gb105pln | *Solanum tuberosum* spliceosomal protein (U2B) mRNA, complete cds. |
| 700258692H1 | g927239 | 7 | 7 | gb105allp | globulin1 |
| 700266585H1 | g22283 | 79 | −75 | gb105pln | *Zea mays* Glb1-L gene for vicilin-like embryo storage protein. |
| 700207267H1 | g1262145 | 18 | −7 | gb105pln | *S. oleracea* mRNA for proteasome 37 kD subunit. |
| 700267356H1 | g1296954 | 77 | −73 | gb105pln | *O. sativa* mRNA for novel protein, osr40c1. |
| 700267241H1 | g170775 | 27 | −8 | gb105pln | Wheat translation elongation factor 1 alpha-subunit (TEF1) mRNA, complete cds. |
| 700266985H1 | g644492 | 77 | −70 | gb105pln | Corn elongation factor 1alpha gene, complete cds. |
| 700266410H1 | g960356 | 51 | −43 | gb105pln | Barley mRNA for S-adenosylmethionine synthetase, complete cds. |
| 700267333H1 | g168405 | 81 | −15 | gb105pln | maize alcohol dehydrogenase (adh1) mrna 3' end and flank. |
| 700264158H1 | g596077 | 63 | −22 | gb105pln | *Zea mays* thiamine biosynthetic enzyme (thi1-1) mRNA, complete cds. |
| 700260819H1 | g22215 | 56 | −73 | gb105pln | *Z. mays* ZSF4C1 gene for zein. |
| 700207168H1 | g473205 | 18 | 16 | gb105pln | *E. gunnii* mRNA for mitochondrial malate dehydrogenase. |
| 700258692H1 | g22287 | 8 | 8 | gb105allp | vicilin-like embryo storage protein |
| 700265470H1 | g2462742 | 18 | −15 | gb105eukp | F8A5.25 |
| 700267048H1 | g578406 | 12 | 7 | gb105eukp | RPA1; DNA-directed RNA polymerase I largest subunit; EC 2.7.7.6 |
| 700257815H1 | g304103 | 29 | −4 | gb105pln | *Arabidopsis thaliana* ubiquitin activating enzyme E1-related protein (AXR1) mRNA, complete cds. |
| 700266504H1 | g2463334 | 65 | −31 | gb105pln | *Oryza sativa* mRNA for ribosomal protein S4. |
| 700267319H1 | g2781432 | 19 | 9 | gb105pln | *Oryza sativa* subsp. *japonica* RSW1-like cellulose synthase catalytic subunit mRNA, partial cds. |
| 700262935H1 | g895909 | 61 | −1 | gb105eukp | CFBP; fructose-1, 6-bisphosphatase; EC 3.1.3.11 |
| 700267641H1 | g19101 | 37 | −25 | gb105pln | *H. vulgare* mRNA for ribosomal protein L17-1. |
| 700265817H1 | g687244 | 88 | −15 | gb105pln | *Zea mays* oil body protein 16 kDa oleosin (ole16) gene, complete cds. |
| 700265053H1 | g2224553 | 4 | 8 | gb105allp | KIAA0306 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700267187H1 | g1890575 | 18 | 3 | gb105eukp | HVXEA; xyloglucan endotransglycosylase (XET) |
| 700262511H1 | g22281 | 82 | −74 | gb105pln | *Zea mays* Glb1-0 gene for vicilin-like storage protein (truncated). |
| 700262533H1 | g1171351 | 30 | −17 | gb105pln | *Oryza sativa* 16 kDa oleosin (ole16) mRNA, complete cds. |
| 700267233H1 | g2264312 | 19 | −0 | gb105pln | *Arabidopsis thaliana* genomic DNA, chromosome 5, P1 clone: MOK16, complete sequence. |
| 700266411H1 | g972270 | 9 | 8 | gb105allp | 32 kd accesory protein |
| 700258891H1 | g1171351 | 25 | −8 | gb105pln | *Oryza sativa* 16 kDa oleosin (ole16) mRNA, complete cds. |
| 700267470H1 | g1777706 | 50 | −83 | gb105pln | *Zea mays* 18S ribosomal RNA gene, partial sequence. |
| 700257244H1 | g168512 | 45 | −42 | gb105pln | Maize major protein (L3) mRNA from the surface of lipid bodies, 3' end. |
| 700265131H1 | g173065 | 21 | −5 | gb105pln | Yeast (*Saccharomyces cerevisiae*) mitochondrial ef-tu (tufm) gene. |
| 700262445H1 | g293888 | 75 | −63 | gb105pln | *Zea mays*, glyceraldehyde-3-phosphate dehydrogenase mRNA, 3' end (clone GAPC2). |
| 700262667H1 | g170460 | 14 | 4 | gb105allp | threonine deaminase |
| 700264266H1 | g899393 | 18 | −2 | gb105pln | Yeast (*Saccharomyces cerevisiae*) chromosome IV cosmid 8358. |
| 700258808H1 | g1107460 | 36 | −6 | gb105pln | Rice mRNA for aspartate kinase-homoserine dehydrogenase, complete cds. |
| 700259358H1 | g1296954 | 39 | −21 | gb105pln | *O. sativa* mRNA for novel protein, osr40c1. |
| 700264666H1 | g168508 | 57 | −71 | gb105pln | Maize oleosin KD18 (KD18; L2) gene, complete cds. |
| 700257965H1 | g1132482 | 20 | 3 | gb105pln | Rice mRNA for ADP-ribosylation factor, complete cds. |
| 700262263H1 | g2414402 | 48 | −9 | gb105eukp | Y57G11C.15 |
| 700265660H1 | g310570 | 8 | 7 | gb105eukp | GmPM3; dessication protectant; seed maturation protein; pGmPM3 |
| 700267136H1 | g22281 | 67 | −22 | gb105pln | *Zea mays* Glb1-0 gene for vicilin-like storage protein (truncated). |
| 700256844H1 | g393707 | 29 | −6 | gb105eukp | 3-ketoacyl-CoA thiolase; EC 2.3.1.16 |
| 700266506H1 | g1632831 | 13 | 8 | gb105eukp | orf |
| 700267651H1 | g1553133 | 9 | 4 | gb105eukp | phosphorylates actin in actin-fragmin complex; actin-fragmin kinase |
| 700266392H1 | g1171351 | 27 | −16 | gb105pln | *Oryza sativa* 16 kDa oleosin (ole16) mRNA, complete cds. |
| 700262239H1 | g1370183 | 30 | −16 | gb105pln | *L. japonicus* mRNA for small GTP-binding protein, RAB7B. |
| 700264595H1 | g1020408 | 71 | −68 | gb105pln | *Zea mays* mRNA for phospholipase D, complete cds. |
| 700265615H1 | g1196896 | 12 | 1 | gb105pln | *Glycine max* acidic ribosomal protein P0 mRNA, complete cds. |
| 700267772H1 | g168505 | 73 | −73 | gb105pln | *Zea mays* histone H3 gene, complete cds. |
| 700257966H1 | g1129084 | 23 | −1 | gb105pln | Wheat mRNA for protein H2A, complete cds, clone wcH2A-3. |
| 700261901H1 | g22270 | 57 | −75 | gb105pln | Maize mRNA from an embryogenic abscisic acid-inducible gene. |
| 700258962H1 | g506860 | 27 | −13 | gb105eukp | HRSec61 |
| 700260571H2 | g294212 | 12 | 7 | gb105allp | aldose reductase |
| 700261901H1 | g19016 | 18 | −18 | gb105pln | *H. vulgare* mRNA for LEA B19.4 protein. |
| 700267621H1 | g168512 | 17 | −33 | gb105pln | Maize major protein (L3) mRNA from the surface of lipid bodies, 3' end. |
| 700258637H1 | g22285 | 60 | −72 | gb105pln | *Zea mays* Glb1-S gene for vicilin-like embryo storage protein. |
| 700260177H1 | g473135 | 28 | −15 | gb105eukp | ORF4, F1286 |
| 700263073H1 | g2345153 | 95 | −57 | gb105pln | *Zea mays* ribsomal protein S4 (rps4) mRNA, complete cds. |
| 700257929H1 | g22100 | 20 | 1 | gb105pln | *Z. mays* 27 kDa zein locus DNA. |
| 700262783H1 | g2414614 | 17 | 7 | gb105eukp | SPAC2C4.03c; small nuclear ribonuclear protein |
| 700266040H1 | g902583 | 54 | −17 | gb105pln | *Zea mays* clone MubG1 ubiquitin gene, complete cds. |
| 700257437H2 | g474006 | 55 | −25 | gb105pln | Rice mRNA, partial homologous to ribosomal protein S11 gene. |
| 700268160H1 | g459267 | 37 | −24 | gb105pln | *Z. mays* gene for HMG protein. |
| 700267482H1 | g22281 | 29 | −6 | gb105pln | *Zea mays* Glb1-0 gene for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700266961H1 | g1171347 | 47 | −26 | gb105pln | vicilin-like storage protein (truncated). *Triticum aestivum* pMA1951 mRNA, partial cds. |
| 700266143H1 | g1550737 | 13 | 14 | gb105pln | *A. thaliana* mRNA for endomembrane-associated protein. |
| 700207130H1 | g2065530 | 26 | −20 | gb105pln | *Lycopersicon esculentum* endo-1,4-beta-glucanase (Cel3) mRNA, complete cds. |
| 700258188H1 | g20501 | 12 | 4 | gb105eukp | vicilin-like storage protein |
| 700263356H1 | g1335861 | 58 | −23 | gb105pln | Glycine max clathrin heavy chain mRNA, complete cds. |
| 700267455H1 | g1575127 | 46 | −82 | gb105pln | *Zea mays* lumenal binding protein cBiPe2 mRNA, complete cds. |
| 700266675H1 | g544501 | 14 | 4 | gb105eukp | SEC13; Sec13p |
| 700257017H1 | g1568635 | 14 | 2 | gb105eukp | host cell receptor involved in nuclear import of Agrobacterium VirD2 protein; AtKAP alpha |
| 700256909H1 | g22144 | 86 | −83 | gb105pln | Maize anaerobically regulated gene for fructose bisphosphate aldolase (EC 4.1.2.13). |
| 700256789H1 | g1658314 | 42 | −55 | gb105pln | *O. sativa* osr40g3 gene. |
| 700262967H1 | g587562 | 21 | −2 | gb105eukp | MPP; mitochondrial processing peptidase |
| 700267483H1 | g791115 | 25 | −11 | gb105eukp | ODP2; component (E2) of pyruvate dehydrogenase complex precursor; dihydrolipoamide S-acetyltransferase; EC 2.3.1.12 |
| 700263794H1 | g687244 | 35 | −61 | gb105pln | *Zea mays* oil body protein 16 kDa oleosin (ole16) gene, complete cds. |
| 700265827H1 | g1296954 | 75 | −10 | gb105pln | *O. sativa* mRNA for novel protein, osr40c1. |
| 700262526H1 | g1552830 | 10 | 5 | gb105allp | similar to *S. cerevisiae* YLL062c |
| 700262660H1 | g22270 | 71 | −85 | gb105pln | Maize mRNA from an embryogenic abscisic acid-inducible gene. |
| 700267343H1 | g168512 | 51 | −42 | gb105pln | Maize major protein (L3) mRNA from the surface of lipid bodies, 3' end. |
| 700267137H1 | g520935 | 81 | −11 | gb105pln | *H. vulgare* mRNA for gamma-TIP-like protein. |
| 700266266H1 | g22119 | 96 | −92 | gb105pln | Maize Adh1-F mRNA for alcohol dehydrogenase. |
| 700262459H1 | g687244 | 56 | −29 | gb105pln | *Zea mays* oil body protein 16 kDa oleosin (ole16) gene, complete cds. |
| 700263272H1 | g2130520 | 22 | −1 | gb105pln | *Pisum sativum* reversibly glycosylatable polypeptide (RGP1) mRNA, complete cds. |
| 700267495H1 | g2809248 | 47 | −5 | gb105eukp | F21B7.17 |
| 700266115H1 | g169649 | 21 | −2 | gb105eukp | CCoAMT; caffeoyl-CoA 3-O-methyltransferase |
| 700257784H1 | g2832633 | 39 | 5 | gb105eukp | F13C5.220; putative protein |
| 700265375H1 | g780371 | 30 | −16 | gb105pln | *Oryza sativa* enolase mRNA, complete cds. |
| 700258053H1 | g2282583 | 75 | −82 | gb105pln | *Zea mays* elongation factor 1-alpha (EF1-A) mRNA, complete cds. |
| 700264285H1 | g406051 | 23 | −3 | gb105eukp | let1; Let1 |
| 700264959H1 | g2570223 | 26 | −14 | gb105pln | Sequence of BAC F20D22 from *Arabidopsis thaliana* chromosome 1, complete sequence. |
| 700267581H1 | g168702 | 51 | −72 | gb105pln | Corn 22 kDa zein protein gene, complete cds. |
| 700267249H1 | g1550813 | 74 | −80 | gb105pln | *Z. mays* mRNA for acidic ribosomal protein P0. |
| 700267272H1 | g2656029 | 22 | 2 | gb105pln | *Arabidopsis thaliana* genomic DNA, chromosome 5, P1 clone: MQB2. |
| 700267190H1 | g1220178 | 15 | 8 | gb105eukp | dormancy related protein |
| 700264608H1 | g2341060 | 97 | −85 | gb105pln | *Zea mays* translational initiation factor eIF-4A (tif-4A3) mRNA, complete cds. |
| 700264745H1 | g22281 | 82 | 5 | gb105pln | *Zea mays* Glb1-0 gene for vicilin-like storage protein (truncated). |
| 700256935H1 | g1142620 | 25 | −11 | gb105pln | *Phaseolus vulgaris* phaseolin G-box binding protein PG2 (PC2) mRNA, partial cds. |
| 700263954H1 | g22149 | 48 | −54 | gb105pln | *Z. mays* mRNA for alpha-tubulin 3. |
| 700266291H1 | g2662344 | 77 | −74 | gb105pln | *Oryza sativa* mRNA for EF-1 alpha, complete cds. |
| 700262725H1 | g998429 | 36 | −19 | gb105pln | GRF1 = general regulatory factor |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700262845H1 | g599624 | 45 | −33 | gb105pln | [*Zea mays*, XL80, Genomic, 5348 nt].<br>*A. thaliana* mRNA for aconitase (ZAPII). |
| 700260910H1 | g1622938 | 20 | 8 | gb105pln | *Bromus secalinus* oleosin (ole16) mRNA, complete cds. |
| 700262121H1 | g2809248 | 15 | −1 | gb105eukp | F21B7.17 |
| 700263640H1 | g2104535 | 26 | −4 | gb105eukp | T10M13.13; T10M13.13 |
| 700264707H1 | g1469221 | 34 | −6 | gb105eukp | unknown |
| 700267350H1 | g402551 | 40 | −24 | gb105pln | *A. thaliana* gene for acetohydroxy acid isomeroreductase. |
| 700265490H1 | g169127 | 48 | −49 | gb105pln | *Pisum sativum* (clone pCLp) nuclear encoded precursor to chloroplast protein mRNA, complete cds. |
| 700264750H1 | g22283 | 38 | −39 | gb105pln | *Zea mays* Glb1-L gene for vicilin-like embryo storage protein. |
| 700256924H1 | g927239 | 6 | 7 | gb105allp | globulin1 |
| 700265468H1 | g471320 | 19 | −32 | gb105pln | *H. vulgare* (cv. Bomi) B15C mRNA. |
| 700263260H1 | g2821959 | 40 | −9 | gb105eukp | spermidine synthase; EC 2.5.1.16 |
| 700263956H1 | g22233 | 21 | −52 | gb105pln | Maize mRNA for catalase 2. |
| 700261488H1 | g998429 | 52 | −25 | gb105pln | GRF1 = general regulatory factor [*Zea mays*, XL80, Genomic, 5348 nt]. |
| 700262427H1 | g1256595 | 31 | −12 | gb105allp | LytB |
| 700263121H1 | g22340 | 76 | −9 | gb105pln | Maize gene for heat shock protein 70 exon 1 (hsp70; clone pMON 9502). |
| 700267275H1 | g529093 | 59 | −52 | gb105pln | Rice mRNA for proteasome C2 subunit, complete cds. |
| 700266240H1 | g22322 | 23 | −36 | gb105pln | *Z. mays* mRNA for H2B histone (clone cH2B214). |
| 700262569H1 | g536895 | 34 | 4 | gb105pln | Wheat mRNA for protein H2A, complete cds, clone wcH2A-10. |
| 700262727H1 | g687244 | 52 | −80 | gb105pln | *Zea mays* oil body protein 16 kDa oleosin (ole16) gene, complete cds. |
| 700263850H1 | g168512 | 23 | −16 | gb105pln | Maize major protein (L3) mRNA from the surface of lipid bodies, 3' end. |
| 700266248H1 | g1161311 | 51 | −46 | gb105pln | *Arabidopsis thaliana* Columbia myo-inositol-1-phosphate synthase mRNA, complete cds. |
| 700264788H1 | g310932 | 34 | −21 | gb105pln | *Nicotiana tabacum* ribosomal protein L17 mRNA, complete cds. |
| 700262062H1 | g2058283 | 16 | 10 | gb105pln | *A. thaliana* mRNA for AtRanBP1b protein. |
| 700258950H1 | g434905 | 27 | −36 | gb105pln | *A. thaliana* (Columbia) gene for S18 ribosomal protein (1471 bp). |
| 700264418H1 | g790640 | 20 | −1 | gb105pln | *Hordeum vulgare* gamma-thionin (HTH3) mRNA, complete cds. |
| 700264777H1 | g471320 | 47 | −48 | gb105pln | *H. vulgare* (cv. Bomi) B15C mRNA. |
| 700257503H1 | g1354468 | 35 | 0 | gb105eukp | U1 SnRNP 70K truncated protein |
| 700267172H1 | g1743006 | 21 | −2 | gb105pln | *C. paradoxa* mRNA for ribosomal protein L13a. |
| 700259036H1 | g310932 | 38 | −15 | gb105pln | *Nicotiana tabacum* ribosomal protein L17 mRNA, complete cds. |
| 700264271H1 | g2833627 | 32 | −23 | gb105pln | *Arabidopsis thaliana* chromosome 1 BAC F17O7 complete sequence. |
| 700263687H1 | g2827001 | 42 | −15 | gb105pln | *Triticum aestivum* 70 kDa heat shock protein (TaHSP70d) mRNA, complete cds. |
| 700266923H1 | g436782 | 48 | −20 | gb105pln | Rice mRNA for cyc07, complete cds. |
| 700266186H1 | g1171351 | 29 | −17 | gb105pln | *Oryza sativa* 16 kDa oleosin (ole16) mRNA, complete cds. |
| 700259811H1 | g2645970 | 42 | −37 | gb105pln | *Arabidopsis thaliana* reversibly glycosylated polypeptide-3 (RGP) mRNA, complete cds. |
| 700266127H1 | g170064 | 14 | 2 | gb105allp | glucose binding protein |
| 700265524H1 | g2462910 | 19 | 13 | gb105pln | *A. sativa* mRNA for UDP-glucose:sterol glucosyltransferase. |
| 700259208H1 | g410487 | 33 | −36 | gb105pln | *L. esculentum* DAHP synthase 2 precursor. |
| 700265222H1 | g168512 | 35 | −32 | gb105pln | Maize major protein (L3) mRNA from the surface of lipid bodies, 3' end. |
| 700265822H1 | g22614 | 94 | −26 | gb105pln | *S. vulgare* pepC gene for PEP carboxylase. |
| 700258863H1 | g2444419 | 42 | −36 | gb105pln | *Glycine max* ribosome-associated protein p40 mRNA, |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | complete cds. |
| 700264293H1 | g2645166 | 30 | −11 | gb105pln | *Oryza sativa* mRNA, similar to ubiquitin conjugating enzyme. |
| 700264232H1 | g310932 | 44 | −33 | gb105pln | *Nicotiana tabacum* ribosomal protein L17 mRNA, complete cds. |
| 700261611H1 | g432488 | 47 | −30 | gb105pln | Wheat initiation factor 1A (eIF-1A) mRNA. |
| 700267589H1 | g22292 | 67 | −57 | gb105pln | *Z. mays* mRNA for glycine-rich protein. |
| 700262961H1 | g218241 | 24 | −14 | gb105pln | Rice mRNA for ribosomal protein L3 (T82 gene), partial sequence. |
| 700263340H1 | g691751 | 26 | −13 | gb105pln | Pumpkin mRNA for MP27 and MP32. |
| 700264623H1 | g349403 | 16 | −27 | gb105pln | *Brassica campestris* (clone lambda GCN1-2) napin gene, complete cds. |
| 700266538H1 | g22281 | 58 | −55 | gb105pln | *Zea mays* Glb1-0 gene for vicilin-like storage protein (truncated). |
| 700258276H1 | g2673912 | 31 | −10 | gb105eukp | T24P15.12 |
| 700261174H1 | g1185553 | 23 | −60 | gb105pln | *Zea mays* glyceraldehyde-3-phosphate dehydrogenase (gpc2) gene, complete cds. |
| 700268165H1 | g416499 | 9 | 7 | gb105allp | globulin |
| 700266014H1 | g22287 | 11 | 2 | gb105allp | vicilin-like embryo storage protein |
| 700267267H1 | g687244 | 44 | −35 | gb105pln | *Zea mays* oil body protein 16 kDa oleosin (ole16) gene, complete cds. |
| 700258277H1 | g470126 | 33 | −18 | gb105pln | *N. tabacum* (cv. Samsun NN) L19 mRNA for ribosomal protein L19. |
| 700257428H2 | g1167474 | 15 | 2 | gb105eukp | C47E12.1 |
| 700258217H1 | g1064884 | 37 | −1 | gb105pln | *A. thaliana* mRNA for phosphoribosyl pyrophosphate synthetase II. |
| 700264994H1 | g2789660 | 61 | −30 | gb105eukp | p105 |
| 700262609H1 | g454872 | 22 | −50 | gb105pln | Maize mRNA for group 3 Lea protein MGL3, complete cds. |
| 700263306H1 | g558364 | 51 | −28 | gb105pln | *Z. mays* mRNA for ADP-glucose pyrophosphorylase. |
| 700257375H1 | g2331300 | 29 | −34 | gb105pln | *Zea mays* ribosomal protein S4 type I (rps4) mRNA, complete cds. |
| 700259835H1 | g633094 | 67 | −55 | gb105pln | *Panicum miliaceum* mRNA for plastidic aspartate aminotransferase, complete cds. |
| 700260105H1 | g2645970 | 16 | −31 | gb105pln | *Arabidopsis thaliana* reversibly glycosylated polypeptide-3 (RGP) mRNA, complete cds. |
| 700261755H1 | g218334 | 48 | −46 | gb105pln | *Triticum aestivum* mRNA for O-acetylserine (thiol) lyase. |
| 700265395H1 | g2288968 | 62 | −48 | gb105pln | *Zea mays* mRNA for glutathione transferase. |
| 700267032H1 | g520935 | 44 | −13 | gb105pln | *H. vulgare* mRNA for gamma-TIP-like protein. |
| 700265211H1 | g2384671 | 24 | −6 | gb105eukp | AtKT2; putative potassium transporter AtKT2p |
| 700266139H1 | g1658312 | 39 | −31 | gb105pln | *O. sativa* osr40g2 gene. |
| 700256749H1 | g1749733 | 32 | −36 | gb105pln | Fission Yeast mRNA, partial cds. |
| 700266979H1 | g22281 | 76 | −76 | gb105pln | *Zea mays* Glb1-0 gene for vicilin-like storage protein (truncated). |
| 700268135H1 | g940880 | 30 | 8 | gb105pln | *Z. mays* zag2 gene. |
| 700266494H1 | g1432082 | 24 | −12 | gb105pln | *Arabidopsis thaliana* Skp1p homolog mRNA, complete cds. |
| 700266182H1 | g1777929 | 60 | −62 | gb105pln | *Saccharum officinarum* nucleoside diphosphate kinase (SoNDPK1) mRNA, complete cds. |
| 700263690H1 | g2244851 | 10 | 6 | gb105allp | amine oxidase |
| 700267256H1 | g1244659 | 12 | −2 | gb105pln | *Zea mays* copia-type retroelement PREM-2, partial sequence. |
| 700258094H1 | g899607 | 67 | −64 | gb105pln | *Zea mays* polyubiquitin (MubC5) mRNA, complete cds. |
| 700260329H1 | g1107486 | 10 | −0 | gb105pln | *A. thaliana* mRNA for 60S ribosomal protein L27a. |
| 700258836H1 | g533473 | 43 | −33 | gb105pln | *Mesembryanthemum crystallinum* 2-phospho-D-glycerate hydrolase, enolase, mRNA, complete cds. |
| 700262981H1 | g602252 | 29 | −8 | gb105pln | *Zea mays* enolase (eno2) mRNA, complete cds. |
| 700266294H1 | g144733 | 7 | 3 | gb105allp | NAD-dependent beta-hydroxybutyryl coenzyme A dehydrogenase |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700265753H1 | g289749 | 10 | −4 | gb105eukp | ZK1236.7 protein |
| 700265205H1 | g8394 | 14 | 5 | gb105allp | pumilio gene product |
| 700262929H1 | g1171353 | 11 | 17 | gb105pln | *Oryza sativa* 18 kDa oleosin mRNA, complete cds. |
| 700261262H1 | g20755 | 23 | −31 | gb105pln | *P. sativum* mRNA rab for ras-related GTP-binding protein. |
| 700263774H1 | g687244 | 50 | −45 | gb105pln | *Zea mays* oil body protein 16 kDa oleosin (ole16) gene, complete cds. |
| 700261329H1 | g895891 | 12 | 3 | gb105eukp | RPS5; ribosomal protein S5 |
| 700259702H1 | g218367 | 13 | 8 | gb105pln | Yeast (*Candida tropicalis*) CTPACTB gene for acetoacetyl-CoA thiolase A. |
| 700265547H1 | g1848211 | 41 | −17 | gb105pln | *N. tabacum* mRNA for protein disulfide-isomerase precursor. |
| 700263762H1 | g1561577 | 35 | −6 | gb105eukp | spermine synthase 1; EC 2.5.1.22 |
| 700266894H1 | g1895083 | 96 | −54 | gb105pln | *Zea mays* golgi associated protein se-wap41 mRNA, complete cds. |
| 700258654H1 | g1184771 | 67 | −60 | gb105pln | *Zea mays* glyceraldehyde-3-phosphate dehydrogenase GAPC2 (gpc2) mRNA, complete cds. |
| 700260539H2 | g927238 | 17 | −30 | gb105pln | *Zea mays* globulin1 (Glb1) gene, allele Glb1-Hb, complete cds. |
| 700267013H1 | g927238 | 78 | −9 | gb105pln | *Zea mays* globulin1 (Glb1) gene, allele Glb1-Hb, complete cds. |
| 700259606H1 | g16159 | 18 | 13 | gb105pln | *A. thaliana* mRNA for adenosine nucleotide translocator. |
| 700260472H1 | g624933 | 12 | 6 | gb105allp | suppressor for an inositol auxotrophic mutant and a choline seins itive mutant |
| 700267235H1 | g167141 | 19 | −1 | gb105pln | Spring cabbage histidinol dehydrogenase mRNA, complete cds. |
| 700266240H1 | g577824 | 37 | −38 | gb105pln | *Z. mays* gene for H2B histone (gH2B3). |
| 700259039H1 | g410482 | 18 | −2 | gb105eukp | chorismate synthase 1; EC 4.6.1.4 |
| 700260577H2 | g799369 | 23 | 3 | gb105eukp | proteolytic removal of chloroplast transit peptides; metalloendopeptidase |
| 700267853H1 | g1184771 | 54 | −72 | gb105pln | *Zea mays* glyceraldehyde-3-phosphate dehydrogenase GAPC2 (gpc2) mRNA, complete cds. |
| 700257792H1 | g506533 | 26 | −4 | gb105pln | *N. tabacum* PKTL7 mRNA for protein kinase. |
| 700264638H1 | g312178 | 31 | −43 | gb105pln | *Z. mays* GapC2 gene. |
| 700260111H1 | g509548 | 17 | 14 | gb105pln | *Sorghum bicolor* dehydrin (DHN1) mRNA, complete cds. |
| 700260572H2 | g1184775 | 48 | −68 | gb105pln | *Zea mays* glyceraldehyde-3-phosphate dehydrogenase GAPC4 (gpc4) mRNA, complete cds. |
| 700266758H1 | g1724112 | 20 | 5 | gb105allp | ABA induced plasma membrane protein PM 19 |
| 700262541H1 | g913940 | 15 | −8 | gb105pln | btg-26 = turgor-responsive/drought-induced gene [*Brassica napus*, cv. Bridger, Genomic, 4442 nt]. |
| 700268141H1 | g22281 | 59 | −62 | gb105pln | *Zea mays* Glb1-0 gene for vicilin-like storage protein (truncated). |
| 700262909H1 | g1171351 | 17 | 7 | gb105pln | *Oryza sativa* 16 kDa oleosin (ole16) mRNA, complete cds. |
| 700268006H1 | g388052 | 58 | −79 | gb105pln | *Zea mays* alcohol dehydrogenase (Adh1-S) mRNA, complete cds. |
| 700260982H1 | g22281 | 72 | −49 | gb105pln | *Zea mays* Glb1-0 gene for vicilin-like storage protein (truncated). |
| 700256920H1 | g20834 | 38 | −31 | gb105pln | *P. sativum* PHSP1 mRNA for HSP70. |
| 700264631H1 | g558364 | 93 | −81 | gb105pln | *Z. mays* mRNA for ADP-glucose pyrophosphorylase. |
| 700267978H1 | g308082 | 54 | −45 | gb105pln | hsp82 = 82 kda heat shock protein [*Zea mays*, seedling, leaves, Genomic, 3468 nt]. |
| 700262853H1 | g398607 | 21 | 10 | gb105pln | *A. thaliana* mRNA for elongation factor 1 beta. |
| 700260514H2 | g2564046 | 19 | −22 | gb105pln | *Arabidopsis thaliana* genomic DNA, chromosome 5, P1 clone: MGI19, complete sequence. |
| 700263352H1 | g602605 | 71 | −74 | gb105pln | *Zea mays* tandem genes for alpha1-tubulin and alpha2-tubulin. |
| 700256756H1 | g2331300 | 71 | −86 | gb105pln | *Zea mays* ribosomal protein S4 type I (rps4) mRNA, complete cds. |
| 700258159H1 | g2288886 | 25 | −8 | gb105pln | *Arabidopsis thaliana* mRNA for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700257066H1 | g2369714 | 26 | 5 | gb105allp | mevalonate diphosphate decarboxylase. elongation factor 2 |
| 700257736H1 | g1694832 | 23 | 1 | gb105pln | *H. vulgare* Per1 gene. |
| 700256847H1 | g1212995 | 30 | −4 | gb105pln | *H. vulgare* mRNA for UDP-glucose pyrophosphorylase. |
| 700262922H1 | g22287 | 6 | 7 | gb105allp | vicilin-like embryo storage protein |
| 700264394H1 | g471320 | 63 | −56 | gb105pln | *H. vulgare* (cv. Bomi) B15C mRNA. |
| 700258326H1 | g1370202 | 59 | −51 | gb105pln | *L. japonicus* mRNA for small GTP-binding protein, RAN1A. |
| 700261534H1 | g975887 | 53 | −47 | gb105pln | *Mesembryanthemum crystallinum* myo-inositol-1-phosphate synthase mRNA, complete cds. |
| 700267602H1 | g2656028 | 20 | 16 | gb105pln | *Arabidopsis thaliana* genomic DNA, chromosome 5, P1 clone: MNF13. |
| 700260531H2 | g1495250 | 22 | −16 | gb105pln | *A. thaliana* mRNA for heat-shock protein. |
| 700261356H1 | g798913 | 18 | 7 | gb105eukp | LCB2; Lcb2p |
| 700257189H1 | g596079 | 96 | −25 | gb105pln | *Zea mays* thiamine biosynthetic enzyme (thi1-2) mRNA, complete cds. |
| 700266078H1 | g2058283 | 14 | 13 | gb105pln | *A. thaliana* mRNA for AtRanBP1b protein. |
| 700263763H1 | g2815897 | 12 | 5 | gb105eukp | tpk1, protein kinase 1 |
| 700258410H1 | g1724112 | 37 | −6 | gb105eukp | WTABAPM; ABA induced plasma membrane protein PM 19 |
| 700267436H1 | g1171351 | 24 | −10 | gb105pln | *Oryza sativa* 16 kDa oleosin (ole16) mRNA, complete cds. |
| 700263826H1 | g2459435 | 36 | −5 | gb105eukp | F4P9.30; putative serine carboxypeptidase |
| 700266147H1 | g953179 | 19 | 2 | gb105allp | ORF14 |
| 700264386H1 | g20321 | 71 | −66 | gb105pln | *Oryza sativa* RAc1 mRNA for actin. |
| 700267778H1 | g556672 | 18 | 9 | gb105pln | *S. cereale* (Halo) chloroplast mRNA for heat-shock protein. |
| 700266044H1 | g22277 | 10 | 10 | gb105pln | Maize mRNA for ferritin (clone FM2). |
| 700267451H1 | g1658312 | 39 | −25 | gb105pln | *O. sativa* osr40g2 gene. |
| 700266646H1 | g22283 | 81 | −54 | gb105pln | *Zea mays* Glb1-L gene for vicilin-like embryo storage protein. |
| 700266301H1 | g2342735 | 62 | −13 | gb105eukp | T14011.28 |
| 700258553H1 | g22283 | 52 | −69 | gb105pln | *Zea mays* Glb1-L gene for vicilin-like embryo storage protein. |
| 700257337H1 | g21834 | 44 | −10 | gb105pln | Wheat mRNA for cytosolic phosphoglycerate kinase (EC 2.7.2.3). |
| 700258238H1 | g296203 | 58 | −68 | gb105pln | *P. miliaceum* mRNA for alanine aminotransferase. |
| 700258055H1 | g556685 | 14 | 17 | gb105pln | *Z. mays* mRNA for ADP-ribosylation factor. |
| 700267788H1 | g22283 | 51 | 9 | gb105pln | *Zea mays* Glb1-L gene for vicilin-like embryo storage protein. |
| 700258449H1 | g168608 | 93 | −23 | gb105pln | Maize 17S ribosomal RNA gene and flanks. |
| 700261030H1 | g303854 | 51 | −37 | gb105pln | Rice mRNA for ribosomal protein L7A, complete cds. |
| 700207111H1 | g603601 | 15 | −1 | gb105eukp | NTF2; Ntf2p: Nuclear Transport Factor 2 |
| 700267239H1 | g485090 | 11 | 5 | gb105eukp | C05D11.3 |
| 700267592H1 | g218082 | 29 | −30 | gb105pln | Rice mRNA for initiation factor eIF-4D (225 gene), partial sequence. |
| 700265945H1 | g22283 | 54 | −7 | gb105pln | *Zea mays* Glb1-L gene for vicilin-like embryo storage protein. |
| 700265291H1 | g1814401 | 29 | −8 | gb105eukp | phosphoglucomutase; EC 5.4.2.2 |
| 700257046H1 | g2160155 | 30 | −1 | gb105pln | Sequence of BAC F21M12 from *Arabidopsis thaliana* chromosome 1, complete sequence. |
| 700261763H1 | g168472 | 87 | −93 | gb105pln | Maize ferredoxin III (Fd) isoprotein mRNA, pFD3. |
| 700262208H1 | g2276349 | 23 | −6 | gb105pln | Yeast (*Saccharomyces pombe*) chromosome II cosmid c30D10. |
| 700261839H1 | g454878 | 29 | 14 | gb105pln | Rice mRNA for WSI18 protein induced by water stress, complete cds. |
| 700262465H1 | g2459406 | 43 | −46 | gb105pln | *Arabidopsis thaliana* chromosome II BAC F4P9 genomic sequence, complete sequence. |
| 700257570H1 | g915312 | 27 | −10 | gb105pln | *Nicotiana glutinosa* ribosomal |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700261645H1 | g2505870 | 26 | −7 | gb105eukp | protein L31 mRNA, complete cds. hypothetical protein |
| 700262587H1 | g1066282 | 35 | −28 | gb105pln | *Phaseolus vulgaris* 1L-myo-inositol 1-phosphate synthase mRNA, complete cds. |
| 700266439H1 | g2414643 | 33 | −21 | gb105pln | Yeast (*Saccharomyces pombe*) chromosome I cosmid c3H5. |
| 700260661H1 | g727450 | 27 | 1 | gb105eukp | T10F2.4 |
| 700260232H1 | g461033 | 26 | −5 | gb105allp | c6.1A [human, Peptide, 324 aa]. |
| 700264456H1 | g861009 | 23 | −2 | gb105pln | *Hordeum vulgare* mRNA for bas1 protein. |
| 700257623H1 | g471320 | 36 | −13 | gb105pln | *H. vulgare* (cv. Bomi) B15C mRNA. |
| 700256830H1 | g1399260 | 28 | −14 | gb105pln | *Arabidopsis thaliana* DEF (CLA1) mRNA, complete cds. |
| 700262942H1 | g527680 | 38 | −10 | gb105eukp | ribosomal protein S3 |
| 700258201H1 | g1171347 | 26 | 11 | gb105pln | *Triticum aestivum* pMA1951 mRNA, partial cds. |
| 700257033H1 | g1125691 | 28 | −2 | gb105eukp | dnaJ, DnaJ protein |
| 700264956H1 | g633890 | 19 | −1 | gb105eukp | glucose and ribitol dehydrogenase homolog |
| 700264777H1 | g971279 | 46 | −41 | gb105pln | Rice mRNA for RAB24 protein, complete cds. |
| 700258339H1 | g1872162 | 25 | 5 | gb105pln | *Arabidopsis thaliana* DnaJ homolog (atj) mRNA, complete cds. |
| 700267190H1 | g453834 | 25 | 7 | gb105allp | nodG homolog |
| 700261086H1 | g148231 | 27 | 4 | gb105allp | o251 |
| 700259354H1 | g1532072 | 81 | −74 | gb105pln | *Z. mays* mRNA for S-adenosylmethionine decarboxylase. |
| 700260760H1 | g1173555 | 9 | −2 | gb105eukp | galE; catabolism of galactose to glucose in Leloir pathway, and in galactose synthesis from glucose.; UDP-galactose-4-epimerase; EC 5.1.3.2 |
| 700264166H1 | g298744 | 34 | −21 | gb105pln | gravity specific cDNA {clone GSC381} [*Oryza sativa*, Nipponbare, suspension callus, mRNA, 685 nt]. |
| 700264214H1 | g530206 | 34 | −24 | gb105pln | Glycine max heat shock protein (SB100) mRNA, complete cds. |
| 700260189H1 | g19655 | 59 | −30 | gb105pln | *M. sativa* 26S rRNA. |
| 700260324H1 | g1694832 | 15 | −34 | gb105pln | *H. vulgare* Per1 gene. |
| 700257751H1 | g18518 | 6 | 7 | gb105eukp | 4-coumarate-CoA ligase; EC 6.2.1.12 |
| 700263361H1 | g1403043 | 11 | 10 | gb105pln | *H. chilense* × *T. turgidum* conv. durum (Tritordeum) mRNA for S-adenosylmethionine decarboxylase. |
| 700259064H1 | g2522194 | 23 | −21 | gb105pln | *Triticum aestivum* ornithine/acetylornithine aminotransferase mRNA, partial cds. |
| 700257872H1 | g563986 | 23 | −1 | gb105eukp | RNA helicase like protein DB10 |
| 700267162H1 | g2583081 | 15 | −9 | gb105allp | microsomal glutathione S-transferase 3 |
| 700268182H1 | g587499 | 74 | −38 | gb105pln | *O. sativa* mRNA for calcium dependent protein kinase 11. |
| 700267345H1 | g165011 | 10 | 3 | gb105allp | eucaryotic release factor (eRF) |
| 700265214H1 | g2677829 | 30 | −28 | gb105pln | *Prunus armeniaca* ribosomal protein L12 mRNA, complete cds. |
| 700261055H1 | g312575 | 41 | 5 | gb105pln | *L. laureoleum* 26S rRNA (partial). |
| 700260523H2 | g973313 | 14 | 4 | gb105eukp | myo-inositol 1-phosphate synthase isozyme-2 |
| 700257060H1 | g927571 | 92 | −81 | gb105pln | *Z. mays* mRNA for calreticulin precursor. |
| 700260372H2 | g1881692 | 75 | 15 | gb105pln | *Zea mays* phosphoglucomutase mRNA, partial cds. |
| 700262173H1 | g313151 | 27 | −13 | gb105pln | *A. thaliana* ribosomal protein S15 mRNA, complete CDS. |
| 700264370H1 | g2746086 | 8 | 7 | gb105eukp | HvHAK1; putative high-affinity potassium transporter |
| 700259631H1 | g780371 | 16 | −4 | gb105pln | *Oryza sativa* enolase mRNA, complete cds. |
| 700267652H1 | g433216 | 14 | 16 | gb105pln | Rice mRNA for ascorbate peroxidase (gene name SS622), partial cds. |
| 700263712H1 | g1532072 | 20 | −20 | gb105pln | *Z. mays* mRNA for S-adenosylmethionine decarboxylase. |
| 700261239H1 | g395078 | 19 | −19 | gb105pln | *B. rapa* ubiquitin and ribosomal |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | protein mRNA, complete CDS's. |
| 700264419H1 | g2463334 | 31 | −33 | gb105pln | *Oryza sativa* mRNA for ribosomal protein S4. |
| 700263273H1 | g1694832 | 32 | −49 | gb105pln | *H. vulgare* Per1 gene. |
| 700265923H1 | g1399563 | 39 | −66 | gb105pln | *Hydrastis canadensis* nuclear 26S ribosomal RNA gene, partial sequence. |
| 700265237H1 | g2654088 | 13 | 6 | gb105eukp | KUP1; potassium transporter |
| 700256937H1 | g170775 | 63 | −60 | gb105pln | Wheat translation elongation factor 1 alpha-subunit (TEF1) mRNA, complete cds. |
| 700263630H1 | g1622938 | 27 | −13 | gb105pln | *Bromus secalinus* oleosin (ole16) mRNA, complete cds. |
| 700207256H1 | g2267212 | 38 | −1 | gb105pln | *Arabidopsis thaliana* dynamin-like GTP binding protein mRNA, complete cds. |
| 700267916H1 | g473976 | 60 | −52 | gb105pln | Rice mRNA, partial homologous to elongation factor 1-alpha gene. |
| 700263960H1 | g1574937 | 29 | −66 | gb105pln | *Zea mays* superoxide dismutase 4 (sod4) gene, partial cds. |
| 700266083H1 | g2264302 | 18 | 8 | gb105pln | *Arabidopsis thaliana* genomic DNA, chromosome 5, P1 clone: MAC12, complete sequence. |
| 700262573H1 | g168512 | 39 | −28 | gb105pln | Maize major protein (L3) mRNA from the surface of lipid bodies, 3' end. |
| 700264620H1 | g1244759 | 30 | 6 | gb105pln | *Arabidopsis thaliana* xyloglucan endotransglycosylase-related protein (XTR7) mRNA, complete cds. |
| 700259519H1 | g1575127 | 58 | −57 | gb105pln | *Zea mays* lumenal binding protein cBiPe2 mRNA, complete cds. |
| 700261183H1 | g536891 | 21 | 15 | gb105pln | Wheat mRNA for protein H2A, complete cds, clone wcH2A-4. |
| 700265857H1 | g2431768 | 50 | −45 | gb105pln | *Zea mays* acidic ribosomal protein P1a (rpp1a) mRNA, complete cds. |
| 700266483H1 | g22151 | 82 | −48 | gb105pln | *Z. mays* (A188) mRNA for alpha-tubulin 4. |
| 700267770H1 | g2623294 | 14 | 9 | gb105pln | *Arabidopsis thaliana* chromosome II BAC T20B5 genomic sequence, complete sequence. |
| 700266595H1 | g459894 | 74 | −55 | gb105pln | *Zea mays* sus1 gene, complete cds. |
| 700257160H1 | g463251 | 36 | −29 | gb105pln | *M. sativa* (Nagyszenasi) mRNA for ribosomal protein RL5. |
| 700262314H1 | g20834 | 44 | −39 | gb105pln | *P. sativum* PHSP1 mRNA for HSP70. |
| 700265484H1 | g1155212 | 39 | −25 | gb105pln | *Avena fatua* aldose reductase-related protein mRNA, complete cds. |
| 700265923H1 | g169818 | 44 | −80 | gb105pln | Rice 25S ribosomal RNA gene. |
| 700259180H2 | g1171351 | 13 | −10 | gb105pln | *Oryza sativa* 16 kDa oleosin (ole16) mRNA, complete cds. |
| 700263884H1 | g2832667 | 15 | 12 | gb105pln | *Arabidopsis thaliana* DNA chromosome 4, BAC clone T10I14 (ESSAII project). |
| 700265166H1 | g2288968 | 18 | 2 | gb105pln | *Zea mays* mRNA for glutathione transferase. |
| 700260119H1 | g1174152 | 16 | −7 | gb105pln | *Arabidopsis thaliana* RNA recognition motif-type RNA-binding protein (RBP37) mRNA, complete cds. |
| 700257641H1 | g1694832 | 31 | −8 | gb105pln | *H. vulgare* Per1 gene. |
| 700258481H1 | g22140 | 100 | −28 | gb105pln | *Z. mays* gene for acetohydroxyacid synthase (AHAS109). |
| 700267325H1 | g1694832 | 34 | −4 | gb105pln | *H. vulgare* Per1 gene. |
| 700258332H1 | g18259 | 18 | −2 | gb105pln | *C. sativus* mRNA for cs DnaJ-1. |
| 700258453H1 | g687244 | 52 | −70 | gb105pln | *Zea mays* oil body protein 16 kDa oleosin (ole16) gene, complete cds. |
| 700263371H1 | g2160155 | 16 | 8 | gb105pln | Sequence of BAC F21M12 from *Arabidopsis thaliana* chromosome 1, complete sequence. |
| 700267284H1 | g1212996 | 25 | 3 | gb105eukp | UDP-glucose pyrophosphorylase; EC 2.7.7.9 |
| 700259063H1 | g1070353 | 19 | 10 | gb105pln | *H. vulgare* mRNA for Hv14-3-3b. |
| 700262855H1 | g2465428 | 11 | 2 | gb105eukp | JRG1.2; 32 kDa protein |
| 700264065H1 | g1403043 | 28 | 0 | gb105pln | *H. chilense* × *T. turgidum* conv. durum (Tritordeum) mRNA for S-adenosylmethionine decarboxylase. |
| 700264620H1 | g1890574 | 66 | −15 | gb105pln | *H. vulgare* mRNA for xyloglucan endotransglycosylase-like protein (XEA). |
| 700257176H1 | g2345153 | 32 | −53 | gb105pln | *Zea mays* ribosomal protein S4 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | (rps4) mRNA, complete cds. |
| 700261374H1 | g168480 | 94 | −62 | gb105pln | Maize embryo globulin S allele (7S-like) mRNA, complete cds. |
| 700262265H1 | g1787163 | 9 | 6 | gb105allp | aminopeptidase N |
| 700266675H1 | g172559 | 14 | 4 | gb105eukp | Sec13; Sec13p |
| 700265601H1 | g1049307 | 28 | 7 | gb105eukp | actin-2 |
| 700267060H1 | g22118 | 39 | −77 | gb105pln | *Z. mays* DNA for Adh1-Cm allele. |
| 700257376H1 | g170772 | 27 | −30 | gb105pln | *Triticum aestivum* S-adenosyl-L-homocysteine hydrolase (SH6.2) mRNA, complete cds. |
| 700264596H1 | g973312 | 37 | −30 | gb105pln | *Arabidopsis thaliana* myo-inositol 1-phosphate synthase isozyme-2 mRNA, complete cds. |
| 700264789H1 | g168508 | 55 | −16 | gb105pln | Maize oleosin KD18 (KD18; L2) gene, complete cds. |
| 700264394H1 | g971279 | 58 | −51 | gb105pln | Rice mRNA for RAB24 protein, complete cds. |
| 700265524H1 | g2462911 | 25 | 7 | gb105eukp | sgt; UDP-glucose:sterol glucosyltransferase; EC 2.4.1.173 |
| 700262857H1 | g960356 | 37 | −2 | gb105pln | Barley mRNA for S-adenosylmethionine synthetase, complete cds. |
| 700262085H1 | g22531 | 67 | −79 | gb105pln | *Zea mays* mRNA encoding a zein (clone pZ22.1). |
| 700261631H1 | g166606 | 30 | −4 | gb105eukp | anthranilate synthase alpha subunit |
| 700261850H1 | g1580783 | 17 | 4 | gb105eukp | sperm receptor |
| 700264721H1 | g1931642 | 7 | 7 | gb105allp | Ser/Thr protein kinase isolog |
| 700261663H1 | g218162 | 30 | −12 | gb105pln | Rice mRNA for ferredoxin-NADP+ reductase, complete cds. |
| 700260580H1 | g2624201 | 39 | −41 | gb105pln | *M. acuminata* mRNA; clone pBAN UU90. |
| 700266083H1 | g2407247 | 18 | −2 | gb105eukp | oxen; alpha NAC |
| 700258070H1 | g1171351 | 29 | −17 | gb105pln | *Oryza sativa* 16 kDa oleosin (ole16) mRNA, complete cds. |
| 700262548H1 | g1532047 | 21 | −9 | gb105pln | *O. sativa* mRNA for S-adenosylmethionine decarboxylase. |
| 700264366H1 | g1125690 | 26 | −8 | gb105pln | *S. tuberosum* mRNA for DnaJ protein. |
| 700267956H1 | g687244 | 62 | −17 | gb105pln | *Zea mays* oil body protein 16 kDa oleosin (ole16) gene, complete cds. |
| 700263862H1 | g168466 | 38 | −40 | gb105pln | Corn late embryogenesis-abundant protein (EMB5) mRNA, complete cds. |
| 700261696H1 | g2288968 | 35 | −17 | gb105pln | *Zea mays* mRNA for glutathione transferase. |
| 700258423H1 | g1546918 | 47 | −66 | gb105pln | *Z. mays* mRNA for translation initiation factor 5A. |
| 700263968H1 | g312520 | 23 | −21 | gb105pln | *T. aestivum* Em H5 gene. |
| 700257533H1 | g2275194 | 33 | −2 | gb105pln | *Arabidopsis thaliana* chromosome II BAC T08113 genomic sequence, complete sequence. |
| 700267791H1 | g1100222 | 31 | −23 | gb105pln | *Pinus sylvestris* chloroplast NAD+-dependent glyceraldehyde-3-phosphate dehydrogenase mRNA, complete cds. |
| 700262903H1 | g577301 | 12 | 5 | gb105allp | The ha3523 gene product is related to *S. cerevisiae* gene product located in chromosome III. |
| 700265076H1 | g1575129 | 59 | −52 | gb105pln | *Zea mays* lumenal binding protein cBiPe3 mRNA, complete cds. |
| 700265832H1 | g2347199 | 43 | −2 | gb105eukp | T09D09.17; protein kinase isolog |
| 700262379H1 | g2641200 | 46 | −9 | gb105pln | *Fritillaria agrestis* ribosomal protein L23a (rp123a) mRNA, complete cds. |
| 700262330H1 | g2739389 | 7 | 5 | gb105eukp | T9J22.5; Cf-2.2 like protein |
| 700264635H1 | g2462742 | 12 | 2 | gb105eukp | E8A5.25 |
| 700267791H1 | g460978 | 17 | 3 | gb105pln | *C. plantagineum* Hochst mRNA for glyceraldehyde-3-phosphate dehydrogenase. |
| 700265451H1 | g396209 | 57 | −52 | gb105pln | *S. polyrrhiza* mRNA for D-myo-inositol-3-phosphate synthase. |
| 700257570H1 | g18208 | 17 | 3 | gb105pln | *C. reinhardtii* mRNA for ribosomal protein L31. |
| 700257127H1 | g168480 | 71 | −73 | gb105pln | Maize embryo globulin S allele (7S-like) mRNA, complete cds. |
| 700261386H1 | g790640 | 21 | 4 | gb105pln | *Hordeum vulgare* gamma-thionin (HTH3) mRNA, complete cds. |
| 700263405H1 | g2645162 | 18 | −12 | gb105pln | *Oryza sativa* mRNA, similar to |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | initiation factor eIE-4c. |
| 700260035H1 | g1658314 | 34 | 4 | gb105pln | *O. sativa* osr40g3 gene. |
| 700266290H1 | g473602 | 35 | −61 | gb105pln | *Zea mays* W-22 histone H2A mRNA, complete cds. |
| 700257623H1 | g971279 | 35 | −13 | gb105pln | Rice mRNA for RAB24 protein, complete cds. |
| 700256935H1 | g1465367 | 22 | −3 | gb105pln | *A. thaliana* mRNA for RAP-1 protein. |
| 700265901H1 | g168512 | 42 | −49 | gb105pln | Maize major protein (L3) mRNA from the surface of lipid bodies, 3′ end. |
| 700261206H1 | g435542 | 42 | −34 | gb105pln | *Z. mays* mRNA for calmodulin. |
| 700258709H1 | g1777706 | 95 | −94 | gb105pln | *Zea mays* 18S ribosomal RNA gene, partial sequence. |
| 700268129H1 | g474832 | 40 | −35 | gb105pln | *S. commersonii* mRNA for stearoyl-acyl carrier protein desaturase. |
| 700265388H1 | g500702 | 19 | −4 | gb105eukp | ARD1; Ard1p: subunit of the major N alpha-acetyltransferase |
| 700261125H1 | g435648 | 50 | −23 | gb105pln | Rice mRNA for gamma-Tip, complete cds. |
| 700265501H1 | g2062175 | 6 | 6 | gb105eukp | T02O04.23 |
| 700266411H1 | g532733 | 6 | 7 | gb105eukp | vacuolar ATPase subunit DVA41 |
| 700260973H1 | g1658312 | 37 | −31 | gb105pln | *O. sativa* osr40g2 gene. |
| 700262725H1 | g1519250 | 42 | −29 | gb105pln | *Oryza sativa* GF14-c protein mRNA, complete cds. |
| 700261361H1 | g22281 | 55 | −62 | gb105pln | *Zea mays* Glb1-0 gene for vicilin-like storage protein (truncated). |
| 700264902H1 | g2342727 | 10 | 2 | gb105eukp | T14G11.19 |
| 700266974H1 | g22447 | 9 | 9 | gb105pln | *Zea mays* ZMPMS2 gene for 19 kDa zein protein. |
| 700257240H1 | g2564213 | 45 | 2 | gb105eukp | ABI2 |
| 700264413H1 | g296204 | 34 | −21 | gb105eukp | pAlaAT-2; alanine aminotransferase; EC 2.6.1.2 |
| 700257754H1 | g170064 | 8 | 6 | gb105eukp | sbp; glucose binding protein |
| 700207126H1 | g169662 | 21 | 5 | gb105pln | Parsley S-adenosylhomocysteine hydrolase (SHH) mRNA, complete cds. |
| 700265147H1 | g2511530 | 58 | −51 | gb105pln | *Eleusine indica* alpha tubulin 1 (TUA1) mRNA, complete cds. |
| 700256972H1 | g172578 | 29 | 6 | gb105eukp | SEN3; affects tRNA processing |
| 700257986H1 | g644491 | 61 | −51 | gb105pln | Corn mRNA for elongation factor 1A. |
| 700266970H1 | g595535 | 8 | 6 | gb105eukp | YAL049C; Yal049cp |
| 700256701H1 | g644492 | 66 | −50 | gb105pln | Corn elongation factor 1alpha gene, complete cds. |
| 700207224H1 | g22342 | 69 | −56 | gb105pln | Maize gene for heat shock protein 70 exon 2 and 3′-UT (hsp70; clone pMON 9502). |
| 700258950H1 | g434342 | 40 | −38 | gb105pln | *A. thaliana* (C24) mRNA for S18 ribosomal protein. |
| 700263090H1 | g1061254 | 19 | 6 | gb105allp | putative protein |
| 700263848H1 | g596077 | 43 | −5 | gb105pln | *Zea mays* thiamine biosynthetic enzyme (thi1-1) mRNA, complete cds. |
| 700264595H1 | g1020414 | 61 | −49 | gb105pln | *Oryza sativa* mRNA for phospholipase D, complete cds. |
| 700261318H1 | g1770020 | 52 | −35 | gb105pln | *Oryza sativa* S-adenosyl-L-methionine synthetase (pOS-SAMS2) mRNA, complete cds. |
| 700258070H1 | g687244 | 51 | −84 | gb105pln | *Zea mays* oil body protein 16 kDa oleosin (ole16) gene, complete cds. |
| 700258754H1 | g452559 | 35 | −78 | gb105pln | *Zea mays* group 3 Lea protein MGL3 mRNA, complete cds. |
| 700265086H1 | g454872 | 38 | −71 | gb105pln | Maize mRNA for group 3 Lea protein MGL3, complete cds. |
| 700265601H1 | g1002531 | 28 | 7 | gb105eukp | ACT4; actin-4 |
| 700260580H1 | g1236618 | 34 | −31 | gb105pln | *Arabidopsis thaliana* glutamate decarboxylase (GAD2) mRNA, complete cds. |
| 700261022H1 | g633890 | 20 | 5 | gb105allp | glucose and ribitol dehydrogenase homolog [barley, *Hordeum vulgare*, Peptide, 293 aa]. |
| 700267115H1 | g553123 | 22 | 4 | gb105eukp | ORF |
| 700268165H1 | g927239 | 8 | 8 | gb105eukp | Glb1; globulin1 |
| 700266107H1 | g498737 | 67 | −73 | gb105pln | *H. vulgare* (pMaW21) pseudo mRNA for beta-ketoacyl-ACP synthase (partial). |
| 700264647H1 | g1171351 | 20 | −3 | gb105pln | *Oryza sativa* 16 kDa oleosin (ole16) mRNA, complete cds. |
| 700267893H1 | g895891 | 10 | −1 | gb105eukp | RPS5; ribosomal protein S5 |
| 700257580H1 | g22283 | 71 | −1 | gb105pln | *Zea mays* Glb1-L gene for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700258007H1 | g1067106 | 17 | −1 | gb105eukp | vicilin-like embryo storage protein. ZK757.3 |
| 700265469H1 | g1132482 | 58 | −47 | gb105pln | Rice mRNA for ADP-ribosylation factor, complete cds. |
| 700258627H1 | g19257 | 50 | −49 | gb105pln | *Lycopersicon esculentum* hsc-2 mRNA for heat shock protein cognate 70. |
| 700262511H1 | g927238 | 84 | −76 | gb105pln | *Zea mays* globulin1 (Glb1) gene, allele Glb1-Hb, complete cds. |
| 700263666H1 | g577824 | 73 | −21 | gb105pln | *Z. mays* gene for H2B histone (gH2B3). |
| 700263788H1 | g975887 | 32 | −30 | gb105pln | *Mesembryanthemum crystallinum* myo-inositol-1-phosphate synthase mRNA, complete cds. |
| 700266514H1 | g998429 | 41 | −88 | gb105pln | GRF1 = general regulatory factor [*Zea mays*, XL80, Genomic, 5348 nt]. |
| 700261141H1 | g927239 | 7 | 6 | gb105allp | globulin1 |
| 700258007H1 | g2149640 | 20 | −4 | gb105eukp | AGO1; leaf development; Argonaute protein |
| 700263192H1 | g2584827 | 34 | −9 | gb105pln | Sequence of BAC F12F1 from *Arabidopsis thaliana* chromosome 1, complete sequence. |
| 700207178H1 | g168512 | 35 | 5 | gb105pln | Maize major protein (L3) mRNA from the surface of lipid bodies, 3' end. |
| 700265237H1 | g2384671 | 42 | −6 | gb105eukp | AtKT2; putative potassium transporter AtKT2p |
| 700265932H1 | g2627057 | 18 | 7 | gb105pln | *Oryza sativa* mRNA for ADP glucose pyrophosphorylase large subunit, complete cds. |
| 700257309H1 | g1184771 | 82 | −78 | gb105pln | *Zea mays* glyceraldehyde-3-phosphate dehydrogenase GAPC2 (gpc2) mRNA, complete cds. |
| 700266615H1 | g2257743 | 28 | 2 | gb105eukp | lysine-sensitive aspartate kinase |
| 700257621H1 | g899607 | 23 | 17 | gb105pln | *Zea mays* polyubiquitin (MubC5) mRNA, complete cds. |
| 700263603H1 | g2326345 | 99 | −0 | gb105eukp | PRL1; PRL1 protein |
| 700257864H1 | g410487 | 48 | −23 | gb105pln | *L. esculentum* DAHP synthase 2 precursor. |
| 700259528H1 | g1518113 | 15 | 1 | gb105eukp | SLL2 |
| 700265227H1 | g22324 | 30 | −43 | gb105pln | *Z. mays* mRNA for H2B histone (clone cH2B221). |
| 700265234H1 | g2244836 | 30 | −6 | gb105eukp | RNA helicase homolog |
| 700263176H1 | g166606 | 29 | 3 | gb105allp | anthranilate synthase alpha subunit |
| 700262420H1 | g1149569 | 15 | −8 | gb105eukp | athb-8; HD-zip |
| 700262407H1 | g22287 | 8 | 7 | gb105allp | vicilin-like embryo storage protein |
| 700258594H1 | g1469221 | 18 | 6 | gb105eukp | unknown |
| 700257575H1 | g2673912 | 24 | −1 | gb105eukp | T24P15.12 |
| 700256961H1 | g16394 | 44 | 0 | gb105eukp | leucine aminopeptidase; EC 3.4.11.1 |
| 700264055H1 | g1632829 | 12 | 1 | gb105eukp | aarp2; AARP2 protein |
| 700257047111 | g19348 | 18 | −7 | gb105pln | *L. esculentum* mRNA for shikimate kinase precursor. |
| 700258514H1 | g458966 | 30 | 7 | gb105eukp | P37A4.8 |
| 700262932H1 | g1019691 | 6 | 3 | gb105eukp | CDC8 |
| 700264781H1 | g20163 | 44 | −42 | gb105pln | *O. sativa* Rrl5 mRNA for 5S ribosomal RNA. |
| 700258767H1 | g168512 | 48 | −44 | gb105pln | Maize major protein (L3) mRNA from the surface of lipid bodies, 3' end. |
| 700264247H1 | g1143392 | 31 | −25 | gb105eukp | uridine diphosphate glucose epimerase; EC 5.1.3.2 |
| 700267453H1 | g2464860 | 11 | 5 | gb105eukp | nuclear histone-binding protein homolog |
| 700265755H1 | g2582639 | 7 | 7 | gb105eukp | hnRNP-like protein |
| 700258693H1 | g391874 | 39 | −33 | gb105pln | Rice mRNA for 40S subunit ribosomal protein, complete cds. |
| 700262313H1 | g530349 | 7 | −0 | gb105eukp | len:138, CAI:0.12, potential spliced gene, hydropho bic composition |
| 700264979H1 | g514945 | 94 | −87 | gb105pln | *Zea mays* sucrose synthase (Sus1) mRNA, complete cds. |
| 700259015H1 | g2842486 | 10 | −1 | gb105eukp | F21O9.120; putative protein |
| 700265719H1 | g1931636 | 36 | 1 | gb105pln | *Arabidopsis thaliana* BAC T19D16 genomic sequence. |
| 700257647H1 | g1321917 | 24 | −3 | gb105eukp | su12; cytoplasmic ribosomal protein S7 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700265919H1 | g1167913 | 19 | 2 | gb105pln | *Zea Mays* MADS box protein (ZmOV23) mRNA, complete cds. |
| 700258094H1 | g777757 | 61 | −55 | gb105pln | *Saccharum* hybrid (clone SCUBI561) polyubiquitin mRNA, complete cds. |
| 700258303H1 | g21732 | 26 | −10 | gb105pln | Wheat mRNA for Em protein. |
| 700264853H1 | g22284 | 10 | 1 | gb105eukp | Glb1-L; vicilin-like embryo storage protein |
| 700258389H1 | g644491 | 73 | −67 | gb105pln | Corn mRNA for elongation factor 1A. |
| 700267317H1 | g2113818 | 34 | −13 | gb105eukp | AmphiBrf43 |
| 700261776H1 | g22151 | 45 | −16 | gb105pln | *Z. mays* (A188) mRNA for alpha-tubulin 4. |
| 700265622H1 | g454872 | 34 | −55 | gb105pln | Maize mRNA for group 3 Lea protein MGL3, complete cds. |
| 700258381H1 | g1788865 | 10 | 2 | gb105allp | hypothetical 43.1 kD protein in ndk-gcpE intergenic region |
| 700262301H1 | g453857 | 39 | 4 | gb105allp | ubiquitin conjugating enzyme |
| 700259156H2 | g1498052 | 71 | −86 | gb105pln | *Zea mays* ribosomal protein S8 mRNA, complete cds. |
| 700260528H2 | g312611 | 13 | 2 | gb105eukp | HSP |
| 700264527H1 | g468055 | 93 | −89 | gb105pln | *Zea mays* B73 QM protein mRNA, complete cds. |
| 700267778H1 | g556673 | 17 | 6 | gb105allp | heat-shock protein |
| 700265853H1 | g1209316 | 19 | 16 | gb105pln | *Hevea brasiliensis* ethylene-inducible protein (ER1) mRNA, complete cds. |
| 700266464H1 | g452559 | 43 | −61 | gb105pln | *Zea mays* group 3 Lea protein MGL3 mRNA, complete cds. |
| 700267465H1 | g2809251 | 25 | −13 | gb105eukp | F21B7.20 |
| 700266524H1 | g1200160 | 14 | −5 | gb105pln | *T. gesneriana* mRNA for tonoplast intrinsic protein. |
| 700267136H1 | g927238 | 65 | −20 | gb105pln | *Zea mays* globulin1 (Glb1) gene, allele Glb1-Hb, complete cds. |
| 700260508H1 | g22270 | 29 | −4 | gb105pln | Maize mRNA from an embryogenic abscisic acid-inducible gene. |
| 700267283H1 | g22287 | 8 | 6 | gb105allp | vicilin-like embryo storage protein |
| 700263284H1 | g2584787 | 13 | 6 | gb105allp | Aminopeptidase P-like |
| 700264637H1 | g2662475 | 12 | 8 | gb105eukp | DC-ERS2; putative ethylene receptor |
| 700258067H1 | g1694832 | 32 | −48 | gb105pln | *H. vulgare* Per1 gene. |
| 700257245H1 | g1171351 | 25 | −9 | gb105pln | *Oryza sativa* 16 kDa oleosin (ole16) mRNA, complete cds. |
| 700263868H1 | g168419 | 49 | −61 | gb105pln | Maize (*Z. mays*) aldolase mRNA, complete cds. |
| 700258372H1 | g558648 | 18 | 6 | gb105eukp | D-myo-inositol-3-phosphate synthase; EC 5.5.1.4 |
| 700267566H1 | g415316 | 26 | −29 | gb105pln | Rice mRNA for acidic ribosomal protein P0, complete cds. |
| 700207177H1 | g454872 | 34 | −33 | gb105pln | Maize mRNA for group 3 Lea protein MGL3, complete cds. |
| 700262233H1 | g22461 | 53 | −65 | gb105pln | Maize RAB-17 gene. |
| 700262533H1 | g168512 | 50 | −45 | gb105pln | Maize major protein (L3) mRNA from the surface of lipid bodies, 3' end. |
| 700262836H1 | g22324 | 69 | −55 | gb105pln | *Z. mays* mRNA for H2B histone (clone cH2B221). |
| 700264779H1 | g1777706 | 82 | −80 | gb105pln | *Zea mays* 18S ribosomal RNA gene, partial sequence. |
| 700261362H1 | g1161167 | 13 | −0 | gb105eukp | EFE; ethylene-forming enzyme |
| 700263128H1 | g22151 | 44 | 4 | gb105pln | *Z. mays* (A188) mRNA for alpha-tubulin 4. |
| 700266392H1 | g168512 | 43 | −43 | gb105pln | Maize major protein (L3) mRNA from the surface of lipid bodies, 3' end. |
| 700265239H1 | g20163 | 41 | −29 | gb105pln | *O. sativa* Rr15 mRNA for 5S ribosomal RNA. |
| 700267731H1 | g22275 | 82 | −14 | gb105pln | Maize mRNA for ferritin (clone FM1). |
| 700263776H1 | g397400 | 42 | −31 | gb105pln | *B. rapa* mRNA for S phase specific gene. |
| 700264914H1 | g435648 | 65 | −59 | gb105pln | Rice mRNA for gamma-Tip, complete cds. |
| 700259743H1 | g1136741 | 28 | 5 | gb105allp | predicted protein of 548 amino acids |
| 700258280H1 | g2245073 | 17 | 8 | gb105pln | *Arabidopsis thaliana* DNA chromosome 4, ESSA I contig fragment No. 8. |
| 700261940H1 | g22118 | 44 | −74 | gb105pln | *Z. mays* DNA for Adh1-Cm allele. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700263911H1 | g2293565 | 38 | −43 | gb105pln | *Oryza sativa* ADP-ribosylation factor 1 (Os-ARF1) mRNA, complete cds. |
| 700264257H1 | g2624211 | 49 | −17 | gb105pln | *M. acuminata* mRNA; clone pBAN UU131. |
| 700258186H1 | g2253009 | 27 | −12 | gb105pln | *Arabidopsis thaliana* mRNA for MAP3K delta-1 protein kinase, partial. |
| 700267351H1 | g168512 | 45 | −24 | gb105pln | Maize major protein (L3) mRNA from the surface of lipid bodies, 3' end. |
| 700264817H1 | g169474 | 20 | −14 | gb105pln | *S. tuberosum* 3-deoxy-D-arabino-heptulosonate 7-phosphate synthase (aro1) mRNA, complete cds. |
| 700261842H1 | g168512 | 26 | −7 | gb105pln | Maize major protein (L3) mRNA from the surface of lipid bodies, 3' end. |
| 700262526H1 | g2632527 | 10 | 3 | gb105allp | similar to hypothetical proteins |
| 700260452H1 | g536891 | 29 | −12 | gb105pln | Wheat mRNA for protein H2A, complete cds, clone wcH2A-4. |
| 700266822H1 | g1658312 | 64 | 15 | gb105pln | *O. sativa* osr40g2 gene. |
| 700265615H1 | g1550813 | 72 | −93 | gb105pln | *Z. mays* mRNA for acidic ribosomal protein P0. |
| 700265472H1 | g1125690 | 37 | −4 | gb105pln | *S. tuberosum* mRNA for DnaJ protein. |
| 700207221H1 | g510538 | 20 | −30 | gb105pln | *N. tabacum* mRNA for cytochrome b5. |
| 700261025H1 | g973312 | 51 | −27 | gb105pln | *Arabidopsis thaliana* myo-inositol 1-phosphate synthase isozyme-2 mRNA, complete cds. |
| 700257790H1 | g1431621 | 52 | −29 | gb105pln | *T. repens* mRNA for protein kinase. |
| 700259218H1 | g2821954 | 39 | −21 | gb105pln | *Hyoscyamus niger* mRNA for spermidine synthase 1, complete cds. |
| 700262278H1 | g537445 | 24 | −0 | gb105pln | *Arabidopsis thaliana* heat shock protein AtHSP101 (Athsp101) mRNA, complete cds. |
| 700263952H1 | g22119 | 68 | −12 | gb105pln | Maize Adh1-F mRNA for alcohol dehydrogenase. |
| 700264292H1 | g2738751 | 13 | 13 | gb105pln | *Zea mays* sulfate permease mRNA, partial cds. |
| 700266023H1 | g2444420 | 20 | 1 | gb105allp | ribosome-associated protein p40 |
| 700258754H1 | g444044 | 35 | −78 | gb105pln | *Z. mays* mRNA for group 3 Lea protein MGL3. |
| 700266066H1 | g1151134 | 9 | 4 | gb105eukp | permease 1 |
| 700262551H1 | g1345132 | 16 | −1 | gb105eukp | ERECTA; ERECTA |
| 700267455H1 | g1575129 | 39 | −49 | gb105pln | *Zea mays* lumenal binding protein cBiPe3 mRNA, complete cds. |
| 700261179H1 | g416260 | 62 | −23 | gb105pln | Rice mRNA for glutaminyl-tRNA synthetase, partial sequence. |
| 700256796H1 | g1403043 | 62 | −55 | gb105pln | *H. chilense* × *T. turgidum* conv. durum (Tritordeum) mRNA for S-adenosylmethionine decarboxylase. |
| 700267812H1 | g1694832 | 18 | −28 | gb105pln | *H. vulgare* Per1 gene. |
| 700258076H1 | g4026 | 17 | −3 | gb105eukp | NAM8 |
| 700263258H1 | g20412 | 30 | −14 | gb105pln | *P. amygdalus* mRN for alpha-tubulin. |
| 700257539H1 | g687244 | 60 | −22 | gb105pln | *Zea mays* oil body protein 16 kDa oleosin (ole16) gene, complete cds. |
| 700264158H1 | g596079 | 77 | −35 | gb105pln | *Zea mays* thiamine biosynthetic enzyme (thi1-2) mRNA, complete cds. |
| 700266864H1 | g2266661 | 36 | −15 | gb105pln | *Hordeum vulgare* mRNA for 14-3-3 protein (Hv1433c). |
| 700256873H1 | g1336169 | 26 | −23 | gb105pln | *Arabidopsis thaliana* 5'-adenylylphosphosulfate reductase (APR3) mRNA, partial cds. |
| 700260261H1 | g687244 | 42 | −32 | gb105pln | *Zea mays* oil body protein 16 kDa oleosin (ole16) gene, complete cds. |
| 700267436H1 | g168512 | 41 | −39 | gb105pln | Maize major protein (L3) mRNA from the surface of lipid bodies, 3' end. |
| 700258470H1 | g218233 | 30 | −19 | gb105pln | Rice mRNA for NDP kinase (T164 gene), partial sequence. |
| 700267995H1 | g168481 | 8 | 7 | gb105eukp | globulin precursor |
| 700262048H1 | g1575127 | 92 | −22 | gb105pln | *Zea mays* lumenal binding protein cBiPe2 mRNA, complete cds. |
| 700267667H1 | g168480 | 69 | −70 | gb105pln | Maize embryo globulin S allele (7S-like) mRNA, complete cds. |
| 700258007H1 | g1167810 | 17 | −1 | gb105eukp | T22B3.2 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700258651H1 | g22155 | 75 | −71 | gb105pln | Z. mays mRNA for alpha-tubulin 5. |
| 700261247H1 | g19655 | 32 | −17 | gb105pln | M. sativa 26S rRNA. |
| 700264483H1 | g687244 | 93 | −32 | gb105pln | Zea mays oil body protein 16 kDa oleosin (ole16) gene, complete cds. |
| 700267809H1 | g1019398 | 12 | −9 | gb105pln | Yeast (Saccharomyces pombe) chromosome I cosmid c2G11. |
| 700265950H1 | g2293565 | 25 | −39 | gb105pln | Oryza sativa ADP-ribosylation factor 1 (Os-ARF1) mRNA, complete cds. |
| 700258877H1 | g8497 | 16 | −2 | gb105eukp | E(Dfd); SRp55 |
| 700263854H1 | g2665840 | 13 | 7 | gb105allp | putative histone deacetylase RPD3 |
| 700266382H1 | g168512 | 50 | −70 | gb105pln | Maize major protein (L3) mRNA from the surface of lipid bodies, 3' end. |
| 700265218H1 | g2564237 | 17 | 3 | gb105eukp | omega-6 desaturase |
| 700258437H1 | g471320 | 31 | −39 | gb105pln | H. vulgare (cv. Bomi) B15C mRNA. |
| 700262693H1 | g2160155 | 24 | −11 | gb105pln | Sequence of BAC F21M12 from Arabidopsis thaliana chromosome 1, complete sequence. |
| 700265374H1 | g1132482 | 26 | −0 | gb105pln | Rice mRNA for ADP-ribosylation factor, complete cds. |
| 700258506H1 | g21734 | 17 | −23 | gb105pln | T. aestivum (cDNA I) mRNA for EC protein. |
| 700263353H1 | g22272 | 79 | −74 | gb105pln | Maize mRNA for enolase (2-phospho-D-glycerate hydrolase). |
| 700256816H1 | g404866 | 19 | −8 | gb105eukp | allene oxide synthase |
| 700264453H1 | g1561579 | 34 | −11 | gb105eukp | spermine synthase 2; EC 2.5.1.22 |
| 700264702H1 | g602605 | 60 | −51 | gb105pln | Zea mays tandem genes for alpha1-tubulin and alpha2-tubulin. |
| 700266085H1 | g2463334 | 56 | −43 | gb105pln | Oryza sativa mRNA for ribosomal protein S4. |
| 700258532H1 | g488787 | 5 | 7 | gb105eukp | putative imbibition protein |
| 700259658H1 | g218000 | 13 | 11 | gb105pln | Potato mRNA for UDP-glucose pyrophosphorylase (EC 2.7.7.9). |
| 700262031H1 | g2529341 | 24 | 3 | gb105pln | Spinacia oleracea chloroplast transketolase mRNA, complete cds. |
| 700258046H1 | g22283 | 89 | −58 | gb105pln | Zea mays Glb1-L gene for vicilin-like embryo storage protein. |
| 700267040H1 | g2668741 | 56 | −33 | gb105pln | Zea mays glycine-rich RNA binding protein (GRP) mRNA, complete cds. |
| 700256927H1 | g22281 | 36 | −23 | gb105pln | Zea mays Glb1-0 gene for vicilin-like storage protein (truncated). |
| 700263504H1 | g18260 | 57 | 4 | gb105allp | cs DnaJ-1 |
| 700257883H1 | g22292 | 35 | −26 | gb105pln | Z. mays mRNA for glycine-rich protein. |
| 700264610H1 | g2827529 | 12 | 2 | gb105eukp | F8F16.160; putative protein |
| 700266305H1 | g536339 | 23 | −9 | gb105pln | Yeast (Saccharomyces cerevisiae) chromosome II reading frame ORF YBR080c. |
| 700259574H1 | g168480 | 37 | −63 | gb105pln | Maize embryo globulin S allele (7S-like) mRNA, complete cds. |
| 700257693H1 | g168512 | 37 | −9 | gb105pln | Maize major protein (L3) mRNA from the surface of lipid bodies, 3' end. |
| 700261122H1 | g22270 | 74 | −61 | gb105pln | Maize mRNA from an embryogenic abscisic acid-inducible gene. |
| 700264718H1 | g22485 | 20 | −18 | gb105pln | Maize mRNA for sucrose synthase (EC 2.4.1.13). |
| 700262416H1 | g1388076 | 12 | −4 | gb105eukp | TRX3; thioredoxin h |
| 700259210H1 | g2414643 | 14 | −6 | gb105pln | Yeast (Saccharomyces pombe) chromosome I cosmid c3H5. |
| 700261194H1 | g2245136 | 24 | −25 | gb105eukp | trehalose-6-phosphate synthase homolog |
| 700257974H1 | g22281 | 54 | −54 | gb105pln | Zea mays Glb1-0 gene for vicilin-like storage protein (truncated). |
| 700266040H1 | g902585 | 65 | −25 | gb105pln | Zea mays clone MubG9 ubiquitin gene, complete cds. |
| 700256972H1 | g556872 | 29 | 6 | gb105eukp | sen3 |
| 700264459H1 | g57002 | 8 | 5 | gb105allp | pyrimidine binding protein 1 |
| 700258324H1 | g303852 | 65 | −58 | gb105pln | Rice mRNA for ribosomal protein L3, complete cds. |
| 700260273H1 | g1143510 | 35 | −3 | gb105pln | M. domestica Borkh mRNA for serine/threonine protein phosphatase (PPX). |
| 700263169H1 | g722271 | 17 | 12 | gb105pln | Brassica napus chitinase class IV (LSC222) mRNA, partial cds. |
| 700265286H1 | g510676 | 30 | −12 | gb105pln | Triticum aestivium pWR5 RNA |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700257383H1 | g22614 | 40 | −22 | gb105pln | for protochlorophyilide reductase. *S. vulgare* pepC gene for PEP carboxylase. |
| 700264594H1 | g429103 | 59 | −22 | gb105pln | *L. esculentum* S-adenosyl-L-methionine synthetase mRNA, complete CDS. |
| 700266464H1 | g444044 | 43 | −61 | gb105pln | *Z. mays* mRNA for group 3 Lea protein MGL3. |
| 700263613H1 | g2662344 | 50 | −54 | gb105pln | *Oryza sativa* mRNA for EF-1 alpha, complete cds. |
| 700260028H1 | g532111 | 20 | 7 | gb105allp | similar to *D. melanogaster* white protein |
| 700259708H1 | g169818 | 17 | −37 | gb105pln | Rice 25S ribosomal RNA gene. |
| 700263151H1 | g20501 | 6 | 2 | gb105eukp | vicilin-like storage protein |
| 700259428H1 | g168512 | 62 | −1 | gb105pln | Maize major protein (L3) mRNA from the surface of lipid bodies, 3′ end. |
| 700261788H1 | g2791948 | 34 | 2 | gb105eukp | rpl13a; ribosomal protein L13a |
| 700256972H1 | g763271 | 29 | 6 | gb105allp | Sen3p |
| 700260023H1 | g406310 | 31 | −1 | gb105pln | *B. napus* (Topas) clpA mRNA. |
| 700259602H1 | g169326 | 27 | 8 | gb105pln | Bean (*P. vulgaris*) NADP-dependent malic enzyme mRNA, complete cds. |
| 700262871H1 | g433706 | 94 | −47 | gb105pln | *Z. mays* PRP gene. |
| 700263853H1 | g1184771 | 67 | −57 | gb105pln | *Zea mays* glyceraldehyde-3-phosphate dehydrogenase GAPC2 (gpc2) mRNA, complete cds. |
| 700267306H1 | g21802 | 22 | −20 | gb105pln | *T. aestivum* mRNA for high mobility group protein (HMGW). |
| 700261357H1 | g603381 | 14 | −3 | gb105eukp | COX15, Cox15p: Cytochrom oxidase assembly factor |
| 700258850H1 | g868003 | 36 | −7 | gb105eukp | a member for glyoxylate cycle; aconitase; EC 4.2.1.3 |
| 700262858H1 | g2642446 | 20 | 7 | gb105eukp | T20D16.20; similar to auxin-responsive GH3 protein |
| 700267641H1 | g19103 | 45 | −34 | gb105pln | *H. vulgare* mRNA for ribosomal protein L17-2. |
| 700265590H1 | g22342 | 59 | −49 | gb105pln | Maize gene for heat shock protein 70 exon 2 and 3′-UT (hsp70; clone pMON 9502). |
| 700263464H1 | g248338 | 46 | 14 | gb105pln | polyubiquitin [maize, Genomic, 3439 nt]. |
| 700264329H1 | g439197 | 35 | −16 | gb105eukp | Iswi; ISWI protein |
| 700267401H1 | g1314427 | 31 | −26 | gb105pln | *Zea mays* ssp. huehuetenangensis Doebley M031 ITS1, 5.8S ribosomal RNA, ITS2. |
| 700258076H1 | g1899188 | 16 | −4 | gb105eukp | DNA binding protein ACBF |
| 700258664H1 | g804656 | 23 | −12 | gb105eukp | BGQ60; beta-glucosidase |
| 700262511H1 | g22283 | 85 | −77 | gb105pln | *Zea mays* Glb1-L gene for vicilin-like embryo storage protein. |
| 700264780H1 | g596077 | 43 | −41 | gb105pln | *Zea mays* thiamine biosynthetic enzyme (thi1-1) mRNA, complete cds. |
| 700261480H1 | g2641208 | 27 | −1 | gb105pln | *Fritiliaria agrestis* ribosomal protein S16 (rps16) mRNA, complete cds. |
| 700264429H1 | g1070353 | 11 | 0 | gb105pln | *H. vulgare* mRNA for Hv14-3-3b. |
| 700266987H1 | g825783 | 22 | 7 | gb105pln | *Nicotiana tabacum* ribosomal protein L41 mRNA, complete cds. |
| 700266170H1 | g2832620 | 8 | 2 | gb105eukp | F13C5.90; hypothetical protein |
| 700260639H1 | g1296954 | 48 | −53 | gb105pln | *O. sativa* mRNA for novel protein, osr40c1. |
| 700266139H1 | g1658314 | 32 | −7 | gb105pln | *O. sativa* osr40g3 gene. |
| 700256964H1 | g1155264 | 60 | −10 | gb105pln | *Pennisetum ciliare* possible apospory-associated protein mRNA, complete cds. |
| 700263018H1 | g2736514 | 17 | 8 | gb105eukp | T22D1.4 |
| 700264874H1 | g19012 | 25 | −26 | gb105pln | *H. vulgare* mRNA for LEA B19.1 protein. |
| 700267036H1 | g22281 | 56 | −42 | gb105pln | *Zea mays* Glb1-0 gene for vicilin-like storage protein (truncated). |
| 700258885H1 | g722271 | 16 | 13 | gb105pln | *Brassica napus* chitinase class IV (LSC222) mRNA, partial cds. |
| 700266766H1 | g16086 | 26 | −15 | gb105pln | *A. porrum* dnaJ mRNA for DNA J protein (partial). |
| 700265769H1 | g1724111 | 17 | 12 | gb105pln | *Triticum aestivum* ABA induced plasma membrane protein PM-19 (WTABAPM) mRNA, complete cds. |
| 700266540H1 | g644491 | 94 | −43 | gb105pln | Corn mRNA for elongation factor 1A. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700266014H1 | g927239 | 10 | 2 | gb105allp | globulin1 |
| 700257736H1 | g471320 | 23 | 0 | gb105pln | *H. vulgare* (cv. Bomi) B15C mRNA. |
| 700267136H1 | g22283 | 67 | −22 | gb105pln | *Zea mays* Glb1-L gene for vicilin-like embryo storage protein. |
| 700261371H1 | g457708 | 37 | −21 | gb105pln | *S. oleracea* mRNA for protein kinase. |
| 700263437H1 | g1272684 | 100 | −40 | gb105pln | *Z. mays* mRNA for acetyl CoA carboxylase (partial). |
| 700265383H1 | g1871192 | 9 | 5 | gb105eukp | T06D20.20 |
| 700266923H1 | g387908 | 36 | −9 | gb105pln | *Brassica rapa* S-phase-specific (BIS289) mRNA, complete cds. |
| 700256720H1 | g1531594 | 15 | −2 | gb105allp | unknown |
| 700259639H1 | g1553130 | 53 | −48 | gb105pln | *Gossypium hirsutum* ribosomal protein L44 isoform b (RL44), complete cds. |
| 700260554H2 | g21732 | 27 | 7 | gb105pln | Wheat mRNA for Em protein. |
| 700262768H1 | g1171351 | 22 | −6 | gb105pln | *Oryza sativa* 16 kDa oleosin (ole16) mRNA, complete cds. |
| 700265602H1 | g296094 | 45 | −1 | gb105eukp | M(3)95A; ribosomal protein S3 |
| 700261573H1 | g533251 | 85 | −13 | gb105pln | *Zea mays* (clone pSM8) sucrose synthase 2 (Sus1) gene, complete cds. |
| 700259846H1 | g217973 | 19 | −44 | gb105pln | *Zea mays* gene for triosephosphate isomerase, complete cds. |
| 700263268H1 | g1658312 | 17 | −17 | gb105pln | *O. sativa* osr40g2 gene. |
| 700263868H1 | g22144 | 49 | −60 | gb105pln | Maize anaerobically regulated gene for fructose bisphosphate aldolase (EC 4.1.2.13). |
| 700267001H1 | g1694832 | 22 | −35 | gb105pln | *H. vulgare* Per1 gene. |
| 700258168H1 | g1171351 | 29 | −17 | gb105pln | *Oryza sativa* 16 kDa oleosin (ole16) mRNA, complete cds. |
| 700265517H1 | g687244 | 49 | −32 | gb105pln | *Zea mays* oil body protein 16 kDa oleosin (oIe16) gene, complete cds. |
| 700267492H1 | g558648 | 23 | 3 | gb105eukp | D-myo-inositol-3-phosphate synthase; EC 5.5.1.4 |
| 700256848H1 | g458557 | 5 | 8 | gb105eukp | YLA1; La homolog |
| 700258749H1 | g633680 | 28 | −18 | gb105pln | *S. tuberosum* (Desiree) cr14 mRNA. |
| 700257383H1 | g22415 | 31 | −4 | gb105pln | Maize mRNA for phosphoenolpyruvate carboxylase (PEPCase EC 4.1.1.31). |
| 700263146H1 | g902524 | 62 | −2 | gb105pln | *Zea mays* clone MubG10 ubiquitin fusion protein gene, complete cds. |
| 700263701H1 | g1181330 | 49 | −60 | gb105pln | *Z. mays* CNX mRNA. |
| 700264838H1 | g687246 | 26 | −3 | gb105pln | *Zea mays* oil body protein 17 kDa oleosin (ole17) gene, complete cds. |
| 700267065H1 | g450549 | 33 | 6 | gb105eukp | S-adenosyl methionine synthetase |
| 700266447H1 | g22237 | 99 | −92 | gb105pln | Maize mRNA for cytosolic GAPDH (GapC) glyceraldehyde-3-phosphate dehydrogenase. |
| 700258790H1 | g2781361 | 17 | 4 | gb105allp | F24O1.17 |
| 700263282H1 | g22237 | 98 | −89 | gb105pln | Maize mRNA for cytosolic GAPDH (GapC) glyceraldehyde-3-phosphate dehydrogenase. |
| 700267434H1 | g927239 | 6 | 7 | gb105allp | globulin1 |
| 700258687H1 | g2253156 | 14 | −2 | gb105allp | Ran_GTP binding protein 5 |
| 700257641H1 | g471320 | 35 | −12 | gb105pln | *H. vulgare* (cv. Bomi) B15C mRNA. |
| 700260015H1 | g695625 | 11 | 8 | gb105allp | CCTtheta, theta subunit of the chaperonin containing TCP-1 (CCT) |
| 700266136H1 | g1747293 | 54 | −49 | gb105pln | Rice mRNA for vacuolar H+-pyrophosphatase, complete cds. |
| 700267210H1 | g1742800 | 8 | 7 | gb105allp | ORF_ID:o322#7; similar to [SwissProt Accession Number Q06373]. |
| 700262959H1 | g963061 | 55 | −37 | gb105pln | *H. vulgare* Ole-1 mRNA for oleosin. |
| 700258449H1 | g20359 | 100 | −26 | gb105pln | Rice gene for 17S ribosomal RNA. |
| 700263101H1 | g475257 | 45 | 6 | gb105eukp | similar to ribosomal protein L19; ctg start codon. putative |
| 700258134H1 | g168480 | 39 | −43 | gb105pln | Maize embryo globulin S allele (7S-like) mRNA, complete cds. |
| 700207258H1 | g1814402 | 48 | −13 | gb105pln | *Mesembryanthemum crystallinum* methionine synthase (MetE) mRNA, complete cds. |
| 700265272H1 | g2274990 | 55 | −62 | gb105pln | *Hordeum vulgare* mRNA for expressed sequence tag. |
| 700262653H1 | g217973 | 36 | −62 | gb105pln | *Zea mays* gene for triosephosphate isomerase, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264747H1 | g20726 | 29 | −15 | gb105pln | *P. sativum* GA mRNA (clone F). |
| 700265385H1 | g2104681 | 25 | 1 | gb105eukp | transcription factor |
| 700256961H1 | g1236654 | 27 | 5 | gb105allp | leucine aminopeptidase |
| 700257357H1 | g18260 | 16 | 1 | gb105eukp | cs DnaJ-1 |
| 700264392H1 | g790507 | 73 | −28 | gb105pln | *Z. mays* mRNA for 60S acidic ribosomal protein. |
| 700268017H1 | g1777454 | 37 | −54 | gb105pln | *Oryza sativa* pyruvate decarboxylase 2 (pdc2) gene, complete cds. |
| 700261386H1 | g790641 | 19 | 1 | gb105allp | gamma-thionin |
| 700266281H1 | g510931 | 33 | −26 | gb105pln | *V. faba* mRNA for alpha 1,4-glucan phosphorylase type H. |
| 700257186H1 | g1403043 | 21 | 9 | gb105pln | *H. chilense* x T turgidum conv. durum (Tritordeum) mRNA for S-adenosylmethionine decarboxylase. |
| 700262027H1 | g1513227 | 39 | −27 | gb105pln | *Brassica napus* myo-inositol 1-phosphate synthase mRNA, complete cds. |
| 700264623H1 | g349405 | 16 | −27 | gb105pln | *Brassica napus* (clone BnNa) DNA sequence. |
| 700259216H1 | g1086831 | 13 | −10 | gb105eukp | F10E7.7 |
| 700264504H1 | g22287 | 8 | 7 | gb105allp | vicilin-like embryo storage protein |
| 700266180H1 | g600768 | 39 | −31 | gb105pln | *Oryza sativa* cyclophilin 2 (Cyp2) mRNA, complete cds. |
| 700264733H1 | g758246 | 40 | −31 | gb105pln | *Phalaenopsis* sp. mRNA for S-adenosyhomocysteine hydrolase. |
| 700262329H1 | g575730 | 56 | −61 | gb105pln | *Z. mays* mRNA for transmembrane protein. |
| 700264083H1 | g432367 | 27 | −37 | gb105pln | Rice mRNA for elongation factor 1 beta, complete cds. |
| 700265288H1 | g459894 | 73 | −81 | gb105pln | *Zea mays* sus1 gene, complete cds. |
| 700266888H1 | g18748 | 17 | 5 | gb105eukp | a protein similar to potato tuber protein p322 homolgous to Bowman-Birk Proteinase Inhibitor |
| 700263890H1 | g451192 | 54 | −33 | gb105pln | *Triticum aestivum* (wal17) mRNA, 3' end, partial cds. |
| 700262912H1 | g1706958 | 47 | −13 | gb105eukp | celA2; cellulose synthase |
| 700262667H1 | g170458 | 14 | 4 | gb105allp | threonine deaminase |
| 700260796H1 | g1184771 | 79 | −11 | gb105pln | *Zea mays* glyceraldehyde-3-phosphate dehydrogenase GAPC2 (gpc2) mRNA, complete cds. |
| 700260970H1 | g687244 | 37 | −63 | gb105pln | *Zea mays* oil body protein 16 kDa oleosin (ole16) gene, complete cds. |
| 700267533H1 | g1431618 | 48 | −2 | gb105eukp | ribosomal protein L27a |
| 700258418H1 | g2266661 | 11 | 14 | gb105pln | *Hordeum vulgare* mRNA for 14-3-3 protein (Hv1433c). |
| 700262438H1 | g963095 | 17 | −4 | gb105eukp | 60S ribosomal protein L13A |
| 700264745H1 | g22283 | 82 | 5 | gb105pln | *Zea mays* Glb1-L gene for vicilin-like embryo storage protein. |
| 700265507H1 | g687244 | 33 | −35 | gb105pln | *Zea mays* oil body protein 16 kDa oleosin (ole16) gene, complete cds. |
| 700257146H1 | g687244 | 53 | −82 | gb105pln | *Zea mays* oil body protein 16 kDa oleosin (ole16) gene, complete cds. |
| 700266514H1 | g168602 | 93 | −88 | gb105pln | *Zea mays* regulatory protein GF14-12 mRNA, complete cds. |
| 700258884H1 | g2668741 | 52 | −20 | gb105pln | *Zea mays* glycine-rich RNA binding protein (GRP) mRNA, complete cds. |
| 700264357H1 | g22281 | 43 | −32 | gb105pln | *Zea mays* Glb1-0 gene for vicilin-like storage protein (truncated). |
| 700266570H1 | g21734 | 17 | 6 | gb105pln | *T. aestivum* (cDNA I) mRNA for EC protein. |
| 700257332H1 | g1702955 | 13 | 0 | gb105eukp | unknown ORF |
| 700258884H1 | g2293479 | 38 | −9 | gb105pln | *Oryza sativa* glycine-rich protein mRNA, complete cds. |
| 700258982H1 | g21233 | 32 | −47 | gb105pln | *S. oleracea* AHRI mRNA for acetohydroxy acid reductoisomerase. |
| 700264641H1 | g2245038 | 16 | −4 | gb105eukp | hypothetical protein |
| 700259337H1 | g2463334 | 30 | −42 | gb105pln | *Oryza sativa* mRNA for ribosomal protein S4. |
| 700266240H1 | g22324 | 64 | −51 | gb105pln | *Z. mays* mRNA for H2B nistone (clone cH2B221). |
| 700261695H1 | g1296806 | 17 | −29 | gb105pln | *H. vulgare* xylose isomerase gene. |
| 700264296H1 | g347527 | 26 | 2 | gb105allp | ribosomal protein S3 |
| 700267451H1 | g1658314 | 30 | −10 | gb105pln | *O. sativa* osr40g3 gene. |
| 700257528H1 | g168480 | 87 | −32 | gb105pln | Maize embryo globulin S allele |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | (7S-like) mRNA, complete cds. |
| 700259549H1 | g22635 | 48 | −48 | gb105pln | *P. vulgaris* mRNA for 70 kD heat shock protein. |
| 700266107H1 | g498738 | 67 | −73 | gb105pln | *H. vulgare* (pMaW20) pseudo mRNA for beta-ketoacyl-ACP synthase (partial). |
| 700264058H1 | g168512 | 65 | −75 | gb105pln | Maize major protein (L3) mRNA from the surface of lipid bodies, 3' end. |
| 700264173H1 | g391884 | 24 | −51 | gb105pln | Rice DNA for VP1 protein, complete cds. |
| 700267432H1 | g515428 | 24 | 1 | gb105allp | S-phase-specific protein |
| 700262411H1 | g2345153 | 47 | −61 | gb105pln | *Zea mays* ribsomal protein S4 (rps4) mRNA, complete cds. |
| 700261160H1 | g167080 | 31 | −25 | gb105pln | *Hordeum vulgare* peroxidase BP 1 (Prx5) mRNA, complete cds. |
| 700267372H1 | g1839244 | 47 | −19 | gb105eukp | EGF receptor like protein |
| 700266550H1 | g1296954 | 36 | −37 | gb105pln | *O. sativa* mRNA for novel protein, osr40c1. |
| 700260157H1 | g22287 | 7 | 6 | gb105allp | vicilin-like embryo storage protein |
| 700263405H1 | g2565420 | 24 | −20 | gb105pln | *Onobrychis viciifolia* eukaryotic translation initiation factor eIF-1A mRNA, complete cds. |
| 700267449H1 | g1486471 | 19 | −7 | gb105pln | *S. tuberosum* mRNA for oxoglutarate malate translocator. |
| 700265072H1 | g1143863 | 60 | −53 | gb105pln | *Oryza sativa* beta-glucosidase mRNA, nuclear gene encoding chloroplast protein, complete cds. |
| 700258437H1 | g971279 | 30 | −35 | gb105pln | Rice mRNA for RAB24 protein, complete cds. |
| 700258654H1 | g312178 | 31 | −76 | gb105pln | *Z. mays* GapC2 gene. |
| 700259039H1 | g410484 | 16 | −3 | gb105eukp | chorismate synthase 2; EC 4.6.1.4 |
| 700268133H1 | g1236986 | 12 | 4 | gb105allp | Skip |
| 700256916H1 | g495866 | 4 | 8 | gb105allp | collagen type VII |
| 700264527H1 | g575354 | 68 | −66 | gb105pln | *O. sativa* SC34 mRNA for tumor suppressor. |
| 700267001H1 | g471320 | 38 | −38 | gb105pln | *H. vulgare* (cv. Bomi) B15C mRNA. |
| 700261830H1 | g599722 | 45 | −16 | gb105pln | *C. melo* mRNA for aconitase (UNI-ZAPxR). |
| 700262740H1 | g2702284 | 21 | −18 | gb105eukp | T21L14.12; Argonaute (AGO1)-like protein |
| 700265039H1 | g22284 | 6 | 7 | gb105allp | vicilin-like embryo storage protein |
| 700257308H1 | g469067 | 4 | 6 | gb105allp | NMDA receptor subunit NR2D |
| 700264635H1 | g2769700 | 15 | 6 | gb105allp | peroxisomal-like protein |
| 700262260H1 | g862479 | 28 | −30 | gb105pln | Glycine max valosin-containing protein mRNA, complete cds. |
| 700266286H1 | g2462749 | 35 | −21 | gb105eukp | F8A5.31; Putative Serine/Threonine protein kinase |
| 700258432H1 | g1575127 | 58 | −69 | gb105pln | *Zea mays* lumenal binding protein cBiPe2 mRNA, complete cds. |
| 700258559H1 | g1497983 | 19 | 2 | gb105eukp | alien; putative thyroid receptor interacting protein |
| 700260122H1 | g927239 | 6 | 7 | gb105allp | globulin1 |
| 700263117H1 | g1805617 | 47 | −0 | gb105eukp | OSH45 |
| 700266538H1 | g22283 | 61 | −57 | gb105pln | *Zea mays* Glb1-L gene for vicilin-like embryo storage protein. |
| 700266819H1 | g987122 | 64 | −27 | gb105pln | *Z. mays* mRNA for class II metallothionein. |
| 700262113H1 | g166548 | 63 | −52 | gb105pln | *Avena sativa* vacuolar H+-ATPase 16 kDa proteolipid subunit (vatp-P1) mRNA, complete cds. |
| 700259835H1 | g169914 | 39 | −27 | gb105pln | Glycine max (clone pSAT17) aspartate aminotransferase mRNA, complete cds. |
| 700265218H1 | g2501790 | 20 | 2 | gb105eukp | omega-6 fatty acid desaturase |
| 700265461H1 | g472902 | 14 | 0 | gb105eukp | carrier protein (c1) |
| 700265486H1 | g21856 | 25 | −51 | gb105pln | Wheat rDNA 25S-18S intergenic region EcoRI-BamHI fragment. |
| 700266553H1 | g286238 | 4 | 7 | gb105allp | N-methyl-D-aspartate receptor subunit |
| 700257965H1 | g2293565 | 16 | 8 | gb105pln | *Oryza sativa* ADP-ribosylation factor 1 (Os-ARF1) mRNA, complete cds. |
| 700259190H2 | g2661608 | 14 | −4 | gb105eukp | SPAC10F6.03c; hypothetical ctp synthase |
| 700262570H1 | g2696018 | 43 | −25 | gb105pln | *Arabidopsis thaliana* genomic |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700263122H1 | g2668741 | 56 | −5 | gb105pln | DNA, chromosome 5, P1 clone: MXC9. Zea mays glycine-rich RNA binding protein (GRP) mRNA, complete cds. |
| 700258701H1 | g1103627 | 34 | −38 | gb105pln | Z. mays Fer1 gene. |
| 700264660H1 | g471320 | 33 | −11 | gb105pln | H. vulgare (cv. Bomi) B15C mRNA. |
| 700260027H1 | g410488 | 39 | 6 | gb105eukp | phospho-2-dehydro-3-deoxyheptonate aldolase; EC 4.1.2.15; DAHP synthase 2 |
| 700264320H1 | g168502 | 79 | −63 | gb105pln | Maize (Zea mays) histone H4 gene (H4C7), complete cds. |
| 700263122H1 | g2293479 | 44 | 1 | gb105pln | Oryza sativa glycine-rich protein mRNA, complete cds. |
| 700262729H1 | g927238 | 63 | −26 | gb105pln | Zea mays globulin1 (Glb1) gene, allele Glb1-Hb, complete cds. |
| 700264660H1 | g1694832 | 34 | −13 | gb105pln | H. vulgare Per1 gene. |
| 700265837H1 | g2605714 | 13 | 8 | gb105allp | beta-tonoplast intrinsic protein |
| 700258018H1 | g2246376 | 23 | −3 | gb105eukp | b-Zip DNA binding protein |
| 700259357H1 | g16268 | 19 | 0 | gb105pln | A. thaliana mRNA for Eli3-2. |
| 700261161H1 | g168512 | 27 | −13 | gb105pln | Maize major protein (L3) mRNA from the surface of lipid bodies, 3' end. |
| 700258423H1 | g2668737 | 64 | −80 | gb105pln | Zea mays translation initiation factor 5A (TIF5A) mRNA, complete cds. |
| 700262747H1 | g2104679 | 28 | 2 | gb105eukp | transcription factor |
| 700262494H1 | g600768 | 50 | −41 | gb105pln | Oryza sativa cyclophilin 2 (Cyp2) mRNA, complete cds. |
| 700262592H1 | g1495250 | 29 | −16 | gb105pln | A. thaliana mRNA for heat-shock protein. |
| 700262757H1 | g516838 | 42 | −20 | gb105pln | Rice mRNA for catalase, complete cds. |
| 700257569H1 | g1354271 | 33 | −19 | gb105pln | Arabidopsis thaliana aspartic proteinase mRNA, partial cds. |
| 700263917H1 | g1136228 | 11 | −5 | gb105allp | UV-damaged DNA binding factor |
| 700261582H1 | g1159945 | 5 | 7 | gb105eukp | M18.5 |
| 700262893H1 | g2245069 | 22 | 5 | gb105eukp | hypothetical protein |
| 700263238H1 | g20255 | 43 | −22 | gb105pln | O. sativa gene for heat shock protein 82 HSP82. |
| 700258361H1 | g167385 | 14 | 8 | gb105allp | storage protein |
| 700262728H1 | g2827142 | 50 | −38 | gb105pln | Arabidopsis thaliana cellulose synthase catalytic subunit (Ath-B) mRNA, complete cds. |
| 700266979H1 | g22283 | 82 | −75 | gb105pln | Zea mays Glb1-L gene for vicilin-like embryo storage protein. |
| 700258389H1 | g644492 | 73 | −67 | gb105pln | Corn elongation factor 1alpha gene, complete cds. |
| 700207103H1 | g1389639 | 25 | 1 | gb105pln | Pea mRNA for PNDRN1, complete cds. |
| 700258667H1 | g2827635 | 16 | 0 | gb105eukp | F10N7.170; predicted protein |
| 700264048H1 | g168512 | 29 | 8 | gb105pln | Maize major protein (L3) mRNA from the surface of lipid bodies, 3' end. |
| 700265516H1 | g20266 | 46 | −39 | gb105pln | O. sativa mRNA for lipoxygenase L-2. |
| 700266554H1 | g687244 | 67 | −38 | gb105pln | Zea mays oil body protein 16 kDa oleosin (ole16) gene, complete cds. |
| 700262095H1 | g2463334 | 62 | −34 | gb105pln | Oryza sativa mRNA for ribosomal protein S4. |
| 700267211H1 | g22151 | 94 | −48 | gb105pln | Z. mays (A188) mRNA for alpha-tubulin 4. |
| 700261339H1 | g975887 | 40 | −16 | gb105pln | Mesembryanthemum crystallinum myo-inositol-1-phosphate synthase mRNA, complete cds. |
| 700263340H1 | g1276945 | 21 | −6 | gb105pln | Daucus carota globulin-like protein mRNA, somatic embryo clone Gea8, complete cds. |
| 700264606H1 | g1408470 | 16 | 9 | gb105pln | Arabidopsis thaliana actin depolymerizing factor 1 (AtADF1) mRNA, complete cds. |
| 700263108H1 | g687244 | 93 | −21 | gb105pln | Zea mays oil body protein 16 kDa oleosin (ole16) gene, complete cds. |
| 700259474H1 | g168665 | 63 | −16 | gb105pln | Maize 16- kDa zein-2 mRNA, complete cds. |
| 700262018H1 | g499011 | 53 | −41 | gb105pln | S. vulgare SoAc1 mRNA. |
| 700262379H1 | g310934 | 48 | −10 | gb105pln | Nicotiana tabacum ribosomal protein L25, complete cds. |
| 700259208H1 | g169474 | 35 | −38 | gb105pln | S. tuberosum 3-deoxy-D-arabino-heptulosonate 7-phosphate |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | synthase (aro1) mRNA, complete cds. |
| 700263085H1 | g899607 | 83 | −45 | gb105pln | Zea mays polyubiquitin (MubC5) mRNA, complete cds. |
| 700263173H1 | g1658312 | 51 | −7 | gb105pln | O. sativa osr40g2 gene. |
| 700207256H1 | g1218003 | 42 | −4 | gb105pln | Glycine max dynamin-like protein SDL5A mRNA, complete cds. |
| 700261524H1 | g21075 | 28 | 2 | gb105pln | Ricinus communis mRNA for malate synthase (EC 4.1.3.2). |
| 700267002H1 | g436051 | 65 | −41 | gb105pln | Rice mRNA for branching enzyme-3, complete cds. |
| 700257309H1 | g312178 | 31 | −72 | gb105pln | Z. mays GapC2 gene. |
| 700268010H1 | g2398680 | 37 | −30 | gb105pln | Morinda citrifolia mRNA for 3-deoxy-D-arabino-heptulosonate 7-phosphate synthase, DS2. |
| 700266018H1 | g388928 | 56 | −26 | gb105pln | Zea mays calcium dependent protein kinase (CDPK) mRNA, partial cds. |
| 700260962H1 | g2773184 | 24 | −6 | gb105eukp | F33D11.10 |
| 700262670H1 | g460839 | 37 | 1 | gb105allp | Rab7 related GTP binding protein |
| 700263545H1 | g293888 | 55 | 4 | gb105pln | Zea mays, glyceraldehyde-3-phosphate dehydrogenase mRNA, 3' end (clone GAPC2). |
| 700265207H1 | g2392024 | 35 | −38 | gb105pln | Cucurbita sp. mRNA for stromal ascorbate peroxidase, complete cds. |
| 700262715H1 | g1915974 | 27 | −17 | gb105eukp | FK; fructokinase; EC 2.7.1.4 |
| 700264745H1 | g927238 | 82 | 5 | gb105pln | Zea mays globulin1 (Glb1) gene, allele Glb1-Hb, complete cds. |
| 700261694H1 | g1651885 | 5 | 7 | gb105allp | transaldolase |
| 700260162H1 | g1486502 | 21 | 12 | gb105pln | Oryza sativa LEA-like protein mRNA, embryo-specific clone Ose730, complete cds. |
| 700267247H1 | g687246 | 18 | 5 | gb105pln | Zea mays oil body protein 17 kDa oleosin (ole17) gene, complete cds. |
| 700257343H1 | g471320 | 37 | −17 | gb105pln | H. vulgare (cv. Bomi) B15C mRNA. |
| 700264006H1 | g471320 | 31 | −4 | gb105pln | H. vulgare (cv. Bomi) B15C mRNA. |
| 700257736H1 | g971279 | 24 | −1 | gb105pln | Rice mRNA for RAB24 protein, complete cds. |
| 700261890H1 | g168512 | 21 | 13 | gb105pln | Maize major protein (L3) mRNA from the surface of lipid bodies, 3' end. |
| 700264614H1 | g168508 | 55 | −76 | gb105pln | Maize oleosin KD18 (KD18; L2) gene, complete cds. |
| 700261063H1 | g1835728 | 36 | −29 | gb105pln | Oryza sativa ribosomal protein mRNA, complete cds. |
| 700266507H1 | g204002 | 13 | 3 | gb105allp | translational initiation factor eIP-2, alpha subunit |
| 700262436H1 | g168480 | 49 | −66 | gb105pln | Maize embryo globulin S allele (7S-like) mRNA, complete cds. |
| 700261995H1 | g1922272 | 38 | −0 | gb105eukp | isocitrate dehydrogenase (NADP+); EC 1.1.1.42 |
| 700258508H1 | g2293479 | 24 | −2 | gb105pln | Oryza sativa glycine-rich protein mRNA, complete cds. |
| 700259039H1 | g18256 | 18 | −2 | gb105eukp | chorismate synthase; EC 4.6.1.4 |
| 700268141H1 | g22283 | 60 | −72 | gb105pln | Zea mays Glb1-L gene for vicilin-like embryo storage protein. |
| 700263074H1 | g2352492 | 29 | −7 | gb105eukp | TIR1; transport inhibitor response 1 |
| 700260982H1 | g22283 | 85 | −57 | gb105pln | Zea mays Glb1-L gene for vicilin-like embryo storage protein. |
| 700258570H1 | g398327 | 6 | 7 | gb105eukp | Binding to the poly(A)-tail of eukaryotic mRNAs; poly(A)-mRNA binding protein; PABP |
| 700257211H1 | g984964 | 18 | −4 | gb105eukp | SIK1; suppressor of toxicity of GAL4-IKB; Sik1p |
| 700262372H1 | g2662048 | 6 | 4 | gb105eukp | BcRK1; receptor kinase 1 |
| 700259519H1 | g1575129 | 43 | −24 | gb105pln | Zea mays lumenal binding protein cBiPe3 mRNA, complete cds. |
| 700267435H1 | g22281 | 42 | −25 | gb105pln | Zea mays Glb1-0 gene for vicilin-like storage protein (truncated). |
| 700258133H1 | g473976 | 66 | −54 | gb105pln | Rice mRNA, partial homologous to elongation factor 1-alpha gene. |
| 700256783H1 | g1130617 | 36 | −10 | gb105eukp | F11A10.2 |
| 700260232H1 | g461035 | 26 | −5 | gb105allp | c6.1A [mice, Peptide, 292 aa]. |
| 700265829H1 | g975887 | 37 | −38 | gb105pln | Mesembryanthemum crystallinum |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | myo-inositol-1-phosphate synthase mRNA, complete cds. |
| 700263465H1 | g415314 | 47 | −51 | gb105pln | Rice mRNA for NADP dependent malic enzyme, complete cds. |
| 700264251H1 | g2668741 | 56 | −29 | gb105pln | Zea mays glycine-rich RNA binding protein (GRP) mRNA, complete cds. |
| 700267023H1 | g168512 | 28 | −13 | gb105pln | Maize major protein (L3) mRNA from the surface of lipid bodies, 3' end. |
| 700266289H1 | g439653 | 24 | −4 | gb105pln | G. hirsutum mRNA for ribosomal protein 16, small subunit. |
| 700257588H1 | g2145472 | 37 | −19 | gb105pln | S. tuberosum mRNA for aconitase/aconitate hydratase. |
| 700262139H1 | g687244 | 43 | −66 | gb105pln | Zea mays oil body protein 16 kDa oleosin (ole16) gene, complete cds. |
| 700263262H1 | g168512 | 34 | −42 | gb105pln | Maize major protein (L3) mRNA from the surface of lipid bodies, 3' end. |
| 700267254H1 | g168480 | 38 | −69 | gb105pln | Maize embryo globulin S allele (7S-like) mRNA, complete cds. |
| 700264250H1 | g533251 | 43 | −57 | gb105pln | Zea mays (clone pSM8) sucrose synthase 2 (Sus1) gene, complete cds. |
| 700257641H1 | g971279 | 36 | −12 | gb105pln | Rice mRNA for RAB24 protein, complete cds. |
| 700207111H1 | g347715 | 18 | −0 | gb105eukp | shows 46% identity to human placental protein 15 (PP15) |
| 700262191H1 | g1658312 | 42 | 14 | gb105pln | O. sativa osr40g2 gene. |
| 700267911H1 | g22118 | 45 | −82 | gb105pln | Z. mays DNA for Adh1-Cm allele. |
| 700258915H1 | g1946264 | 20 | 7 | gb105pln | O. sativa mRNA for myb factor, 1202 bp. |
| 700256818H1 | g1143863 | 51 | −45 | gb105pln | Oryza sativa beta-glucosidase mRNA, nuclear gene encoding chloroplast protein, complete cds. |
| 700267204H1 | g600768 | 56 | −52 | gb105pln | Oryza sativa cyclophilin 2 (Cyp2) mRNA, complete cds. |
| 700257579H1 | g516166 | 25 | 7 | gb105allp | 34 kDA porin |
| 700267206H1 | g10399 | 26 | 3 | gb105eukp | ald orfU protein (AA 1–190) |
| 700262125H1 | g20881 | 10 | 7 | gb105eukp | CL9 ribosomal preprotein (AA −34 to 160) |
| 700258727H1 | g1403043 | 12 | 8 | gb105pln | H. chilense × T. turgidum conv. durum (Tritordeum) mRNA for S-adenosylmethionine decarboxylase. |
| 700262633H1 | g2828266 | 25 | −6 | gb105pln | Arabidopsis thaliana mRNA for geranylgeranyl reductase. |
| 700264620H1 | g1890576 | 47 | −5 | gb105pln | H. vulgare mRNA for xyloglucan endotransglycosylase-like protein (XEB). |
| 700266446H1 | g22281 | 58 | −56 | gb105pln | Zea mays Glb1-0 gene for vicilin-like storage protein (truncated). |
| 700257827H1 | g1125690 | 16 | 17 | gb105pln | S. tuberosum mRNA for DnaJ protein. |
| 700264372H1 | g927238 | 42 | −83 | gb105pln | Zea mays globulin1 (Glb1) gene, allele Glb1-Hb, complete cds. |
| 700267550H1 | g633889 | 55 | −38 | gb105pln | glucose and ribitol dehydrogenase homolog [Hordeum vulgare = barley, Aura, embryo, mRNA, 1170 nt]. |
| 700266289H1 | g538427 | 64 | −49 | gb105pln | Oryza sativa ribosomal protein S16 mRNA, complete cds. |
| 700262705H1 | g2829911 | 19 | −2 | gb105eukp | F22K20.10 |
| 700261940H1 | g22119 | 79 | −78 | gb105pln | Maize Adh1-F mRNA for alcohol dehydrogenase. |
| 700262428H1 | g2827651 | 23 | −11 | gb105eukp | E18F4.70; putative protein |
| 700259044H1 | g1184820 | 9 | 6 | gb105allp | aldose reductase |
| 700260744H1 | g2252634 | 21 | −7 | gb105eukp | T19D16.28 |
| 700265689H1 | g168480 | 31 | 5 | gb105pln | Maize embryo globulin S allele (7S-like) mRNA, complete cds. |
| 700262312H1 | g1022804 | 55 | −52 | gb105pln | Arabidopsis thaliana phosphoglycerate kinase mRNA, partial cds. |
| 700264406H1 | g1513227 | 19 | 0 | gb105pln | Brassica napus myo-inositol 1-phosphate synthase mRNA, complete cds. |
| 700256875H1 | g2225978 | 5 | 7 | gb105allp | probable dehydrogenase |
| 700267088H1 | g248336 | 77 | −77 | gb105pln | polyubiquitin [maize, Genomic, 3841 nt]. |
| 700268071H1 | g2677829 | 34 | −22 | gb105pln | Prunus armeniaca ribosomal protein L12 mRNA, complete cds. |
| 700259667H1 | g396209 | 26 | −5 | gb105pln | S. polyrrhiza mRNA for D-myo-inositol-3-phosphate synthase. |
| 700262346H1 | g471320 | 48 | −51 | gb105pln | H. vulgare (cv. Bomi) B15C mRNA. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700267788H1 | g22285 | 53 | 8 | gb105pln | *Zea mays* Glb1-S gene for vicilin-like embryo storage protein. |
| 700258154H1 | g168481 | 7 | 8 | gb105allp | globulin precursor |
| 700267241H1 | g644492 | 29 | −8 | gb105pln | Corn elongation factor 1alpha gene, complete cds. |
| 700267236H1 | g1592681 | 8 | 5 | gb105eukp | LEA D113 homologue type2 |
| 700265216H1 | g167112 | 37 | −1 | gb105pln | *Bromus inermis* aldose reductase-related protein, complete cds. |
| 700258341H1 | g402551 | 42 | −25 | gb105pln | *A. thaliana* gene for acetohydroxy acid isomeroreductase. |
| 700262577H1 | g2792155 | 14 | −0 | gb105eukp | chalcone reductase |
| 700262728H1 | g2827138 | 30 | −28 | gb105pln | *Arabidopsis thaliana* cellulose synthase catalytic subunit (RSW1) gene, complete cds. |
| 700256846H1 | g248338 | 44 | −35 | gb105pln | polyubiquitin [maize, Genomic, 3439 nt]. |
| 700259605H1 | g2267596 | 50 | −26 | gb105pln | *Oryza sativa* 10 kDa chaperonin mRNA, complete cds. |
| 700262423H1 | g1737491 | 22 | −13 | gb105pln | *Triticum aestivum* poly(A)-binding protein (wheatpab) mRNA, complete cds. |
| 700257017H1 | g2244950 | 16 | 7 | gb105pln | *Arabidopsis thaliana* DNA chromosome 4, ESSA I contig fragment No. 5. |
| 700266537H1 | g415316 | 57 | −47 | gb105pln | Rice mRNA for acidic ribosomal protein P0, complete cds. |
| 700264825H1 | g596077 | 22 | −21 | gb105pln | *Zea mays* thiamine biosynthetic enzyme (thi1-1) mRNA, complete cds. |
| 700264369H1 | g516102 | 15 | 7 | gb105pln | Soybean phytochrome B (phyB) gene exons 1–5, complete cds. |
| 700266089H1 | g1737490 | 15 | −2 | gb105allp | p76 |
| 700259645H1 | g871515 | 38 | −6 | gb105eukp | Psst70; Psst70 (stress 70 protein) |
| 700262516H1 | g602784 | 45 | −18 | gb105eukp | M106.1 |
| 700258750H1 | g722271 | 12 | 13 | gb105pln | *Brassica napus* chitinase class IV (LSC222) mRNA, partial cds. |
| 700262966H1 | g939749 | 39 | −6 | gb105eukp | LPZ15c; Lpz15p |
| 700265768H1 | g416460 | 9 | −2 | gb105allp | unidentified protein |
| 700263001H1 | g296204 | 29 | −8 | gb105eukp | pAlaAT-2; alanine aminotransferase; EC 2.6.1.2 |
| 700264457H1 | g2267592 | 42 | −21 | gb105pln | *Oryza sativa* glycine-rich RNA-binding protein mRNA, complete cds. |
| 700267568H1 | g1113941 | 12 | 1 | gb105eukp | unknown; Pv42p |
| 700259322H1 | g606966 | 25 | 0 | gb105allp | plasma membrane Ca2+-ATPase isoform 4 |
| 700266391H1 | g1870198 | 49 | −39 | gb105pln | *Z. mays* mRNA for acyl carrier protein. |
| 700263155H1 | g633632 | 14 | 4 | gb105allp | probable thioredoxin |
| 700267791H1 | g1100224 | 30 | −22 | gb105pln | *Pinus sylvestris* chloroplast NAD+-dependent glyceraldehyde-3-phosphate dehydrogenase mRNA, complete cds. |
| 700266993H1 | g2267592 | 37 | −19 | gb105pln | *Oryza sativa* glycine-rich RNA-binding protein mRNA, complete cds. |
| 700257055H1 | g1302034 | 25 | −11 | gb105eukp | DBP2 |
| 700257937H1 | g218334 | 48 | −38 | gb105pln | *Triticum aestivum* mRNA for O-acetylserine (thiol) lyase. |
| 700257689H1 | g403218 | 23 | 5 | gb105allp | Transplantation Antigene |
| 700267713H1 | g2632129 | 12 | 4 | gb105eukp | PARP; secondary protein modification; poly(ADP-ribose) polymerase |
| 700259380H1 | g1652971 | 7 | 3 | gb105allp | hypothetical protein |
| 700262005H1 | g169834 | 55 | −43 | gb105pln | Rye 26S rRNA 3' end and 18S rRNA, 5' end. |
| 700259485H1 | g16878 | 36 | 6 | gb105allp | 60S ribosomal protein L5 |
| 700267001H1 | g971279 | 37 | −35 | gb105pln | Rice mRNA for RAB24 protein, complete cds. |
| 700258693H1 | g168539 | 26 | 9 | gb105pln | *Zea mays* putative ribosomal protein S22 homolog mRNA, partial cds. |
| 700207150H1 | g2624211 | 45 | −31 | gb105pln | *M. acuminata* mRNA; clone pBAN UU131. |
| 700267958H1 | g2407790 | 6 | 7 | gb105eukp | grr1; grr1 |
| 700265769H1 | g1724112 | 20 | 8 | gb105allp | ABA induced plasma membrane protein PM 19 |
| 700257007H1 | g927239 | 16 | 6 | gb105allp | globulin1 |
| 700266987H1 | g1015315 | 23 | 6 | gb105pln | *Pisum sativum* (clone PsRCI35-2) ribosomal protein L41 mRNA, complete cds. |
| 700263509H1 | g167449 | 52 | −9 | gb105pln | *Chlamydomonas reinhardtii* |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | alpha-2 tubulin gene, complete cds. |
| 700259305H1 | g968995 | 60 | −59 | gb105pln | *Oryza sativa* clone glyceraldehyde-3-phosphate dehydrogenase (Gpc) mRNA, complete cds. |
| 700258836H1 | g1087070 | 43 | −33 | gb105pln | Pgh1b = 2-phospho-D-glycerate hydrolase [*Mesembryanthemum crystallinum* = common ice plant, mRNA Partial, 1683 nt]. |
| 700267757H1 | g1652434 | 19 | 7 | gb105allp | N-acetylglutamate kinase |
| 700262062H1 | g1732510 | 16 | 10 | gb105pln | *Arabidopsis thaliana* Ran binding protein 1 homolog (RanBP1) mRNA, complete cds. |
| 700262550H1 | g1928968 | 22 | −15 | gb105eukp | ribosomal protein 49 |
| 700263860H1 | g232496 | 11 | 5 | gb105allp | branched-chain alpha-keto acid dehydrogenase complex E1 alpha subunit [human, Peptide Partial, 387 aa]. |
| 700267559H1 | g18963 | 58 | −79 | gb105pln | *Z. mays* mRNA for dehydrin (dhn3). |
| 700266425H1 | g927239 | 6 | 7 | gb105allp | globulin1 |
| 700266013H1 | g22281 | 47 | −80 | gb105pln | *Zea mays* Glb1-0 gene for vicilin-like storage protein (truncated). |
| 700264660H1 | g971279 | 32 | −10 | gb105pln | Rice mRNA for RAB24 protein, complete cds. |
| 700264166H1 | g1906825 | 33 | −18 | gb105pln | *A. thaliana* hsp81.2 gene. |
| 700267215H1 | g687244 | 85 | −80 | gb105pln | *Zea mays* oil body protein 16 kDa oleosin (ole16) gene, complete cds. |
| 700267885H1 | g1209000 | 23 | 6 | gb105allp | unknown |
| 700266989H1 | g2827698 | 22 | −7 | gb105pln | *Arabidopsis thaliana* DNA chromosome 4, BAC clone F6H11 (ESSAII project). |
| 700263343H1 | g2645165 | 58 | −2 | gb105pln | *Oryza sativa* mRNA, similar to ribosomal protein 41. |
| 700207184H1 | g295737 | 37 | −1 | gb105eukp | V14 |
| 700266405H1 | g1899059 | 70 | −57 | gb105pln | *Zea mays* endosperm C-24 sterol methyltransferase (ESMT1) mRNA, complete cds. |
| 700262526H1 | g1786456 | 10 | 5 | gb105allp | o310; 100 pct identical to GB: EDU70214__103 Accession U70214; 27 pct identical (34 gaps) to 306 residues from 5-methly-tetrahydrofolate:homocysteine methyltransferase METH_SALTY SW: P37586 (370 aa) |
| 700260973H1 | g1658314 | 29 | −6 | gb105pln | *O. sativa* osr40g3 gene. |
| 700262468H1 | g1667593 | 49 | −9 | gb105pln | *Oryza sativa* transmembrane protein mRNA, complete cds. |
| 700266540H1 | g644492 | 94 | −43 | gb105pln | Corn elongation factor 1alpha gene, complete cds. |
| 700256951H1 | g170772 | 51 | −4 | gb105pln | *Triticum aestivum* S-adenosyl-L-homocysteine hydrolase (SH6.2) mRNA, complete cds. |
| 700258372H1 | g975888 | 16 | 7 | gb105allp | myo-inositol-1-phosphate synthase |
| 700257840H1 | g1132482 | 50 | −15 | gb105pln | Rice mRNA for ADP-ribosylation factor, complete cds. |
| 700261635H1 | g790507 | 45 | −45 | gb105pln | *Z. mays* mRNA for 60S acidic ribosomal protein. |
| 700264678H1 | g22312 | 55 | −73 | gb105pln | Maize ABA-inducible gene for glycine-rich protein (ABA = abscisic acid). |
| 700266165H1 | g493710 | 11 | 3 | gb105eukp | beta-tubulin |
| 700262241H1 | g471320 | 48 | −50 | gb105pln | *H. vulgare* (cv. Bomi) B15C mRNA. |
| 700263973H1 | g435648 | 33 | −4 | gb105pln | Rice mRNA for gamma-Tip, complete cds. |
| 700257541H1 | g436782 | 32 | −15 | gb105pln | Rice mRNA for cyc07, complete cds. |
| 700257375H1 | g2345153 | 36 | −45 | gb105pln | *Zea mays* ribsomal protein S4 (rps4) mRNA, complete cds. |
| 700262320H1 | g1694832 | 34 | −49 | gb105pln | *H. vulgare* Per1 gene. |
| 700264627H1 | g868002 | 56 | −46 | gb105pln | Pumpkin mRNA for aconitase, complete cds. |
| 700265601H1 | g1002533 | 28 | 7 | gb105eukp | ACT11; actin-11 |
| 700265004H1 | g1171351 | 73 | −21 | gb105pln | *Oryza sativa* 16 kDa oleosin (ole16) mRNA, complete cds. |
| 700264479H1 | g168512 | 34 | −17 | gb105pln | Maize major protein (L3) mRNA from the surface of lipid bodies, 3' end. |
| 700266065H1 | g643073 | 41 | −33 | gb105pln | *Fragaria × ananassa* putative 40S ribosomal protein s12 mRNA, complete cds. |
| 700265143H1 | g21832 | 46 | −31 | gb105pln | Wheat mRNA for chloroplast phosphoglycerate kinase (EC 2.7.2.3). |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264749H1 | g435648 | 56 | −47 | gb105pln | Rice mRNA for gamma-Tip, complete cds. |
| 700267804H1 | g2282583 | 83 | −82 | gb105pln | *Zea mays* elongation factor 1-alpha (EF1-A) mRNA, complete cds. |
| 700260988H1 | g435648 | 30 | 5 | gb105pln | Rice mRNA for gamma-Tip, complete cds. |
| 700265407H1 | g2351073 | 21 | 2 | gb105pln | *Arabidopsis thaliana* genomic DNA, chromosome 5, P1 clone: MYJ24. |
| 700266428H1 | g1935910 | 18 | −4 | gb105pln | *Zea mays* lethal leaf-spot 1 (lls1) gene, partial cds. |
| 700257119H1 | g1931636 | 26 | −33 | gb105pln | *Arabidopsis thaliana* BAC T19D16 genomic sequence. |
| 700265172H1 | g18208 | 12 | 14 | gb105pln | *C. reinhardtii* mRNA for ribosomal protein L31. |
| 700262260H1 | g1019903 | 28 | −28 | gb105pln | *Arabidopsis thaliana* cell division cycle protein (CDC48) mRNA, complete cds. |
| 700265124H1 | g22283 | 68 | −77 | gb105pln | *Zea mays* Glb1-L gene for vicilin-like embryo storage protein. |
| 700258736H1 | g1669659 | 32 | −39 | gb105pln | *C. annuum* mRNA for CDC48p-like protein. |
| 700267309H1 | g1143501 | 29 | −8 | gb105pln | *H. vulgare* mRNA for ADP-glucose pyrophosphorylase small subunit (1902 bp). |
| 700267345H1 | g32709 | 9 | 3 | gb105allp | IFP53 |
| 700266637H1 | g514945 | 100 | −89 | gb105pln | *Zea mays* sucrose synthase (Sus1) mRNA, complete cds. |
| 700264135H1 | g687244 | 82 | −42 | gb105pln | *Zea mays* oil body protein 16 kDa oleosin (ole16) gene, complete cds. |
| 700264386H1 | g1498391 | 70 | −78 | gb105pln | *Zea mays* actin (Maz65) gene, partial cds. |
| 700257343H1 | g971279 | 37 | −16 | gb105pln | Rice mRNA for RAB24 protein, complete cds. |
| 700262083H1 | g2286150 | 34 | −61 | gb105pln | *Zea mays* translation initiation factor (eIE-4A) mRNA, complete cds. |
| 700264017H1 | g474392 | 26 | 0 | gb105eukp | Cpx;2-3; serine carboxylase II-3; EC 3.4.16.1 |
| 700260544H2 | g695169 | 13 | −6 | gb105eukp | unknown |
| 700207212H1 | g1185553 | 30 | −72 | gb105pln | *Zea mays* glyceraldehyde-3-phosphate dehydrogenase (gpc2) gene, complete cds. |
| 700267610H1 | g19101 | 40 | −33 | gb105pln | *H. vulgare* mRNA for ribosomal protein L17-1. |
| 700262639H1 | g2511530 | 50 | −50 | gb105pln | *Eleusine indica* alpha tubulin 1 (TUA1) mRNA, complete cds. |
| 700262406H1 | g168480 | 46 | −66 | gb105pln | Maize embryo globulin S allele (7S-like) mRNA, complete cds. |
| 700266375H1 | g1171351 | 25 | −6 | gb105pln | *Oryza sativa* 16 kDa oleosin (ole16) mRNA, complete cds. |
| 700259179H2 | g497978 | 17 | 17 | gb105pln | *Arabidopsis thaliana* Columbia glutamate decarboxylase (GAD) mRNA, complete cds. |
| 700258893H1 | g435456 | 18 | −39 | gb105pln | Proso millet gene for aspartate aminotransferase, complete cds. |
| 700263329H1 | g1086833 | 8 | 4 | gb105eukp | F10E7.5 |
| 700263856H1 | g602605 | 37 | −63 | gb105pln | *Zea mays* tandem genes for alpha1-tubulin and alpha2-tubulin. |
| 700266390H1 | g2511737 | 11 | 3 | gb105allp | caffeoyl-CoA 3-O-methyltransferase 5 |
| 700265782H1 | g2264309 | 12 | −5 | gb105pln | *Arabidopsis thaliana* genomic DNA, chromosome 5, P1 clone: MJJ3, complete sequence. |
| 700262551H1 | g2827714 | 13 | −2 | gb105eukp | F6H11.160; receptor protein kinase - like protein |
| 700263272H1 | g2218151 | 33 | −13 | gb105pln | *Vigna unguiculata* type IIIa membrane protein cp-wap13 mRNA, complete cds. |
| 700268080H1 | g22379 | 14 | 14 | gb105pln | *Z. mays* mRNA for CAAT-box DNA binding protein subunit B (NP-YB). |
| 700257343H1 | g1694832 | 26 | −5 | gb105pln | *H. vulgare* Per1 gene. |
| 700264006H1 | g1694832 | 31 | −4 | gb105pln | *H. vulgare* Per1 gene. |
| 700264114H1 | g549984 | 20 | −18 | gb105eukp | possible apospory-associated protein |
| 700207180H1 | g1747295 | 70 | −62 | gb105pln | Rice mRNA for vacuolar H+-pyrophosphatase, complete cds. |
| 700264513H1 | g2464884 | 26 | −4 | gb105eukp | RNA-binding protein homolog |
| 700262822H1 | g1200205 | 42 | −33 | gb105eukp | DAG |
| 700256856H1 | g1480017 | 21 | −3 | gb105pln | *Brassica rapa* mRNA for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700262902H1 | g2821959 | 36 | −6 | gb105eukp | ribosomal protein, complete cds. spermidine synthase; EC 2.5.1.16 |
| 700266423H1 | g2829893 | 31 | −10 | gb105eukp | T26J12.5; phosphoglucomutase |
| 700258361H1 | g18337 | 16 | 7 | gb105eukp | ecp31; embryonic cell protein |
| 700258017H1 | g1197653 | 28 | −13 | gb105allp | WbcJ |
| 700265183H1 | g168579 | 90 | −82 | gb105pln | Maize pyruvate, orthophosphate dikinase mRNA, complete cds. |
| 700266766H1 | g18259 | 24 | −20 | gb105pln | *C. sativus* mRNA for cs DnaJ-1. |
| 700262109H1 | g687244 | 39 | −69 | gb105pln | *Zea mays* oil body protein 16 kDa oleosin (ole16) gene, complete cds. |
| 700264392H1 | g899609 | 73 | −27 | gb105pln | *Zea mays* acidic ribosomal protein P2 (RPA-2A1) mRNA, complete cds. |
| 700261614H1 | g1200160 | 27 | −9 | gb105pln | *T. gesneriana* mRNA for tonoplast intrinsic protein. |
| 700256768H1 | g1113941 | 19 | 0 | gb105eukp | unknown; Pv42p |
| 700266125H1 | g397400 | 43 | −40 | gb105pln | *B. rapa* mRNA for S phase specific gene. |
| 700264106H1 | g168481 | 14 | 2 | gb105eukp | globulin precursor |
| 700267951H1 | g167112 | 50 | −9 | gb105pln | *Bromus inermis* aldose reductase-related protein, complete cds. |
| 700261371H1 | g2244788 | 28 | −22 | gb105pln | *Arabidopsis thaliana* DNA chromosome 4, ESSA I contig fragment No. 1. |
| 700266638H1 | g1568510 | 47 | −39 | gb105pln | *N. tabacum* mRNA for protein phosphatase 2A, 65 kD regulatory subunit. |
| 700260708H1 | g168481 | 8 | 8 | gb105allp | globulin precursor |
| 700257007H1 | g22284 | 16 | 6 | gb105eukp | Glb1-L; vicilin-like embryo storage protein |
| 700207111H1 | g2114027 | 17 | −1 | gb105eukp | ntf-2; putative nuclear transport factor 2 |
| 700258560H1 | g169538 | 30 | −21 | gb105eukp | pyrophosphate-fructose 6-phosphate 1-phosphotransferase alpha-subunit; EC 2.7.1.90 |
| 700264162H1 | g217861 | 23 | 5 | gb105eukp | serine/threonine protein kinase |
| 700264214H1 | g537445 | 34 | −24 | gb105pln | *Arabidopsis thaliana* heat shock protein AtHSP101 (Athsp101) mRNA, complete cds. |
| 700264366H1 | g1872162 | 21 | 0 | gb105pln | *Arabidopsis thaliana* DnaJ homolog (atj) mRNA, complete cds. |
| 700264255H1 | g22144 | 73 | −84 | gb105pln | Maize anaerobically regulated gene for fructose bisphosphate aldolase (EC 4.1.2.13). |
| 700256756H1 | g2345153 | 59 | −70 | gb105pln | *Zea mays* ribosomal protein S4 (rps4) mRNA, complete cds. |
| 700263345H1 | g1230612 | 9 | 3 | gb105allp | CDC68 gene product |
| 700267110H1 | g687244 | 80 | −2 | gb105pln | *Zea mays* oil body protein 16 kDa oleosin (ole16) gene, complete cds. |
| 700262889H1 | g1694832 | 55 | −10 | gb105pln | *H. vulgare* Per1 gene. |
| 700262922H1 | g927239 | 5 | 7 | gb105allp | globulin1 |
| 700258950H1 | g434344 | 43 | −41 | gb105pln | *A. thaliana* (Columbia) mRNA for S18 ribosomal protein (641 bp). |
| 700263848H1 | g596079 | 44 | −6 | gb105pln | *Zea mays* thiamine biosynthetic enzyme (thi1-2) mRNA, complete cds. |
| 700258419H1 | g2190991 | 23 | −5 | gb105pln | *Aegilops squarrosa* glutathione S-transferase TSI-1 mRNA, complete cds. |
| 700265065H1 | g168512 | 94 | −85 | gb105pln | Maize major protein (L3) mRNA from the surface of lipid bodies, 3' end. |
| 700264670H1 | g1435156 | 55 | −47 | gb105pln | *L. esculentum* mRNA for histone H3 variant H3.3. |
| 700266107H1 | g498739 | 67 | −73 | gb105pln | *H. vulgare* (pMaW22) mRNA for beta-ketoacyl-ACP synthase. |
| 700265972H1 | g2828280 | 14 | −7 | gb105eukp | T18B16.20; putative protein |
| 700267539H1 | g168512 | 43 | −43 | gb105pln | Maize major protein (L3) mRNA from the surface of lipid bodies, 3' end. |
| 700260134H1 | g20255 | 47 | −57 | gb105pln | *O. sativa* gene for heat shock protein 82 HSP82. |
| 700264120H1 | g18890 | 41 | −8 | gb105pln | *H. vulgare* gene for aldose reductase-related protein. |
| 700258421H1 | g790969 | 59 | −48 | gb105pln | Rice mRNA for aidolase C-1, complete cds. |
| 700256929H1 | g1778376 | 5 | 5 | gb105allp | PsRT17-1 |
| 700262346H1 | g971279 | 46 | −46 | gb105pln | Rice mRNA for RAB24 protein, complete cds. |
| 700263876H1 | g173231 | 19 | −0 | gb105pln | Yeast (*Saccharomyces cerevisiae*) ribosomal 5S RNA-binding protein |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | (YL3) gene, 5' cds. |
| 700258746H1 | g530206 | 38 | −30 | gb105pln | Glycine max heat shock protein (SB100) mRNA, complete cds. |
| 700267856H1 | g1788878 | 16 | 1 | gb105allp | f128; This 128 aa ORF is 50 pct identical (5 gaps) to 122 residues of an approx. 320 aa protein NIFU_AZOVI SW: P05340 |
| 700260910H1 | g687244 | 32 | −52 | gb105pln | Zea mays oil body protein 16 kDa oleosin (ole16) gene, complete cds. |
| 700260358H2 | g687244 | 59 | −40 | gb105pln | Zea mays oil body protein 16 kDa oleosin (ole16) gene, complete cds. |
| 700263392H1 | g1122931 | 16 | 3 | gb105allp | serine-threonine phosphatase |
| 700264350H1 | g1707112 | 20 | −10 | gb105eukp | C23H3.4 |
| 700264846H1 | g1403043 | 18 | 12 | gb105pln | H. chilense × T. turgidum conv. durum (Tritordeum) mRNA for S-adenosylmethionine decarboxylase. |
| 700266734H1 | g167961 | 26 | 16 | gb105pln | D. caryophyllus S-adenosylmethionine synthetase (CARSAM2) mRNA, complete cds. |
| 700261202H1 | g899607 | 35 | −43 | gb105pln | Zea mays polyubiquitin (MubC5) mRNA, complete cds. |
| 700265641H1 | g2827716 | 40 | −21 | gb105eukp | F6H11.180; predicted protein |
| 700260687H1 | g260552 | 22 | 13 | gb105pln | Wx (wx-B2) {transposable element Tourist-Zml} [Zea mays = corn, Transposon Mutant, 150 nt]. |
| 700258785H1 | g168508 | 29 | −51 | gb105pln | Maize oleosin KD18 (KD18; L2) gene, complete cds. |
| 700266078H1 | g1732510 | 14 | 13 | gb105pln | Arabidopsis thaliana Ran binding protein 1 homolog (RanBP1) mRNA, complete cds. |
| 700262239H1 | g1370187 | 32 | −16 | gb105pln | L. japonicus mRNA for small GTP-binding protein, RAB7D. |
| 700263313H1 | g899607 | 69 | −56 | gb105pln | Zea mays polyubiquitin (MubC5) mRNA, complete cds. |
| 700267483H1 | g1301955 | 25 | −11 | gb105eukp | LAT1 |
| 700264920H1 | g168512 | 47 | −45 | gb105pln | Maize major protein (L3) mRNA from the surface of lipid bodies, 3' end. |
| 700266538H1 | g927238 | 61 | −57 | gb105pln | Zea mays globulin1 (Glb1) gene, allele Glb1-Hb, complete cds. |
| 700261784H1 | g687244 | 71 | 3 | gb105pln | Zea mays oil body protein 16 kDa oleosin (ole16) gene, complete cds. |
| 700265703H1 | g167074 | 55 | −9 | gb105pln | Barley ubiquitin (mub2) gene, complete cds. |
| 700265908H1 | g2245020 | 6 | 6 | gb105allp | growth regulator homolog |
| 700259645H1 | g1143427 | 38 | −6 | gb105eukp | hsp70; heat shock protein 70 |
| 700267052H1 | g431947 | 15 | 8 | gb105allp | Similar to ABC1 gene of yeast (SW: ABC1_Yeast) |
| 700263690H1 | g1046377 | 8 | 1 | gb105eukp | copper amine oxidase; copper amine oxidase |
| 700264058H1 | g1171351 | 47 | −38 | gb105pln | Oryza sativa 16 kDa oleosin (ole16) mRNA, complete cds. |
| 700265760H1 | g2570506 | 36 | −42 | gb105pln | Oryza sativa ribosomal protein mRNA, complete cds. |
| 700267062H1 | g587562 | 6 | 8 | gb105eukp | MPP; mitochondrial processing peptidase |
| 700260669H1 | g577824 | 28 | −28 | gb105pln | Z. mays gene for H2B histone (gH2B3). |
| 700207196H1 | g168406 | 47 | −74 | gb105pln | Z. mays alcohol dehydrogenase (ADH-1 C-m allele) gene, complete cds. |
| 700263683H1 | g168512 | 42 | −30 | gb105pln | Maize major protein (L3) mRNA from the surface of lipid bodies, 3' end. |
| 700266330H1 | g2462741 | 34 | −2 | gb105eukp | F8A5.23 |
| 700256858H1 | g758246 | 49 | −43 | gb105pln | Phalaenopsis sp. mRNA for S-adenosyhomocysteine hydrolase. |
| 700260659H1 | g22292 | 73 | −58 | gb105pln | Z. mays mRNA for glycine-rich protein. |
| 700257977H1 | g21832 | 39 | −28 | gb105pln | Wheat mRNA for chloroplast phosphoglycerate kinase (EC 2.7.2.3). |
| 700263111H1 | g1532048 | 43 | 2 | gb105allp | S-adenosylmethionine decarboxylase |
| 700262339H1 | g169326 | 34 | −38 | gb105pln | Bean (P. vulgaris) NADP-dependent malic enzyme mRNA, complete cds. |
| 700258409H1 | g1865751 | 11 | 3 | gb105eukp | T23D8.4 |
| 700264421H1 | g1694620 | 25 | −14 | gb105pln | Cucurbita sp. mRNA for 3-ketoacyl-CoA thiolase, complete cds. |
| 700267252H1 | g1546918 | 79 | −89 | gb105pln | Z. mays mRNA for translation initiation factor 5A. |
| 700261390H1 | g1171351 | 24 | −4 | gb105pln | Oryza sativa 16 kDa oleosin (ole16) mRNA, complete cds. |
| 700264716H1 | g2344885 | 18 | −22 | gb105pln | Arabidopsis thaliana |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | chromosome II BAC T13E15 genomic sequence, complete sequence. |
| 700261959H1 | g22144 | 46 | −31 | gb105pln | Maize anaerobically regulated gene for fructose bisphosphate aldolase (EC 4.1.2.13). |
| 700264707H1 | g2760327 | 32 | −5 | gb105eukp | F1N21.12 |
| 700265675H1 | g22113 | 8 | −1 | gb105eukp | ORFa |
| 700263156H1 | g687244 | 63 | −43 | gb105pln | *Zea mays* oil body protein 16 kDa oleosin (ole16) gene, complete cds. |
| 700265841H1 | g514945 | 77 | −64 | gb105pln | *Zea mays* sucrose synthase (Sus1) mRNA, complete cds. |
| 700265662H1 | g22340 | 49 | −68 | gb105pln | Maize gene for heat shock protein 70 exon 1 (hsp70; clone pMON 9502). |
| 700257051H1 | g22237 | 94 | −87 | gb105pln | Maize mRNA for cytosolic GAPDH (GapC) glyceraldehyde-3-phosphate dehydrogenase. |
| 700267813H1 | g288062 | 30 | −23 | gb105pln | *A. thaliana* mRNA for ketol-acid reductoisomerase subunit. |
| 700207218H1 | g22281 | 62 | 4 | gb105pln | *Zea mays* Glb1-0 gene for vicilin-like storage protein (truncated). |
| 700265947H1 | g22270 | 52 | −62 | gb105pln | Maize mRNA from an embryogenic abscisic acid-inducible gene. |
| 700261361H1 | g22283 | 55 | −62 | gb105pln | *Zea mays* Glb1-L gene for vicilin-like embryo storage protein. |
| 700264331H1 | g22281 | 53 | −68 | gb105pln | *Zea mays* Glb1-0 gene for vicilin-like storage protein (truncated). |
| 700268138H1 | g2337888 | 22 | 1 | gb105pln | Genomic sequence for *Arabidopsis thaliana* BAC F14J16, complete sequence. |
| 700265947H1 | g19016 | 25 | −3 | gb105pln | *H. vulgare* mRNA for LEA B19.4 protein. |
| 700267626H1 | g561664 | 39 | −17 | gb105pln | Rice mRNA, partial homologous to ribosomal protein S3 coding sequence. |
| 700259092H1 | g556217 | 10 | 5 | gb105allp | spliceosomal protein |
| 700265648H1 | g540581 | 18 | −7 | gb105eukp | mudrA |
| 700261657H1 | g168512 | 31 | 3 | gb105pln | Maize major protein (L3) mRNA from the surface of lipid bodies, 3' end. |
| 700265113H1 | g596077 | 22 | −18 | gb105pln | *Zea mays* thiamine biosynthetic enzyme (thi1-1) mRNA, complete cds. |
| 700257921H1 | g1724111 | 44 | −41 | gb105pln | *Triticum aestivum* ABA induced plasma membrane protein PM-19 (WTABAPM) mRNA, complete cds. |
| 700257073H1 | g1184771 | 61 | −7 | gb105pln | *Zea mays* glyceraldehyde-3-phosphate dehydrogenase GAPC2 (gpc2) mRNA, complete cds. |
| 700256805H1 | g550543 | 38 | −27 | gb105pln | *A. thaliana* mRNA for ribosomal protein L16. |
| 700261488H1 | g1519248 | 31 | 9 | gb105pln | *Oryza sativa* GF14-b protein mRNA, complete cds. |
| 700259036H1 | g2459406 | 36 | −13 | gb105pln | *Arabidopsis thaliana* chromosome II BAC F4P9 genomic sequence, complete sequence. |
| 700263768H1 | g168512 | 36 | −31 | gb105pln | Maize major protein (L3) mRNA from the surface of lipid bodies, 3' end. |
| 700263965H1 | g416146 | 90 | −86 | gb105pln | *Zea mays* beta-6 tubulin (tub6) gene and mRNA, complete cds. |
| 700257445H2 | g1302114 | 9 | 4 | gb105eukp | YCK2 |
| 700261840H1 | g168512 | 27 | −8 | gb105pln | Maize major protein (L3) mRNA from the surface of lipid bodies, 3' end. |
| 700262048H1 | g1575129 | 96 | −23 | gb105pln | *Zea mays* lumenal binding protein cBiPe3 mRNA, complete cds. |
| 700267208H1 | g22281 | 38 | −40 | gb105pln | *Zea mays* Glb1-0 gene for vicilin-like storage protein (truncated). |
| 700267918H1 | g533690 | 41 | −3 | gb105eukp | BRP10 |
| 700261239H1 | g347063 | 19 | −19 | gb105pln | *Brassica rapa* ubiquitin/ribosomal protein mRNA, complete cds. |
| 700264753H1 | g790977 | 44 | −32 | gb105pln | *B. juncea* msams mRNA. |
| 700263975H1 | g22328 | 58 | −51 | gb105pln | Maize mRNA for a high mobility group protein. |
| 700258863H1 | g402903 | 39 | −31 | gb105pln | *Arabidopsis thaliana* Columbia laminin receptor-like protein mRNA, complete cds. |
| 700261859H1 | g736271 | 46 | −39 | gb105pln | *O. sativa* hsp70 gene for heat shock protein 70. |
| 700258804H1 | g2511530 | 52 | −56 | gb105pln | *Eleusine indica* alpha tubulin 1 (TUA1) mRNA, complete cds. |
| 700266052H1 | g2267005 | 53 | −42 | gb105pln | *Oryza sativa* endosperm lumenal binding protein (BiP) mRNA, complete cds. |
| 700260556H2 | g168490 | 84 | −93 | gb105pln | Maize glutathione S-transferase (GST-I) mRNA, complete cds. |
| 700267380H1 | g170046 | 25 | −12 | gb105pln | *Glycine max* protein kinase (PK6) mRNA, complete cds. |
| 700263620H1 | g438451 | 18 | −1 | gb105eukp | Fad2; delta-12 desaturase |
| 700264569H1 | g758693 | 13 | 8 | gb105pln | *Catharanthus roseus* |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | S-adenosyl-L-methionine decarboxylase proenzyme mRNA, complete cds. |
| 700262991H1 | g1129083 | 32 | −6 | gb105pln | Wheat mRNA for protein H2A, complete cds, clone wcH2A-2. |
| 700261252H1 | g471320 | 41 | −44 | gb105pln | *H. vulgare* (cv. Bomi) B15C mRNA. |
| 700263058H1 | g22292 | 76 | −29 | gb105pln | *Z. mays* mRNA for glycine-rich protein. |
| 700263934H1 | g1580781 | 7 | 7 | gb105allp | beige-like protein |
| 700266193H1 | g499011 | 32 | −13 | gb105pln | *S. vulgare* SoAcl mRNA. |
| 700261379H1 | g168512 | 38 | −29 | gb105pln | Maize major protein (L3) mRNA from the surface of lipid bodies, 3′ end. |
| 700259167H2 | g2464931 | 24 | 3 | gb105eukp | trichohyalin homolog |
| 700263855H1 | g2062155 | 12 | 6 | gb105allp | mitochondrial processing peptidase alpha subunit precursor isolog |
| 700266933H1 | g167141 | 44 | −18 | gb105pln | Spring cabbage histidinol dehydrogenase mRNA, complete cds. |
| 700266701H1 | g2398810 | 20 | 15 | gb105pln | Yeast (*Saccharomyces pombe*) chromosome I cosmid c26H5. |
| 700266138H1 | g1917018 | 54 | −69 | gb105pln | *Zea mays* ribosomal protein S6 RPS6-1 (rps6-1) mRNA, complete cds. |
| 700262028H1 | g471320 | 54 | −43 | gb105pln | *H. vulgare* (cv. Bomi) B15C mRNA. |
| 700263371H1 | g2160158 | 22 | 0 | gb105allp | Similar to elongation factor 1-gamma (gb\|EFiG__XENLA). ESTs gb\|T20564, gb\|T45940, gb\|T04527 come from this gene. |
| 700266771H1 | g2760171 | 21 | −7 | gb105pln | *Arabidopsis thaliana* genomic DNA, chromosome 5, P1 clone: MPA24, complete sequence. |
| 700258859H1 | g22292 | 52 | −38 | gb105pln | *Z. mays* mRNA for glycine-rich protein. |
| 700262241H1 | g971279 | 46 | −45 | gb105pln | Rice mRNA for RAB24 protein, complete cds. |
| 700265659H1 | g596077 | 31 | 6 | gb105pln | *Zea mays* thiamine biosynthetic enzyme (thil-1) mRNA, complete cds. |
| 700264670H1 | g473987 | 50 | −41 | gb105pln | Rice mRNA, partial homologous to histone H3 gene. |
| 700267252H1 | g218082 | 42 | −38 | gb105pln | Rice mRNA for initiation factor eIF-4D (225 gene), partial sequence. |
| 700266066H1 | g2739376 | 17 | −16 | gb105eukp | T9J22.18; putative permease |
| 700262527H1 | g19010 | 39 | −15 | gb105pln | *H. vulgare* mRNA for jasmonate-induced protein. |
| 700258021H1 | g1872131 | 13 | −0 | gb105eukp | ORF YBR245c |
| 700264284H1 | g563234 | 13 | 15 | gb105pln | *Zea mays* xyloglucan endo-transglycosylase homolog gene, complete cds. |
| 700266762H1 | g1151134 | 5 | 2 | gb105eukp | permease 1 |
| 700267003H1 | g536891 | 49 | −43 | gb105pln | Wheat mRNA for protein H2A, complete cds, clone wcH2A-4. |
| 700262467H1 | g1045304 | 80 | −35 | gb105pln | *Zea mays* acetyl-coenzyme A carboxylase mRNA, complete cds. |
| 700261496H1 | g687244 | 53 | −21 | gb105pln | *Zea mays* oil body protein 16 kDa oleosin (ole16) gene, complete cds. |
| 700264783H1 | g471320 | 54 | −51 | gb105pln | *H. vulgare* (cv. Bomi) B15C mRNA. |
| 700264063H1 | g452559 | 42 | −82 | gb105pln | *Zea mays* group 3 Lea protein MGL3 mRNA, complete cds. |
| 700267527H1 | g168608 | 58 | −73 | gb105pln | Maize 17S ribosomal RNA gene and flanks. |
| 700266534H1 | g257804 | 76 | −52 | gb105pln | C4ppdkZm1 = orthophosphate dikinase {5′ region} [maize, Chloroplast, 237 nt, segment 2 of 2]. |
| 700261986H1 | g473602 | 75 | −46 | gb105pln | *Zea mays* W-22 histone H2A mRNA, complete cds. |
| 700263465H1 | g1561773 | 36 | −38 | gb105pln | *Vitis vinifera* malate dehydrogenase (VVME2) mRNA, complete cds. |
| 700257259H1 | g687244 | 64 | −22 | gb105pln | *Zea mays* oil body protein 16 kDa oleosin (ole16) gene, complete cds. |
| 700257169H1 | g1724111 | 17 | 10 | gb105pln | *Triticum aestivum* ABA induced plasma membrane protein PM-19 (WTABAPM) mRNA, complete cds. |
| 700265275H1 | g540581 | 32 | −19 | gb105eukp | mudrA |
| 700256701H1 | g473976 | 47 | −34 | gb105pln | Rice mRNA, partial homologous to elongation factor 1-alpha gene. |
| 700267193H1 | g1213255 | 21 | −16 | gb105eukp | SPAC17G8.06c; unknown |
| 700257287H1 | g974781 | 24 | −6 | gb105pln | *C. blumei* kinetoplast met gene for cobalamine-independent methionine synthase. |
| 700264460H1 | g1403043 | 21 | 7 | gb105pln | *H. chilense* × *T. turgidum* conv. durum (Tritordeum) mRNA for S-adenosylmethionine decarboxylase. |
| 700266872H1 | g687246 | 18 | 9 | gb105pln | *Zea mays* oil body protein 17 kDa oleosin (ole17) gene, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700265639H1 | gi68480 | 68 | −82 | gb105pln | Maize embryo globulin S allele (7S-like) mRNA, complete cds. |
| 700264208H1 | g1667262 | 31 | 3 | gb105eukp | B0035.1 |
| 700266962H1 | g1314176 | 10 | −3 | gb105eukp | SPAC26F1.07; unknown |
| 700266912H1 | g11042 | 9 | 8 | gb105eukp | per; hrp48.1 |
| 700258533H1 | g506138 | 74 | −62 | gb105pln | *Zea mays* Ec metallothionein class II protein mRNA, complete cds. |
| 700260563H2 | g459197 | 22 | −10 | gb105pln | *Gossypium hirsutum* vacuolar H+-ATPase subunit B mRNA, complete cds. |
| 700262715H1 | g1052973 | 26 | −17 | gb105eukp | fructokinase; EC 2.7.1.4 |
| 700259551H1 | g2435519 | 25 | −16 | gb105eukp | A_TM017A05.7 |
| 700258761H1 | g22342 | 51 | −68 | gb105pln | Maize gene for heat shock protein 70 exon 2 and 3'-UT (hsp70; clone pMON 9502). |
| 700257855H1 | g167402 | 27 | −11 | gb105pln | *Chlamydomonas reinhardtii* ATP synthase (CF1) gamma subunit gene, complete CDS. |
| 700263085H1 | g777757 | 68 | −34 | gb105pln | Saccharum hybrid (clone SCUBI561) polyubiquitin mRNA, complete cds. |
| 700258754H1 | g454872 | 35 | −78 | gb105pln | Maize mRNA for group 3 Lea protein MGL3, complete cds. |
| 700263465H1 | g168527 | 63 | −69 | gb105pln | Maize NADP-dependent malic enzyme (Mel) mRNA, complete cds. |
| 700267449H1 | g1100740 | 24 | −3 | gb105pln | *Panicum miliaceum* mRNA for 2-oxoglutarate/malate translocator, complete cds. |
| 700257038H1 | g22136 | 50 | −36 | gb105pln | Maize Adh2-N mRNA for alcohol dehydrogenase 2. |
| 700262311H1 | g602605 | 32 | −80 | gb105pln | *Zea mays* tandem genes for alpha1-tubulin and alpha2-tubulin. |
| 700258527H1 | g2821956 | 47 | −39 | gb105pln | *Hyoscyamus niger* mRNA for spermidine synthase 2, complete cds. |
| 700262783H1 | g2529662 | 24 | 2 | gb105eukp | T30B22.5; putative small nuclear ribonucleoprotein, Sm D2 |
| 700256914H1 | g1498385 | 81 | −41 | gb105pln | *Zea mays* actin (Maz87) gene, partial cds. |
| 700262149H1 | g2245030 | 21 | −1 | gb105eukp | apetala2 domain TINY homolog |
| 700267991H1 | g22270 | 76 | −70 | gb105pln | Maize mRNA from an embryogenic abscisic acid-inducible gene. |
| 700263074H1 | g2088647 | 9 | 7 | gb105eukp | T28M21.10 |
| 700267912H1 | g296204 | 18 | −2 | gb105eukp | pA1aAT-2; alanine aminotransferase; EC 2.6.1.2 |
| 700261388H1 | g493590 | 13 | 15 | gb105pln | *Hordeum vulgare* disulfide isomerase (PDI) mRNA, 3' end. |
| 700267083H1 | g22285 | 25 | −65 | gb105pln | *Zea mays* Glb1-S gene for vicilin-like embryo storage protein. |
| 700265183H1 | g168584 | 30 | −78 | gb105pln | Corn pyruvate, orthophosphate dikinase gene, exons 2-19. |
| 700267128H1 | g2668741 | 40 | −32 | gb105pln | *Zea mays* glycine-rich RNA binding protein (GRP) mRNA, complete cds. |
| 700257864H1 | g169474 | 48 | −23 | gb105pln | *S. tuberosum* 3-deoxy-D-arabino-heptulosonate 7-phosphate synthase (aro1) mRNA, complete cds. |
| 700261343H1 | g2529229 | 9 | 3 | gb105allp | 6-phosphogluconate dehydrogenase |
| 700261357H1 | g603947 | 14 | −3 | gb105eukp | C0X15; cytochrome oxidase assembly factor |
| 700267424H1 | g168512 | 20 | −29 | gb105pln | Maize major protein (L3) mRNA from the surface of lipid bodies, 3' end. |
| 700266979H1 | g927238 | 70 | −67 | gb105pln | *Zea mays* globulin1 (Glb1) gene, allele Glb1-Hb, complete cds. |
| 700260103H1 | g167961 | 30 | 1 | gb105pln | *D. caryophyllus* S-adenosylmethionine synthetase (CARSAM2) mRNA, complete cds. |
| 700257782H1 | g18140 | 19 | 13 | gb105pln | *C. rubrum* mRNA for light-induced 34kD protein. |
| 700262875H1 | g2791884 | 44 | −36 | gb105pln | *Arabidopsis thaliana* JAB1 (JAB1) mRNA, complete cds. |
| 700265369H1 | g16075 | 27 | −12 | gb105pln | *A. officinalis* mRNA for asparagine synthetase. |
| 700267550H1 | g1184013 | 11 | 15 | gb105pln | Yeast (*Saccharomyces pombe*) chromosome I cosmid c4H3. |
| 700258473H1 | g288062 | 43 | −13 | gb105pln | *A. thaliana* mRNA for ketol-acid reductoisomerase subunit. |
| 700265688H1 | g394874 | 10 | 8 | gb105allp | HSP 70- *Pisum sativum* |
| 700257392H1 | g170767 | 39 | −37 | gb105pln | Wheat Nor-D3 locus ribosomal RNA gene. |
| 700261631H1 | g960291 | 32 | −4 | gb105eukp | anthranilate synthase alpha subunit |
| 700262263H1 | g506860 | 47 | −8 | gb105eukp | HRSec61 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700267911H1 | g22119 | 96 | −88 | gb105pln | Maize Adh1-F mRNA for alcohol dehydrogenase. |
| 700265560H1 | g22302 | 47 | −79 | gb105pln | Maize Gpc1 gene for glyceraldehyde-3-phosphate dehydrogenase (GADPH) subunit C. |
| 700258414H1 | g1067126 | 16 | 5 | gb105pln | *D. caryophyllus* mRNA for dihydroflavonol 4-reductase. |
| 700268067H1 | g347844 | 65 | −12 | gb105pln | *Zea mays* globulin-1 gene, terminator region. |
| 700264409H1 | g887939 | 9 | 3 | gb105eukp | GAST1 protein homolog |
| 700266315H1 | g2529657 | 22 | 14 | gb105pln | *Arabidopsis thaliana* chromosome II BAC T30B22 genomic sequence, complete sequence. |
| 700267731H1 | g22277 | 27 | 9 | gb105pln | Maize mRNA for ferritin (clone FM2). |
| 700261958H1 | g1814402 | 44 | −38 | gb105pln | *Mesembryanthemum crystallinum* methionine synthase (MetE) mRNA, complete cds. |
| 700263268H1 | g1658314 | 22 | −3 | gb105pln | *O. sativa* osr40g3 gene. |
| 700264568H1 | g687246 | 22 | −6 | gb105pln | *Zea mays* oil body protein 17 kDa oleosin (ole17) gene, complete cds. |
| 700263524H1 | g22302 | 58 | −34 | gb105pln | Maize Gpc1 gene for glyceraldehyde-3-phosphate dehydrogenase (GADPH) subunit C. |
| 700262662H1 | g2654870 | 17 | 6 | gb105eukp | RbohAOsp |
| 700268163H1 | g2623342 | 27 | −5 | gb105pln | Yeast (Saccharomyces cerevisiae) splicing factor Prp43p (PRP43) gene, complete cds. |
| 700261181H1 | g22285 | 84 | −33 | gb105pln | *Zea mays* Glb1-S gene for vicilin-like embryo storage protein. |
| 700260238H1 | g168440 | 33 | −19 | gb105pln | *Zea mays* chitinase A (seed chitinase) gene, complete cds. |
| 700258810H1 | g1296954 | 63 | −60 | gb105pln | *O. sativa* mRNA for novel protein, osr40cl. |
| 700257102H1 | g1531764 | 11 | 13 | gb105pln | *D. stramonium* mRNA for S-adenosylmethionine decarboxylase. |
| 700256825H1 | g1171351 | 27 | −14 | gb105pln | *Oryza sativa* 16 kDa oleosin (ole16) mRNA, complete cds. |
| 700261614H1 | g520935 | 40 | −26 | gb105pln | *H. vulgare* mRNA for gamma-TIP-like protein. |
| 700257959H1 | g168481 | 13 | 3 | gb105allp | globulin precursor |
| 700264974H1 | g2632251 | 30 | −17 | gb105pln | S. bicolor DNA for gene encoding putative protein serine/threonine kinase, clone cSNFL1. |
| 700262027H1 | g602564 | 41 | −29 | gb105pln | *C. paradisi* (Macf) INO1 gene. |
| 700267589H1 | g2668741 | 49 | −35 | gb105pln | *Zea mays* glycine-rich RNA binding protein (GRP) mRNA, complete cds. |
| 700257929H1 | g22549 | 20 | 0 | gb105pln | Maize gene for a 27 kDa storage protein, zein. |
| 700264806H1 | g20501 | 13 | 1 | gb105eukp | vicilin-like storage protein |
| 700262364H1 | g913940 | 17 | −6 | gb105pln | btg-26 = turgor-responsive/drought-induced gene [*Brassica napus*, cv. Bridger, Genomic, 4442 nt]. |
| 700267589H1 | g2293479 | 35 | −20 | gb105pln | *Oryza sativa* glycine-rich protein mRNA, complete cds. |
| 700266136H1 | g1747295 | 42 | −32 | gb105pln | Rice mRNA for vacuolar H+-pyrophosphatase, complete cds. |
| 700263862H1 | g450353 | 26 | −4 | gb105pln | *H. vulgare* (cv Bomi) gB19.1b gene. |
| 700264196H1 | g287297 | 37 | −0 | gb105pln | *Oryza sativa* mRNA for aspartate aminotransferase, complete cds. |
| 700257301H1 | g1212780 | 29 | 14 | gb105pln | *B. juncea* mRNA for oleate desaturase. |
| 700263240H1 | g2623294 | 19 | 14 | gb105pln | *Arabidopsis thaliana* chromosome II BAC T20B5 genomic sequence, complete sequence. |
| 700263483H1 | g2462926 | 21 | −2 | gb105pln | *A. thaliana* mRNA for protein with homology to amidase. |
| 700258230H1 | g2852445 | 15 | 4 | gb105eukp | SUI1 homolog |
| 700258027H1 | g2264314 | 26 | −8 | gb105pln | *Arabidopsis thaliana* genomic DNA, chromosome 5, Pl clone: MQK4, complete sequence. |
| 700268182H1 | g435465 | 56 | −26 | gb105pln | Rice mRNA for calcium-dependent protein kinase, complete cds. |
| 700267673H1 | g633889 | 32 | −36 | gb105pln | glucose and ribitol dehydrogenase homolog [*Hordeum vulgare* = barley, Aura, embryo, mRNA, 1170 nt]. |
| 700261133H1 | g2443890 | 12 | 3 | gb105eukp | F11P17.16 |
| 700265469H1 | g2293565 | 62 | −50 | gb105pln | *Oryza sativa* ADP-ribosylation factor 1 (Os-ARF1) mRNA, complete cds. |
| 700257248H1 | g1181330 | 83 | −17 | gb105pln | *Z. mays* CNX mRNA. |
| 700268180H1 | g452559 | 68 | −63 | gb105pln | *Zea mays* group 3 Lea protein MGL3 mRNA, complete cds. |
| 700258544H1 | g2645971 | 26 | −9 | gb105eukp | RGP; reversibly glycosylated |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | polypeptide-3 |
| 700263661H1 | g1488311 | 27 | −9 | gb105pln | Sorghum bicolor dehydrin (DHN2) mRNA, partial cds. |
| 700266491H1 | g168460 | 88 | −79 | gb105pln | Zea mays cyclophilin (CyP) mRNA, complete cds. |
| 700259129H2 | g2648031 | 30 | −16 | gb105pln | Solanum tuberosum mRNA for alpha-glucosidase. |
| 700266464H1 | g454872 | 43 | −61 | gb105pln | Maize mRNA for group 3 Lea protein MGL3, complete cds. |
| 700258322H1 | g392943 | 18 | 5 | gb105pln | Lophopyrum elongatum salt-stress induced ESI3 gene, complete cds. |
| 700258078H1 | g633890 | 21 | 4 | gb105allp | glucose and ribitol dehydrogenase homolog [barley, Hordeum vulgare, Peptide, 293 aa] |
| 700261640H1 | g1296954 | 63 | −54 | gb105pln | O. sativa mRNA for novel protein, osr40cl. |
| 700266572H1 | g687244 | 54 | −69 | gb105pln | Zea mays oil body protein 16 kDa oleosin (ole16) gene, complete cds. |
| 700264780H1 | g596079 | 47 | −74 | gb105pln | Zea mays thiamine biosynthetic enzyme (thil-2) mRNA, complete cds. |
| 700266731H1 | g168608 | 53 | −21 | gb105pln | Maize 17S ribosomal RNA gene and flanks. |
| 700265559H1 | g1575127 | 68 | −82 | gb105pln | Zea mays lumenal binding protein cBiPe2 mRNA, complete cds. |
| 700267218H1 | g1161511 | 32 | −21 | gb105pln | A. thaliana mRNA for shaggy-like kinase etha. |
| 700266244H1 | g473976 | 58 | −47 | gb105pln | Rice mRNA, partial homologous to elongation factor 1-alpha gene. |
| 700257528H1 | g22281 | 85 | −29 | gb105pln | Zea mays Glb1-0 gene for vicilin-like storage protein (truncated). |
| 700264078H1 | g1669597 | 14 | −3 | gb105eukp | AR192 |
| 700259345H1 | g2809244 | 16 | 2 | gb105eukp | F21B7.13 |
| 700262515H1 | g485099 | 11 | −1 | gb105eukp | mel-32; highly similar to serine hydromethyltransferase |
| 700264254H1 | g1171351 | 31 | −21 | gb105pln | Oryza sativa 16 kDa oleosin (ole16) mRNA, complete cds. |
| 700264558H1 | g687246 | 25 | −11 | gb105pln | Zea mays oil body protein 17 kDa oleosin (ole17) gene, complete cds. |
| 700262962H1 | g168512 | 35 | −26 | gb105pln | Maize major protein (L3) mRNA from the surface of lipid bodies, 3' end. |
| 700267256H1 | g1657763 | 17 | −0 | gb105pln | Zea mays retrotransposon Ji-3 5' LTR and primer binding site DNA sequence. |
| 700266844H1 | g304217 | 12 | −1 | gb105pln | Hordeum vulgare abscisic acid and stress inducible (A22) gene. |
| 700258661H1 | g168440 | 36 | −57 | gb105pln | Zea mays chitinase A (seed chitinase) gene, complete cds. |
| 700267021H1 | g22118 | 49 | −53 | gb105pln | Z. mays DNA for Adh1-Cm allele. |
| 700264063H1 | g444044 | 42 | −82 | gb105pln | Z. mays mRNA for group 3 Lea protein MGL3. |
| 700264536H1 | g2459410 | 28 | −8 | gb105eukp | F4P9.4; putative thioredoxin |
| 700261627H1 | g168512 | 60 | −59 | gb105pln | Maize major protein (L3) mRNA from the surface of lipid bodies, 3' end. |
| 700263202H1 | g1051257 | 70 | −16 | gb105pln | Hordeum vulgare vacuolar ATPase catalytic subunit mRNA, partial cds. |
| 700260177H1 | g486385 | 28 | −15 | gb105eukp | ORF YKL215c |
| 700261695H1 | g1296808 | 65 | −51 | gb105pln | H. vulgare mRNA for xylose isomerase. |
| 700258184H1 | g1244773 | 15 | −1 | gb105eukp | RPL37A; Rpl37ap: 60S ribosomal protein L37a |
| 700256927H1 | g22283 | 36 | −23 | gb105pln | Zea mays Glb1-L gene for vicilin-like embryo storage protein. |
| 700258481H1 | g22138 | 85 | −21 | gb105pln | Z. mays gene for acetohydroxyacid synthase (AHAS108). |
| 700266604H1 | g2460180 | 16 | −2 | gb105allp | RNA binding protein |
| 700265085H1 | g19874 | 37 | −26 | gb105pln | N. tabacum mRNA for glutamate-1-semialdehyde aminotransferase. |
| 700261635H1 | g899609 | 45 | −44 | gb105pln | Zea mays acidic ribosomal protein P2 (RPA-2A1) mRNA, complete cds. |
| 700261794H1 | g984046 | 9 | 6 | gb105eukp | ATK1 |
| 700264956H1 | g633889 | 18 | 2 | gb105pln | glucose and ribitol dehydrogenase homolog [Hordeum vulgare = barley, Aura, embryo, mRNA, 1170 nt]. |
| 700258348H1 | g2829211 | 21 | −11 | gb105pln | Oryza sativa proteinase inhibitor (Rgpi9) gene, complete cds. |
| 700258296H1 | g687244 | 31 | −51 | gb105pln | Zea mays oil body protein 16 kDa oleosin (ole16) gene, complete cds. |
| 700260363H2 | g1694832 | 29 | −44 | gb105pln | H. vulgare Perl gene. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700266743H1 | g2511530 | 53 | −55 | gb105pln | *Eleusine indica* alpha tubulin 1 (TUA1) mRNA, complete cds. |
| 700266303H1 | g17931 | 26 | −10 | gb105pln | *B. secalinas* embryo-specific mRNA. |
| 700267462H1 | g22118 | 45 | −61 | gb105pln | *Z. mays* DNA for Adhl-Cm allele. |
| 700261252H1 | g971279 | 39 | −39 | gb105pln | Rice mRNA for RAB24 protein, complete cds. |
| 700257974H1 | g22283 | 61 | −58 | gb105pln | *Zea mays* Glb1-L gene for vicilin-like embryo storage protein. |
| 700266183H1 | g2584827 | 19 | −2 | gb105pln | Sequence of BAC F12F1 from *Arabidopsis thaliana* chromosome 1, complete sequence. |
| 700260446H1 | g806807 | 24 | −19 | gb105pln | *Pisum sativum* chaperonin precursor mRNA, chloroplast gene encoding chloroplast protein, complete cds. |
| 700260028H1 | g2315579 | 21 | 7 | gb105allp | Similar to ABC transporter; coded for by *C. elegans* cDNA yk9Sa12.5; coded for by *C. elegans* cDNA yk169d7.5 |
| 700256923H1 | g22272 | 65 | −30 | gb105pln | Maize mRNA for enolase (2-phospho-D-glycerate hydrolase) |
| 700258794H1 | g206886 | 14 | 7 | gb105allp | homologue to sec61 |
| 700263763H1 | g1524006 | 9 | 6 | gb105allp | protein kinase |
| 700264864H1 | g536303 | 12 | 0 | gb105eukp | ORF YBR061c |
| 700266720H1 | g22292 | 54 | −2 | gb105pln | *Z. mays* mRNA for glycine-rich protein. |
| 700261194H1 | g808825 | 9 | −9 | gb105eukp | unknown protein |
| 700262028H1 | g971279 | 52 | −41 | gb105pln | Rice mRNA for RAB24 protein, complete cds. |
| 700259305H1 | g22302 | 32 | −83 | gb105pln | Maize Gpc1 gene for glyceraldehyde-3-phosphate dehydrogenase (GADPH) subunit C. |
| 700263836H1 | g22281 | 59 | −4 | gb105pln | *Zea mays* Glb1-0 gene for vicilin-like storage protein (truncated). |
| 700266206H1 | g2655268 | 9 | 8 | gb105allp | phenylacetaldehyde dehydrogenase |
| 700266109H1 | g1399266 | 18 | −4 | gb105pln | *Arabidopsis thaliana* calmodulin-domain protein kinase CDPK isoform 4 (CPK4) mRNA, partial cds. |
| 700263116H1 | g790969 | 47 | −1 | gb105pln | Rice mRNA for aldolase C-1, complete cds. |
| 700258432H1 | g1575129 | 45 | −36 | gb105pln | *Zea mays* lumenal binding protein cBiPe3 mRNA, complete cds. |
| 700262346H1 | g1694832 | 32 | −48 | gb105pln | *H. vulgare* Perl gene. |
| 700261025H1 | g1513227 | 49 | −25 | gb105pln | *Brassica napus* myo-inositol 1-phosphate synthase mRNA, complete cds. |
| 700258570H1 | g899236 | 10 | 4 | gb105eukp | F22B5.2 |
| 700261232H1 | g558648 | 19 | −3 | gb105eukp | D-myo-inositol-3-phosphate synthase; EC 5.5.1.4 |
| 700261813H1 | g1513227 | 25 | −11 | gb105pln | *Brassica napus* myo-inositol 1-phosphate synthase mRNA, complete cds. |
| 700262515H1 | g2330795 | 9 | −1 | gb105eukp | SPAC24C9.12c; serine hydroxymethyltransferase |
| 700264742H1 | g2245073 | 24 | −21 | gb105pln | *Arabidopsis thaliana* DNA chromosome 4, ESSA I contig fragment No. 8. |
| 700266811H1 | g22281 | 78 | −59 | gb105pln | *Zea mays* Glb1-0 gene for vicilin-like storage protein (truncated). |
| 700268130H1 | g22287 | 7 | 7 | gb105allp | vicilin-like embryo storage protein |
| 700266131H1 | g286011 | 22 | −1 | gb105allp | KIAA0002 |
| 700264783H1 | g971279 | 49 | −47 | gb105pln | Rice mRNA for RAB24 protein, complete cds. |
| 700265114H1 | g2282583 | 99 | −86 | gb105pln | *Zea mays* elongation factor 1-alpha (EF1-A) mRNA, complete cds. |
| 700265213H1 | g1403043 | 13 | 7 | gb105pln | *H. chilense × T. turgidum* conv. durum (Tritordeum) mRNA for S-adenosylmethionine decarboxylase. |
| 700268139H1 | g2274990 | 57 | −55 | gb105pln | *Hordeum vulgare* mRNA for expressed sequence tag. |
| 700257617H1 | g1321917 | 27 | 7 | gb105eukp | su12; cytoplasmic ribosomal protein S7 |
| 700263631H1 | g971279 | 14 | −10 | gb105pln | Rice mRNA for RAB24 protein, complete cds. |
| 700260279H1 | g633890 | 18 | 4 | gb105allp | glucose and ribitol dehydrogenase homolog [barley, *Hordeum vulgare*, Peptide, 293 aa] |
| 700261253H1 | g1203905 | 15 | −10 | gb105eukp | M(1)15D; M(1)15D |
| 700262547H1 | g2511736 | 20 | −3 | gb105pln | *Nicotiana tabacum* caffeoyl-CoA 3-O-methyltransferase 5 (CCoAOMT-5) mRNA, complete cds. |
| 700267220H1 | g22270 | 52 | −78 | gb105pln | Maize mRNA from an embryogenic abscisic acid-inducible gene. |
| 700267036H1 | g22283 | 56 | −42 | gb105pln | *Zea mays* Glb1-L gene for vicilin-like embryo storage protein. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700260263H1 | g2661203 | 10 | 6 | gb105eukp | rpl13; ribosomal protein L13 |
| 700258560H1 | g483547 | 42 | −28 | gb105eukp | pyrophosphate-dependent phosphofructokinase alpha subunit |
| 700207150H1 | g758246 | 37 | −23 | gb105pln | *Phalaenopsis* sp. mRNA for S-adenosyhomocysteine hydrolase. |
| 700262420H1 | g2145356 | 15 | −10 | gb105eukp | ATHB-14; HD-Zip protein |
| 700267271H1 | g514945 | 100 | −94 | gb105pln | *Zea mays* sucrose synthase (Sus1) mRNA, complete cds. |
| 700262587H1 | g396209 | 37 | −33 | gb105pln | *S. polyrrhiza* mRNA for D-myo-inositol-3-phosphate synthase. |
| 700267217H1 | g473878 | 36 | 3 | gb105allp | calnexin homolog |
| 700267172H1 | g2791947 | 22 | −3 | gb105pln | *Lupinus luteus* mRNA for ribosomal protein L13a. |
| 700266830H1 | g687244 | 66 | −50 | gb105pln | *Zea mays* oil body protein 16 kDa oleosin (ole16) gene, complete cds. |
| 700258634H1 | g1215788 | 35 | −23 | gb105eukp | PKR; coacts with chalcone synthase to produce 6'-deoxychalcone; polyketide reductase |
| 700266681H1 | g2331300 | 35 | −45 | gb105pln | *Zea mays* ribosomal protein S4 type I (rps4) mRNA, complete cds. |
| 700257223H1 | g1216244 | 14 | 1 | gb105eukp | SPAC19G10.04c; unknown |
| 700267890H1 | g415316 | 32 | −29 | gb105pln | Rice mRNA for acidic ribosomal protein P0, complete cds. |
| 700265830H1 | g2282583 | 90 | −16 | gb105pln | *Zea mays* elongation factor 1-alpha (EF1-A) mRNA, complete cds. |
| 700263173H1 | g1658314 | 31 | 5 | gb105pln | *O. sativa* osr40g3 gene. |
| 700263484H1 | g747879 | 10 | 15 | gb105pln | Yeast (*Saccharomyces cerevisiae*) chromosome IV cosmid 9727. |
| 700265218H1 | g2578033 | 19 | 2 | gb105allp | omega-6 desaturase |
| 700258322H1 | g439272 | 18 | 4 | gb105pln | *H. vulgare* blt101 mRNA. |
| 700258319H1 | g248336 | 78 | −83 | gb105pln | polyubiquitin [maize, Genomic, 3841 nt]. |
| 700207130H1 | g1022806 | 23 | −17 | gb105pln | *Arabidopsis thaliana* cellulase (OR16pep) mRNA, complete cds. |
| 700261508H1 | g2760170 | 17 | 15 | gb105pln | *Arabidopsis thaliana* genomic DNA, chromosome 5, P1 clone: MIO24, complete sequence. |
| 700264850H1 | g248336 | 69 | −79 | gb105pln | polyubiquitin [maize, Genomic, 3841 nt]. |
| 700268180H1 | g444044 | 68 | −63 | gb105pln | *Z. mays* mRNA for group 3 Lea protein MGL3. |
| 700266419H1 | g633890 | 24 | 0 | gb105allp | glucose and ribitol dehydrogenase homolog [barley, Hordeum vulgare, Peptide, 293 aa] |
| 700266244H1 | g2662342 | 59 | −47 | gb105pln | *Oryza sativa* mRNA for EF-1 alpha, complete cds. |
| 700265923H1 | g1399567 | 39 | −66 | gb105pln | *Podophyllum peltatum* nuclear 26S ribosomal RNA gene, partial sequence. |
| 700262943H1 | g22514 | 47 | −58 | gb105pln | Maize Zc1 gene for Zein Zc1 (14 kD zein-2). |
| 700267482H1 | g22285 | 28 | −5 | gb105pln | *Zea mays* Glb1-S gene for vicilin-like embryo storage protein. |
| 700261308H1 | g505623 | 17 | 1 | gb105eukp | plasma membrane calcium ATPase |
| 700266890H1 | g18963 | 84 | −53 | gb105pln | *Z. mays* mRNA for dehydrin (dhn3). |
| 700257308H1 | g469069 | 4 | 6 | gb105allp | NMDA receptor subunit NR2D |
| 700265410H1 | g1871173 | 13 | −3 | gb105pln | *Arabidopsis thaliana* chromosome II BAC T06D20 genomic sequence, complete sequence. |
| 700256838H1 | g1403043 | 11 | 11 | gb105pln | *H. chilense* × *T. turgidum* conv. durum (Tritordeum) mRNA for S-adenosylmethionine decarboxylase. |
| 700263074H1 | g2352494 | 29 | −7 | gb105eukp | TIR1; transport inhibitor response 1 |
| 700264622H1 | g2829903 | 64 | −32 | gb105eukp | T26J12.14 |
| 700266855H1 | g304505 | 26 | 5 | gb105allp | elongation factor 2 |
| 700265822H1 | g21629 | 94 | −26 | gb105pln | *Sorghum vulgare* mRNA for phosphoenolpyruvate carboxylase (PEPC). |
| 700258066H1 | g435648 | 52 | −39 | gb105pln | Rice mRNA for gamma-Tip, complete cds. |
| 700266153H1 | g6711 | 21 | −4 | gb105eukp | F02A9.5 |
| 700259589H1 | g2827554 | 7 | 3 | gb105eukp | T12H17.160; putative DNA binding protein |
| 700258154H1 | g22287 | 7 | 8 | gb105allp | vicilin-like embryo storage protein |
| 700265502H1 | g17782 | 18 | 7 | gb105eukp | Bplo |
| 700265602H1 | g290275 | 45 | −1 | gb105eukp | M(3)95A; multifunctional activity and location; ribosomal protein S3/AP endonuclease DNA repair protein |
| 700260542H2 | g2621768 | 8 | 5 | gb105allp | ribonuclease PH |
| 700207180H1 | g285637 | 64 | −56 | gb105pln | *Hordeum vulgare* mRNA for vacuolar membrane proton-translocating inorganic pyrophosphat. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700263075H1 | g575291 | 58 | −25 | gb105pln | *H. vulgare* mRNA for SNF1-related protein kinase. |
| 700257265H1 | g296203 | 69 | −17 | gb105pln | *P. miliaceum* mRNA for alanine aminotransferase. |
| 700260982H1 | g927238 | 81 | −53 | gb105pln | *Zea mays* globulin1 (Gib1) gene, allele Glb1-Hb, complete cds. |
| 700267975H1 | g577611 | 30 | −24 | gb105pln | *Zea mays* CRT1 gene for calcium-binding protein. |
| 700266556H1 | g2191177 | 24 | −6 | gb105eukp | A_IG002P16.25 |
| 700261941H1 | g471320 | 43 | −44 | gb105pln | *H. vulgare* (cv. Bomi) B15C mRNA. |
| 700262561H1 | g1724111 | 19 | 8 | gb105pln | *Triticum aestivum* ABA induced plasma membrane protein PM-19 (WTABAPM) mRNA, complete cds. |
| 700263917H1 | g304026 | 11 | −5 | gb105allp | UV-damaged DNA-binding protein |
| 700262991H1 | g1129084 | 31 | −4 | gb105pln | Wheat mRNA for protein H2A, complete cds, clone wcH2A-3. |
| 700264806H1 | g170064 | 14 | 1 | gb105eukp | sbp; glucose binding protein |
| 700267282H1 | g602605 | 73 | −84 | gb105pln | *Zea mays* tandem genes for alpha1-tubulin and alpha2-tubulin. |
| 700265487H1 | g460990 | 80 | −68 | gb105pln | *O. sativa* (Arborio) Beta Tubulin mRNA, clone OSTB-16. |
| 700259044H1 | g202852 | 8 | 6 | gb105allp | aldose reductase |
| 700257868H1 | g19012 | 32 | −1 | gb105pln | *H. vulgare* mRNA for LEA B19.1 protein. |
| 700267952H1 | g1694832 | 32 | −51 | gb105pln | *H. vulgare* Per1 gene. |
| 700258915H1 | g1946266 | 20 | 1 | gb105pln | *O. sativa* mRNA for myb factor, 1355 bp. |
| 700264745H1 | g22285 | 82 | 5 | gb105pln | *Zea mays* Glb1-S gene for vicilin-like embryo storage protein. |
| 700264196H1 | g20598 | 37 | −0 | gb105pln | *P. miliaceum* mRNA for aspartate aminotransferase (pcAAT2). |
| 700267520H1 | g22281 | 61 | −80 | gb105pln | *Zea mays* Glb1-0 gene for vicilin-like storage protein (truncated). |
| 700258230H1 | g20238 | 14 | 5 | gb105allp | GOS2 gene product |
| 700263681H1 | g166680 | 5 | −1 | gb105eukp | CTR1; protein kinase |
| 700260516H2 | g1724111 | 22 | −1 | gb105pln | *Triticum aestivum* ABA induced plasma membrane protein PM-19 (WTABAPM) mRNA, complete cds. |
| 700264266H1 | g171782 | 16 | 2 | gb105pln | Yeast (*Saccharomyces cerevisiae*) dihydrolipoyl transsuccinylase (KGD2) gene, complete cds. |
| 700266963H1 | g168500 | 63 | −53 | gb105pln | Maize (*Zea mays*) histone H4 gene (H4C14), complete cds. |
| 700261630H1 | g1814424 | 62 | −13 | gb105eukp | homeodomain protein AHDP |
| 700257855H1 | g19784 | 24 | 3 | gb105pln | *N. tabacum* atpC mRNA for gamma subunit of ATP synthase. |
| 700262546H1 | g248336 | 65 | −48 | gb105pln | polyubiquitin [maize, Genomic, 3841 nt]. |
| 700264421H1 | g1066162 | 24 | −12 | gb105pln | *B. napus* mRNA for glyoxysomal beta-ketoacyl-thiolase precursor. |
| 700264811H1 | g603338 | 10 | 6 | gb105allp | Ubc6p: ubiquitin-conjugating enzyme; YER100W |
| 700264357H1 | g22283 | 43 | −32 | gb105pln | *Zea mays* Glb1-L gene for vicilin-like embryo storage protein. |
| 700261061H1 | g168396 | 22 | 12 | gb105pln | *Zea mays* auxin-binding protein (abp1) gene, exons 1–5 and complete cds. |
| 700263942H1 | g2274990 | 48 | −53 | gb105pln | *Hordeum vulgare* mRNA for expressed sequence tag. |
| 700264144H1 | g1173554 | 28 | −1 | gb105pln | *Pisum sativum* UDP-galactose-4-epimerase (galE) mRNA, complete cds. |
| 700262137H1 | g687244 | 49 | −80 | gb105pln | *Zea mays* oil body protein 16 kDa oleosin (ole16) gene, complete cds. |
| 700261210H1 | g1302004 | 8 | 7 | gb105allp | ORF YNL096c |
| 700258888H1 | g168512 | 46 | −42 | gb105pln | Maize major protein (L3) mRNA from the surface of lipid bodies, 3' end. |
| 700207129H1 | g1513227 | 33 | −24 | gb105pln | *Brassica napus* myo-inositol 1-phosphate synthase mRNA, complete cds. |
| 700265406H1 | g2239259 | 38 | −46 | gb105pln | *Zea mays* mRNA for cinnamoyl CoA reductase. |
| 700262230H1 | g2415699 | 17 | −4 | gb105pln | *P. pratense* mRNA for profilin 3. |
| 700261343H1 | g603220 | 18 | 6 | gb105pln | *Medicago sativa* 6-phosphogluconate dehydrogenase mRNA, complete cds. |
| 700261202H1 | g777757 | 34 | −42 | gb105pln | Saccharum hybrid (clone SCUBI561) polyubiquitin mRNA, complete cds. |
| 700262306H1 | g927239 | 6 | 7 | gb105allp | globulin1 |
| 700257169H1 | g1724112 | 21 | 6 | gb105allp | ABA induced plasma membrane protein PM 19 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700266003H1 | g2826881 | 54 | −16 | gb105pln | *Arabidopsis thaliana* mRNA for transcription factor IIA small subunit. |
| 700261447H1 | g2618699 | 9 | 6 | gb105eukp | T32G6.16 |
| 700257572H1 | g924631 | 22 | −4 | gb105pln | *Solanum lycopersicum* predominantly pistil-, sepal-, and fruit-expressed unknown protein mRNA, partial cds. |
| 700262749H1 | g168512 | 52 | −12 | gb105pln | Maize major protein (L3) mRNA from the surface of lipid bodies, 3' end. |
| 700265476H1 | g21732 | 24 | −16 | gb105pln | Wheat mRNA for Em protein. |
| 700267546H1 | g1711240 | 12 | 4 | gb105allp | TIS |
| 700265861H1 | g22284 | 16 | −6 | gb105eukp | Glb1-L; vicilin-like embryo storage protein |
| 700261609H1 | g1403043 | 11 | 11 | gb105pln | *H. chilense* × *T. turgidum* conv. durum (Tritordeum) mRNA for S-adenosylmethionine decarboxylase. |
| 700257939H1 | g2828286 | 25 | −9 | gb105eukp | T18B16.80; kinase-like protein |
| 700257901H1 | g1915974 | 41 | −3 | gb105eukp | FK; fructokinase; EC 2.7.1.4 |
| 700261272H1 | g170432 | 28 | −24 | gb105pln | Tomato ATP-dependent protease (CD4A) gene, complete cds. |
| 700265829H1 | g1513227 | 40 | −41 | gb105pln | *Brassica napus* myo-inositol 1-phosphate synthase mRNA, complete cds. |
| 700261257H1 | g169022 | 43 | −43 | gb105pln | *Pisum sativum* chloroplast stromal 70 kDa heat shock protein (hsp70) mRNA, complete cds. |
| 700259725H1 | g1749824 | 38 | 1 | gb105pln | *N. plumbaginifolia* mRNA for G protein beta-subunit-like protein. |
| 700259177H2 | g15948 | 48 | −40 | gb105pln | *A. calamus* 18S ribosomal RNA, partial sequence. |
| 700264474H1 | g452559 | 49 | −57 | gb105pln | *Zea mays* group 3 Lea protein MGL3 mRNA, complete cds. |
| 700263059H1 | g22302 | 39 | −73 | gb105pln | Maize Gpc1 gene for glyceraldehyde-3-phosphate dehydrogenase (GADPH) subunit C. |
| 700266478H1 | g1305524 | 80 | −48 | gb105pln | *Oryza sativa* Wilms' tumor-related protein QM mRNA, partial cds. |
| 700267184H1 | g2737890 | 16 | 7 | gb105allp | nucleolar protein CaCbf5p |
| 700258967H1 | g763204 | 19 | −2 | gb105eukp | TCP1beta; Tcp1betap |
| 700262703H1 | g1498356 | 41 | −46 | gb105pln | *Nicotiana tabacum* actin (Tob104) gene, partial cds. |
| 700263139H1 | g452559 | 49 | −14 | gb105pln | *Zea mays* group 3 Lea protein MGL3 mRNA, complete cds. |
| 700267845H1 | g21732 | 23 | −19 | gb105pln | Wheat mRNA for Em protein. |
| 700267651H1 | g311339 | 7 | 4 | gb105eukp | unknown |
| 700267220H1 | g450353 | 24 | −14 | gb105pln | *H. vulgare* (cv Bomi) gB19.1b gene. |
| 700265187H1 | g984755 | 12 | 13 | gb105pln | *O. sativa* mRNA for chilling-inducible protein. |
| 700268010H1 | g2398678 | 33 | −26 | gb105pln | *Morinda citrifolia* mRNA for 3-deoxy-D-arabino-heptulosonate 7-phosphate synthase, DS1. |
| 700266627H1 | g687244 | 72 | −3 | gb105pln | *Zea mays* oil body protein 16 kDa oleosin (ole16) gene, complete cds. |
| 700267581H1 | g22222 | 52 | −76 | gb105pln | *Z. mays* ZSF4C4 gene for zein. |
| 700266742H1 | g1050840 | 25 | 4 | gb105eukp | snRNP protein, U1snRNP-specific protein, U1A; U1A |
| 700258363H1 | g2264311 | 16 | 9 | gb105pln | *Arabidopsis thaliana* genomic DNA, chromosome 5, P1 clone: MLN1, complete sequence. |
| 700264535H1 | g168480 | 54 | −71 | gb105pln | Maize embryo globulin S allele (7S-like) mRNA, complete cds. |
| 700256732H1 | g460042 | 12 | 3 | gb105eukp | DBF3; involved in the control of S phase and pre-mRNA splicing |
| 700265484H1 | g18890 | 41 | −25 | gb105pln | *H. vulgare* gene for aldose reductase-related protein. |
| 700256881H1 | g1469220 | 24 | −19 | gb105pln | *B. oleracea* mRNA (unknown). |
| 700263993H1 | g22270 | 75 | −82 | gb105pln | Maize mRNA from an embryogenic abscisic acid-inducible gene. |
| 700264455H1 | g927238 | 27 | −24 | gb105pln | *Zea mays* globulin1 (Glb1) gene, allele Glb1-Hb, complete cds. |
| 700268101H1 | g257807 | 30 | −3 | gb105pln | cyppdkZm1 = orthophosphate dikinase {5' region} [maize, Genomic, 895 nt]. |
| 700257052H1 | g2570066 | 20 | 17 | gb105pln | *Pisum sativum* mRNA for second sucrose synthase. |
| 700267570H1 | g168481 | 7 | 8 | gb105allp | globulin precursor |
| 700259363H1 | g1087070 | 50 | −43 | gb105pln | Pgh1b = 2-phospho-D-glycerate hydrolase [*Mesembryanthemum crystallinum* = common ice plant, mRNA Partial, 1683 nt]. |
| 700258593H1 | g1100740 | 10 | 13 | gb105pln | *Panicum miliaceum* mRNA for 2-oxoglutarate/malate translocator, complete cds. |
| 700263993H1 | g19016 | 26 | −17 | gb105pln | *H. vulgare* mRNA for LEA B19.4 protein. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700265687H1 | g1785861 | 40 | −48 | gb105pln | *Elaeis guineensis* var. *tenera* stearoyl-Acyl-carrier protein desaturase mRNA, partial cds. |
| 700268153H1 | g312180 | 34 | −77 | gb105pln | *Z. mays* GapC4 gene. |
| 700262382H1 | g397400 | 50 | −11 | gb105pln | *B. rapa* mRNA for S phase specific gene. |
| 700267206H1 | g1321917 | 27 | 5 | gb105eukp | su12; cytoplasmic ribosomal protein S7 |
| 700257226H1 | g403218 | 25 | 7 | gb105allp | Transplantation Antigene |
| 700256843H1 | g22281 | 55 | −61 | gb105pln | *Zea mays* Glb1-0 gene for vicilin-like storage protein (truncated). |
| 700261022H1 | g633889 | 18 | 10 | gb105pln | glucose and ribitol dehydrogenase homolog [*Hordeum vulgare* = barley, Aura, embryo, mRNA, 1170 nt]. |
| 700257760H1 | g2827141 | 17 | −13 | gb105eukp | Ath-A; cellulose synthase catalytic subunit |
| 700263366H1 | g897761 | 17 | 1 | gb105allp | protein phosphatase 5 |
| 700257908H1 | g22284 | 6 | 6 | gb105allp | vicilin-like embryo storage protein |
| 700257371H1 | g1419684 | 38 | −17 | gb105pln | *M. sativa* mRNA for TCTP-like protein. |
| 700207221H1 | g19852 | 21 | −31 | gb105pln | *N. tabacum* mRNA for cytochrome b5 (partial) |
| 700263854H1 | g2665839 | 21 | 6 | gb105pln | *Zea mays* putative histone deacetylase RPD3 mRNA, complete cds. |
| 700257538H1 | g2814982 | 59 | −7 | gb105eukp | T21B10.7 |
| 700266303H1 | g1694832 | 26 | −10 | gb105pln | *H. vulgare* Per1 gene. |
| 700259710H1 | g927238 | 49 | −78 | gb105pln | *Zea mays* globulin1 (Glb1) gene, allele Glb1-Hb, complete cds. |
| 700264017H1 | g2443888 | 18 | 3 | gb105eukp | F11P17.14 |
| 700258553H1 | g168480 | 48 | −63 | gb105pln | Maize embryo globulin S allele (7S-like) mRNA, complete cds. |
| 700258285H1 | g1502355 | 9 | 5 | gb105eukp | GCN5 |
| 700268150H1 | g313759 | 92 | −37 | gb105pln | *Z. mays* hsp 70-1 gene for heat shock protein 70. |
| 700267475H1 | g1652993 | 13 | 2 | gb105allp | aspartyl-tRNA synthetase |
| 700264757H1 | g388052 | 89 | −84 | gb105pln | *Zea mays* alcohol dehydrogenase (Adh1-S) mRNA, complete cds. |
| 700257182H1 | g2264309 | 23 | −9 | gb105pln | *Arabidopsis thaliana* genomic DNA, chromosome 5, P1 clone MJJ3, complete sequence. |
| 700263988H1 | g2651296 | 12 | 6 | gb105eukp | T2P4.3; b-zip DNA-binding protein |
| 700264864H1 | g2813984 | 9 | −2 | gb105eukp | R74.7 |
| 700267252H1 | g2668737 | 63 | −65 | gb105pln | *Zea mays* translation initiation factor 5A (TIF5A) mRNA, complete cds. |
| 700261362H1 | g479047 | 11 | 0 | gb105eukp | SRG1 |
| 700264345H1 | g290275 | 46 | −13 | gb105eukp | M(3)95A; multifunctional activity and location; ribosomal protein S3/AP endonuclease DNA repair protein |
| 700264853H1 | g22287 | 10 | 1 | gb105allp | vicilin-like embryo storage protein |
| 700267788H1 | g168480 | 53 | 8 | gb105pln | Maize embryo globulin S allele (7S-like) mRNA, complete cds. |
| 700266378H1 | g1899026 | 31 | −74 | gb105pln | *Zea mays* superoxide dismutase 4A (sod4A) gene, complete cds. |
| 700262649H1 | g312569 | 57 | −14 | gb105pln | *I. latifolius* 26S rRNA (partial). |
| 700260027H1 | g169475 | 39 | 6 | gb105eukp | 3-deoxy-D-arabino-heptulosonate 7-phosphate synthase (arol; EC 4.1.2.15) precursor |
| 700264825H1 | g596079 | 60 | −75 | gb105pln | *Zea mays* thiamine biosynthetic enzyme (thil-2) mRNA, complete cds. |
| 700258925H1 | g20412 | 43 | −43 | gb105pln | *P. amygdalus* mRNA for alpha-tubulin. |
| 700257069H1 | g469147 | 30 | −17 | gb105pln | *H. vulgare* mRNA for alanine aminotransferase. |
| 700266305H1 | g433218 | 61 | −60 | gb105pln | Rice mRNA for SEC18 (gene name SS652), partial cds. |
| 700264252H1 | g870962 | 9 | 0 | gb105eukp | F09B9.3 |
| 700267547H1 | g2463334 | 32 | −33 | gb105pln | *Oryza sativa* mRNA for ribosomal protein S4. |
| 700265601H1 | g1002535 | 28 | 7 | gb105eukp | ACT12; actin-12 |
| 700261183H1 | g536895 | 21 | 15 | gb105pln | Wheat mRNA for protein H2A, complete cds, clone wcH2A-10. |
| 700267435H1 | g22283 | 42 | −25 | gb105pln | *Zea mays* Glb1-L gene for vicilin-like embryo storage protein. |
| 700261341H1 | g687244 | 37 | 4 | gb105pln | *Zea mays* oil body protein 16 kDa oleosin (ole16) gene, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700260464H1 | g2760167 | 18 | 4 | gb105pln | *Arabidopsis thaliana* genomic DNA, chromosome 5, P1 clone: MCO15, complete sequence. |
| 700266126H1 | g2258073 | 35 | −20 | gb105pln | *Hordeum vulgare* var. *distichum* soluble inorganic pyrophosphatase (Ipp) mRNA, complete cds. |
| 700258057H1 | g1549222 | 22 | −5 | gb105eukp | NtSAR1; NtSar1 protein |
| 700258638H1 | g168480 | 91 | −87 | gb105pln | Maize embryo globulin S allele (7S-like) mRNA, complete cds. |
| 700267470H1 | g168608 | 50 | −84 | gb105pln | Maize 17S ribosomal RNA gene and flanks. |
| 700266424H1 | g21598 | 21 | 4 | gb105pln | *S. tuberosum* mRNA for UDP-glucose pyrophosphorylase. |
| 700263709H1 | g469067 | 4 | 6 | gb105allp | NMDA receptor subunit NR2D |
| 700259141H2 | g22281 | 82 | −23 | gb105pln | *Zea mays* Glb1-0 gene for vicilin-like storage protein (truncated). |
| 700256728H1 | g2811284 | 5 | 8 | gb105allp | ribosomal protein S7 |
| 700262211H1 | g1209098 | 14 | −0 | gb105pln | *Arabidopsis thaliana* ovule development protein (AINTEGUMENTA) mRNA, complete cds. |
| 700264823H1 | g2160155 | 17 | 6 | gb105pln | Sequence of BAC F21M12 from *Arabidopsis thaliana* chromosome 1, complete sequence. |
| 700265087H1 | g1212995 | 68 | −59 | gb105pln | *H. vulgare* mRNA for UDP-glucose pyrophosphorylase. |
| 700267031H1 | g168406 | 49 | −51 | gb105pln | *Z. mays* alcohol dehydrogenase (ADH-1 C-m allele) gene, complete cds. |
| 700262643H1 | g506470 | 21 | −3 | gb105pln | *N. tabacum* mRNA pNLA-35. |
| 700267320H1 | g485952 | 35 | −11 | gb105pln | *O. sativa* mRNA for glutaredoxin. |
| 700260869H1 | g468732 | 31 | −13 | gb105pln | *R. sativus* (Fakir) APX mRNA for L-ascorbate peroxidase. |
| 700264110H1 | g168575 | 26 | −26 | gb105pln | Maize phospholipid transfer protein mRNA, complete cds. of clone 9C2. |
| 700261023H1 | g1825645 | 55 | −16 | gb105eukp | F46F11.4 |
| 700266193H1 | g168403 | 36 | −38 | gb105pln | Maize actin 1 gene (MAc1), complete cds. |
| 700259349H1 | g22287 | 8 | 7 | gb105allp | vicilin-like embryo storage protein |
| 700260151H1 | g166857 | 52 | −20 | gb105pln | *Arabidopsis thaliana* cytoplasmic ribosomal protein mRNA, complete cds. |
| 700264244H1 | g1171351 | 43 | −20 | gb105pln | *Oryza sativa* 16 kDa oleosin (ole16) mRNA, complete cds. |
| 700266934H1 | g2160155 | 27 | 2 | gb105pln | Sequence of BAC F21M12 from *Arabidopsis thaliana* chromosome 1, complete sequence. |
| 700266446H1 | g22283 | 58 | −56 | gb105pln | *Zea mays* Glb1-L gene for vicilin-like embryo storage protein. |
| 700263431H1 | g2331300 | 83 | −22 | gb105pln | *Zea mays* ribosomal protein S4 type I (rps4) mRNA, complete cds. |
| 700267396H1 | g687244 | 38 | −32 | gb105pln | *Zea mays* oil body protein 16 kDa oleosin (ole16) gene, complete cds. |
| 700265734H1 | g168508 | 57 | −7 | gb105pln | Maize oleosin KD18 (KD18; L2) gene, complete cds. |
| 700257609H1 | g2642446 | 27 | 7 | gb105eukp | T20D16.20; similar to auxin-responsive GH3 protein |
| 700259620H1 | g310314 | 41 | −51 | gb105pln | *Oryza sativa* calmodulin gene, complete cds. |
| 700266491H1 | g829147 | 92 | −83 | gb105pln | *Z. mays* gene for cyclophilin. |
| 700260952H1 | g927238 | 60 | −34 | gb105pln | *Zea mays* globulin1 (Glb1) gene, allele Glb1-Hb, complete cds. |
| 700263020H1 | g596077 | 30 | 0 | gb105pln | *Zea mays* thiamine biosynthetic enzyme (thi1-1) mRNA, complete cds. |
| 700261021H1 | g2414636 | 21 | −7 | gb105eukp | SPAC3A11.08; hypothetical protein |
| 700260556H2 | g168487 | 39 | −40 | gb105pln | Maize glutathione S-transferase gene (GST-I), exons 2 and 3. |
| 700265978H1 | g1762308 | 23 | −3 | gb105pln | *Camptotheca acuminata* AP-1 Golgi-related complex component protein (ap19) mRNA, complete cds. |
| 700257804H1 | g22314 | 66 | −62 | gb105pln | Maize mRNA for GSH gluthathione S-transferase I (GST;EC 2.5.1.18). |
| 700261941H1 | g971279 | 41 | −39 | gb105pln | Rice mRNA for RAB24 protein, complete cds. |
| 700259694H1 | g2286150 | 42 | −30 | gb105pln | *Zea mays* translation initiation factor (eIF-4A) mRNA, complete cds. |
| 700264474H1 | g444044 | 49 | −57 | gb105pln | *Z. mays* mRNA for group 3 Lea protein MGL3. |
| 700266088H1 | g1532072 | 52 | −48 | gb105pln | *Z. mays* mRNA for S-adenosylmethionine decarboxylase. |
| 700266928H1 | g452559 | 33 | −36 | gb105pln | *Zea mays* group 3 Lea protein MGL3 mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700261061H1 | g22174 | 22 | 12 | gb105pln | Maize Aux311 gene for auxin-binding protein. |
| 700262834H1 | g166974 | 41 | −27 | gb105pln | Barley acyl carrier protein III (ACP III) mRNA, complete cds. |
| 700261861H1 | g1000489 | 26 | 6 | gb105eukp | gdcsPB; glycine decarboxylase; P-protein precursor of glycine cleavage system; EC 2.1.2.10 |
| 700263139H1 | g444044 | 49 | −14 | gb105pln | Z. mays mRNA for group 3 Lea protein MGL3. |
| 700262846H1 | g687244 | 73 | −37 | gb105pln | Zea mays oil body protein 16 kDa oleosin (ole16) gene, complete cds. |
| 700258273H1 | g20755 | 24 | −10 | gb105pln | P. sativum mRNA rab for ras-related GTP-binding protein. |
| 700258246H1 | g687244 | 52 | −79 | gb105pln | Zea mays oil body protein 16 kDa oleosin (ole16) gene, complete cds. |
| 700258021H1 | g1420671 | 13 | 1 | gb105eukp | ORF YOR304w |
| 700257582H1 | g577548 | 13 | 2 | gb105eukp | C16C10.7 |
| 700267496H1 | g1532047 | 56 | −15 | gb105pln | O. sativa mRNA for S-adenosylmethionine decarboxylase. |
| 700257160H1 | g2570506 | 53 | −48 | gb105pln | Oryza sativa ribosomal protein mRNA, complete cds. |
| 700260162H1 | g1235566 | 20 | 13 | gb105pln | O. sativa mRNA for group 3 LEA (type I) protein. |
| 700258034H1 | g168512 | 47 | −41 | gb105pln | Maize major protein (L3) mRNA from the surface of lipid bodies, 3' end. |
| 700258679H1 | g168400 | 13 | 16 | gb105pln | Zea mays auxin-binding protein (abp5) gene, exons 1–4 and 5' end of cds. |
| 700268079H1 | g22537 | 92 | −90 | gb105pln | Maize mRNA for zein polypeptide (clone M6). |
| 700266888H1 | g1360108 | 16 | 5 | gb105allp | putative gamma-thionin protein |
| 700265291H1 | g1408296 | 23 | −4 | gb105eukp | pgmA; phosphoglucomutase A |
| 700262083H1 | g397632 | 25 | −31 | gb105pln | T. aestivum translation initiation factor 4A. |
| 700266874H1 | g927239 | 15 | 4 | gb105allp | globulin1 |
| 700262093H1 | g551287 | 39 | −21 | gb105pln | Z. mays (W22) phosphoglycerate mutase gene (exon 1). |
| 700264290H1 | g1694621 | 11 | 5 | gb105allp | 3-ketoacyl-CoA thiolase |
| 700266206H1 | g1789015 | 11 | 4 | gb105allp | succinate-semialdehyde dehydrogenase |
| 700256734H1 | g2267005 | 36 | −27 | gb105pln | Oryza sativa endosperm lumenal binding protein (BiP) mRNA, complete cds. |
| 700267021H1 | g168406 | 49 | −53 | gb105pln | Z. mays alcohol dehydrogenase (ADH-1 C-m allele) gene, complete cds. |
| 700258723H1 | g780371 | 50 | −42 | gb105pln | Oryza sativa enolase mRNA, complete cds. |
| 700267328H1 | g1870152 | 17 | 1 | gb105eukp | sec61; ER translocation; SEC61 protein |
| 700258893H1 | g287297 | 49 | −42 | gb105pln | Oryza sativa mRNA for aspartate aminotransferase, complete cds. |
| 700263262H1 | g1171351 | 20 | −10 | gb105pln | Oryza sativa 16 kDa oleosin (ole16) mRNA, complete cds. |
| 700267218H1 | g2182028 | 33 | −28 | gb105pln | Oryza sp. mRNA for shaggy-like kinase etha. |
| 700258772H1 | g1161311 | 41 | −29 | gb105pln | Arabidopsis thaliana Columbia myo-inositol-1-phosphate synthase mRNA, complete cds. |
| 700257046H1 | g2494106 | 29 | 2 | gb105pln | Arabidopsis thaliana chromosome 1 YAC yUP8H12R, complete sequence. |
| 700264872H1 | g1694832 | 31 | −49 | gb105pln | H. vulgare Per1 gene. |
| 700258290H1 | g452473 | 62 | −66 | gb105pln | Zea mays Black Mexican Sweet alpha-tubulin mRNA, complete cds. |
| 700262416H1 | g1388084 | 12 | −4 | gb105eukp | TRX5; thioredoxin h |
| 700262745H1 | g790977 | 44 | −29 | gb105pln | B. juncea msams mRNA. |
| 700264336H1 | g451192 | 17 | −17 | gb105pln | Triticum aestivum (wali7) mRNA, 3' end, partial cds. |
| 700262858H1 | g18591 | 18 | 6 | gb105eukp | GH3; auxin-responsive GH3 product |
| 700263922H1 | g1842187 | 40 | −8 | gb105pln | B. pendula mRNA encoding mitochondrial phosphate translocator. |
| 700262215H1 | g1263308 | 9 | 7 | gb105allp | phosphatase 2A inhibitor I2PP2A |
| 700263545H1 | g1184771 | 55 | 4 | gb105pln | Zea mays glyceraldehyde-3-phosphate dehydrogenase GAPC2 (gpc2) mRNA, complete cds. |
| 700265823H1 | g2454181 | 32 | −14 | gb105pln | Arabidopsis thaliana pyruvate dehydrogenase E1 alpha subunit mRNA, nuclear gene encoding plastid protein, complete cds. |
| 700262982H1 | g168571 | 76 | −54 | gb105pln | Zea mays tryptophan synthase beta-subunit (TSB1) mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700268071H1 | g2264318 | 26 | −4 | gb105pln | *Arabidopsis thaliana* genomic DNA, chromosome 5, P1 clone: MUP24, complete sequence. |
| 700257910H1 | g460990 | 46 | −52 | gb105pln | *O. sativa* (Arborio) Beta Tubulin mRNA, clone OSTB-16. |
| 700264367H1 | g2738749 | 20 | 9 | gb105pln | *Zea mays* ATP sulfurylase mRNA, complete cds. |
| 700267021H1 | g22119 | 92 | −56 | gb105pln | Maize Adh1-F mRNA for alcohol dehydrogenase. |
| 700258490H1 | g857573 | 41 | −24 | gb105pln | *Oryza sativa* vacuolar H+-ATPase (vatp-P1) mRNA, complete cds. |
| 700266011H1 | g2244747 | 16 | 8 | gb105pln | *Arabidopsis thaliana* DNA chromosome 4, ESSA I contig fragment No. 0. |
| 700266983H1 | g1694832 | 40 | −32 | gb105pln | *H. vulgare* Per1 gene. |
| 700265454H1 | g1272605 | 20 | −7 | gb105eukp | C10C5.6 |
| 700267439H1 | g904154 | 29 | −19 | gb105eukp | microsomal omega-6 desaturase |
| 700259361H1 | g1644207 | 15 | 6 | gb105allp | ribosomal protein L13 |
| 700265012H1 | g471345 | 20 | 7 | gb105eukp | g6pdh; glucose-6-phosphate 1-dehydrogenase; EC 1.1.1.49 |
| 700267266H1 | g21891 | 56 | −3 | gb105pln | *T. aestivum* (clone pTAU1.4) U1 snRNA. |
| 700265859H1 | g1841869 | 18 | 7 | gb105pln | *Pimpinella brachycarpa* elongation factor 1-beta (EF-1-beta) mRNA, complete cds. |
| 700256866H1 | g2832657 | 5 | 7 | gb105eukp | F28J12.180; putative protein |
| 700260677H1 | g1167963 | 21 | 2 | gb105allp | 18-56 protein |
| 700259088H1 | g22284 | 8 | 6 | gb105eukp | Glb1-L; vicilin-like embryo storage protein |
| 700258816H1 | g927238 | 57 | −56 | gb105pln | *Zea mays* globulin1 (Glb1) gene, allele Glb1-Hb, complete cds. |
| 700264361H1 | g2446980 | 20 | 9 | gb105pln | *Arabidopsis thaliana* mRNA for AtGDI2, complete cds. |
| 700267306H1 | g397395 | 47 | −40 | gb105pln | *Z. mays* MNB1b mRNA for DNA-binding protein. |
| 700261483H1 | g218082 | 41 | 0 | gb105pln | Rice mRNA for initiation factor eIF-4D (225 gene), partial sequence. |
| 700260191H1 | g2213600 | 14 | −1 | gb105eukp | T7N9.20 |
| 700264567H1 | g217870 | 27 | −10 | gb105pln | *A. thaliana* mRNA for t-complex polypeptide 1 homologue, complete cds. |
| 700259361H1 | g2632416 | 15 | 6 | gb105allp | ribosomal protein L13 |
| 700259218H1 | g2821958 | 44 | −27 | gb105pln | *Nicotiana sylvestris* mRNA for spermidine synthase, complete cds. |
| 700267095H1 | g20320 | 25 | −3 | gb105eukp | rab25; rab25 product |
| 700267462H1 | g22119 | 90 | −64 | gb105pln | Maize Adh1-F mRNA for alcohol dehydrogenase. |
| 700260010H1 | g1070353 | 20 | 10 | gb105pln | *H. vulgare* mRNA for Hv14-3-3b. |
| 700261412H1 | g2462755 | 21 | −8 | gb105eukp | F8A5.14; RNA polymerase subunit (isoform B) |
| 700207243H1 | g170010 | 11 | 3 | gb105eukp | MP2; maturation polypeptide |
| 700265180H1 | g687244 | 45 | −82 | gb105pln | *Zea mays* oil body protein 16 kDa oleosin (ole16) gene, complete cds. |
| 700264263H1 | g218182 | 38 | −22 | gb105pln | Rice mRNA for oryzain beta (EC 3.4.22). |
| 700265101H1 | g168480 | 95 | −55 | gb105pln | Maize embryo globulin S allele (7S-like) mRNA, complete cds. |
| 700261210H1 | g1420271 | 7 | 8 | gb105eukp | RP30 |
| 700264140H1 | g1752735 | 16 | 17 | gb105pln | Yeast DNA for MNN4 gene, complete cds. |
| 700261901H1 | g21732 | 18 | −17 | gb105pln | Wheat mRNA for Em protein. |
| 700262914H1 | g1177347 | 14 | 10 | gb105pln | Yeast (*Saccharomyces pombe*) chromosome I cosmid 26A3. |
| 700268025H1 | g22284 | 10 | 3 | gb105eukp | Glb1-L; vicilin-like embryo storage protein |
| 700266174H1 | g1724103 | 18 | 10 | gb105pln | *Mesembryanthemum crystallinum* methionine adenosyltransferase mRNA, complete cds. |
| 700264173H1 | g168604 | 62 | −73 | gb105pln | *Zea mays* viviparous-1 mRNA, complete cds. |
| 700262215H1 | g545265 | 6 | 7 | gb105allp | Set beta isoform = leukemogenesis protein {alternatively spliced} [rats, neonatal kidney, Peptide, 277 aa] |
| 700267657H1 | g1129144 | 15 | 5 | gb105pln | *M. indica* (Manila) THMF5 mRNA for 3-ketoacyl-coA thiolase B. |
| 700264147H1 | g471320 | 64 | 0 | gb105pln | *H. vulgare* (cv. Bomi) B15C mRNA. |
| 700265873H1 | g527618 | 30 | −17 | gb105pln | *Glycine max* 3-methylcrotonyl-CoA carboxylase mRNA, biotin-carrier domain, partial cds. |
| 700265219H1 | g18047 | 42 | −13 | gb105pln | *C. latifoila* mRNA CUR09 for curculin. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700265378H1 | g167244 | 27 | −14 | gb105pln | *Chlorella kessleri* elongation factor 2 mRNA, complete cds. |
| 700207210H1 | g2632252 | 20 | −1 | gb105eukp | SNFL1; serine/threonine kinase |
| 700261261H1 | g21493 | 17 | −10 | gb105eukp | mpp; mitochondrial processing peptidase |
| 700262370H1 | g22542 | 91 | −79 | gb105pln | Maize gene for Mr 19000 alpha zein and 5'-flanking region. |
| 700265143H1 | g21834 | 71 | −58 | gb105pln | Wheat mRNA for cytosolic phosphoglycerate kinase (EC 2.7.2.3). |
| 700266281H1 | g169472 | 36 | −29 | gb105pln | Potato alpha-glucan phosphorylase type H isozyme mRNA, complete cds. |
| 700266568H1 | g168512 | 49 | −48 | gb105pln | Maize major protein (L3) mRNA from the surface of lipid bodies, 3' end. |
| 700265124H1 | g22285 | 70 | −79 | gb105pln | *Zea mays* Glb1-S gene for vicilin-like embryo storage protein. |
| 700262561H1 | g1724112 | 23 | 4 | gb105allp | ABA induced plasma membrane protein PM 19 |
| 700258533H1 | g21734 | 25 | −29 | gb105pln | *T. aestivum* (cDNA I) mRNA for EC protein. |
| 700263670H1 | g1519250 | 50 | −32 | gb105pln | *Oryza sativa* GF14-c protein mRNA, complete cds. |
| 700258668H1 | g2369713 | 56 | −52 | gb105pln | *Beta vulgaris* cDNA for elongation factor 2. |
| 700263591H1 | g293888 | 98 | −85 | gb105pln | *Zea mays*, glyceraldehyde-3-phosphate dehydrogenase mRNA, 3' end (clone GAPC2). |
| 700264383H1 | g1841307 | 17 | 3 | gb105pln | Fission Yeast mRNA for ribosomal protein S16 homolog, partial cds. |
| 700261655H1 | g168512 | 49 | −44 | gb105pln | Maize major protein (L3) mRNA from the surface of lipid bodies, 3' end. |
| 700264290H1 | g393707 | 11 | 5 | gb105eukp | 3-ketoacyl-CoA thiolase; EC 2.3.1.16 |
| 700261761H1 | g16485 | 49 | −18 | gb105pln | *A. thaliana* gene for RNA polymerase II second largest subunit. |
| 700267610H1 | g19103 | 52 | −45 | gb105pln | *H. vulgare* mRNA for ribosomal protein L17-2. |
| 700264678H1 | g21624 | 46 | −35 | gb105pln | *S. vulgare* mRNA for glycine-rich RNA-binding protein (clone S2). |
| 700263343H1 | g2739216 | 36 | 3 | gb105pln | *Hordeum vulgare* L41 ribosomal protein. |
| 700260426H1 | g218229 | 55 | −20 | gb105pln | Rice mRNA for Aspartate aminotransferase. |
| 700258406H1 | g1171351 | 30 | −15 | gb105pln | *Oryza sativa* 16 kDa oleosin (ole16) mRNA, complete cds. |
| 700262068H1 | g168512 | 43 | −41 | gb105pln | Maize major protein (L3) mRNA from the surface of lipid bodies, 3' end. |
| 700265105H1 | 91800227 | 13 | 5 | gb105eukp | Bowman-Birk proteinase inhibitor |
| 700260813H1 | g1519248 | 48 | −30 | gb105pln | *Oryza sativa* GF14-b protein mRNA, complete cds. |
| 700263934H1 | g2262140 | 7 | 5 | gb105allp | putative protein trafficking component |
| 700266928H1 | g444044 | 33 | −36 | gb105pln | *Z. mays* mRNA for group 3 Lea protein MGL3. |
| 700265859H1 | g398607 | 14 | 3 | gb105pln | *A. thaliana* mRNA for elongation factor 1 beta. |
| 700264140H1 | g486357 | 17 | 16 | gb105pln | Yeast (*Saccharomyces cerevisiae*) chromosome XI reading frame ORF YKL202w. |
| 700257879H1 | g168512 | 37 | −3 | gb105pln | Maize major protein (L3) mRNA from the surface of lipid bodies, 3' end. |
| 700265592H1 | g1171351 | 27 | −13 | gb105pln | *Oryza sativa* 16 kDa oleosin (ole16) mRNA, complete cds. |
| 700268188H1 | g1403043 | 11 | 11 | gb105pln | *H. chilense* x *T. turgidum* conv. durum (Tritordeum) mRNA for s-adenosylmethionine decarboxylase. |
| 700256836H1 | g1200160 | 30 | −14 | gb105pln | *T. gesneriana* mRNA for tonoplast intrinsic protein. |
| 700257053H1 | g975887 | 49 | −3 | gb105pln | *Mesembryanthemum crystallinum* myo-inositol-1-phosphate synthase mRNA, complete cds. |
| 700263604H1 | g1402891 | 48 | −7 | gb105eukp | orf18; unknown |
| 700265562H1 | g1183936 | 14 | 13 | gb105pln | *P. sativum* 5S rRNA gene. |
| 700267368H1 | g2642446 | 43 | −11 | gb105eukp | T20D16.20; similar to auxin-responsive GH3 protein |
| 700265562H1 | g20163 | 39 | −28 | gb105pln | *O. sativa* Rr15 mRNA for 5S ribosomal RNA. |
| 700259349H1 | g168481 | 8 | 7 | gb105eukp | globulin precursor |
| 700260508H1 | g312516 | 19 | 15 | gb105pln | *T. aestivum* Em mRNA. |
| 700262455H1 | g1055071 | 26 | −17 | gb105eukp | C23G10.2 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264120H1 | g167112 | 35 | −3 | gb105pln | *Bromus inermis* aldose reductase-related protein, complete cds. |
| 700267926H1 | g2654209 | 54 | −48 | gb105pln | *Spinacia oleracea* heat shock 70 protein (HSC70-10) mRNA, nuclear gene encoding mitochondrial protein, complete cds. |
| 700258528H1 | g1143501 | 32 | −12 | gb105pln | *H. vulgare* mRNA for ADP-glucose pyrophosphorylase small subunit (1902 bp). |
| 700258534H1 | g1272405 | 24 | −6 | gb105pln | *Arabidopsis thaliana* immunophilin (FKBP15-1) mRNA, complete cds. |
| 700262629H1 | g2656031 | 24 | −9 | gb105pln | *Arabidopsis thaliana* genomic DNA, chromosome 5, P1 clone: MXC20. |
| 700259646H1 | g687244 | 57 | −76 | gb105pln | *Zea mays* oil body protein 16 kDa oleosin (ole16) gene, complete cds. |
| 700263353H1 | g780371 | 29 | −14 | gb105pln | *Oryza sativa* enolase mRNA, complete cds. |
| 700267467H1 | g1154858 | 74 | −65 | gb105pln | *H. vulgare* mRNA for L24 ribosomal protein. |
| 700266293H1 | g168481 | 7 | 8 | gb105allp | globulin precursor |
| 700266126H1 | g534915 | 30 | −15 | gb105pln | *S. tuberosum* (Desiree) ppa mRNA for soluble inorganic pyrophosphatase. |
| 700267755H1 | g18963 | 90 | −11 | gb105pln | *Z. mays* mRNA for dehydrin (dhn3). |
| 700267462H1 | g168406 | 45 | −61 | gb105pln | *Z. mays* alcohol dehydrogenase (ADH-1 C-m allele) gene, complete cds. |
| 700267906H1 | g2213425 | 23 | −3 | gb105eukp | unknown; hypothetical protein |
| 700257521H1 | g2331300 | 58 | 1 | gb105pln | *Zea mays* ribosomal protein S4 type I (rps4) mRNA, complete cds. |
| 700261356H1 | g1431513 | 18 | 7 | gb105eukp | LCB2 |
| 700265113H1 | g596079 | 61 | −71 | gb105pln | *Zea mays* thiamine biosynthetic enzyme (thi1-2) mRNA, complete cds. |
| 700265148H1 | g1916867 | 16 | −3 | gb105eukp | who; muscle development; WHO |
| 700264887H1 | g2331300 | 76 | −84 | gb105pln | *Zea mays* ribosomal protein S4 type I (rps4) mRNA, complete cds. |
| 700261331H1 | g2511573 | 27 | −3 | gb105pln | *Arabidopsis thaliana* mRNA for proteasome subunit prc3. |
| 700266981H1 | g2330786 | 21 | 7 | gb105eukp | SPAC24C9.03; diphosphomevalonate decarboxylase |
| 700261308H1 | g2618691 | 19 | 0 | gb105eukp | T32G6.8; putative chloroplast envelope Ca2+-ATPase |
| 700263308H1 | g2760165 | 14 | 12 | gb105pln | *Arabidopsis thaliana* genomic DNA, chromosome 5, P1 clone: MAC9, complete sequence. |
| 700265873H1 | g497180 | 26 | −13 | gb105pln | *Lycopersicon esculentum* biotin-containing subunit of methylcrotonyl-CoA carboxylase mRNA, partial cds. |
| 700258527H1 | g2821958 | 50 | −43 | gb105pln | *Nicotiana sylvestris* mRNA for spermidine synthase, complete cds. |
| 700256914H1 | g1498387 | 49 | −20 | gb105pln | *Zea mays* actin (Maz83) gene, partial cds. |
| 700261179H1 | g500689 | 29 | 2 | gb105pln | Yeast (*Saccharomyces cerevisiae*) chromosome VIII cosmid 8082. |
| 700264515H1 | g1136574 | 52 | −75 | gb105pln | Sorghum bicolor heat shock protein 70 (hsp70) pseudogene. |
| 700260594H2 | g1086773 | 25 | −11 | gb105eukp | T02G5.9 |
| 700263267H1 | g1184771 | 100 | −92 | gb105pln | *Zea mays* glyceraldehyde-3-phosphate dehydrogenase GAPC2 (gpc2) mRNA, complete cds. |
| 700267088H1 | g902583 | 77 | −77 | gb105pln | *Zea mays* clone MubG1 ubiquitin gene, complete cds. |
| 700261076H1 | g520935 | 30 | 7 | gb105pln | *H. vulgare* mRNA for gamma-TIP-like protein. |
| 700261343H1 | g603221 | 10 | 2 | gb105allp | 6-phosphogluconate dehydrogenase |
| 700268179H1 | g1906364 | 34 | −18 | gb105eukp | CCT gamma; chaperonin subunit CCTV gamma |
| 700260871H1 | g2191160 | 12 | 1 | gb105eukp | A_IG002P16.5 |
| 700258363H1 | g2264312 | 15 | −14 | gb105pln | *Arabidopsis thaliana* genomic DNA, chromosome 5, P1 clone: MOK16, complete sequence. |
| 700261874H1 | g2191137 | 11 | 1 | gb105allp | similar to the GDSL family of lipolytic enzymes |
| 700266972H1 | g633109 | 49 | −40 | gb105pln | Rice mRNA for plasma membrane H+-ATPase, complete cds. |
| 700261763H1 | g1864000 | 87 | −87 | gb105pln | Maize DNA for Fd III, complete cds. |
| 700264274H1 | g973312 | 13 | 11 | gb105pln | *Arabidopsis thaliana* myo-inositol 1-phosphate synthase isozyme-2 mRNA, complete cds. |
| 700262453H1 | g687244 | 71 | −23 | gb105pln | *Zea mays* oil body protein 16 kDa oleosin (ole16) gene, complete cds. |
| 700262241H1 | g1694832 | 32 | −47 | gb105pln | *H. vulgare* Per1 gene. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700262295H1 | g1669660 | 80 | 6 | gb105eukp | CAFP; protein of AAA family |
| 700262623H1 | g987122 | 49 | −40 | gb105pln | *Z. mays* mRNA for class II metallothionein. |
| 700266588H1 | g1181261 | 10 | 4 | gb105allp | dolichyl-phosphate beta-glucosyltransferase |
| 700266050H1 | g1575127 | 53 | −73 | gb105pln | *Zea mays* lumenal binding protein cBiPe2 mRNA, complete cds. |
| 700259322H1 | g1054880 | 25 | 0 | gb105allp | plasma membrane Ca2+-ATPase isoform 4 |
| 700264093H1 | g22283 | 46 | −24 | gb105pln | *Zea mays* Glb1-L gene for vicilin-like embryo storage protein. |
| 700262863H1 | g633889 | 48 | −37 | gb105pln | glucose and ribitol dehydrogenase homolog [*Hordeum vulgare* = barley, Aura, embryo, mRNA, 1170 nt]. |
| 700264122H1 | g168480 | 85 | −69 | gb105pln | Maize embryo globulin S allele (7S-like) mRNA, complete cds. |
| 700264564H1 | g687244 | 38 | −64 | gb105pln | *Zea mays* oil body protein 16 kDa oleosin (ole16) gene, complete cds. |
| 700256816H1 | g791093 | 16 | −3 | gb105eukp | RPP30; rubber particle protein |
| 700263901H1 | g804655 | 9 | 7 | gb105pln | *Hordeum vulgare* L. beta-glucosidase (BGQ60) gene, complete cds. |
| 700264641H1 | g2191182 | 20 | −6 | gb105eukp | A_TM021B04.2 |
| 700257052H1 | g2570067 | 29 | 7 | gb105allp | second sucrose synthase |
| 700264568H1 | g1171353 | 14 | 8 | gb105pln | *Oryza sativa* 18 kDa oleosin mRNA, complete cds. |
| 700258766H1 | g509769 | 12 | 3 | gb105eukp | seed-specific low molecular weight sulfur-rich protein |
| 700258720H1 | g304037 | 7 | 8 | gb105eukp | ENOD8; early nodulin |
| 700262783H1 | g600748 | 22 | 4 | gb105allp | Sm D2 |
| 700257087H1 | g852057 | 42 | 5 | gb105allp | casein kinase I-epsilon |
| 700265666H1 | g22149 | 73 | −75 | gb105pln | *Z. mays* mRNA for alpha-tubulin 3. |
| 700266826H1 | g168512 | 35 | −18 | gb105pln | Maize major protein (L3) mRNA from the surface of lipid bodies, 3' end. |
| 700265659H1 | g596079 | 39 | −7 | gb105pln | *Zea mays* thiamine biosynthetic enzyme (thil-2) mRNA, complete cds. |
| 700266985H1 | g2282583 | 79 | −72 | gb105pln | *Zea mays* elongation factor 1-alpha (EF1-A) mRNA, complete cds. |
| 700266977H1 | g471320 | 63 | −55 | gb105pln | *H. vulgare* (cv. Bomi) B15C mRNA. |
| 700266520H1 | g2058374 | 12 | −0 | gb105eukp | SPAC57A10.07; unknown |
| 700262608H1 | g1212780 | 33 | −22 | gb105pln | *B. juncea* mRNA for oleate desaturase. |
| 700207126H1 | g1724101 | 23 | 3 | gb105pln | *Mesembryanthemum crystallinum* S-adenosyl-L-homocystein hydrolase mRNA, complete cds. |
| 700266104H1 | g170455 | 58 | −34 | gb105pln | Tomato heat shock cognate protein 80 gene, 3' end. |
| 700266018H1 | g1504051 | 37 | −4 | gb105pln | Maize; corn mRNA for Calcium-dependent protein kinase, complete cds. |
| 700262961H1 | g166857 | 33 | −6 | gb105pln | *Arabidopsis thaliana* cytoplasmic ribosomal protein mRNA, complete cds. |
| 700266969H1 | g780371 | 56 | −26 | gb105pln | *Oryza sativa* enolase mRNA, complete cds. |
| 700266628H1 | g2645163 | 46 | −18 | gb105pln | *Oryza sativa* mRNA, similar to ribosomal protein L26. |
| 700256743H1 | g22275 | 18 | 4 | gb105pln | Maize mRNA for ferritin (clone FM1). |
| 700262608H1 | g2564236 | 24 | −11 | gb105pln | *G. hirsutum* mRNA for omega-6 desaturase. |
| 700260452H1 | g536895 | 31 | −14 | gb105pln | Wheat mRNA for protein H2A, complete cds, clone wcH2A-10. |
| 700257977H1 | g21834 | 60 | −63 | gb105pln | Wheat mRNA for cytosolic phosphoglycerate kinase (EC 2.7.2.3). |
| 700264351H1 | g294667 | 34 | −25 | gb105pln | Castor bean chloroplast beta-ketoacyl-ACP synthase (50 kDa synthase) mRNA, complete cds. |
| 700264974H1 | g2632253 | 31 | −19 | gb105pln | *S. bicolor* mRNA for putative protein serine/threonine kinase, clone cSNFL2. |
| 700257840H1 | g2293565 | 49 | −15 | gb105pln | *Oryza sativa* ADP-ribosylation factor 1 (Os-ARF1) mRNA, complete cds. |
| 700261719H1 | g1185553 | 44 | −21 | gb105pln | *Zea mays* glyceraldehyde-3-phosphate dehydrogenase (gpc2) gene, complete cds. |
| 700266438H1 | g2465430 | 9 | −3 | gb105eukp | JRG1.3; 32 kDa protein |
| 700266735H1 | g1458098 | 34 | 0 | gb105eukp | Gea8; globulin-like protein |
| 700263134H1 | g687244 | 86 | −18 | gb105pln | *Zea mays* oil body protein 16 kDa oleosin (ole16) gene, complete cds. |
| 700258215H1 | g1658312 | 59 | −66 | gb105pln | *O. sativa* osr40g2 gene. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700256847H1 | g21598 | 24 | 12 | gb105pln | *S. tuberosum* mRNA for UDP-glucose pyrophosphorylase. |
| 700207218H1 | g22283 | 62 | 4 | gb105pln | *Zea mays* Glb1-L gene for vicilin-like embryo storage protein. |
| 700264331H1 | g22283 | 61 | −66 | gb105pln | *Zea mays* Glb1-L gene for. vicilin-like embryo storage protein. |
| 700258503H1 | g168480 | 60 | −82 | gb105pln | Maize embryo globulin S allele (7S-like) mRNA, complete cds. |
| 700265039H1 | g22287 | 6 | 7 | gb105allp | vicilin-like embryo storage protein |
| 700257855H1 | g167404 | 27 | −12 | gb105pln | *C. reinhardtii* chloroplast ATP synthase gamma subunit mRNA, complete cds. |
| 700262123H1 | g1431053 | 32 | −9 | gb105eukp | PSA1 |
| 700265518H1 | g602565 | 13 | 1 | gb105eukp | INO1 |
| 700267717H1 | g531787 | 8 | −1 | gb105eukp | T09A5.11 |
| 700257901H1 | g1052973 | 41 | −3 | gb105eukp | fructokinase; EC 2.7.1.4 |
| 700267716H1 | g486050 | 16 | 5 | gb105eukp | ORF YKL040c |
| 700260988H1 | g473997 | 26 | 8 | gb105allp | gamma-Tip |
| 700264466H1 | g1405553 | 9 | 3 | gb105eukp | EhUBI1; ubiquitin |
| 700265936H1 | g1667591 | 41 | −34 | gb105pln | *Oryza sativa* histone 3 mRNA, complete cds. |
| 700259137H2 | g940385 | 25 | 6 | gb105eukp | beta-Amy; beta-amylase; EC 3.2.1.2 |
| 700264809H1 | g2244747 | 21 | −5 | gb105pln | *Arabidopsis thaliana* DNA chromosome 4, ESSA I contig fragment No. 0. |
| 700267208H1 | g22283 | 38 | −40 | gb105pln | *Zea mays* Glb1-L gene for vicilin-like embryo storage protein. |
| 700264875H1 | g452559 | 44 | −66 | gb105pln | *Zea mays* group 3 Lea protein MGL3 mRNA, complete cds. |
| 700265070H1 | g22121 | 66 | −65 | gb105pln | Maize alcohol dehydrogenase 1 gene (Adh1-1F). |
| 700267013H1 | g22281 | 97 | −12 | gb105pln | *Zea mays* Glb1-0 gene for vicilin-like storage protein (truncated). |
| 700265539H1 | g780371 | 52 | −40 | gb105pln | *Oryza sativa* enolase mRNA, complete cds. |
| 700260472H1 | g1000369 | 11 | 7 | gb105eukp | required for neurotransmitter release; vesicle-associated membrane protein/synaptobrevin binding protein |
| 700263116H1 | g22144 | 39 | −19 | gb105pln | Maize anaerobically regulated gene for fructose bisphosphate aldolase (EC 4.1.2.13). |
| 700265559H1 | g1575129 | 54 | −51 | gb105pln | *Zea mays* lumenal binding protein cBiPe3 mRNA, complete cds. |
| 700207164H1 | g1100771 | 17 | −1 | gb105allp | glucose-6-phosphate isomerase |
| 700263879H1 | g2257755 | 9 | −0 | gb105pln | *Zea mays* nucleolar histone deacetylase HD2-p39 mRNA, complete cds. |
| 700266254H1 | g18890 | 32 | −33 | gb105pln | *H. vulgare* gene for aldose reductase-related protein. |
| 700265779H1 | g2252863 | 13 | −9 | gb105eukp | A_TM018A10.14 |
| 700262966H1 | g887594 | 39 | −6 | gb105eukp | unknown |
| 700258570H1 | g1749496 | 14 | −5 | gb105eukp | similar to *Saccharomyces cerevisiae* no definition line found, GENEBANK Accession Number U33007 |
| 700257392H1 | g20359 | 39 | −38 | gb105pln | Rice gene for 17S ribosomal RNA. |
| 700207238H1 | g2832242 | 31 | −13 | gb105pln | *Zea mays* 22-kDa alpha zein gene cluster, complete sequence. |
| 700261790H1 | g1296954 | 37 | −18 | gb105pln | *O. sativa* mRNA for novel protein, osr40cl. |
| 700264359H1 | g2342735 | 18 | −2 | gb105eukp | T14G11.28 |
| 700267449H1 | g1100738 | 24 | −3 | gb105pln | *Panicum miliaceum* mRNA for 2-oxoglutarate/malate translocator, complete cds. |
| 700262207H1 | g22287 | 7 | 8 | gb105allp | vicilin-like embryo storage protein |
| 700265837H1 | g166623 | 15 | 7 | gb105eukp | alpha-TIP; tonoplast intrinsic protein |
| 700264147H1 | g971279 | 64 | 0 | gb105pln | Rice mRNA for RAB24 protein, complete cds. |
| 700261257H1 | g1143426 | 45 | −46 | gb105pln | *C. sativus* mRNA for heat shock protein 70 (hsp70). |
| 700261061H1 | g22118 | 23 | 12 | gb105pln | *Z. mays* DNA for Adh1-Cm allele. |
| 700261958H1 | g886470 | 44 | −37 | gb105pln | *C. roseus* MetE mRNA for methionine synthase. |
| 700257374H1 | g168543 | 58 | −30 | gb105pln | *Zea mays* putative ribosomal protein S8 mRNA, partial cds. |
| 700268067H1 | g22285 | 65 | −11 | gb105pln | *Zea mays* Glb1-S gene for vicilin-like embryo storage protein. |
| 700266501H1 | g2282583 | 74 | −79 | gb105pln | *Zea mays* elongation factor 1-alpha (EF1-A) mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700260677H1 | g2245467 | 21 | 2 | gb105allp | DUG |
| 700265548H1 | g21725 | 17 | −14 | gb105pln | *T. aestivum* (cDNA III) mRNA for EC protein. |
| 700259693H1 | g167064 | 33 | −26 | gb105pln | *Hordeum vulgare* beta-ketoacyl-ACP synthase I (Kas12) mRNA, complete cds. |
| 700260238H1 | g168442 | 38 | −26 | gb105pln | *Zea mays* chitinase B (seed chitinase) gene, 3′ end. |
| 700256720H1 | g1302535 | 12 | 1 | gb105allp | ORF YNR035c |
| 700257237H1 | g2708482 | 48 | −0 | gb105eukp | IAA25; IAA25 |
| 700267708H1 | g167007 | 73 | −69 | gb105pln | Barley cam gene encoding calmodulin, complete cds. |
| 700267526H1 | g533251 | 72 | 15 | gb105pln | *Zea mays* (clone pSM8) sucrose synthase 2 (Sus1) gene, complete cds. |
| 700266158H1 | g393400 | 90 | −85 | gb105pln | *Z. mays* mRNA for alpha-tubulin. |
| 700261474H1 | g687244 | 40 | −24 | gb105pln | *Zea mays* oil body protein 16 kDa oleosin (ole16) gene, complete cds. |
| 700257817H1 | g927238 | 66 | −44 | gb105pln | *Zea mays* globulin1 (Glb1) gene, allele Glb1-Hb, complete cds. |
| 700257060H1 | g577611 | 90 | −78 | gb105pln | *Zea mays* CRT1 gene for calcium-binding protein. |
| 700262031H1 | g1658321 | 34 | −5 | gb105pln | *S. tuberosum* mRNA for transketolase. |
| 700263464H1 | g899607 | 48 | 8 | gb105pln | *Zea mays* polyubiquitin (MubC5) mRNA, complete cds. |
| 700263860H1 | g179360 | 11 | 5 | gb105allp | branched-chain alpha-keto acid dehydrogenase E1-alpha subunit |
| 700266111H1 | g170064 | 10 | 1 | gb105eukp | sbp; glucose binding protein |
| 700260994H1 | g2196704 | 21 | 5 | gb105allp | MEK1 |
| 700258746H1 | g537445 | 39 | −31 | gb105pln | *Arabidopsis thaliana* heat shock protein AtHSP101 (Athsp101) mRNA, complete cds. |
| 700257146H1 | g1171351 | 17 | −11 | gb105pln | *Oryza sativa* 16 kDa oleosin (ole16) mRNA, complete cds. |
| 700256925H1 | g1730332 | 24 | −12 | gb105eukp | (R)-(+)-mandelonitrile lyase isoform MDL1 precursor |
| 700265928H1 | g1323460 | 15 | −12 | gb105eukp | PUP2 |
| 700259481H1 | g2398678 | 28 | 12 | gb105pln | *Morinda citrifolia* mRNA for 3-deoxy-D-arabino-heptulosonate 7-phosphate synthase, DS1. |
| 700258761H1 | g2827001 | 44 | −52 | gb105pln | *Triticum aestivum* 70 kDa heat shock protein (TaHSP70d) mRNA, complete cds. |
| 700256909H1 | g790969 | 77 | −76 | gb105pln | Rice mRNA for aldolase C-1, complete cds. |
| 700262662H1 | g2654868 | 18 | 6 | gb105eukp | RbohAp108 |
| 700264907H1 | g687244 | 45 | −74 | gb105pln | *Zea mays* oil body protein 16 kDa oleosin (ole16) gene, complete cds. |
| 700266630H1 | g2369714 | 21 | 7 | gb105eukp | elongation factor 2 |
| 700256844H1 | g1129145 | 25 | −4 | gb105eukp | THMP1; 3-ketoacyl-CoA thiolase B; EC 2.3.1.16 |
| 700266058H1 | g550543 | 28 | −22 | gb105pln | *A. thaliana* mRNA for ribosomal protein L16. |
| 700257851H1 | g2384757 | 65 | −36 | gb105pln | *Oryza sativa* GDP dissociation inhibitor protein OsGDI1 (OsGDI1) mRNA, complete cds. |
| 700266494H1 | g1737168 | 23 | −11 | gb105pln | *Arabidopsis thaliana* homologue to SKP1 (ATskp1) mRNA, complete cds. |
| 700256924H1 | g22287 | 7 | 8 | gb105allp | vicilin-like embryo storage protein |
| 700259514H1 | g16513 | 24 | 2 | gb105pln | *A. thaliana* gene for suppressor-like protein. |
| 700263491H1 | g22272 | 98 | −84 | gb105pln | Maize mRNA for enolase (2-phospho-D-glycerate hydrolase). |
| 700266438H1 | g2465426 | 9 | −3 | gb105eukp | JRG1.1; 32 kDa protein |
| 700263334H1 | g1665827 | 15 | 4 | gb105allp | Similar to Human Na+/H+ exchanger 2 (A57644) |
| 700267548H1 | g2286150 | 71 | −80 | gb105pln | *Zea mays* translation initiation factor (eIF-4A) mRNA, complete cds. |
| 700258347H1 | g1171351 | 13 | 13 | gb105pln | *Oryza sativa* 16 kDa oleosin (ole16) mRNA, complete cds. |
| 700262468H1 | g1632821 | 49 | −9 | gb105pln | *O. sativa* mRNA for transmembrane protein. |
| 700262520H1 | g1907362 | 21 | 8 | gb105pln | *Taxus baccata* 28S ribosomal RNA gene, partial sequence. |
| 700257645H1 | g2828186 | 22 | 14 | gb105pln | *Arabidopsis thaliana* genomic DNA, chromosome 5, TAC clone: K18I23, complete sequence. |
| 700258661H1 | g168442 | 40 | −64 | gb105pln | *Zea mays* chitinase B (seed chitinase) gene, 3′ end. |
| 700258972H1 | g18259 | 46 | −15 | gb105pln | *C. sativus* mRNA for cs DnaJ-1. |
| 700262420H1 | g2145358 | 14 | −7 | gb105eukp | ATHB-9; transcription factor; |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700267553H1 | g927238 | 45 | −55 | gb105pln | HD-Zip protein<br>*Zea mays* globulin1 (Glb1)<br>gene, allele Glb1-Hb, complete cds. |
| 700259380H1 | g312509 | 8 | 3 | gb105allp | ORF328 |
| 700263785H1 | g1171351 | 24 | −5 | gb105pln | *Oryza sativa* 16 kDa oleosin<br>(ole16) mRNA, complete cds. |
| 700263259H1 | g474816 | 23 | −4 | gb105allp | R07E5.13 |
| 700265184H1 | g625147 | 98 | −90 | gb105pln | *Zea mays* protein disulfide<br>isomerase (pdi) mRNA, complete cds. |
| 700264603H1 | g436782 | 58 | −51 | gb105pln | Rice mRNA for cyc07, complete<br>cds. |
| 700265230H1 | g2335192 | 7 | 7 | gb105eukp | Atmyc-146; DNA binding; bHLH<br>protein |
| 700266065H1 | g218099 | 23 | −46 | gb105pln | Rice mRNA for ribosomal<br>protein S12 (320 gene), partial sequence. |
| 700258176H1 | g2282583 | 98 | −86 | gb105pln | *Zea mays* elongation factor<br>1-alpha (EF1-A) mRNA, complete cds. |
| 700264361H1 | g1655423 | 21 | 8 | gb105pln | *Arabidopsis thaliana* mRNA for<br>GDP dissociation inhibitor, complete cds. |
| 700261794H1 | g984048 | 9 | 6 | gb105allp | ATK1 gene product |
| 700266201H1 | g1592681 | 10 | 4 | gb105eukp | LEA D113 homologue type2 |
| 700264063H1 | g454872 | 42 | −82 | gb105pln | Maize mRNA for group 3 Lea<br>protein MGL3, complete cds. |
| 700264084H1 | g971699 | 6 | −2 | gb105allp | ribosomal protein S7 |
| 700264955H1 | g2262105 | 25 | −4 | gb105eukp | T19F06.8 |
| 700263654H1 | g1107889 | 19 | −4 | gb105pln | Yeast (*Saccharomyces pombe*)<br>chromosome I cosmid c11D3. |
| 700265952H1 | g22118 | 59 | −29 | gb105pln | *Z. mays* DNA for Adh1-Cm allele. |
| 700259236H1 | g2431770 | 85 | −85 | gb105pln | *Zea mays* acidic ribosomal<br>protein P2b (rpp2b) mRNA, complete cds. |
| 700267218H1 | g1161509 | 33 | −23 | gb105pln | *A. thaliana* mRNA for<br>shaggy-like kinase dzeta. |
| 700259842H1 | g495263 | 23 | −8 | gb105eukp | sec61; sec61 protein |
| 700267781H1 | g454303 | 16 | 3 | gb105eukp | LDJ2 |
| 700267652H1 | g1890353 | 12 | 16 | gb105pln | *B. napus* mRNA for ascorbate<br>peroxidase. |
| 700266785H1 | g1808686 | 18 | −3 | gb105allp | hypothetical protein |
| 700263141H1 | g1055158 | 34 | 5 | gb105eukp | F10G7.4 |
| 700265451H1 | g602564 | 50 | −45 | gb105pln | *C. paradisi* (Macf) IN01 gene. |
| 700261748H1 | g303852 | 28 | 7 | gb105pln | Rice mRNA for ribosomal<br>protein L3, complete cds. |
| 700264534H1 | g687244 | 50 | −83 | gb105pln | *Zea mays* oil body protein 16<br>kDa oleosin (ole16) gene, complete cds. |
| 700264875H1 | g444044 | 44 | −66 | gb105pln | *Z. mays* mRNA for group 3 Lea<br>protein MGL3. |
| 700263220H1 | g429016 | 70 | −11 | gb105pln | Rice mRNA for Wilm's tumor<br>suppressor (gene name SS501), partial cds. |
| 700267475H1 | g2649677 | 7 | 5 | gb105allp | aspartyl-tRNA synthetase<br>(aspS) |
| 700265022H1 | g2282583 | 64 | −53 | gb105pln | *Zea mays* elongation factor<br>1-alpha (EF1-A) mRNA, complete cds. |
| 700260544H2 | g643479 | 10 | 3 | gb105eukp | GCN20; Gcn20p |
| 700263366H1 | g972155 | 15 | 1 | gb105allp | phosphoprotein phosphatase |
| 700261356H1 | g505313 | 18 | 7 | gb105eukp | SCS1; ScS1p |
| 700257383H1 | g21629 | 40 | −22 | gb105pln | *Sorghum vulgare* mRNA for<br>phosphoenolpyruvate carboxylase (PEPC). |
| 700258038H1 | g2738247 | 48 | −37 | gb105pln | *Arabidopsis thaliana*<br>cobalamin-independent methionine synthase (ATCIMS) mRNA, complete cds. |
| 700266977H1 | g971279 | 58 | −51 | gb105pln | Rice mRNA for RAB24 protein,<br>complete cds. |
| 700207221H1 | g414704 | 25 | −40 | gb105pln | *O. sativa* mRNA for cytochrome<br>b5. |
| 700264664H1 | g21492 | 25 | −13 | gb105pln | *S. tuberosum* mRNA for<br>mitochondrial processing peptidase. |
| 700265638H1 | g1694832 | 32 | −52 | gb105pln | *H. vulgare* Per1 gene. |
| 700267604H1 | g687244 | 39 | 3 | gb105pln | *Zea mays* oil body protein 16<br>kDa oleosin (ole16) gene, complete cds. |
| 700267648H1 | g22270 | 98 | −30 | gb105pln | Maize mRNA from an embryogenic<br>abscisic acid-inducible gene. |
| 700261349H1 | g1040728 | 22 | −3 | gb105pln | *H. annuus* mRNA for<br>extraplastidial fusion protein. |
| 700259589H1 | g2598227 | 11 | −2 | gb105eukp | AHP1; AT-hook protein 1 |
| 700263687H1 | g22340 | 60 | −54 | gb105pln | Maize gene for heat shock<br>protein 70 exon 1 (hsp70; clone pMON 9502). |
| 700257642H1 | g1155213 | 47 | 0 | gb105eukp | aldose reductase-related<br>protein; EC 1.1.1.21 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700266109H1 | g1235716 | 21 | −11 | gb105pln | *Arabidopsis thaliana* mRNA for calcium-dependent protein kinase (CDPK), complete cds. |
| 700258134H1 | g22283 | 40 | −49 | gb105pln | *Zea mays* Glb1-L gene for vicilin-like embryo storage protein. |
| 700264256H1 | g687244 | 36 | −86 | gb105pln | *Zea mays* oil body protein 16 kDa oleosin (ole16) gene, complete cds. |
| 700258365H1 | g2564214 | 29 | −3 | gb105pln | *Arabidopsis thaliana* mRNA for glycyl-tRNA synthetase. |
| 700264336H1 | g2624219 | 13 | 14 | gb105pln | *M. acuminata* mRNA; clone pBAN UD75. |
| 700267734H1 | g1729751 | 9 | 6 | gb105eukp | 2K795.d |
| 700266062H1 | g563926 | 24 | −10 | gb105pln | *Zea mays* xyloglucan endo-transglycosylase homolog mRNA, complete cds. |
| 700261412H1 | g514322 | 18 | −10 | gb105eukp | RNA polymerase subunit |
| 700261631H1 | g960289 | 31 | −3 | gb105eukp | anthranilate synthase alpha subunit |
| 700263723H1 | g1015663 | 7 | 7 | gb105allp | ORF YJR024c |
| 700264802H1 | g687244 | 55 | −50 | gb105pln | *Zea mays* oil body protein 16 kDa oleosin (ole16) gene, complete cds. |
| 700259382H1 | g1622938 | 24 | −1 | gb105pln | *Bromus secalinus* oleosin (ole16) mRNA, complete cds. |
| 700262615H1 | g1296954 | 33 | −21 | gb105pln | *O. sativa* mRNA for novel protein, osr40c1. |
| 700258552H1 | g687244 | 74 | 10 | gb105pln | *Zea mays* oil body protein 16 kDa oleosin (ole16) gene, complete cds. |
| 700262766H1 | g1498052 | 57 | −30 | gb105pln | *Zea mays* ribosomal protein S8 mRNA, complete cds. |
| 700264260H1 | g2081612 | 15 | −1 | gb105eukp | OSP5CS; delta1-pyrroline-5-carboxylate synthetase |
| 700262891H1 | g22340 | 78 | −35 | gb105pln | Maize gene for heat shock protein 70 exon 1 (hsp70; clone pMON 9502). |
| 700265887H1 | g170696 | 3 | 8 | gb105eukp | Gb11; storage protein |
| 700261516H1 | g168575 | 37 | −8 | gb105pln | Maize phospholipid transfer protein mRNA, complete cds. of clone 9C2. |
| 700259355H1 | g2160438 | 5 | 7 | gb105allp | glutamate receptor channel subunit epsilon 4 |
| 700257008H1 | g971890 | 42 | 5 | gb105allp | translation elongation factor eEF-1 alpha chain |
| 700267577H1 | g1197461 | 17 | 0 | gb105eukp | CKI2; casein kinase I |
| 700257646H1 | g1546918 | 76 | −33 | gb105pln | *Z. mays* mRNA for translation initiation factor 5A. |
| 700264147H1 | g471321 | 71 | 3 | gb105allp | HvB15C gene product |
| 700267266H1 | g21892 | 50 | −11 | gb105pln | *T. aestivum* (clone pTAU1.3) U1 snRNA. |
| 700261846H1 | g2511591 | 49 | −17 | gb105pln | *Arabidopsis thaliana* mRNA for proteasome subunit prc8. |
| 700266361H1 | g509769 | 21 | 0 | gb105eukp | seed-specific low molecular weight sulfur-rich protein |
| 700267314H1 | g312518 | 23 | −10 | gb105pln | *T. aestivum* Em H2 gene. |
| 700262125H1 | g16499 | 10 | 7 | gb105allp | plastid ribosomal protein CL9 |
| 700264251H1 | g22292 | 90 | −49 | gb105pln | *Z. mays* mRNA for glycine-rich protein. |
| 700267425H1 | g2662342 | 63 | −65 | gb105pln | *Oryza sativa* mRNA for EF-1 alpha, complete cds. |
| 700266247H1 | g529901 | 33 | −24 | gb105pln | Yeast (*Schizosaccharomyces pombe*) SP66 casein kinase-1 (hhp1) gene, complete cds. |
| 700264352H1 | g1685087 | 22 | 4 | gb105eukp | diphenol oxidase; EC 1.10.3.2 |
| 700264667H1 | g499158 | 14 | 8 | gb105allp | mitochondrial acetoacetyl-CoA thiolase |
| 700265572H1 | g2245136 | 29 | −15 | gb105eukp | trehalose-6-phosphate synthase homolog |
| 700264656H1 | g1694832 | 19 | −25 | gb105pln | *H. vulgare* Per1 gene. |
| 700266060H1 | g168512 | 46 | −46 | gb105pln | Maize major protein (L3) mRNA from the surface of lipid bodies, 3' end. |
| 700260523H2 | g558648 | 15 | 2 | gb105eukp | D-myo-inositol-3-phosphate synthase; EC 5.5.1.4 |
| 700260334H2 | g2668747 | 50 | −57 | gb105pln | *Zea mays* ribosomal protein L17 (rpl17) mRNA, complete cds. |
| 700264112H1 | g459894 | 62 | −8 | gb105pln | *Zea mays* sus1 gene, complete cds. |
| 700264292H1 | g1279875 | 11 | 15 | gb105pln | *Hordeum vulgare* high affinity sulfate transporter HVST1 mRNA, complete cds. |
| 700267128H1 | g22292 | 64 | −49 | gb105pln | *Z. mays* mRNA for glycine-rich protein. |
| 700262292H1 | g2828188 | 35 | −19 | gb105pln | *Arabidopsis thaliana* genomic DNA, chromosome 5, TAC clone: K3I3, complete sequence. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700266689H1 | g1321957 | 13 | 1 | gb105allp | D1572 |
| 700258794H1 | g2076715 | 11 | 6 | gb105allp | SEC61 protein |
| 700266602H1 | g2407614 | 29 | −9 | gb105pln | *Lycopersicon esculentum* gamma-glutamylcysteine synthetase (GSH1) mRNA, complete cds. |
| 700260819H1 | g2832242 | 58 | −73 | gb105pln | *Zea mays* 22-kDa alpha zein gene cluster, complete sequence. |
| 700263836H1 | g22283 | 59 | −4 | gb105pln | *Zea mays* Glb1-L gene for vicilin-like embryo storage protein. |
| 700207219H1 | g19498 | 20 | −28 | gb105pln | *L. polyphyllus* pPLB08 mRNA. |
| 700268180H1 | g454872 | 68 | −63 | gb105pln | Maize mRNA for group 3 Lea protein MGL3, complete cds. |
| 700263591H1 | g1185553 | 47 | −79 | gb105pln | *Zea mays* glyceraldehyde-3-phosphate dehydrogenase (gpc2) gene, complete cds. |
| 700262406H1 | g22283 | 48 | −68 | gb105pln | *Zea mays* Glb1-L gene for vicilin-like embryo storage protein. |
| 700258627H1 | g736271 | 67 | −64 | gb105pln | *O. sativa* hsp70 gene for heat shock protein 70. |
| 700262618H1 | g2645161 | 15 | 10 | gb105pln | *Oryza sativa* mRNA, similar to protein kinase. |
| 700266811H1 | g22283 | 78 | −59 | gb105pln | *Zea mays* Glb1-L gene for vicilin-like embryo storage protein. |
| 700257989H1 | g556685 | 31 | −13 | gb105pln | *Z. mays* mRNA for ADP-ribosylation factor. |
| 700267976H1 | g1184771 | 81 | −78 | gb105pln | *Zea mays* glyceraldehyde-3-phosphate dehydrogenase GAPC2 (gpc2) mRNA, complete cds. |
| 700267632H1 | g22144 | 48 | −22 | gb105pln | Maize anaerobically regulated gene for fructose bisphosphate aldolase (EC 4.1.2.13). |
| 700266358H1 | g1403043 | 23 | 5 | gb105pln | *H. chilense* × *T. turgidum* conv. durum (Tritordeum) mRNA for S-adenosylmethionine decarboxylase. |
| 700257246H1 | g984327 | 19 | −2 | gb105eukp | hmgA; 2,5 dihydroxyphenylacetate oxidase |
| 700264019H1 | g2582664 | 41 | −9 | gb105pln | *C. sinensis* thi mRNA. |
| 700262842H1 | g1546918 | 60 | −37 | gb105pln | *Z. mays* mRNA for translation initiation factor 5A. |
| 700263352H1 | g2511530 | 82 | −75 | gb105pln | *Eleusine indica* alpha tubulin 1 (TUA1) mRNA, complete cds. |
| 700267308H1 | g2463334 | 36 | −49 | gb105pln | *Oryza sativa* mRNA for ribosomal protein S4. |
| 700259554H1 | g2651294 | 9 | 15 | gb105pln | *Arabidopsis thaliana* chromosome II BAC T2P4 genomic sequence, complete sequence. |
| 700262722H1 | g790640 | 21 | −0 | gb105pln | *Hordeum vulgare* gamma-thionin (HTH3) mRNA, complete cds. |
| 700263256H1 | g396209 | 23 | −5 | gb105pln | *S. polyrrhiza* mRNA for D-myo-inositol-3-phosphate synthase. |
| 700264874H1 | g22270 | 46 | −79 | gb105pln | Maize mRNA from an embryogenic abscisic acid-inducible gene. |
| 700263681H1 | g166682 | 5 | −1 | gb105eukp | CTR1; protein kinase |
| 700264071H1 | g1421729 | 67 | −45 | gb105pln | *Zea mays* T cytoplasm male sterility restorer factor 2 (rf2) mRNA, complete cds. |
| 700267690H1 | g1044918 | 22 | 7 | gb105pln | *O. sativa* pRRD25 gene. |
| 700267312H1 | g398848 | 45 | −45 | gb105pln | *Z. mays* mRNA for beta 5 tubulin. |
| 700258014H1 | g170696 | 10 | 6 | gb105eukp | Gb11; storage protein |
| 700258054H1 | g1924920 | 15 | 3 | gb105pln | *A. thaliana* mRNA for glyoxalase II. |
| 700265817H1 | g168512 | 88 | −15 | gb105pln | Maize major protein (L3) mRNA from the surface of lipid bodies, 3′ end. |
| 700262546H1 | g248338 | 73 | −54 | gb105pln | polyubiquitin [maize, Genomic, 3439 nt]. |
| 700264064H1 | g2852444 | 14 | −8 | gb105pln | *Salix bakko* mRNA for SUI1 homolog, complete cds. |
| 700259362H1 | g2852446 | 35 | −26 | gb105pln | *Arabidopsis thaliana* APK2a mRNA for protein kinase, complete cds. |
| 700261876H1 | g168419 | 76 | −65 | gb105pln | Maize (*Z. mays*) aldolase mRNA, complete cds. |
| 700264558H1 | g1171353 | 21 | −0 | gb105pln | *Oryza sativa* 18 kDa oleosin mRNA, complete cds. |
| 700262991H1 | g473602 | 40 | −19 | gb105pln | *Zea mays* W-22 histone H2A mRNA, complete cds. |
| 700257993H1 | g1568634 | 30 | −17 | gb105pln | *Arabidopsis thaliana* AtKAP alpha mRNA, complete cds. |
| 700257137H1 | g576509 | 15 | −1 | gb105eukp | IAP86; component of chloroplast outer membrane protein import apparatus; GTP-binding protein |
| 700266320H1 | g435648 | 34 | 4 | gb105pln | Rice mRNA for gamma-Tip, complete cds. |
| 700264380H1 | g1246847 | 28 | −20 | gb105pln | *S. oleracea* act1 mRNA for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | glycerol-3-phosphate acyltransferase. |
| 700258139H1 | g435648 | 49 | −28 | gb105pln | Rice mRNA for gamma-Tip, complete cds. |
| 700260224H1 | g1724111 | 22 | −35 | gb105pln | *Triticum aestivum* ABA induced plasma membrane protein PM-19 (WTABAPM) mRNA, complete cds. |
| 700264089H1 | g2735007 | 74 | −64 | gb105pln | *Zea mays* kinase associated protein phosphatase (KAPP) mRNA, complete cds. |
| 700262449H1 | g1928982 | 23 | 0 | gb105pln | *Brassica oleracea* var. botrytis tonoplast intrinsic protein bobTIP26-2 mRNA, partial cds. |
| 700267212H1 | g168579 | 66 | −59 | gb105pln | Maize pyruvate, orthophosphate dikinase mRNA, complete cds. |
| 700262005H1 | g21856 | 33 | −46 | gb105pln | Wheat rDNA 25S-18S intergenic region EcoRI-BamHI fragment. |
| 700263823H1 | g687244 | 68 | −41 | gb105pln | *Zea mays* oil body protein 16 kDa oleosin (ole16) gene, complete cds. |
| 700265919H1 | g886400 | 21 | −1 | gb105pln | *Oryza sativa* MADS-box protein (MADS2) mRNA, complete cds. |
| 700256705H1 | g217951 | 16 | −0 | gb105eukp | S6PDH; NADP-dependent D-sorbitol-6-phosphate dehydrogenase |
| 700258385H1 | g2454182 | 39 | 2 | gb105eukp | pyruvate dehydrogenase E1 alpha subunit; EC 1.2.4.1 |
| 700257007H1 | g22287 | 16 | 6 | gb105allp | vicilin-like embryo storage protein |
| 700257445H2 | g433622 | 9 | 4 | gb105eukp | CKI1; casein kinase-1; EC 2.7.1.37 |
| 700258057H1 | g1616612 | 22 | −5 | gb105eukp | small GTP-binding protein |
| 700263901H1 | g804656 | 13 | −8 | gb105eukp | BGQ60; beta-glucosidase |
| 700266941H1 | g17797 | 22 | 6 | gb105eukp | Bplo |
| 700268010H1 | g2546987 | 33 | −26 | gb105pln | *Morinda citrifolia* mRNA for 3-deoxy-D-arabino-heptulosonate 7-phosphate synthase. |
| 700266775H1 | g40019 | 11 | 7 | gb105allp | ORF 821 (aa 1-821) |
| 700263176H1 | g960289 | 32 | 2 | gb105allp | anthranilate synthase alpha subunit |
| 700265356H1 | g1724111 | 15 | 15 | gb105pln | *Triticum aestivum* ABA induced plasma membrane protein PM-19 (WTABAPM) mRNA, complete cds. |
| 700263278H1 | g520515 | 6 | 8 | gb105eukp | RNA polymerase II, second largest subunit |
| 700266788H1 | g2257597 | 48 | −43 | gb105pln | *Robinia pseudoacacia* mRNA for phosphoglycerate kinase, partial cds. |
| 700266264H1 | g687246 | 29 | −21 | gb105pln | *Zea mays* oil body protein 17 kDa oleosin (ole17) gene, complete cds. |
| 700260908H1 | g2298893 | 20 | 4 | gb105allp | unnamed protein product |
| 700258341H1 | g21233 | 46 | −40 | gb105pln | *S. oleracea* AHRI mRNA for acetohydroxy acid reductoisomerase. |
| 700267487H1 | g1403043 | 27 | −18 | gb105pln | *H. chilense × T. turgidum* conv. durum (Tritordeum) mRNA for S-adenosylmethionine decarboxylase. |
| 700259710H1 | g22281 | 48 | −76 | gb105pln | *Zea mays* Glb1-0 gene for vicilin-like storage protein (truncated). |
| 700262576H1 | g1707074 | 13 | −3 | gb105eukp | M01E11.2 |
| 700265076H1 | g2267005 | 51 | −34 | gb105pln | *Oryza sativa* endosperm lumenal binding protein (BiP) mRNA, complete cds. |
| 700263777H1 | g218097 | 14 | 17 | gb105pln | Rice mRNA for catalase (273 gene), partial sequence. |
| 700263593H1 | g168553 | 75 | −41 | gb105pln | *Zea mays* putative cytoplasmic malate dehydrogenase homolog mRNA, partial cds. |
| 700266534H1 | g257807 | 39 | −75 | gb105pln | cyppdkZml = orthophosphate dikinase {5' region} [maize, Genomic, 895 nt]. |
| 700262671H1 | g587561 | 15 | 6 | gb105pln | *S. tuberosum* mRNA for alpha-II MPP. |
| 700267938H1 | g1136121 | 80 | −72 | gb105pln | *O. sativa* mRNA for alpha-tubulin (clone OSTA-136). |
| 700263794H1 | g168512 | 35 | −30 | gb105pln | Maize major protein (L3) mRNA from the surface of lipid bodies, 3' end. |
| 700268101H1 | g257809 | 68 | −41 | gb105pln | cyppdkZm2 = orthophosphate dikinase [maize, Genomic, 871 nt]. |
| 700265648H1 | g22375 | 18 | −8 | gb105eukp | ORF |
| 700267520H1 | g22283 | 69 | −77 | gb105pln | *Zea mays* Glb1-L gene for vicilin-like embryo storage protein. |
| 700262459H1 | g168512 | 21 | 3 | gb105pln | Maize major protein (L3) mRNA from the surface of lipid bodies, 3' end. |
| 700265214H1 | g1167827 | 18 | −10 | gb105pln | *C. reinhardtii* mRNA for ribosomal protein L12. |
| 700256712H1 | g2827001 | 28 | −10 | gb105pln | *Triticum aestivum* 70 kDa heat shock protein (TaHSP70d) mRNA, complete cds. |
| 700259590H1 | g963095 | 13 | −0 | gb105eukp | 60S ribosomal protein L13A |
| 700266504H1 | g2331300 | 66 | −33 | gb105pln | *Zea mays* ribosomal protein S4 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700265643H1 | g3075 | 24 | −11 | gb105pln | type I (rps4) mRNA, complete cds. *N. crassa* mRNA for a ribosomal protein. |
| 700258816H1 | g22281 | 57 | −57 | gb105pln | *Zea mays* Glb1-0 gene for vicilin-like storage protein (truncated). |
| 700207184H1 | g475257 | 47 | −2 | gb105eukp | similar to ribosomal protein L19; ctg start codon. putative |
| 700265548H1 | g987122 | 64 | −55 | gb105pln | *Z. mays* mRNA for class II metallothionein. |
| 700256846H1 | g899607 | 43 | −48 | gb105pln | *Zea mays* polyubiquitin (MubC5) mRNA, complete cds. |
| 700262982H1 | g2792519 | 43 | −25 | gb105pln | *Camptotheca acuminata* tryptophan synthase beta subunit mRNA, complete cds. |
| 700265667H1 | g1403043 | 36 | −41 | gb105pln | *H. chilense × T. turgidum* conv. durum (Tritordeum) mRNA for S-adenosylmethionine decarboxylase. |
| 700265912H1 | g1519248 | 57 | −45 | gb105pln | *Oryza sativa* GF14-b protein mRNA, complete cds. |
| 700259236H1 | g416265 | 38 | −30 | gb105pln | Rice mRNA for ribosomal protein A2, partial sequence. |
| 700267148H1 | g667069 | 9 | 6 | gb105eukp | ORF |
| 700266194H1 | g16430 | 8 | 16 | gb105pln | *A. thaliana* PP1-At mRNA for protein phosphatase-1. |
| 700267245H1 | g1403043 | 56 | −46 | gb105pln | *H. chilense × T. turgidum* conv. durum (Tritordeum) mRNA for S-adenosylmethionine decarboxylase. |
| 700261563H1 | g22118 | 29 | −21 | gb105pln | *Z. mays* DNA for Adh1-Cm allele. |
| 700256881H1 | g1469218 | 37 | −28 | gb105pln | *B. oleracea* mRNA (unknown). |
| 700262488H1 | g2331300 | 58 | −12 | gb105pln | *Zea mays* ribosomal protein S4 type I (rps4) mRNA, complete cds. |
| 700264721H1 | g2735017 | 7 | 6 | gb105allp | KI domain interacting kinase 1 |
| 700262468H1 | g575730 | 85 | −39 | gb105pln | *Z. mays* mRNA for transmembrane protein. |
| 700265147H1 | g1638836 | 61 | −49 | gb105pln | *H. vulgare* mRNA for alpha-tubulin 2. |
| 700267045H1 | g854469 | 16 | −2 | gb105eukp | GUA1; Gua1p |
| 700258593H1 | g1100738 | 10 | 13 | gb105pln | *Panicum miliaceum* mRNA for 2-oxoglutarate/malate translocator, complete cds. |
| 700257319H1 | g2058278 | 25 | −0 | gb105eukp | atran1 |
| 700260760H1 | g536222 | 12 | −2 | gb105eukp | GAL10 |
| 700262727H1 | g168512 | 39 | −40 | gb105pln | Maize major protein (L3) mRNA from the surface of lipid bodies, 3′ end. |
| 700257153H1 | g289749 | 15 | −5 | gb105eukp | ZK1236.7 protein |
| 700256945H1 | g973312 | 16 | 4 | gb105pln | *Arabidopsis thaliana* myo-inositol 1-phosphate synthase isozyme-2 mRNA, complete cds. |
| 700265101H1 | g22283 | 92 | −53 | gb105pln | *Zea mays* Glb1-L gene for vicilin-like embryo storage protein. |
| 700267480H1 | g168508 | 53 | −5 | gb105pln | Maize oleosin KD18 (KD18; L2) gene, complete cds. |
| 700265601H1 | g166582 | 28 | 7 | gb105eukp | actin-1 |
| 700260015H1 | g2300247 | 11 | 8 | gb105allp | unnamed protein product |
| 700265388H1 | g806323 | 19 | −4 | gb105eukp | ARD1 |
| 700258278H1 | g927238 | 36 | −50 | gb105pln | *Zea mays* globulin1 (Glb1) gene, allele Glb1-Hb, complete cds. |
| 700262020H1 | g687244 | 55 | −77 | gb105pln | *Zea mays* oil body protein 16 kDa oleosin (ole16) gene, complete cds. |
| 700264261H1 | g2408048 | 19 | 7 | gb105eukp | SPAC29B12.06c; hypothetical protein |
| 700257818H1 | g987122 | 59 | −26 | gb105pln | *Z. mays* mRNA for class II metallothionein. |
| 700265072H1 | g435312 | 11 | 5 | gb105pln | *Z. mays* mRNA for beta-D-glucosidase. |
| 700265704H1 | g435648 | 45 | −30 | gb105pln | Rice mRNA for gamma-Tip, complete cds. |
| 700260669H1 | g22322 | 22 | −26 | gb105pln | *Z. mays* mRNA for H2B histone (clone cH2B214). |
| 700264050H1 | g2832242 | 31 | −9 | gb105pln | *Zea mays* 22-kDa alpha zein gene cluster, complete sequence. |
| 700257038H1 | g20408 | 43 | −4 | gb105pln | Pearl millet Adh-1 mRNA for 'slow' alcohol dehydrogenase (EC 1.1.1.1). |
| 700258512H1 | g736271 | 42 | −31 | gb105pln | *O. sativa* hsp70 gene for heat shock protein 70. |
| 700258051H1 | g987122 | 65 | −57 | gb105pln | *Z. mays* mRNA for class II metallothionein. |
| 700263709H1 | g469069 | 4 | 6 | gb105allp | NMDA receptor subunit NR2D |
| 700265473H1 | g1814402 | 39 | −37 | gb105pln | *Mesembryanthemum crystallinum* methionine synthase (MetE) mRNA, complete cds. |
| 700265912H1 | g998429 | 37 | −68 | gb105pln | GRF1 = general regulatory factor |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700266394H1 | g2760165 | 27 | −14 | gb105pln | [Zea mays, XL80, Genomic, 5348 nt].<br>*Arabidopsis thaliana* genomic<br>DNA, chromosome 5, P1 clone: MAC9, complete sequence. |
| 700261201H1 | g1550725 | 11 | 3 | gb105eukp | ribosomal protein L18 |
| 700257796H1 | g2345153 | 22 | 15 | gb105pln | *Zea mays* ribsomal protein S4<br>(rps4) mRNA, complete cds. |
| 700257860H1 | g1395193 | 19 | 5 | gb105allp | RNA-binding protein RZ-1 |
| 700260819H1 | g22525 | 48 | −63 | gb105pln | *Zea mays* gene encoding a zein<br>(clone zA1). |
| 700257872H1 | g1420479 | 25 | 0 | gb105eukp | DED1 |
| 700267694H1 | g1532072 | 24 | 3 | gb105pln | *Z. mays* mRNA for<br>S-adenosylmethionine decarboxylase. |
| 700267546H1 | g36102 | 12 | 4 | gb105allp | protein A1-alpha (AA 1-320) |
| 700266285H1 | g520935 | 41 | −31 | gb105pln | *H. vulgare* mRNA for<br>gamma-TIP-like protein. |
| 700262520H1 | g1907363 | 15 | 12 | gb105pln | *Torreya grandis* 28S ribosomal<br>RNA gene, partial sequence. |
| 700264110H1 | g168577 | 51 | −46 | gb105pln | Maize phospholipid transfer<br>protein mRNA, 3′ end. |
| 700268009H1 | g1532072 | 77 | −75 | gb105pln | *Z. mays* mRNA for<br>S-adenosylmethionine decarboxylase. |
| 700261414H1 | g1184771 | 48 | −48 | gb105pln | *Zea mays*<br>glyceraldehyde-3-phosphate dehydrogenase GAPC2 (gpc2) mRNA, complete cds. |
| 700262148H1 | g21090 | 31 | −19 | gb105pln | Castor-bean mRNA for Rubisco<br>subunit binding-protein alpha subunit. |
| 700266069H1 | g22119 | 69 | −82 | gb105pln | Maize Adh1-F mRNA for alcohol<br>dehydrogenase. |
| 700261491H1 | g396209 | 59 | −15 | gb105pln | *S. polyrrhiza* mRNA for<br>D-myo-inositol-3-phosphate synthase. |
| 700261005H1 | g311121 | 10 | 5 | gb105eukp | PRP18 |
| 700264457H1 | g22292 | 89 | −55 | gb105pln | *Z. mays* mRNA for glycine-rich<br>protein. |
| 700263439H1 | g2257742 | 24 | −20 | gb105pln | *Arabidopsis thaliana*<br>lysine-sensitive aspartate kinase mRNA, complete cds. |
| 700267267H1 | g168512 | 30 | −15 | gb105pln | Maize major protein (L3) mRNA<br>from the surface of lipid bodies, 3′ end. |
| 700262084H1 | g473205 | 19 | −0 | gb105pln | *E. gunnii* mRNA for<br>mitochondrial malate dehydrogenase. |
| 700264142H1 | g1161311 | 35 | −7 | gb105pln | *Arabidopsis thaliana* Columbia<br>myo-inositol-1-phosphate synthase mRNA, complete cds. |
| 700261008H1 | g485376 | 84 | −50 | gb105pln | *Zea mays* alpha-3-tubulin gene,<br>complete cds. |
| 700256843H1 | g22283 | 55 | −61 | gb105pln | *Zea mays* Glb1-L gene for<br>vicilin-like embryo storage protein. |
| 700267492H1 | g416460 | 19 | −0 | gb105allp | unidentified protein |
| 700260479H1 | g1724111 | 12 | 17 | gb105pln | *Triticum aestivum* ABA induced<br>plasma membrane protein PM-19 (WTABAPM) mRNA, complete cds. |
| 700264641H1 | g2244773 | 18 | −5 | gb105eukp | hypothetical protein |
| 700258329H1 | g687244 | 51 | −78 | gb105pln | *Zea mays* oil body protein 16<br>kDa oleosin (ole16) gene, complete cds. |
| 700266772H1 | g2264304 | 22 | −4 | gb105pln | *Arabidopsis thaliana* genomic<br>DNA, chromosome 5, P1 clone: MBG8, complete sequence. |
| 700263020H1 | g596079 | 82 | −51 | gb105pln | *Zea mays* thiamine biosynthetic<br>enzyme (thi1-2) mRNA, complete cds. |
| 700258651H1 | g452473 | 74 | −70 | gb105pln | *Zea mays* Black Mexican Sweet<br>alpha-tubulin mRNA, complete cds. |
| 700261755H1 | g2243123 | 30 | −16 | gb105pln | *Brassica juncea* mRNA for<br>O-acetylserine(thiol) lyase, clone OAS-TL6. |
| 700263389H1 | g633889 | 46 | −36 | gb105pln | glucose and ribitol<br>dehydrogenase homolog [*Hordeum vulgare* = barley, Aura, embryo, mRNA, 1170 nt]. |
| 700267416H1 | g2696803 | 25 | −6 | gb105pln | *Oryza sativa* mRNA for water<br>channel protein, complete cds. |
| 700264437H1 | g609261 | 11 | 8 | gb105pln | *S. cereale* (cv. Halo) mRNA for<br>triosephosphate isomerase. |
| 700257095H1 | g2262135 | 21 | −23 | gb105pln | *Arabidopsis thaliana* BAC<br>T10P11, complete sequence. |
| 700258948H1 | g22646 | 47 | −58 | gb105pln | *Z. mays* MFS18 mRNA. |
| 700263245H1 | g391884 | 40 | −5 | gb105pln | Rice DNA for VP1 protein,<br>complete cds. |
| 700267552H1 | g170455 | 20 | −18 | gb105pln | Tomato heat shock cognate<br>protein 80 gene, 3′ end. |
| 700267259H1 | g435648 | 45 | −35 | gb105pln | Rice mRNA for gamma-Tip,<br>complete cds. |
| 700265093H1 | g168621 | 95 | −85 | gb105pln | Maize superoxide dismutase 2<br>(SOD2) mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264752H1 | g1079683 | 12 | −11 | gb105eukp | YPL059W; Yp1059wp |
| 700262288H1 | g687244 | 45 | −42 | gb105pln | *Zea mays* oil body protein 16 kDa oleosin (ole16) gene, complete cds. |
| 700264474H1 | g454872 | 49 | −57 | gb105pln | Maize mRNA for group 3 Lea protein MGL3, complete cds. |
| 700267930H1 | g687244 | 56 | −26 | gb105pln | *Zea mays* oil body protein 16 kDa oleosin (ole16) gene, complete cds. |
| 700258234H1 | g790969 | 73 | −64 | gb105pln | Rice mRNA for aldolase C-1, complete cds. |
| 700259616H1 | g22270 | 27 | 5 | gb105pln | Maize mRNA from an embryogenic abscisic acid-inducible gene. |
| 700263774H1 | g168512 | 26 | 7 | gb105pln | Maize major protein (L3) mRNA from the surface of lipid bodies, 3' end. |
| 700267313H1 | g217910 | 37 | −29 | gb105pln | Carrot mRNA for nuclear antigen 21D7. |
| 700260706H1 | g602252 | 51 | −65 | gb105pln | *Zea mays* enolase (eno2) mRNA, complete cds. |
| 700263139H1 | g454872 | 49 | −14 | gb105pln | Maize mRNA for group 3 Lea protein MGL3, complete cds. |
| 700257237H1 | g1711205 | 48 | −0 | gb105eukp | IAA23; IAA23 |
| 700266210H1 | g1519250 | 47 | −40 | gb105pln | *Oryza sativa* GF14-c protein mRNA, complete cds. |
| 700259616H1 | g19016 | 26 | 5 | gb105pln | *H. vulgare* mRNA for LEA B19.4 protein. |
| 700257131H1 | g602605 | 63 | −81 | gb105pln | *Zea mays* tandem genes for alpha1-tubulin and alpha2-tubulin. |
| 700260121H1 | g170775 | 45 | −26 | gb105pln | Wheat translation elongation factor 1 alpha-subunit (TEF1) mRNA, complete cds. |
| 700262093H1 | g168587 | 38 | 3 | gb105pln | *Zea mays* cofactor-independent phosphoglycerate mutase mRNA, complete cds. |
| 700261292H1 | g20163 | 24 | −6 | gb105pln | *O. sativa* Rr15 mRNA for 5S ribosomal RNA. |
| 700207210H1 | g2632254 | 26 | −4 | gb105eukp | SNFL2; serine/threonine kinase |
| 700257040H1 | g452559 | 49 | −27 | gb105pln | *Zea mays* group 3 Lea protein MGL3 mRNA, complete cds. |
| 700264055H1 | g1478271 | 15 | 7 | gb105pln | Yeast (*Schizosaccharomyces pombe*) cosmid 800. |
| 700261716H1 | g836620 | 9 | 6 | gb105allp | *Putative orf* YCRX13w, chromosome III |
| 700256860H1 | g1163029 | 15 | −11 | gb105eukp | T05E11.1 |
| 700258319H1 | g902583 | 78 | −83 | gb105pln | *Zea mays* clone MubG1 ubiquitin gene, complete cds. |
| 700207115H1 | g1841894 | 21 | 0 | gb105eukp | Glutathione Reductase; EC 1.6.4.2 |
| 700266612H1 | g2244823 | 40 | −24 | gb105eukp | heat shock protein |
| 700264850H1 | g902583 | 69 | −78 | gb105pln | *Zea mays* clone MubG1 ubiquitin gene, complete cds. |
| 700265169H1 | g1216011 | 23 | −3 | gb105allp | NAP57 homologue |
| 700262877H1 | g520935 | 40 | −5 | gb105pln | *H. vulgare* mRNA for gamma-TIP-like protein. |
| 700263311H1 | g1881536 | 10 | −2 | gb105eukp | ATML1; meristem L1 layer homeobox protein |
| 700267212H1 | g168584 | 40 | −48 | gb105pln | Corn pyruvate, orthophosphate dikinase gene, exons 2–19. |
| 700259141H2 | g22283 | 82 | −23 | gb105pln | *Zea mays* Glb1-L gene for vicilin-like embryo storage protein. |
| 700259091H1 | g1504062 | 22 | −34 | gb105pln | *A. thaliana* mRNA for shaggy-like kinase kappa. |
| 700265286H1 | g19060 | 34 | −13 | gb105pln | Barley mRNA for NADPH-protochlorophyllide oxidoreductase (PCR). |
| 700266681H1 | g2345153 | 49 | −60 | gb105pln | *Zea mays* ribsomal protein S4 (rps4) mRNA, complete cds. |
| 700258849H1 | g436782 | 42 | −34 | gb105pln | Rice mRNA for cyc07, complete cds. |
| 700262982H1 | g168573 | 96 | −69 | gb105pln | *Zea mays* tryptophan synthase beta-subunit (TSB2) mRNA, complete cds. |
| 700266595H1 | g533251 | 74 | −55 | gb105pln | *Zea mays* (clone pSM8) sucrose synthase 2 (Sus1) gene, complete cds. |
| 700258528H1 | g21686 | 33 | −14 | gb105pln | *T. aestivum* AGP-S mRNA. |
| 700264811H1 | g397581 | 10 | 6 | gb105eukp | UBC6, ubiquitin conjugating enzyme |
| 700264529H1 | g2352491 | 19 | −3 | gb105pln | *Arabidopsis thaliana* transport inhibitor response 1 (TIR1) gene, complete cds. |
| 700267423H1 | g393400 | 88 | −80 | gb105pln | *Z. mays* mRNA for alpha-tubulin. |
| 700258024H1 | g169818 | 38 | −38 | gb105pln | Rice 25S ribosomal RNA gene. |
| 700266778H1 | g687244 | 47 | −13 | gb105pln | *Zea mays* oil body protein 16 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | kDa oleosin (ole16) gene, complete cds. |
| 700266136H1 | g485743 | 41 | −32 | gb105pln | *Beta vulgaris* clone P1 pyrophosphatase mRNA, complete cds. |
| 700262355H1 | g1353352 | 13 | −0 | gb105eukp | catalyzes the transfer of —NH2 from ala to 2-oxoglutarate; alanine aminotransferase; EC 2.6.1.2 |
| 700259126H2 | g471320 | 32 | −48 | gb105pln | *H. vulgare* (cv. Bomi) B15C mRNA. |
| 700257586H1 | g520935 | 39 | −19 | gb105pln | *H. vulgare* mRNA for gamma-TIP-like protein. |
| 700262211H1 | g1244707 | 14 | −0 | gb105pln | *Arabidopsis thaliana* ANT (AINTEGUMENTA) mRNA, complete cds. |
| 700262317H1 | g170775 | 76 | −35 | gb105pln | Wheat translation elongation factor 1 alpha-subunit (TEF1) mRNA, complete cds. |
| 700262896H1 | g899607 | 49 | 13 | gb105pln | *Zea mays* polyubiquitin (MubC5) mRNA, complete cds. |
| 700256756H1 | g433215 | 54 | −50 | gb105pln | Rice mRNA for scar protein (gene name SS620), partial cds. |
| 700266129H1 | g1167953 | 11 | −2 | gb105eukp | putative 32.6 kDa jasmonate-induced protein |
| 700267425H1 | g644491 | 63 | −64 | gb105pln | Corn mRNA for elongation factor 1A. |
| 700259444H1 | g416144 | 32 | −31 | gb105pln | *Zea mays* beta-4 tubulin (tub4) mRNA, complete cds. |
| 700257111H1 | g17848 | 17 | 7 | gb105allp | phosphatase 2A |
| 700207224H1 | g2827001 | 30 | −12 | gb105pln | *Triticum aestivum* 70 kDa heat shock protein (TaHSP70d) mRNA, complete cds. |
| 700265952H1 | g22119 | 88 | −32 | gb105pln | Maize Adh1-F mRNA for alcohol dehydrogenase. |
| 700260553H2 | g2828182 | 43 | −12 | gb105pln | *Arabidopsis thaliana* genomic DNA, chromosome 5, P1 clone: MOJ9, complete sequence. |
| 700256710H1 | g20359 | 73 | −80 | gb105pln | Rice gene for 17S ribosomal RNA. |
| 700256780H1 | g1296954 | 30 | −38 | gb105pln | *O. sativa* mRNA for novel protein, osr40cl. |
| 700262322H1 | g625147 | 26 | −10 | gb105pln | *Zea mays* protein disulfide isomerase (pdi) mRNA, complete cds. |
| 700264759H1 | g2815099 | 11 | −1 | gb105eukp | Y39E4A.2a |
| 700264332H1 | g19101 | 32 | −15 | gb105pln | *H. vulgare* mRNA for ribosomal protein L17-1. |
| 700266580H1 | g642453 | 16 | 9 | gb105pln | *Chlamydomonas reinhardtii* phosphoglycerate kinase mRNA, complete cds. |
| 700264479H1 | g1171351 | 15 | 12 | gb105pln | *Oryza sativa* 16 kDa oleosin (ole16) mRNA, complete cds. |
| 700261201H1 | g606970 | 20 | −7 | gb105eukp | cytoplasmic ribosomal protein L18 |
| 700258534H1 | g1272407 | 27 | −9 | gb105pln | *Arabidopsis thaliana* immunophilin (FKBP15-2) mRNA, complete cds. |
| 700263960H1 | g22484 | 49 | −41 | gb105pln | *Z. mays* RNA for superoxide dismutase Sod4A. |
| 700267455H1 | g2267005 | 37 | −30 | gb105pln | *Oryza sativa* endosperm lumenal binding protein (BiP) mRNA, complete cds. |
| 700260407H1 | g1209779 | 7 | 4 | gb105allp | similar to *Saccharomyces cerevisiae* Spt4; protein has potential N-terminal zinc-finger |
| 700257323H1 | g435648 | 48 | −24 | gb105pln | Rice mRNA for gamma-Tip, complete cds. |
| 700257567H1 | g471320 | 24 | −2 | gb105pln | *H. vulgare* (cv. Bomi) B15C mRNA. |
| 700268140H1 | g4445 | 17 | −0 | gb105eukp | SEC53 |
| 700264838H1 | g168508 | 62 | −47 | gb105pln | Maize oleosin KD18 (KD18; L2) gene, complete cds. |
| 700266174H1 | g167961 | 16 | 10 | gb105pln | *D. caryophyllus* S-adenosylmethionine synthetase (CARSAM2) mRNA, complete cds. |
| 700262906H1 | g960356 | 48 | −37 | gb105pln | Barley mRNA for S-adenosylmethionine synthetase, complete cds. |
| 700267786H1 | g459894 | 76 | −36 | gb105pln | *Zea mays* sus1 gene, complete cds. |
| 700266677H1 | g2347186 | 12 | 11 | gb105pln | *Arabidopsis thaliana* chromosome II BAC T09D09 genomic sequence, complete sequence. |
| 700261122H1 | g21732 | 24 | 0 | gb105pln | Wheat mRNA for Em protein. |
| 700260344H2 | g687244 | 45 | −87 | gb105pln | *Zea mays* oil body protein 16 kDa oleosin (ole16) gene, complete cds. |
| 700263329H1 | g485985 | 5 | 8 | gb105allp | ORP YKL009w |
| 700264143H1 | g21895 | 43 | −10 | gb105pln | *T. aestivum* (clone pTAU2.3) U2 snRNA. |
| 700261863H1 | g2190992 | 12 | 6 | gb105eukp | chloroacetamide herbicide metabolism; glutathione S-transferase TSI-1; EC 2.5.1.18 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700263361H1 | g1531764 | 11 | 12 | gb105pln | *D. stramonium* mRNA for S-adenosylmethionine decarboxylase. |
| 700267581H1 | g2832242 | 54 | −75 | gb105pln | *Zea mays* 22-kDa alpha zein gene cluster, complete sequence. |
| 700267372H1 | g1765899 | 47 | −19 | gb105eukp | Spot 3 protein |
| 700266320H1 | g1200160 | 18 | 16 | gb105pln | *T. gesneriana* mRNA for tonoplast intrinsic protein. |
| 700264285H1 | g2815905 | 18 | −0 | gb105eukp | sug-1; Sug-1 proteosome subunit homolog |
| 700260821H1 | g19342 | 21 | −6 | gb105pln | *L. esculentum* mRNA for ribosomal protein L2. |
| 700258139H1 | g1200160 | 28 | −9 | gb105pln | *T. gesneriana* mRNA for tonoplast intrinsic protein. |
| 700263603H1 | g2244947 | 99 | −0 | gb105eukp | PRL1 protein - *Arabidopsis thaliana* |
| 700264840H1 | g22270 | 77 | −80 | gb105pln | Maize mRNA from an embryogenic abscisic acid-inducible gene. |
| 700258814H1 | g168665 | 82 | −83 | gb105pln | Maize 16-kDa zein-2 mRNA, complete cds. |
| 700258932H1 | g2662342 | 55 | −49 | gb105pln | *Oryza sativa* mRNA for EF-1 alpha, complete cds. |
| 700265488H1 | g21598 | 41 | −33 | gb105pln | *S. tuberosum* mRNA for UDP-glucose pyrophorylase. |
| 700264840H1 | g19016 | 25 | −17 | gb105pln | *H. vulgare* mRNA for LEA B19.4 protein. |
| 700258593H1 | g403285 | 11 | 6 | gb105allp | 2-Oxoglutarate malate carrier protein (Mito) |
| 700266050H1 | g1575129 | 46 | −59 | gb105pln | *Zea mays* lumenal binding protein cBiPe3 mRNA, complete cds. |
| 700262909H1 | g687244 | 27 | −36 | gb105pln | *Zea mays* oil body protein 16 kDa oleosin (ole16) gene, complete cds. |
| 700265719H1 | g1931647 | 70 | −11 | gb105eukp | T19D16.13; endomembrane protein EMP70 precursor isolog |
| 700262423H1 | g304108 | 20 | 3 | gb105pln | *Arabidopsis thaliana* poly(A)-binding protein mRNA, complete cds. |
| 700267779H1 | g1532072 | 12 | 9 | gb105pln | *Z. mays* mRNA for S-adenosylmethionine decarboxylase. |
| 700258593H1 | g1100743 | 11 | 8 | gb105allp | 2-oxoglutarate/malate translocator |
| 700261632H1 | g485376 | 85 | −34 | gb105pln | *Zea mays* alpha-3-tubulin gene, complete cds. |
| 700267439H1 | g2564237 | 27 | −19 | gb105eukp | omega-6 desaturase |
| 700262577H1 | g899483 | 14 | −2 | gb105eukp | chalcone reductase homologue |
| 700264219H1 | g1296954 | 45 | −10 | gb105pln | *O. sativa* mRNA for novel protein, osr40cl. |
| 700262830H1 | g1532072 | 20 | 15 | gb105pln | *Z. mays* mRNA for S-adenosylmethionine decarboxylase. |
| 700262891H1 | g2624199 | 46 | −4 | gb105pln | *M. acuminata* mRNA; clone pBAN UU93. |
| 700264570H1 | g1724111 | 15 | 15 | gb105pln | *Triticum aestivum* ABA induced plasma membrane protein PM-19 (WTABAPM) mRNA, complete cds. |
| 700258054H1 | g1924921 | 24 | −8 | gb105eukp | hydroxyacylglutathione hydrolase; EC 3.1.2.6; glyoxalase II |
| 700258203H1 | g22283 | 98 | −68 | gb105pln | *Zea mays* Glb1-L gene for vicilin-like embryo storage protein. |
| 700265974H1 | g895890 | 28 | −16 | gb105pln | Yeast (*Saccharomyces cerevisiae*) DNA for ribosomal protein S5 gene. |
| 700256830H1 | g2244901 | 28 | −14 | gb105pln | *Arabidopsis thaliana* DNA chromosome 4, ESSA I contig fragment No. 4. |
| 700264259H1 | g2654870 | 26 | −20 | gb105eukp | RbohAOsp |
| 700265519H1 | g22151 | 82 | −48 | gb105pln | *Z. mays* (A188) mRNA for alpha-tubulin 4. |
| 700265158H1 | g19342 | 21 | −7 | gb105pln | *L. esculentum* mRNA for ribosomal protein L2. |
| 700261764H1 | g2459421 | 24 | −10 | gb105eukp | F4P9.15; similar to calcium-binding EF-hand protein |
| 700258187H1 | g4223 | 18 | −1 | gb105eukp | PRE4; proteasome Pre4 subunit |
| 700264361H1 | g1550739 | 21 | 7 | gb105pln | *A. thaliana* mRNA for GDP dissociation inhibitor. |
| 700261261H1 | g587562 | 21 | −12 | gb105eukp | MPP; mitochondrial processing peptidase |
| 700259154H2 | g2088652 | 27 | −6 | gb105eukp | T28M21.15; 26S proteasome regulatory subunit S12 isolog |
| 700256992H1 | g1167963 | 28 | 1 | gb105eukp | 18-56 protein |
| 700258431H1 | g1519250 | 41 | −26 | gb105pln | *Oryza sativa* GF14-c protein mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700257102H1 | g1532047 | 15 | 15 | gb105pln | *O. sativa* mRNA for S-adenosylmethionine decarboxylase. |
| 700256831H1 | g1694832 | 29 | −2 | gb105pln | *H. vulgare* Per1 gene. |
| 700267714H1 | g533335 | 9 | 6 | gb105allp | N-acylamino acid aminohydrolase (Aminoacylase 1) |
| 700257179H1 | g2252863 | 18 | 8 | gb105eukp | A_TM018A10.14 |
| 700258078H1 | g633889 | 18 | 8 | gb105pln | glucose and ribitol dehydrogenase homolog [*Hordeum vulgare* = barley, Aura, embryo, mRNA, 1170 nt]. |
| 700266928H1 | g454872 | 33 | −36 | gb105pln | Maize mRNA for group 3 Lea protein MGL3, complete cds. |
| 700263670H1 | g1519248 | 39 | −20 | gb105pln | *Oryza sativa* GF14-b protein mRNA, complete cds. |
| 700265438H1 | g2213424 | 22 | −1 | gb105pln | *Citrus paradisi* mRNA for hypothetical protein. |
| 700266013H1 | g22285 | 45 | −78 | gb105pln | *Zea mays* Glb1-S gene for vicilin-like embryo storage protein. |
| 700259180H2 | g687244 | 48 | −79 | gb105pln | *Zea mays* oil body protein 16 kDa oleosin (ole16) gene, complete cds. |
| 700256743H1 | g1103629 | 22 | −41 | gb105pln | *Z. mays* Fer2 gene. |
| 700260426H1 | g435456 | 35 | −20 | gb105pln | Proso millet gene for aspartate aminotransferase, complete cds. |
| 700258669H1 | g790977 | 44 | −30 | gb105pln | *B. juncea* msams mRNA. |
| 700258215H1 | g1658314 | 50 | −54 | gb105pln | *O. sativa* osr40g3 gene. |
| 700267632H1 | g790969 | 56 | −11 | gb105pln | Rice mRNA for aldolase C-1, complete cds. |
| 700257040H1 | g444044 | 49 | −27 | gb105pln | *Z. mays* mRNA for group 3 Lea protein MGL3. |
| 700262416H1 | g992962 | 12 | −4 | gb105eukp | thioredoxin |
| 700262713H1 | g1036803 | 10 | −7 | gb105eukp | TGF-beta receptor interacting protein 1 homolog |
| 700264622H1 | g2645198 | 17 | 8 | gb105pln | *Arabidopsis thaliana* chromosome I BAC T26J12 genomic sequence, complete sequence. |
| 700266044H1 | g1103627 | 20 | −37 | gb105pln | *Z. mays* Fer1 gene. |
| 700262146H1 | g2262155 | 22 | −10 | gb105pln | DNA sequence of *Arabidopsis thaliana* BAC F5J6 from chromosome IV, complete sequence. |
| 700257860H1 | g1435062 | 19 | 5 | gb105eukp | RNA binding protein, RZ-1 |
| 700258112H1 | g19538 | 17 | −1 | gb105pln | *M. crystallinum* mRNA for ribosomal protein YL16. |
| 700261930H1 | g987122 | 68 | −60 | gb105pln | *Z. mays* mRNA for class II metallothionein. |
| 700263464H1 | g303900 | 40 | 15 | gb105pln | Soybean gene for ubiquitin, complete cds. |
| 700263491H1 | g602252 | 52 | −44 | gb105pln | *Zea mays* enolase (eno2) mRNA, complete cds. |
| 700263771H1 | g167283 | 44 | −39 | gb105pln | *C. vulgaris* glyoxysomal malate dehydrogenase mRNA, complete cds. |
| 700259355H1 | g286238 | 5 | 7 | gb105allp | N-methyl-D-aspartate receptor subunit |
| 700264229H1 | g1737491 | 44 | −42 | gb105pln | *Triticum aestivum* poly(A)-binding protein (wheatpab) mRNA, complete cds. |
| 700264647H1 | g687244 | 55 | −76 | gb105pln | *Zea mays* oil body protein 16 kDa oleosin (ole16) gene, complete cds. |
| 700266330H1 | g2462750 | 34 | −3 | gb105eukp | F8A5.26 |
| 700257762H1 | g2645163 | 32 | −17 | gb105pln | *Oryza sativa* mRNA, similar to ribosomal protein L26. |
| 700262429H1 | g1155212 | 40 | −26 | gb105pln | *Avena fatua* aldose reductase-related protein mRNA, complete cds. |
| 700260594H2 | g1122359 | 16 | 1 | gb105eukp | NRS1, GCD5; Krs1p |
| 700258890H1 | g22281 | 46 | −75 | gb105pln | *Zea mays* Glb1-0 gene for vicilin-like storage protein (truncated). |
| 700262345H1 | g1171351 | 23 | −7 | gb105pln | *Oryza sativa* 16 kDa oleosin (ole16) mRNA, complete cds. |
| 700258290H1 | g22155 | 63 | −68 | gb105pln | *Z. mays* mRNA for alpha-tubulin 5. |
| 700264255H1 | g168419 | 89 | −81 | gb105pln | Maize (*Z. mays*) aldolase mRNA, complete cds. |
| 700260476H1 | g1899026 | 18 | −49 | gb105pln | *Zea mays* superoxide dismutase 4A (sod4A) gene, complete cds. |
| 700264823H1 | g2160158 | 40 | −17 | gb105eukp | F21M12.3 |
| 700262692H1 | g435648 | 47 | −7 | gb105pln | Rice mRNA for gamma-Tip, complete cds. |
| 700264949H1 | g471320 | 20 | −20 | gb105pln | *H. vulgare* (cv. Bomi) B15c mRNA. |
| 700265381H1 | g1658312 | 47 | −58 | gb105pln | *O. sativa* osr40g2 gene. |
| 700267657H1 | g1694620 | 18 | −3 | gb105pln | *Cucurbita* sp. mRNA for |

TABLE 1-continued

LIST OF INCYTE CLONES DERIVED FROM SATMON022023
COPYRIGHT 1998 INCYTE PHARMACEUTICALS, INC.

| | | | | |
|---|---|---|---|---|
| | | | | 3-ketoacyl-CoA thiolase, complete cds. |
| 700267559H1 | g22461 | 86 | −81 | gb105pln | Maize RAB-17 gene. |
| 700266953H1 | g2760165 | 24 | −4 | gb105pln | *Arabidopsis thaliana* genomic DNA, chromosome 5, P1 clone: MAC9, complete sequence. |
| 700257245H1 | g687244 | 52 | −80 | gb105pln | *Zea mays* oil body protein 16 kDa oleosin (ole16) gene, complete cds. |
| 700267670H1 | g1045304 | 100 | −90 | gb105pln | *Zea mays* acetyl-coenzyme A carboxylase mRNA, complete cds. |
| 700263255H1 | g2668741 | 49 | −26 | gb105pln | *Zea mays* glycine-rich RNA binding protein (GRP) mRNA, complete cds. |
| 700261761H1 | g16487 | 49 | −18 | gb105pln | *A. thaliana* mRNA for RNA polymerase II second largest subunit. |
| 700265839H1 | g1143387 | 19 | −7 | gb105pln | *A. thaliana* mRNA for Class III ADH. |
| 700265612H1 | g16379 | 38 | −29 | gb105pln | *A. thaliana* mRNA for laminin receptor homologue. |
| 700257947H1 | g151153 | 7 | −0 | gb105allp | cobW |
| 700261986H1 | g1322276 | 28 | 5 | gb105pln | *Triticum aestivum* histone H2A gene, complete cds. |
| 700262884H1 | g2244825 | 35 | −2 | gb105eukp | light induced protein homolog |
| 700264314H1 | g2191149 | 8 | −2 | gb105eukp | A_IG002N01.22 |
| 700266615H1 | g2243116 | 33 | −1 | gb105eukp | ak-lys1; aspartate kinase; EC 2.7.2.4 |
| 700258777H1 | g2231311 | 13 | 16 | gb105pln | *Arabidopsis thaliana* AtRab18 (AtRAB18) mRNA, complete cds. |
| 700268003H1 | g2565339 | 40 | −32 | gb105pln | *Lupinus luteus* ribosomal protein S14 (rps14) mRNA, complete cds. |
| 700268183H1 | g2276349 | 33 | −7 | gb105pln | Yeast (*Saccharomyces pombe*) chromosome II cosmid c30D10. |
| 700266742H1 | g1050839 | 31 | 1 | gb105pln | *S. tuberosum* mRNA for U1snRNP-specific protein (U1A). |
| 700263860H1 | g238318 | 11 | 5 | gb105allp | branched-chain alpha-keto acid dehydrogenase E1 alpha subunit [human, Peptide, 443 aa] |
| 700267003H1 | g536895 | 49 | −44 | gb105pln | Wheat mRNA for protein H2A, complete cds, clone wcH2A-10. |
| 700207249H1 | g312178 | 42 | −22 | gb105pln | *Z. mays* GapC2 gene. |
| 700263265H1 | g22490 | 30 | −3 | gb105eukp | ORF1 |
| 700265029H1 | g396209 | 28 | −15 | gb105pln | *S. polyrrhiza* mRNA for D-myo-inositol-3-phosphate synthase. |
| 700257986H1 | g2662342 | 62 | −52 | gb105pln | *Oryza sativa* mRNA for EF-1 alpha, complete cds. |
| 700266251H1 | g459894 | 38 | −90 | gb105pln | *Zea mays* sus1 gene, complete cds. |
| 700265754H1 | g1813968 | 3 | 7 | gb105allp | HCMVUL61 |
| 700257646H1 | g2668737 | 59 | −15 | gb105pln | *Zea mays* translation initiation factor 5A (TIF5A) mRNA, complete cds. |
| 700259322H1 | g1054878 | 25 | 0 | gb105allp | plasma membrane Ca2+-ATPase isoform 4 |
| 700257379H1 | g20359 | 46 | −53 | gb105pln | Rice gene for 17S ribosomal RNA. |
| 700258453H1 | g168512 | 33 | −33 | gb105pln | Maize major protein (L3) mRNA from the surface of lipid bodies, 3' end. |
| 700260279H1 | g633889 | 16 | 10 | gb105pln | glucose and ribitol dehydrogenase homolog [*Hordeum vulgare* = barley, Aura, embryo, mRNA, 1170 nt]. |
| 700260446H1 | g167116 | 26 | −12 | gb105pln | *B. napus* plastid 60-kDa chaperonin-60 beta-polypeptide (cpn-60 beta) mRNA, partial cds. |
| 700257582H1 | g1871181 | 12 | −0 | gb105eukp | T06D20.8 |
| 700261008H1 | g22149 | 68 | −33 | gb105pln | *Z. mays* mRNA for alpha-tubulin 3. |
| 700261958H1 | g974781 | 44 | −32 | gb105pln | *C. blumei* kinetoplast met gene for cobalamine-independent methionine synthase. |
| 700259702H1 | g1542940 | 27 | −26 | gb105pln | *R. sativus* L. (Saxa knacker) AACT mRNA. |
| 700258410H1 | g310570 | 27 | −9 | gb105eukp | GmPM3; dessication protectant; seed maturation protein; pGmPM3 |
| 700263884H1 | g2832679 | 23 | 3 | gb105allp | putative protein |
| 700259419H1 | g1345132 | 27 | 6 | gb105allp | ERECTA |
| 700263006H1 | g405130 | 25 | −14 | gb105pln | *Arabidopsis thaliana* nuclear-encoded chloroplast stromal cyclophilin (ROC4) mRNA, complete cds. |
| 700264952H1 | g468055 | 69 | −64 | gb105pln | *Zea mays* B73 QM protein mRNA, complete cds. |
| 700267283H1 | g416499 | 7 | 6 | gb105allp | globulin |
| 700262369H1 | g2464934 | 17 | −4 | gb105eukp | serine C-palmitoyltransferase homolog |
| 700267432H1 | g469248 | 26 | 2 | gb105allp | ribosomal protein S3a |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700266780H1 | g18890 | 43 | −8 | gb105pln | *H. vulgare* gene for aldose reductase-related protein. |
| 700267708H1 | g1755006 | 73 | −69 | gb105pln | *Triticum aestivum* calmodulin TaCaM3-3 mRNA, complete cds. |
| 700266795H1 | g2342495 | 50 | −18 | gb105pln | *Ananas comosus* mRNA for bromelain, complete cds. |
| 700259126H2 | g971279 | 31 | −43 | gb105pln | Rice mRNA for RAB24 protein, complete cds. |
| 700261175H1 | g168481 | 9 | 7 | gb105eukp | globulin precursor |
| 700259667H1 | g602564 | 24 | −2 | gb105pln | *C. paradisi* (Macf) INO1 gene. |
| 700257785H1 | g537445 | 43 | −20 | gb105pln | *Arabidopsis thaliana* heat shock protein AtHSP101 (Athsp101) mRNA, complete cds. |
| 700258824H1 | g450292 | 70 | −77 | gb105pln | *Zea mays* alpha-tubulin mRNA, complete cds. |
| 700263550H1 | g1122312 | 15 | −12 | gb105pln | *P. glaucum* mRNA for heat shock protein, HSP 16.9. |
| 700267247H1 | g168508 | 69 | −36 | gb105pln | Maize oleosin KD18 (KD18; L2) gene, complete cds. |
| 700257851H1 | g2384759 | 63 | −35 | gb105pln | *Oryza sativa* GDP dissociation inhibitor protein OsGDI2 (OsGDI2) mRNA, complete cds. |
| 700258634H1 | g1514981 | 34 | −21 | gb105eukp | coacts with chaicone synthase to produce 6′-deoxychalcone; polyketide reductase (GGPKR2) |
| 700264006H1 | g17931 | 31 | −4 | gb105pln | *B. secalinas* embryo-specific mRNA. |
| 700257901H1 | g297015 | 45 | −4 | gb105eukp | fructokinase |
| 700264419H1 | g2331300 | 35 | −47 | gb105pln | *Zea mays* ribosomal protein S4 type I (rps4) mRNA, complete cds. |
| 700266889H1 | g2281704 | 28 | −15 | gb105pln | *Oryza sativa* ethylene responsive factor (OSERS) mRNA, complete cds. |
| 700258931H1 | g22270 | 81 | −20 | gb105pln | Maize mRNA from an embryogenic abscisic acid-inducible gene. |
| 700267867H1 | g763277 | 16 | −2 | gb105eukp | unknown |
| 700263769H1 | g1931630 | 34 | −73 | gb105pln | *Zea mays* glutamate dehydrogenase (GDH1) mRNA, complete cds. |
| 700266419H1 | g633889 | 18 | 2 | gb105pln | glucose and ribitol dehydrogenase homolog [*Hordeum vulgare* = barley, Aura, embryo, mRNA, 1170 nt]. |
| 700263431H1 | g2345153 | 63 | −12 | gb105pln | *Zea mays* ribsomal protein S4 (rps4) mRNA, complete cds. |
| 700258956H1 | g2245467 | 15 | 1 | gb105eukp | DUG |
| 700257567H1 | g971279 | 27 | −2 | gb105pln | Rice mRNA for RAB24 protein, complete cds. |
| 700264093H1 | g22285 | 47 | −24 | gb105pln | *Zea mays* Glb1-S gene for vicilin-like embryo storage protein. |
| 700262667H1 | g1113117 | 17 | 2 | gb105allp | L-threonine deaminase |
| 700258047H1 | g1289203 | 18 | 11 | gb105pln | *A. glutinosa* mRNA for thiazole biosynthetic enzyme. |
| 700263654H1 | g486384 | 16 | 1 | gb105pln | Yeast (*Saccharomyces cerevisiae*) chromosome XI reading frame ORF YKL215c. |
| 700262842H1 | g2668737 | 84 | −52 | gb105pln | *Zea mays* translation initiation factor 5A (TIF5A) mRNA, complete cds. |
| 700264174H1 | g1799607 | 9 | −1 | gb105allp | METHIONYL-TRNA FORMYLTRANSFERASE (EC 2.1.2.9). |
| 700259308H1 | g457405 | 33 | −24 | gb105pln | *Arabidopsis thaliana* mRNA for MAP kinase, complete cds. |
| 700258777H1 | g1370171 | 13 | 16 | gb105pln | *L. japonicus* mRNA for small GTP-binding protein, RAB1X. |
| 700264341H1 | g2829870 | 56 | −26 | gb105eukp | F3I6.12 |
| 700267328H1 | g2414402 | 19 | −2 | gb105eukp | Y57G11C.15 |
| 700259509H1 | g2599091 | 21 | 9 | gb105pln | *Arabidopsis thaliana* WD-40 repeat protein MSI4 (MSI4) mRNA, complete cds. |
| 700263137H1 | g2274990 | 41 | 2 | gb105pln | *Hordeum vulgare* mRNA for expressed sequence tag. |
| 700264528H1 | g1171347 | 35 | −21 | gb105pln | *Triticum aestivum* pMA1951 mRNA, partial cds. |
| 700268133H1 | g1165314 | 14 | 2 | gb105eukp | snwA; unknown |
| 700265912H1 | g168602 | 87 | −81 | gb105pln | *Zea mays* regulatory protein GE14-12 mRNA, complete cds. |
| 700266290H1 | g1129083 | 37 | −49 | gb105pln | Wheat mRNA for protein H2A, complete cds, clone wcH2A-2. |
| 700264514H1 | g22281 | 61 | −68 | gb105pln | *Zea mays* Glb1-0 gene for vicilin-like storage protein (truncated). |
| 700266580H1 | g1161601 | 19 | 9 | gb105pln | *N. tabacum* mRNA for phosphoglycerate kinase (cytosolic isoenzyme). |
| 700258771H1 | g303854 | 53 | −56 | gb105pln | Rice mRNA for ribosomal protein L7A, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700261639H1 | g960356 | 45 | −30 | gb105pln | Barley mRNA for S-adenosylmethionine synthetase, complete cds. |
| 700261813H1 | g973312 | 20 | −4 | gb105pln | *Arabidopsis thaliana* myo-inositoi 1-phosphate synthase isozyme-2 mRNA, complete cds. |
| 700264515H1 | g22342 | 61 | −71 | gb105pln | Maize gene for heat shock protein 70 exon 2 and 3'-UT (hsp70; clone PMON 9502). |
| 700256926H1 | g168480 | 91 | −46 | gb105pln | Maize embryo globulin S allele (7S-like) mRNA, complete cds. |
| 700256749H1 | g486253 | 28 | −31 | gb105pln | Yeast (*Saccharomyces cerevisiae*) chromosome XI reading frame ORF YKL148c. |
| 700256743H1 | g22277 | 22 | −43 | gb105pln | Maize mRNA for ferritin (clone FM2). |
| 700265493H1 | g469067 | 5 | 7 | gb105allp | NMDA receptor subunit NR2D |
| 700261563H1 | g22119 | 55 | −22 | gb105pln | Maize Adh1-F mRNA for alcohol dehydrogenase. |
| 700266590H1 | g1694832 | 33 | −40 | gb105pln | *H. vulgare* Per1 gene. |
| 700262928H1 | g1813638 | 8 | 7 | gb105allp | PF20 |
| 700262942H1 | g1463121 | 34 | −10 | gb105eukp | RPS3; ribosomal protein S3 |
| 700264412H1 | g1808578 | 20 | 3 | gb105alIp | proteasome subunit p112 |
| 700257451H2 | g1871173 | 19 | 8 | gb105pln | *Arabidopsis thaliana* chromosome II BAC T06D20 genomic sequence, complete sequence. |
| 700263848H1 | g1289203 | 36 | 3 | gb105pln | *A. glutinosa* mRNA for thiazole biosynthetic enzyme. |
| 700266375H1 | g687244 | 51 | −63 | gb105pln | *Zea mays* oil body protein 16 kDa oleosin (ole16) gene, complete cds. |
| 700266244H1 | g2662346 | 59 | −46 | gb105pln | *Oryza sativa* mRNA for EF-1 alpha, complete cds. |
| 700266224H1 | g285637 | 19 | −15 | gb105pln | *Hordeum vulgare* mRNA for vacuolar membrane proton-translocating inorganic pyrophosphat. |
| 700257103H1 | g167072 | 65 | −60 | gb105pln | Barley ubiquitin (mub1) gene, complete cds. |
| 700262125H1 | g16501 | 10 | 7 | gb105eukp | rp19; Chloroplast ribosomal protein CL9 |
| 700258510H1 | g1403043 | 11 | 9 | gb105pln | *H. chilense* × *T. turgidum* conv. durum (Tritordeum) mRNA for S-adenosylmethionine decarboxylase. |
| 700260489H1 | g927239 | 7 | 6 | gb105allp | globulin1 |
| 700266786H1 | g763255 | 14 | 1 | gb105eukp | unknown |
| 700256846H1 | g777757 | 40 | −39 | gb105pln | Saccharum hybrid (clone SCUBI561) polyubiquitin mRNA, complete cds. |
| 700207218H1 | g22285 | 60 | 5 | gb105pln | *Zea mays* Glb1-S gene for vicilin-like embryo storage protein. |
| 700263392H1 | g897761 | 16 | 3 | gb105allp | protein phosphatase 5 |
| 700258656H1 | g2829904 | 35 | −15 | gb105eukp | T26J12.15 |
| 700265063H1 | g21598 | 46 | −42 | gb105pln | *S. tuberosum* mRNA for UDP-glucose pyrophosphorylase. |
| 700258605H1 | g248338 | 95 | −95 | gb105pln | polyubiquitin [maize, Genomic, 3439 nt]. |
| 700258261H1 | g396209 | 52 | −49 | gb105pln | *S. polyrrhiza* mRNA for D-myo-inositol-3-phosphate synthase. |
| 700264861H1 | g2351382 | 21 | −5 | gb105allp | eIF3-p48 |
| 700265186H1 | g2104948 | 18 | 7 | gb105pln | *Selaginella lepidophylla* MAP kinase-like protein (sdhn-6r) mRNA, partial cds. |
| 700266292H1 | g687246 | 16 | 0 | gb105pln | *Zea mays* oil body protein 17 kDa oleosin (ole17) gene, complete cds. |
| 700258008H1 | g1930071 | 35 | −17 | gb105pln | *Oryza sativa* thioredoxin h mRNA, complete cds. |
| 700207243H1 | g1526424 | 12 | 2 | gb105allp | LEA protein in group 3 |
| 700264362H1 | g1814236 | 14 | −4 | gb105eukp | ubaA; ubiquitin-activating enzyme |
| 700258327H1 | g2668741 | 83 | −76 | gb105pln | *Zea mays* glycine-rich RNA binding protein (GRP) mRNA, complete cds. |
| 700263153H1 | g790640 | 20 | −1 | gb105pln | *Hordeum vulgare* gamma-thionin (HTH3) mRNA, complete cds. |
| 700258739H1 | g1419369 | 43 | −50 | gb105pln | *Z. mays* ZmABP3 mRNA for actin depolymerizing factor. |
| 700262992H1 | g1519252 | 21 | −9 | gb105pln | *Oryza sativa* GF14-d protein mRNA, complete cds. |
| 700265891H1 | g1658312 | 36 | −37 | gb105pln | *O. sativa* osr40g2 gene. |
| 700267013H1 | g22283 | 97 | −12 | gb105pln | *Zea mays* Glb1-L gene for vicilin-like embryo storage protein. |
| 700257582H1 | g1773040 | 12 | 5 | gb105eukp | A-RZF; unknown; RING zinc finger protein |
| 700266294H1 | g1055222 | 8 | 4 | gb105allp | 3-hydroxybutyryl-CoA dehydrogenase |
| 700262855H1 | g1167953 | 11 | 2 | gb105allp | putative 32.6 kDa jasmonate-induced protein |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264603H1 | g387908 | 51 | −44 | gb105pln | *Brassica rapa* S-phase-specific (BIS289) mRNA, complete cds. |
| 700267380H1 | g928899 | 26 | 8 | gb105pln | *A. thaliana* AK17 gene protein kinase catalytic domain (fragment). |
| 700267439H1 | g2501790 | 27 | −16 | gb105eukp | omega-6 fatty acid desaturase |
| 700262407H1 | g927239 | 7 | 7 | gb105allp | globulin1 |
| 700259357H1 | g556421 | 19 | −1 | gb105pln | *Stylosanthes humilis* cinnamyl alcohol dehydrogenase (CAD1) mRNA, complete cds. |
| 700258169H1 | g950052 | 23 | −24 | gb105pln | *H. vulgare* mRNA for HMG1/2-like protein. |
| 700267980H1 | g1498241 | 15 | −3 | gb105eukp | MRF1 |
| 700267107H1 | g644491 | 86 | −4 | gb105pln | Corn mRNA for elongation factor 1A. |
| 700258709H1 | g20359 | 93 | −93 | gb105pln | Rice gene for 17S ribosomal RNA. |
| 700258203H1 | g168480 | 98 | −67 | gb105pln | Maize embryo globulin S allele (7S-like) mRNA, complete cds. |
| 700257223H1 | g296204 | 22 | −7 | gb105eukp | pA1aAT-2; alanine aminotransferase; EC 2.6.1.2 |
| 700258070H1 | g168512 | 48 | −46 | gb105pln | Maize major protein (L3) mRNA from the surface of lipid bodies, 3' end. |
| 700264779H1 | g20359 | 80 | −79 | gb105pln | Rice gene for 17S ribosomal RNA. |
| 700267187H1 | g563235 | 18 | 6 | gb105eukp | xyloglucan endo-transglycosylase homolog; similar to *Triticum aestivum* endo-xyloglucan transferase, PIR Accession Number E49539 |
| 700262336H1 | g939749 | 57 | −33 | gb105eukp | LPZ15c; Lpz15p |
| 700262719H1 | g2088651 | 8 | 7 | gb105eukp | T28M21.14; hypersensitivity-related gene 201 isolog |
| 700267416H1 | g2570508 | 24 | −4 | gb105pln | *Oryza sativa* transmembrane protein mRNA, complete cds. |
| 700267161H1 | g2465430 | 9 | 1 | gb105eukp | JRG1.3; 32 kDa protein |
| 700260354H1 | g625147 | 49 | −60 | gb105pln | *Zea mays* protein disulfide isomerase (pdi) mRNA, complete cds. |
| 700264560H1 | g218160 | 32 | −16 | gb105pln | *Oryza sativa* mRNA for elongation factor 1 beta'. |
| 700268080H1 | g2398529 | 15 | 6 | gb105allp | Transcription factor |
| 700264229H1 | g2213870 | 29 | −11 | gb105pln | *Mesembryanthemum crystallinum* poly(A)-binding protein mRNA, partial cds. |
| 700258493H1 | g804655 | 34 | 4 | gb105pln | *Hordeum vulgare* L. beta-glucosidase (BGQ60) gene, complete cds. |
| 700261176H1 | g16076 | 29 | −15 | gb105eukp | asparagine synthase (glutamine-hydrolysing); EC 6.3.5.4 |
| 700267248H1 | g2113828 | 14 | 9 | gb105pln | Yeast (*Candida albicans*) TOP2 gene. |
| 700264254H1 | g687244 | 50 | −89 | gb105pln | *Zea mays* oil body protein 16 kDa oleosin (ole16) gene, complete cds. |
| 700265239H1 | g2599103 | 20 | −2 | gb105pln | *Dunaliella salina* 60S ribosomal protein (DSRP1) mRNA, complete cds. |
| 700266020H1 | g1902902 | 42 | −55 | gb105pln | *Oryza sativa* DNA for phospholipase D, complete cds. |
| 700263550H1 | g20264 | 14 | −11 | gb105pln | *O. sativa* mRNA for 16.9 kD low molecular weight heat shock protein. |
| 700265655H1 | g173231 | 22 | −8 | gb105pln | Yeast (*Saccharomyces cerevisiae*) ribosomal 5S RNA-binding protein (YL3) gene, 5' cds. |
| 700264596H1 | g975887 | 39 | −25 | gb105pln | *Mesembryanthemum crystallinum* myo-inositol-1-phosphate synthase mRNA, complete cds. |
| 700267425H1 | g2662344 | 63 | −65 | gb105pln | *Oryza sativa* mRNA for EF-1 alpha, complete cds. |
| 700267734H1 | g791110 | 13 | 6 | gb105allp | unknown |
| 700265936H1 | g20252 | 41 | −33 | gb105pln | *Oryza sativa* H3 histone H3R-21 clone RH3-2. |
| 700258847H1 | g1872521 | 20 | −0 | gb105eukp | LSD1; negative regulator of cell death; zinc-finger protein Lsd1 |
| 700257908H1 | g22287 | 6 | 6 | gb105allp | vicilin-like embryo storage protein |
| 700256992H1 | g2245467 | 28 | 1 | gb105eukp | DUG |
| 700258208H1 | g1788589 | 9 | −3 | gb105allp | o660; This 660 aa ORF is 30 pct identical (9 gaps) to 301 residues of an approx. 320 aa protein FMT_ECOLI SW: P23882 |
| 700263818H1 | g606970 | 31 | −0 | gb105eukp | cytoplasmic ribosomal protein L18 |
| 700261104H1 | g1519250 | 43 | −35 | gb105pln | *Oryza sativa* GF14-c protein mRNA, complete cds. |
| 700267192H1 | g1706955 | 29 | −23 | gb105pln | *Gossypium hirsutum* cellulose |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | synthase (celA1) mRNA, complete cds. |
| 700267437H1 | g2827715 | 37 | −17 | gb105eukp | F6H11.170; receptor protein kinase - like protein |
| 700261252H1 | g1694832 | 26 | −41 | gb105pln | *H. vulgare* Per1 gene. |
| 700266115H1 | g556665 | 21 | −2 | gb105eukp | caffeoyl-CoA 3-O-methyltransferase |
| 700258566H1 | g1749748 | 18 | −14 | gb105eukp | similar to *Saccharomyces cerevisiae* eukaryotic initiation factor 4A (EIF-4), SWISS-PROT Accession Number P10081 |
| 700265996H1 | g2305013 | 59 | −55 | gb105pln | *Musa acuminata* S-adenosyl-L-methionine synthetase homolog mRNA, complete cds. |
| 700262564H1 | g1171347 | 36 | −25 | gb105pln | *Triticum aestivum* pMA1951 mRNA, partial cds. |
| 700256761H1 | g22503 | 23 | 2 | gb105pln | *Zea mays* gene for U2 small nuclear RNA (U2snRNA). |
| 700267714H1 | g1086625 | 6 | 7 | gb105eukp | C06A6.4 |
| 700265093H1 | g218225 | 65 | −57 | gb105pln | Rice mRNA for copper/zinc-superoxide dismutase (EC 1.15.1.1), complete cds. |
| 700267183H1 | g2738025 | 12 | 4 | gb105allp | putative ethylene receptor |
| 700263265H1 | g606979 | 19 | 7 | gb105pln | *Pennisetum glaucum* Ac-like element, AcL2. |
| 700263482H1 | g218112 | 47 | 14 | gb105pln | Rice mRNA for ribosomal protein L41 (340 gene), partial sequence. |
| 700263133H1 | g22562 | 34 | 4 | gb105pln | Maize mRNA for phosphoenolpyruvate carboxylase (EC 4.1.1.31). |
| 700259519H1 | g2267005 | 39 | −9 | gb105pln | *Oryza sativa* endosperm lumenal binding protein (BiP) mRNA, complete cds. |
| 700258746H1 | g2244788 | 16 | 6 | gb105pln | *Arabidopsis thaliana* DNA chromosome 4, ESSA I contig fragment No. 1. |
| 700266003H1 | g1429227 | 45 | −10 | gb105pln | *A. thaliana* mRNA for small subunit of TFIIA. |
| 700267978H1 | g218175 | 38 | −58 | gb105pln | Rice mRNA for heat shock protein 82 (NH67 gene), partial sequence. |
| 700262321H1 | g218088 | 46 | −53 | gb105pln | Rice mRNA for ribosomal protein 117 (249 gene), partial sequence. |
| 700267184H1 | g2737894 | 17 | 7 | gb105allp | Cbf5p homolog |
| 700264875H1 | g454872 | 44 | −66 | gb105pln | Maize mRNA for group 3 Lea protein MGL3, complete cds. |
| 700265217H1 | g1200160 | 22 | 13 | gb105pln | *T. gesneriana* mRNA for tonoplast intrinsic protein. |
| 700261965H1 | g2262155 | 15 | 6 | gb105pln | DNA sequence of Arabidopsis thaliana BAC F5J6 from chromosome IV, complete sequence. |
| 700264843H1 | g2288968 | 32 | −35 | gb105pln | *Zea mays* mRNA for glutathione transferase. |
| 700264203H1 | g2702261 | 17 | −15 | gb105pln | *Arabidopsis thaliana* chromosome II BAC T21L14 genomic sequence, complete sequence. |
| 700264670H1 | g2558943 | 52 | −44 | gb105pln | *Gossypium hirsutum* histone 3 mRNA, complete cds. |
| 700266781H1 | g633890 | 19 | 3 | gb105allp | glucose and ribitol dehydrogenase homolog (barley, *Hordeum vulgare*, Peptide, 293 aa] |
| 700258792H1 | g22302 | 48 | −74 | gb105pln | Maize Gpc1 gene for glyceraldehyde-3-phosphate dehydrogenase (GADPH) subunit C. |
| 700258538H1 | g506860 | 13 | −2 | gb105eukp | HRSec61 |
| 700261143H1 | g167064 | 15 | 14 | gb105pln | *Hordeum vulgare* beta-ketoacyl-ACP synthase I (Kas12) mRNA, complete cds. |
| 700259819H1 | g2668741 | 36 | 11 | gb105pln | *Zea mays* glycine-rich RNA binding protein (GRP) mRNA, complete cds. |
| 700258602H1 | g16172 | 30 | 14 | gb105pln | *A. thaliana* mRNA for ascorbate peroxidase. |
| 700261412H1 | g514324 | 21 | −8 | gb105eukp | RNA polymerase subunit |
| 700265132H1 | g1944572 | 39 | −44 | gb105pln | *H. vulgare* partial PAL mRNA for phenylalanine ammonia-lyase (1831 bp). |
| 700265453H1 | g1421750 | 12 | 6 | gb105pln | *Pisum sativum* S-adenosylmethionine decarboxylase mRNA, complete cds. |
| 700268160H1 | g22328 | 44 | −22 | gb105pln | Maize mRNA for a high mobility group protein. |
| 700259819H1 | g2293479 | 31 | 15 | gb105pln | *Oryza sativa* glycine-rich protein mRNA, complete cds. |
| 700261072H1 | g695169 | 57 | −3 | gb105eukp | unknown |
| 700256844H1 | g1694621 | 28 | −5 | gb105eukp | 3-ketoacyl-CoA thiolase; EC 2.3.1.16 |
| 700265838H1 | g220281 | 32 | 2 | gb105allp | phosphatidylserine synthase |
| 700264244H1 | g687244 | 50 | −29 | gb105pln | *Zea mays* oil body protein 16 kDa oleosin (ole16) gene, complete cds. |
| 700266307H1 | g2645163 | 48 | −17 | gb105pln | *Oryza sativa* mRNA, similar to ribosomal protein L26. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700261546H1 | g1399818 | 17 | 4 | gb105allp | biotin carboxylase |
| 700256801H1 | g967124 | 33 | −25 | gb105pln | *Vigna radiata* Rwilcz calcium dependent protein kinase (CDPK) mRNA, complete cds. |
| 700262028H1 | g1694832 | 36 | −40 | gb105pln | *H. vulgare* Per1 gene. |
| 700260324H1 | g471320 | 26 | −36 | gb105pln | *H. vulgare* (cv. Bomi) B15C mRNA. |
| 700261516H1 | g168577 | 23 | −7 | gb105pln | Maize phospholipid transfer protein mRNA, 3' end. |
| 700258408H1 | g644491 | 70 | −61 | gb105pln | Corn mRNA for elongation factor 1A. |
| 700259567H1 | g435648 | 41 | −30 | gb105pln | Rice mRNA for gamma-Tip, complete cds. |
| 700262957H1 | g687244 | 47 | −56 | gb105pln | *Zea mays* oil body protein 16 kDa oleosin (ole16) gene, complete cds. |
| 700267656H1 | g2827142 | 27 | −14 | gb105pln | *Arabidopsis thaliana* cellulose synthase catalytic subunit (Ath-B) mRNA, complete cds. |
| 700262992H1 | g1519248 | 12 | 14 | gb105pln | *Oryza sativa* GF14-b protein mRNA, complete cds. |
| 700258064H1 | g599625 | 30 | −4 | gb105eukp | Aco; aconitase; EC 4.2.1.3 |
| 700258133H1 | g2282583 | 68 | −54 | gb105pln | *Zea mays* elongation factor 1-alpha (EF1-A) mRNA, complete cds. |
| 700261245H1 | g170782 | 28 | 0 | gb105eukp | ubiquitin carrier protein |
| 700256728H1 | g551251 | 5 | 7 | gb105allp | ribosomal protein S7 |
| 700267458H1 | g928931 | 43 | −20 | gb105pln | *A. thaliana* mRNA for putative dTDP-glucose 4-6-dehydratases. |
| 700261293H1 | g2827001 | 60 | −57 | gb105pln | *Triticum aestivum* 70 kDa heat shock protein (TaHSP70d) mRNA, complete cds. |
| 700207203H1 | g2632037 | 11 | 2 | gb105allp | YkoA |
| 700263392H1 | g1663530 | 16 | 3 | gb105allp | phosphoprotein phosphatase |
| 700265574H1 | g2599116 | 21 | −5 | gb105pln | *Hypocrea jecorina* proteasome regulatory subunit 12 (prs12) gene, complete cds. |
| 700262915H1 | g1289203 | 26 | −15 | gb105pln | *A. glutinosa* mRNA for thiazole biosynthetic enzyme. |
| 700257521H1 | g2345153 | 75 | −11 | gb105pln | *Zea mays* ribsomal protein S54 (rps4) mRNA, complete cds. |
| 700263260H1 | g1561577 | 39 | −9 | gb105eukp | spermine synthase 1; EC 2.5.1.22 |
| 700265591H1 | g2252823 | 33 | −23 | gb105pln | *Arabidopsis thaliana* BAC IG005I10. |
| 700264580H1 | g1171351 | 16 | −5 | gb105pln | *Oryza sativa* 16 kDa oleosin (ole16) mRNA, complete cds. |
| 700264887H1 | g2345153 | 65 | −65 | gb105pln | *Zea mays* ribsomal protein S4 (rps4) mRNA, complete cds. |
| 700267232H1 | g1203905 | 23 | −12 | gb105eukp | M(1)15D; M(1)15D |
| 700266596H1 | g2274990 | 60 | −44 | gb105pln | *Hordeum vulgare* mRNA for expressed sequence tag. |
| 700265490H1 | g170432 | 41 | −41 | gb105pln | Tomato ATP-dependent protease (CD4A) gene, complete cds. |
| 700266426H1 | g2274990 | 51 | −52 | gb105pln | *Hordeum vulgare* mRNA for expressed sequence tag. |
| 700258641H1 | g644492 | 69 | −53 | gb105pln | Corn elongation factor lalpha gene, complete cds. |
| 700261647H1 | g1724111 | 45 | −4 | gb105pln | *Triticum aestivum* ABA induced plasma membrane protein PM-19 (WTABAPM) mRNA, complete cds. |
| 700267944H1 | g927239 | 6 | 7 | gb105allp | globulin1 |
| 700267161H1 | g2465426 | 9 | 1 | gb105eukp | JRG1.1; 32 kDa protein |
| 700258470H1 | g1777929 | 86 | −53 | gb105pln | *Saccharum officinarum* nucleoside diphosphate kinase (SoNDPK1) mRNA, complete cds. |
| 700264174H1 | g1799612 | 9 | −1 | gb105allp | METHIONYL-TRNA FORMYLTRANSFERASE (EC 2.1.2.9). |
| 700262585H1 | g695789 | 11 | 6 | gb105eukp | GST27; glutathione transferase; EC 2.5.1.18 |
| 700267810H1 | g426467 | 33 | −22 | gb105pln | *P. chrysogenum* trxB gene. |
| 700267360H1 | g662897 | 12 | 6 | gb105eukp | T07A5.3 |
| 700259505H1 | g395256 | 15 | 4 | gb105allp | orf4; homologous to human putative GTP-binding protein |
| 700267080H1 | g2661203 | 11 | 5 | gb105eukp | rpl13; ribosomal protein L13 |
| 700264760H1 | g2702272 | 19 | −7 | gb105eukp | T21L14.13 |
| 700266827H1 | g2583129 | 50 | −17 | gb105eukp | F4L23.25; putative methionine aminopeptidase |
| 700265611H1 | g1403043 | 24 | 3 | gb105pln | *H. chilense* × *T. turgidum* conv. durum (Tritordeum) mRNA for S-adenosylmethionine decarboxylase. |
| 700260908H1 | g2298895 | 20 | 4 | gb105allp | unnamed protein product |
| 700257069H1 | g487302 | 20 | 3 | gb105pln | Rice mRNA EN3, partial sequence. |
| 700264471H1 | g540534 | 61 | −58 | gb105pln | Rice mRNA for q group of |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | receptor for activated C-kinase, complete cds. |
| 700258783H1 | g1668772 | 37 | −46 | gb105pln | *O. sativa* mRNA for SMT3 protein. |
| 700262959H1 | g687246 | 66 | −46 | gb105pln | *Zea mays* oil body protein 17 kDa oleosin (ole17) gene, complete cds. |
| 700260174H1 | g2286152 | 48 | −53 | gb105pln | *Zea mays* cytoplasmic malate dehydrogenase mRNA, complete cds. |
| 700265189H1 | g563234 | 16 | 12 | gb105pln | *Zea mays* xyloglucan endo-transglycosylase homolog gene, complete cds. |
| 700267539H1 | g1171351 | 28 | −5 | gb105pln | *Oryza sativa* 16 kDa oleosin (ole16) mRNA, complete cds. |
| 700258850H1 | g2145473 | 35 | −7 | gb105eukp | aconitate hydratase; EC 4.2.1.3 |
| 700259676H1 | g790977 | 39 | −26 | gb105pln | *B. juncea* msams mRNA. |
| 700257612H1 | g22270 | 26 | −21 | gb105pln | Maize mRNA from an embryogenic abscisic acid-inducible gene. |
| 700265837H1 | g16182 | 15 | 7 | gb105allp | tonoplast intrinsic protein: alpha-TIP (Ara) |
| 700266147H1 | g1302523 | 13 | 6 | gb105allp | ORF YNR029c |
| 700257539H1 | g168512 | 34 | 13 | gb105pln | Maize major protein (L3) mRNA from the surface of lipid bodies, 3' end. |
| 700261959H1 | g168419 | 56 | −44 | gb105pln | Maize (*Z. mays*) aldolase mRNA, complete cds. |
| 700260261H1 | g168512 | 28 | 9 | gb105pln | Maize major protein (L3) mRNA from the surface of lipid bodies, 3' end. |
| 700257528H1 | g22285 | 81 | −28 | gb105pln | *Zea mays* Glb1-S gene for vicilin-like embryo storage protein. |
| 700258347H1 | g687244 | 62 | −55 | gb105pln | *Zea mays* oil body protein 16 kDa oleosin (ole16) gene, complete cds. |
| 700258632H1 | g167112 | 40 | −32 | gb105pln | *Bromus inermis* aldose reductase-related protein, complete cds. |
| 700256988H1 | g20255 | 34 | 9 | gb105pln | *O. sativa* gene for heat shock protein 82 HSP82. |
| 700257522H1 | g459894 | 73 | −23 | gb105pln | *Zea mays* sus1 gene, complete cds. |
| 700265288H1 | g533251 | 73 | −81 | gb105pln | *Zea mays* (clone pSM8) sucrose synthase 2 (Sus1) gene, complete cds. |
| 700267989H1 | g22270 | 78 | −74 | gb105pln | Maize mRNA from an embryogenic abscisic acid-inducible gene. |
| 700265871H1 | g927238 | 45 | −47 | gb105pln | *Zea mays* globulin1 (Glb1) gene, allele Glb1-Hb, complete cds. |
| 700262928H1 | g7176 | 9 | 3 | gb105eukp | coding region (AA 1 - 437) |
| 700264483H1 | g168512 | 66 | −26 | gb105pln | Maize major protein (L3) mRNA from the surface of lipid bodies, 3' end. |
| 700267989H1 | g19016 | 25 | −1 | gb105pln | *H. vulgare* mRNA for LEA B19.4 protein. |
| 700259189H1 | g168498 | 38 | −10 | gb105pln | Corn histone H4 (H4C13) gene, complete cds. |
| 700263686H1 | g1724111 | 16 | 12 | gb105pln | *Triticum aestivum* ABA induced plasma membrane protein PM-19 (WTABAPM) mRNA, complete cds. |
| 700267853H1 | g312178 | 30 | −69 | gb105pln | *Z. mays* GapC2 gene. |
| 700259088H1 | g22287 | 8 | 6 | gb105allp | vicilin-like embryo storage protein |
| 700264783H1 | g1694832 | 31 | −48 | gb105pln | *H. vulgare* Per1 gene. |
| 700264952H1 | g575354 | 64 | −59 | gb105pln | *O. sativa* SC34 mRNA for tumor suppressor. |
| 700257674H1 | g22281 | 56 | −30 | gb105pln | *Zea mays* Glb1-0 gene for vicilin-like storage protein (truncated). |
| 700264356H1 | g297017 | 33 | −27 | gb105pln | *Z. mays* OBF3.2 mRNA for ocs-element binding factor 3.2. |
| 700259322H1 | g1054879 | 25 | 0 | gb105allp | plasma membrane Ca2+-ATPase isoform 4 |
| 700264638H1 | g1185553 | 38 | −45 | gb105pln | *Zea mays* glyceraldehyde-3-phosphate dehydrogenase (gpc2) gene, complete cds. |
| 700262215H1 | g403009 | 9 | 7 | gb105allp | PHAPII (Putative HLA DR Associated Protein II) |
| 700257264H1 | g168419 | 66 | −73 | gb105pln | Maize (*Z. mays*) aldolase mRNA, complete cds. |
| 700256873H1 | g1710113 | 26 | −23 | gb105pln | *Arabidopsis thaliana* PAPS reductase homolog (PRH26) mRNA, complete cds. |
| 700265919H1 | g886402 | 19 | 2 | gb105pln | *Oryza sativa* MADS-box protrein (MADS4) mRNA, complete cds. |
| 700257714H1 | g435648 | 23 | 13 | gb105pln | Rice mRNA for gamma-Tip, complete cds. |
| 700257502H1 | g596077 | 31 | 6 | gb105pln | *Zea mays* thiamine biosynthetic enzyme (thil-1) mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700258901H1 | g22281 | 39 | −70 | gb105pln | *Zea mays* Glb1-0 gene for vicilin-like storage protein (truncated). |
| 700263739H1 | g2073569 | 7 | 8 | gb105allp | cDNA encoding nuclear chloride ion channel |
| 700264661H1 | g1575127 | 98 | −94 | gb105pln | *Zea mays* lumenal binding protein cBiPe2 mRNA, complete cds. |
| 700263169H1 | g168440 | 50 | −19 | gb105pln | *Zea mays* chitinase A (seed chitinase) gene, complete cds. |
| 700264806H1 | g1350502 | 12 | 1 | gb105allp | vicilin-like storage protein |
| 700262369H1 | g2464935 | 17 | −4 | gb105eukp | serine C-palmitoyltransferase homolog |
| 700263208H1 | g2331300 | 100 | −53 | gb105pln | *Zea mays* ribosomal protein S4 type I (rps4) mRNA, complete cds. |
| 700265857H1 | g474003 | 27 | 6 | gb105pln | Rice mRNA, partial homologous to ribosomal protein rp21c gene. |
| 700262423H1 | g2642427 | 10 | 7 | gb105pln | *Arabidopsis thaliana* chromosome II BAC T20D16 genomic sequence, complete sequence. |
| 700263258H1 | g22149 | 75 | −71 | gb105pln | *Z. mays* mRNA for alpha-tubulin 3. |
| 700268025H1 | g22287 | 10 | 3 | gb105allp | vicilin-like embryo storage protein |
| 700267970H1 | g22151 | 20 | 10 | gb105pln | *Z. mays* (A188) mRNA for alpha-tubulin 4. |
| 700266724H1 | g1694832 | 47 | −2 | gb105pln | *H. vulgare* Per1 gene. |
| 700267656H1 | g2827138 | 30 | −16 | gb105pln | *Arabidopsis thaliana* cellulose synthase catalytic subunit (RSW1) gene, complete cds. |
| 700263090H1 | g1370486 | 19 | 6 | gb105eukp | ORF YPL235w |
| 700263464H1 | g304117 | 42 | 15 | gb105pln | *Arabidopsis thaliana* (clone ubq11) polyubiquitin gene sequence. |
| 700265052H1 | g2826811 | 22 | −13 | gb105eukp | AtGRP2; AtGRP2 |
| 700259237H1 | g1045304 | 98 | −95 | gb105pln | *Zea mays* acetyl-coenzyme A carboxylase mRNA, complete cds. |
| 700257219H1 | g927238 | 36 | 9 | gb105pln | *Zea mays* globulin1 (Glb1) gene, allele Glb1-Hb, complete cds. |
| 700259636H1 | g1694832 | 30 | −43 | gb105pln | *H. vulgare* Per1 gene. |
| 700262449H1 | g435648 | 44 | −21 | gb105pln | Rice mRNA for gamma-Tip, complete cds. |
| 700262639H1 | g1638836 | 46 | −43 | gb105pln | *H. vulgare* mRNA for alpha-tubulin 2. |
| 700264631H1 | g1432140 | 59 | −52 | gb105pln | *Triticum aestivum* ADP-glucose pyrophosphorylase (WAL1) mRNA, partial cds. |
| 700257131H1 | g2511530 | 80 | −78 | gb105pln | *Eleusine indica* alpha tubulin 1 (TUA1) mRNA, complete cds. |
| 700262215H1 | g338039 | 9 | 7 | gb105allp | set |
| 700268190H1 | g21832 | 41 | −25 | gb105pln | Wheat mRNA for chloroplast phosphoglycerate kinase (EC 2.7.2.3). |
| 700263007H1 | g311341 | 21 | −8 | gb105allp | gamma-COP |
| 700267885H1 | g1552830 | 23 | 6 | gb105allp | similar to *S. cerevisiae* YLL062c |
| 700262060H1 | g2231589 | 28 | −7 | gb105eukp | TpCCTalpha; CCTalpha chaperonin subunit |
| 700262604H1 | g1395190 | 51 | −47 | gb105pln | *Spinacia oleracea* L. mRNA for 26S proteasome ATPase subunit, complete cds. |
| 700267696H1 | g1045304 | 69 | −61 | gb105pln | *Zea mays* acetyl-coenzyme A carboxylase mRNA, complete cds. |
| 700261812H1 | g18590 | 32 | −6 | gb105pln | *G. max* GH3 gene for auxin-regulated protein. |
| 700267088H1 | g899607 | 65 | −51 | gb105pln | *Zea mays* polyubiquitin (MubC5) mRNA, complete cds. |
| 700265703H1 | g168650 | 95 | −33 | gb105pln | *Zea mays* ubiquitin fusion protein (UBF9) gene, complete cds. |
| 700263631H1 | g1694832 | 17 | −3 | gb105pln | *H. vulgare* Per1 gene. |
| 700264537H1 | g2708736 | 11 | 16 | gb105pln | *Arabidopsis thaliana* BAC T13L16 from chromosome IV, top arm, complete sequence. |
| 700258885H1 | g168440 | 47 | −17 | gb105pln | *Zea mays* chitinase A (seed chitinase) gene, complete cds. |
| 700257374H1 | g2274990 | 45 | −29 | gb105pln | *Hordeum vulgare* mRNA for expressed sequence tag. |
| 700258967H1 | g571510 | 19 | −2 | gb105eukp | BIN3; Bin3p |
| 700207144H1 | g2598964 | 20 | 3 | gb105eukp | cnxABC; molybdopterin cofactor biosynthetic protein |
| 700259509H1 | g2599092 | 25 | −2 | gb105eukp | MSI4; WD-40 repeat protein MSI4 |
| 700266290H1 | g1129084 | 38 | −53 | gb105pln | Wheat mRNA for protein H2A, complete cds, clone wcH2A-3. |
| 700262129H1 | g1403043 | 51 | −44 | gb105pln | *H. chilense* × *T. turgidum* conv. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | durum (Tritordeum) mRNA for S-adenosylmethionine decarboxylase. |
| 700261361H1 | g927238 | 55 | −58 | gb105pln | *Zea mays* globulin1 (Glb1) gene, allele Glb1-Hb, complete cds. |
| 700259603H1 | g2462732 | 34 | −12 | gb105eukp | F8A5.10 |
| 700261025H1 | g975887 | 49 | −25 | gb105pln | *Mesembryanthemum crystallinum* myo-inositol-1-phosphate synthase mRNA, complete cds. |
| 700257028H1 | g1694832 | 25 | −6 | gb105pln | *H. vulgare* Per1 gene. |
| 700262320H1 | g471320 | 51 | −52 | gb105pln | *H. vulgare* (cv. Bomi) B15C mRNA. |
| 700262703H1 | g1498365 | 40 | −47 | gb105pln | *Solanum lycopersicum* actin (Tom51) gene, partial cds. |
| 700264590H1 | g687244 | 53 | −75 | gb105pln | *Zea mays* oil body protein 16 kDa oleosin (ole16) gene, complete cds. |
| 700264949H1 | g17931 | 20 | −20 | gb105pln | *B. secalinas* embryo-specific mRNA. |
| 700262588H1 | g1513227 | 44 | −38 | gb105pln | *Brassica napus* myo-inositol 1-phosphate synthase mRNA, complete cds. |
| 700264920H1 | g1171351 | 29 | −16 | gb105pln | *Oryza sativa* 16 kDa oleosin (ole16) mRNA, complete cds. |
| 700267358H1 | g2827140 | 19 | −1 | gb105pln | *Arabidopsis thaliana* cellulose synthase catalytic subunit (Ath-A) mRNA, complete cds. |
| 700260514H2 | g2648031 | 20 | −24 | gb105pln | *Solanum tuberosum* mRNA for alpha-glucosidase. |
| 700257574H1 | g2564336 | 21 | 3 | gb105pln | *Brassica campestris* mRNA for Tat binding protein 1, complete cds. |
| 700268071H1 | g1167827 | 32 | −31 | gb105pln | *C. reinhardtii* mRNA for ribosomal protein L12. |
| 700266364H1 | g596077 | 22 | −28 | gb105pln | *Zea mays* thiamine biosynthetic enzyme (thi1-1) mRNA, complete cds. |
| 700266638H1 | g683501 | 48 | −40 | gb105pln | *A. thaliana* mRNA for 65 kDa regulatory subunit of protein phosphatase 2A. |
| 700258017H1 | g2182294 | 31 | −17 | gb105allp | Y4aF; No1K |
| 700258564H1 | g1209316 | 21 | 6 | gb105pln | *Hevea brasiliensis* ethylene-inducible protein (ER1) mRNA, complete cds. |
| 700266085H1 | g2331300 | 65 | −51 | gb105pln | *Zea mays* ribosomal protein S4 type I (rps4) mRNA, complete cds. |
| 700265613H1 | g396209 | 37 | −32 | gb105pln | *S. polyrrhiza* mRNA for D-myo-inositol-3-phosphate synthase. |
| 700259479H1 | g687244 | 98 | −17 | gb105pln | *Zea mays* oil body protein 16 kDa oleosin (ole16) gene, complete cds. |
| 700265517H1 | g168512 | 27 | 0 | gb105pln | Maize major protein (L3) mRNA from the surface of lipid bodies, 3' end. |
| 700267283H1 | g927239 | 7 | 6 | gb105allp | globulin1 |
| 700257686H1 | g22292 | 49 | 12 | gb105pln | *Z. mays* mRNA for glycine-rich protein. |
| 700265522H1 | g1154858 | 44 | −60 | gb105pln | *H. vulgare* mRNA for L24 ribosomal protein. |
| 700260324H1 | g971279 | 24 | −32 | gb105pln | Rice mRNA for RAB24 protein, complete cds. |
| 700259361H1 | g46912 | 15 | 5 | gb105allp | ribosomal protein L13 |
| 700256940H1 | g1322276 | 27 | 5 | gb105pln | *Triticum aestivum* histone H2A gene, complete cds. |
| 700265186H1 | g2104949 | 27 | −0 | gb105eukp | sdhn-6r; MAP kinase-like protein |
| 700261867H1 | g833835 | 13 | −2 | gb105eukp | amygdalin hydrolase isoform AH I precursor |
| 700263256H1 | g1513227 | 17 | 3 | gb105pln | *Brassica napus* myo-inositol 1-phosphate synthase mRNA, complete cds. |
| 700260033H1 | g790640 | 16 | 9 | gb105pln | *Hordeum vulgare* gamma-thionin (HTH3) mRNA, complete cds. |
| 700264718H1 | g2570066 | 35 | −32 | gb105pln | *Pisum sativum* mRNA for second sucrose synthase. |
| 700260182H1 | g1574937 | 27 | −63 | gb105pln | *Zea mays* superoxide dismutase 4 (sod4) gene, partial cds. |
| 700257224H1 | g602605 | 34 | −65 | gb105pln | *Zea mays* tandem genes for alpha1-tubulin and alpha2-tubulin. |
| 700258024H1 | g21856 | 23 | −42 | gb105pln | Wheat rDNA 25S-18S intergenic region EcoRI-BamHI fragment. |
| 700267784H1 | g596077 | 19 | 5 | gb105pln | *Zea mays* thiamine biosynthetic enzyme (thi1-1) mRNA, complete cds. |
| 700265766H1 | g468055 | 77 | −71 | gb105pln | *Zea mays* B73 QM protein mRNA, complete cds. |
| 700267217H1 | g669003 | 37 | 1 | gb105allp | calnexin |
| 700266872H1 | g168508 | 66 | −42 | gb105pln | Maize oleosin KD18 (KD18; L2) gene, complete cds. |
| 700261735H1 | g1749670 | 5 | 8 | gb105eukp | similar to *Saccharomyces* |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | *cerevisiae* metal resistance protein YCF1, SWISS-PROT Accession Number P39109 |
| 700259710H1 | g22283 | 49 | −79 | gb105pln | *Zea mays* Glb1-L gene for vicilin-like embryo storage protein. |
| 700261256H1 | g2285801 | 26 | −8 | gb105pln | *Spinacia oleracea* mRNA for 26S proteasome alpha subunit, complete cds. |
| 700258680H1 | g595956 | 35 | −21 | gb105pln | *Brassica rapa* acyl-ACP thioesterase Br FatA1 (FatA1) mRNA, complete cds. |
| 700265947H1 | g21732 | 27 | −3 | gb105pln | Wheat mRNA for Em protein. |
| 700258790H1 | g2181182 | 17 | 3 | gb105eukp | cds; CDP-diacylglycerol synthetase; EC 2.7.7.41 |
| 700257224H1 | g1136119 | 51 | −50 | gb105pln | *O. sativa* mRNA for alpha-tubulin (clone OSTA-111). |
| 700258870H1 | g1209258 | 12 | 1 | gb105allp | protease inhibitor II |
| 700257868H1 | g22270 | 59 | −41 | gb105pln | Maize mRNA from an embryogenic abscisic acid-inducible gene. |
| 700265070H1 | g22119 | 76 | −84 | gb105pln | Maize Adh1-F mRNA for alcohol dehydrogenase. |
| 700262321H1 | g310932 | 42 | −44 | gb105pln | *Nicotiana tabacum* ribosomal protein L17 mRNA, complete cds. |
| 700265568H1 | g2341023 | 32 | −18 | gb105pln | Sequence of BAC F19P19 from *Arabidopsis thaliana* chromosome 1, complete sequence. |
| 700266305H1 | g1449178 | 47 | −42 | gb105pln | *Nicotiana tabacum* mRNA for N-ethylmaleimide sensitive fusion protein, complete cds. |
| 700258178H1 | g2738247 | 56 | −48 | gb105pln | *Arabidopsis thaliana* cobalamin-independent methionine synthase (ATCIMS) mRNA, complete cds. |
| 700263893H1 | g2463334 | 67 | −50 | gb105pln | *Oryza sativa* mRNA for ribosomal protein S4. |
| 700264634H1 | g2194119 | 29 | −0 | gb105eukp | F20P5.5 |
| 700258287H1 | g485376 | 48 | −80 | gb105pln | *Zea mays* alpha-3-tubulin gene, complete cds. |
| 700260335H1 | g170772 | 21 | −19 | gb105pln | *Triticum aestivum* S-adenosyl-L-homocysteine hydrolase (SH6.2) mRNA, complete cds. |
| 700264057H1 | g22281 | 50 | −82 | gb105pln | *Zea mays* Glb1-0 gene for vicilin-like storage protein (truncated). |
| 700266105H1 | g435648 | 53 | −45 | gb105pln | Rice mRNA for gamma-Tip, complete cds. |
| 700264529H1 | g2352493 | 19 | −3 | gb105pln | *Arabidopsis thaliana* transport inhibitor response 1 (TIR1) mRNA, complete cds. |
| 700264580H1 | g687244 | 43 | −76 | gb105pln | *Zea mays* oil body protein 16 kDa oleosin (ole16) gene, complete cds. |
| 700263744H1 | g22283 | 39 | −53 | gb105pln | *Zea mays* Glb1-L gene for vicilin-like embryo storage protein. |
| 700267081H1 | g2668741 | 23 | 4 | gb105pln | *Zea mays* glycine-rich RNA binding protein (GRP) mRNA, complete cds. |
| 700261206H1 | g2623679 | 47 | −40 | gb105pln | *Zea mays* calmodulin (Zmrcalm) mRNA, complete cds. |
| 700265296H1 | g624956 | 26 | −13 | gb105pln | *C. reinhardtii* mRNA for ribosomal protein S18. |
| 700262083H1 | g2341060 | 31 | −56 | gb105pln | *Zea mays* translational initiation factor eIF-4A (tif-4A3) mRNA, complete cds. |
| 700263877H1 | g311334 | 7 | 16 | gb105pln | *S. vulgare* ltp1 mRNA. |
| 700266011H1 | g2244760 | 30 | −30 | gb105eukp | selenium-binding protein |
| 700267527H1 | g20359 | 55 | −71 | gb105pln | Rice gene for 17S ribosomal RNA. |
| 700259143H2 | g2244870 | 16 | −1 | gb105pln | *Arabidopsis thaliana* DNA chromosome 4, ESSA I contig fragment No. 3. |
| 700266161H1 | g780371 | 60 | −57 | gb105pln | *Oryza sativa* enolase mRNA, complete cds. |
| 700260970H1 | g168512 | 37 | −30 | gb105pln | Maize major protein (L3) mRNA from the surface of lipid bodies, 3' end. |
| 700266890H1 | g22461 | 97 | −55 | gb105pln | Maize RAB-17 gene. |
| 700265704H1 | g1200160 | 25 | −8 | gb105pln | *T. gesneriana* mRNA for tonoplast intrinsic protein. |
| 700256788H1 | g1657760 | 29 | 4 | gb105pln | *Zea mays* retrotransposon Cinful 5' LTR and and primer binding site DNA sequence. |
| 700267716H1 | g4790 | 16 | 5 | gb105eukp | YKL253 |
| 700266630H1 | g156279 | 17 | 8 | gb105allp | elongation factor |
| 700266566H1 | g388052 | 80 | −83 | gb105pln | *Zea mays* alcohol dehydrogenase (Adh1-S) mRNA, complete cds. |
| 700266276H1 | g1350502 | 9 | 6 | gb105allp | vicilin-like storage protein |
| 700266029H1 | g995555 | 36 | −21 | gb105eukp | homology to pyroxidal-5'-phosphate-dependant glutamate decarboxylases; putative start codon |
| 700259316H1 | g2351073 | 23 | −4 | gb105pln | *Arabidopsis thaliana* genomic DNA, chromosome 5, P1 clone: MYJ24. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700262520H1 | g642234 | 16 | 10 | gb105pln | *H. cordata* 28S rRNA gene (partial). |
| 700265507H1 | g168512 | 17 | −10 | gb105pln | Maize major protein (L3) mRNA from the surface of lipid bodies, 3' end. |
| 700264538H1 | g1531755 | 19 | −1 | gb105pln | *A. officinalis* mRNA for proline-rich-like protein. |
| 700257146H1 | g168512 | 31 | −42 | gb105pln | Maize major protein (L3) mRNA from the surface of lipid bodies, 3' end. |
| 700267741H1 | g1616660 | 60 | −61 | gb105pln | *Zea mays* adenylosuccinate synthetase mRNA, complete cds. |
| 700258534H1 | g1272409 | 24 | −17 | gb105pln | *Vicia faba* immunophilin precursor (FKBP15) mRNA, complete cds. |
| 700265819H1 | g469148 | 11 | 5 | gb105eukp | alanine aminotransferase |
| 700262341H1 | g7758 | 14 | 3 | gb105allp | crn gene product |
| 700264568H1 | g168508 | 51 | −58 | gb105pln | Maize oleosin KD18 (KD18; L2) gene, complete cds. |
| 700259044H1 | g294212 | 9 | 6 | gb105allp | aldose reductase |
| 700263384H1 | g2264302 | 9 | 17 | gb105pln | *Arabidopsis thaliana* genomic DNA, chromosome 5, P1 clone: MAC12, complete sequence. |
| 700267952H1 | g471320 | 61 | −54 | gb105pln | *H. vulgare* (cv. Bomi) B15C mRNA. |
| 700267049H1 | g168795 | 25 | −20 | gb105pln | *Neurospora crassa* ribosomal protein gene, complete cds. |
| 700266731H1 | g20359 | 53 | −21 | gb105pln | Rice gene for 17S ribosomal RNA. |
| 700265492H1 | g1532047 | 26 | −43 | gb105pln | *O. sativa* mRNA for S-adenosylmethionine decarboxylase. |
| 700265211H1 | g2651303 | 24 | −5 | gb105eukp | T2P4.11; putative potassium transporter |
| 700267019H1 | g2668741 | 51 | −33 | gb105pln | *Zea mays* glycine-rich RNA binding protein (GRP) mRNA, complete cds. |
| 700258504H1 | g1754992 | 66 | −58 | gb105pln | *Triticum aestivum* calmodulin TaCaM1-2 mRNA, complete cds. |
| 700267486H1 | g218132 | 64 | −21 | gb105pln | Rice mRNA for Heat shock protein 83. |
| 700207242H1 | g1432083 | 20 | 3 | gb105allp | homolog to Skp1p, an evolutionarily conserved kinetochore protein in budding yeast |
| 700266432H1 | g786322 | 35 | −21 | gb105eukp | VPS4; Vps4p |
| 700262317H1 | g949877 | 79 | −36 | gb105pln | *H. vulgare* mRNA for elongation factor 1-alpha. |
| 700259359H1 | g433935 | 5 | −1 | gb105eukp | UMS binding protein |
| 700265101H1 | g22285 | 95 | −55 | gb105pln | *Zea mays* Glb1-S gene for vicilin-like embryo storage protein. |
| 700256830H1 | g2612940 | 62 | −51 | gb105pln | *Oryza sativa* CLA1 transketolase-like protein (CLA1) mRNA, nuclear gene encoding putative chloroplast protein, partial cds. |
| 700258493H1 | g804656 | 33 | 5 | gb105eukp | BGQ60; beta-glucosidase |
| 700262638H1 | g2832632 | 7 | 2 | gb105eukp | F13C5.210; hypothetical protein |
| 700266675H1 | g1277236 | 12 | 6 | gb105eukp | SEC13; Sec13p |
| 700259708H1 | g169834 | 17 | −32 | gb105pln | Rye 26S rRNA 3' end and 18S rRNA, 5' end. |
| 700261421H1 | g168480 | 38 | −3 | gb105pln | Maize embryo globulin S allele (7S-like) mRNA, complete cds. |
| 700262084H1 | g18296 | 11 | 14 | gb105pln | Water melon mMDH mRNA for mitochondrial malate dehydrogenase (EC 1.1.1.37). |
| 700261620H1 | g2696030 | 7 | 6 | gb105allp | poly A polymerase |
| 700259639H1 | g170919 | 54 | −49 | gb105pln | Yeast (*Candida maltosa*) ribosomal protein L41 (LEL41) gene, complete cds. |
| 700258449H1 | g1777706 | 100 | −26 | gb105pln | *Zea mays* 18S ribosomal RNA gene, partial sequence. |
| 700260676H1 | g436030 | 20 | 5 | gb105allp | 60S ribosomal protein L34 |
| 700267233H1 | g2262135 | 16 | 9 | gb105pln | *Arabidopsis thaliana* BAC T10P11, complete sequence. |
| 700261272H1 | g406310 | 34 | −23 | gb105pln | *B. napus* (Topas) clpA mRNA. |
| 700260669H1 | g22324 | 29 | −30 | gb105pln | *Z. mays* mRNA for H2B histone (clone cH2B221). |
| 700258128H1 | g1432082 | 26 | −4 | gb105pln | *Arabidopsis thaliana* Skp1p homolog mRNA, complete cds. |
| 700265022H1 | g170775 | 64 | −53 | gb105pln | Wheat translation elongation factor 1 alpha-subunit (TEF1) mRNA, complete cds. |
| 700260744H1 | g2827513 | 12 | 13 | gb105pln | *Arabidopsis thaliana* DNA chromosome 4, BAC clone F8F16 (ESSAII project). |
| 700264691H1 | g1086642 | 8 | 6 | gb105eukp | C06G1.5 |
| 700263620H1 | g1054843 | 18 | −1 | gb105eukp | D12 oleate desaturase |
| 700263188H1 | g2431766 | 80 | −53 | gb105pln | *Zea mays* acidic ribosomal |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | protein P3a (rpp3a) mRNA, complete cds. |
| 700263884H1 | g2832685 | 23 | 2 | gb105allp | putative protein |
| 700266252H1 | g1575127 | 69 | −82 | gb105pln | *Zea mays* lumenal binding protein cBiPe2 mRNA, complete cds. |
| 700264954H1 | g2088647 | 23 | 6 | gb105eukp | T28M21.10 |
| 700260580H1 | g1184959 | 34 | −31 | gb105pln | *Arabidopsis thaliana* glutamate decarboxylase 2 (GAD2) mRNA, complete cds. |
| 700259359H1 | g1255963 | 6 | 0 | gb105eukp | ORF N0852 |
| 700264872H1 | g471320 | 50 | −52 | gb105pln | *H. vulgare* (cv. Bomi) B15C mRNA. |
| 700267266H1 | g601833 | 38 | −3 | gb105pln | (wU1.1) = U1 snRNA [*Triticum aestivum* = wheat, snRNA, 162 nt]. |
| 700257073H1 | g312178 | 35 | −5 | gb105pln | *Z. mays* GapC2 gene. |
| 700268080H1 | g2244810 | 13 | 7 | gb105allp | CCAAT-binding transcription factor subunit A(CBF-A) |
| 700267991H1 | g21732 | 25 | −6 | gb105pln | Wheat mRNA for Em protein. |
| 700266983H1 | g471320 | 61 | −35 | gb105pln | *H. vulgare* (cv. Bomi) B15C mRNA. |
| 700266210H1 | g1519248 | 39 | −26 | gb105pln | *Oryza sativa* GF14-b protein mRNA, complete cds. |
| 700258868H1 | g1815627 | 18 | −29 | gb105pln | *Oryza sativa* metallothionein-like type 2 (OsMT-2) mRNA, complete cds. |
| 700266855H1 | g2369714 | 32 | 4 | gb105eukp | elongation factor 2 |
| 700266320H1 | g473997 | 30 | 6 | gb105eukp | yk333; gamma-Tip |
| 700259334H1 | g1871186 | 12 | −5 | gb105eukp | T06D20.14 |
| 700265272H1 | g968901 | 49 | −52 | gb105pln | Rice mRNA for ribosomal protein S8, complete cds. |
| 700267263H1 | g927239 | 7 | 6 | gb105allp | globulin1 |
| 700263377H1 | g1020001 | 38 | −19 | gb105pln | *Hordeum vulgare* signal recognition particle 54 kDa subunit (Srp54-2) mRNA, complete cds. |
| 700267476H1 | g168480 | 32 | −43 | gb105pln | Maize embryo globulin S allele (7S-like) mRNA, complete cds. |
| 700267466H1 | g2388574 | 11 | 5 | gb105allp | Strong similarity to Phalaenopsis homeobox protein (gb\|U34743). |
| 700262295H1 | g862480 | 80 | 6 | gb105allp | valosin-containing protein |
| 700263281H1 | g1694832 | 32 | −52 | gb105pln | *H. vulgare* Per1 gene. |
| 700266391H1 | g166974 | 38 | −30 | gb105pln | Barley acyl carrier protein III (ACP III) mRNA, complete cds. |
| 700262544H1 | g687244 | 50 | −68 | gb105pln | *Zea mays* oil body protein 16 kDa oleosin (ole16) gene, complete cds. |
| 700264558H1 | g168508 | 69 | −65 | gb105pln | Maize oleosin KD18 (KD18; L2) gene, complete cds. |
| 700259362H1 | g217828 | 22 | −2 | gb105pln | *Arabidopsis thaliana* APK1 gene for protein tyrosine-serine-threonine kinase. |
| 700266030H1 | g1706955 | 43 | −35 | gb105pln | *Gossypium hirsutum* cellulose synthase (celA1) mRNA, complete cds. |
| 700266989H1 | g2760171 | 22 | −7 | gb105pln | *Arabidopsis thaliana* genomic DNA, chromosome 5, P1 clone: MPA24, complete sequence. |
| 700266673H1 | g1050839 | 13 | 14 | gb105pln | *S. tuberosum* mRNA for U1snRNP-specific protein (U1A). |
| 700263855H1 | g21493 | 10 | 5 | gb105eukp | mpp; mitochondrial processing peptidase |
| 700266923H1 | g397400 | 36 | −9 | gb105pln | *B. rapa* mRNA for S phase specific gene. |
| 700261143H1 | g167065 | 15 | 8 | gb105allp | beta-ketoacyl-ACP synthase I |
| 700267889H1 | g168419 | 80 | −69 | gb105pln | Maize (*Z. mays*) aldolase mRNA, complete cds. |
| 700258291H1 | g168481 | 16 | −6 | gb105eukp | globulin precursor |
| 700266127H1 | g20501 | 11 | 2 | gb105allp | vicilin-like storage protein |
| 700258783H1 | g2558517 | 26 | −15 | gb105pln | *Cicer arietinum* mRNA for Ubiquitin protein. |
| 700261620H1 | g1419256 | 9 | 7 | gb105allp | polymerase |
| 700267622H1 | g300082 | 28 | −23 | gb105pln | hsp82 = 82 kda heat shock protein [*Zea mays*, seedling, leaves, Genomic, 3468 nt]. |
| 700266554H1 | g168512 | 25 | −2 | gb105pln | Maize major protein (L3) mRNA from the surface of lipid bodies, 3' end. |
| 700262587H1 | g602564 | 37 | −30 | gb105pln | *C. paradisi* (Macf) INO1 gene. |
| 700262766H1 | g168543 | 63 | −33 | gb105pln | *Zea mays* putative ribosomal protein S8 mRNA, partial cds. |
| 700265495H1 | g22281 | 61 | −62 | gb105pln | *Zea mays* Glb1-0 gene for vicilin-like storage protein (truncated). |
| 700267428H1 | g168481 | 7 | 4 | gb105allp | globulin precursor |
| 700266939H1 | g968995 | 64 | −30 | gb105pln | *Oryza sativa* clone glyceraldehyde-3-phosphate dehydrogenase (Gpc) mRNA, complete cds. |
| 700261829H1 | g168608 | 64 | −84 | gb105pln | Maize 17S ribosomal RNA gene and flanks. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700266348H1 | g21622 | 31 | 0 | gb105pln | *S. vulgare* mRNA for glycine-rich RNA-binding protein (clone S1). |
| 700257449H2 | g1185553 | 33 | −27 | gb105pln | *Zea mays* glyceraldehyde-3-phosphate dehydrogenase (gpc2) gene, complete cds. |
| 700263652H1 | g22281 | 69 | −47 | gb105pln | *Zea mays* Glb1-0 gene for vicilin-like storage protein (truncated). |
| 700259337H1 | g2331300 | 30 | −48 | gb105pln | *Zea mays* ribosomal protein S4 type I (rps4) mRNA, complete cds. |
| 700260946H1 | g168677 | 63 | −79 | gb105pln | Maize 19 kDa zein mRNA, clone cZ19C1, complete cds. |
| 700259842H1 | g1870150 | 25 | −7 | gb105eukp | sec61; ER translocation; SEC61 protein |
| 700266465H1 | g22284 | 8 | 7 | gb105allp | vicilin-like embryo storage protein |
| 700258727H1 | g1531764 | 11 | 12 | gb105pln | *D. stramonium* mRNA for S-adenosylmethionine decarboxylase. |
| 700267813H1 | g416251 | 50 | −49 | gb105pln | Rice mRNA for acetohydroxy acid reductoisomerase, partial sequence. |
| 700267459H1 | g687246 | 57 | −24 | gb105pln | *Zea mays* oil body protein 17 kDa oleosin (ole17) gene, complete cds. |
| 700262320H1 | g971279 | 49 | −47 | gb105pln | Rice mRNA for RAB24 protein, complete cds. |
| 700262251H1 | g2780192 | 20 | −3 | gb105eukp | nap |
| 700257443H2 | g169792 | 46 | −24 | gb105pln | Rice histone 3 gene, complete cds. |
| 700258923H1 | g1777706 | 74 | −54 | gb105pln | *Zea mays* 18S ribosomal RNA gene, partial sequence. |
| 700266126H1 | g2668745 | 71 | −96 | gb105pln | *Zea mays* inorganic pyrophosphatase (IPP) mRNA, complete cds. |
| 700258059H1 | g1130683 | 21 | −21 | gb105pln | *G. hirsutum* gene for acetohydroxyacid synthase (2381 bp). |
| 700263058H1 | g2196541 | 32 | −4 | gb105pln | *Oryza sativa* glycine-rich protein mRNA, complete cds. |
| 700263392H1 | g972155 | 14 | 3 | gb105allp | phosphoprotein phosphatase |
| 700266735H1 | g691752 | 57 | −8 | gb105eukp | preproMP27-MP32 |
| 700265381H1 | g1658314 | 50 | −60 | gb105pln | *O. sativa* osr40g3 gene. |
| 700263365H1 | g2392895 | 28 | −15 | gb105eukp | BRI1; brassinosteroid insensitive 1 |
| 700259738H1 | g1667593 | 40 | 4 | gb105pln | *Oryza sativa* transmembrane protein mRNA, complete cds. |
| 700264523H1 | g397632 | 39 | −39 | gb105pln | *T. aestivum* translation initiation factor 4A. |
| 700265638H1 | g471320 | 62 | −56 | gb105pln | *H. vulgare* (cv. Bomi) B15C mRNA. |
| 700258581H1 | g415316 | 61 | −60 | gb105pln | Rice mRNA for acidic ribosomal protein P0, complete cds. |
| 700262467H1 | g1335965 | 74 | −28 | gb105pln | *Zea mays* acetyl CoA carboxylase mRNA, partial cds. |
| 700263768H1 | g1171351 | 21 | −1 | gb105pln | *Oryza sativa* 16 kDa oleosin (ole16) mRNA, complete cds. |
| 700265996H1 | g1778820 | 57 | −53 | gb105pln | *Oryza sativa* S-adenosyl-L-methionine synthetase (pOS-SAMS2) mRNA, complete cds. |
| 700262139H1 | g168512 | 29 | −73 | gb105pln | Maize major protein (L3) mRNA from the surface of lipid bodies, 3' end. |
| 700263103H1 | g2624416 | 56 | −42 | gb105pln | *Zea mays* mRNA for ubiquitin carrier protein UBC7. |
| 700264569H1 | g1421750 | 14 | 5 | gb105pln | *Pisum sativum* S-adenosylmethionine decarboxylase mRNA, complete cds. |
| 700266260H1 | g2832620 | 11 | −1 | gb105eukp | F13C5.90; hypothetical protein |
| 700207121H1 | g1839188 | 29 | 7 | gb105eukp | RHD3; putative GTP-binding protein; root hair defective 3 |
| 700261840H1 | g1171351 | 12 | 17 | gb105pln | *Oryza sativa* 16 kDa oleosin (ole16) mRNA, complete cds. |
| 700258577H1 | g2827711 | 29 | −8 | gb105eukp | F6H11.130; oxoglutarate dehydrogenase - like protein |
| 700263686H1 | g1724112 | 20 | 7 | gb105allp | ABA induced plasma membrane protein PM 19 |
| 700260911H1 | g22270 | 45 | −72 | gb105pln | Maize mRNA from an embryogenic abscisic acid-inducible gene. |
| 700258429H1 | g1008880 | 30 | −40 | gb105pln | *Phaseolus vulgaris* eukaryotic initiation factor 5 (eIF-5) gene, complete cds. |
| 700266166H1 | g22140 | 54 | 4 | gb105pln | *Z. mays* gene for acetohydroxyacid synthase (AHAS109). |
| 700265530H1 | g2231116 | 11 | 3 | gb105allp | heat resistant RNA dependent ATPase |
| 700264314H1 | g2262143 | 8 | −3 | gb105eukp | T10P11.10; putative |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | serine/threonine protein kinase/T10P11.10 |
| 700257547H1 | g22283 | 96 | −36 | gb105pln | Zea mays Glb1-L gene for |
| | | | | | vicilin-like embryo storage protein. |
| 700262869H1 | g395078 | 41 | −11 | gb105pln | B. rapa ubiquitin and ribosomal |
| | | | | | protein mRNA, complete CDS's. |
| 700256744H1 | g338423 | 6 | 6 | gb105allp | small proline rich protein |
| 700265485H1 | g963061 | 23 | 1 | gb105pln | H. vulgare Ole-1 mRNA for |
| | | | | | oleosin. |
| 700258779H1 | g1532072 | 9 | 14 | gb105pln | Z. mays mRNA for |
| | | | | | S-adenosylmethionine decarboxylase. |
| 700207155H1 | g2505864 | 33 | 1 | gb105pln | Arabidopsis thaliana DNA, 24 |
| | | | | | kb surrounding PFL locus. |
| 700264332H1 | g19103 | 41 | −26 | gb105pln | H. vulgare mRNA for ribosomal |
| | | | | | protein L17-2. |
| 700264608H1 | g397632 | 66 | −59 | gb105pln | T. aestivum translation |
| | | | | | initiation factor 4A. |
| 700267794H1 | g1694832 | 31 | −51 | gb105pln | H. vulgare Per1 gene. |
| 700264837H1 | g1825611 | 10 | −1 | gb105eukp | T03F1.8 |
| 700261862H1 | g168480 | 79 | 5 | gb105pln | Maize embryo globulin S allele |
| | | | | | (7S-like) mRNA, complete cds. |
| 700262747H1 | g217853 | 17 | 7 | gb105allp | high mobility group protein |
| 700265093H1 | g168619 | 95 | −85 | gb105pln | Maize superoxide dismutase-2 |
| | | | | | (Sod-2) mRNA, complete cds. |
| 700262095H1 | g2331300 | 62 | −36 | gb105pln | Zea mays ribosomal protein S4 |
| | | | | | type I (rps4) mRNA, complete cds. |
| 700266145H1 | g1370183 | 28 | −25 | gb105pln | L. japonicus mRNA for small |
| | | | | | GTP-binding protein, RAB7B. |
| 700267095H1 | g20319 | 23 | 3 | gb105pln | Rice rab25 mRNA. |
| 700264381H1 | g2828278 | 14 | 13 | gb105pln | Arabidopsis thaliana DNA |
| | | | | | chromosome 4, BAC clone T18B16 (ESSAII project). |
| 700258153H1 | g773573 | 16 | 7 | gb105allp | archain |
| 700259374H1 | g22560 | 46 | −38 | gb105pln | Mesembryanthemum crystallinum |
| | | | | | ppc2 gene for phosphoenolpyruvate carboxylase (EC 4.1.1.31). |
| 700257280H1 | g506138 | 57 | −2 | gb105pln | Zea mays Ec metallothionein |
| | | | | | class II protein mRNA, complete cds. |
| 700258431H1 | g1519248 | 33 | −13 | gb105pln | Oryza sativa GF14-b protein |
| | | | | | mRNA, complete cds. |
| 700257040H1 | g454872 | 49 | −27 | gb105pln | Maize mRNA for group 3 Lea |
| | | | | | protein MGL3, complete cds. |
| 700262284H1 | g20163 | 35 | −18 | gb105pln | O. sativa Rr15 mRNA for 5S |
| | | | | | ribosomal RNA. |
| 700266324H1 | g596077 | 79 | −72 | gb105pln | Zea mays thiamine biosynthetic |
| | | | | | enzyme (thi1-1) mRNA, complete cds. |
| 700260384H1 | g2218148 | 15 | 4 | gb105allp | DEAH box RNA-helicase homolog |
| | | | | | JA2 |
| 700258663H1 | g687244 | 54 | −92 | gb105pln | Zea mays oil body protein 16 |
| | | | | | kDa oleosin (ole16) gene, complete cds. |
| 700263550H1 | g1122314 | 14 | −11 | gb105pln | P. glaucum mRNA for heat shock |
| | | | | | protein, HSP 17.0. |
| 700264275H1 | g415316 | 65 | −59 | gb105pln | Rice mRNA for acidic ribosomal |
| | | | | | protein P0, complete cds. |
| 700268138H1 | g499106 | 16 | 1 | gb105allp | uracil phosphoribosyl |
| | | | | | transferase |
| 700262708H1 | g22281 | 43 | 5 | gb105pln | Zea mays Glb1-0 gene for |
| | | | | | vicilin-like storage protein (truncated). |
| 700265926H1 | g435542 | 79 | −81 | gb105pln | Z. mays mRNA for calmodulin. |
| 700259063H1 | g1519252 | 29 | −6 | gb105pln | Oryza sativa GF14-d protein |
| | | | | | mRNA, complete cds. |
| 700258750H1 | g168440 | 37 | −30 | gb105pln | Zea mays chitinase A (seed |
| | | | | | chitinase) gene, complete cds. |
| 700259391H1 | g22516 | 58 | 11 | gb105pln | Maize Zc2 gene for zein Zc2 |
| | | | | | (28 kD glutelin-2). |
| 700267666H1 | g1345503 | 25 | −9 | gb105eukp | p40; 40 kD protein |
| 700264559H1 | g1658312 | 39 | −31 | gb105pln | O. sativa osr40g2 gene. |
| 700266504H1 | g2345153 | 81 | −49 | gb105pln | Zea mays ribsomal protein S4 |
| | | | | | (rps4) mRNA, complete cds. |
| 700266457H1 | g20255 | 40 | −14 | gb105pln | O. sativa gene for heat shock |
| | | | | | protein 82 HSP82. |
| 700262161H1 | g687244 | 59 | −50 | gb105pln | Zea mays oil body protein 16 |
| | | | | | kDa oleosin (ole16) gene, complete cds. |
| 700263988H1 | g2253278 | 13 | 5 | gb105eukp | rf2a; bZIP transcriptional |
| | | | | | activator; RF2a |
| 700264027H1 | g166809 | 16 | −7 | gb105eukp | protein kinase |
| 700265247H1 | g2454183 | 48 | −39 | gb105pln | Arabidopsis thaliana pyruvate |
| | | | | | dehydrogenase E1 beta subunit mRNA, nuclear gene encoding plastid protein, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700263709H1 | g475552 | 4 | 7 | gb105allp | N-methyl-D-aspartate receptor NMDAR2D subunit |
| 700264727H1 | g1403043 | 11 | 11 | gb105pln | *H. chilense* × *T. turgidum* conv. durum (Tritordeum) mRNA for S-adenosylmethionine decarboxylase. |
| 700267669H1 | g2656029 | 22 | −21 | gb105pln | *Arabidopsis thaliana* genomic DNA, chromosome 5, P1 clone: MQB2. |
| 700266110H1 | g663256 | 27 | −10 | gb105eukp | orf |
| 700263773H1 | g1107486 | 37 | −23 | gb105pln | *A. thaliana* mRNA for 60S ribosomal protein L27a. |
| 700267952H1 | g971279 | 57 | −49 | gb105pln | Rice mRNA for RAB24 protein, complete cds. |
| 700257782H1 | g1550813 | 63 | −52 | gb105pln | *Z. mays* mRNA for acidic ribosomal protein P0. |
| 700265052H1 | g1009363 | 27 | −11 | gb105eukp | RGP-3 |
| 700265385H1 | g2245110 | 12 | 6 | gb105allp | hypothetical protein |
| 700266025H1 | g510910 | 39 | −36 | gb105pln | *L. temulentum* mRNA for histone H3. |
| 700267215H1 | g1171351 | 73 | −61 | gb105pln | *Oryza sativa* 16 kDa oleosin (ole16) mRNA, complete cds. |
| 700266731H1 | g2138083 | 52 | −19 | gb105pln | *Eburophyton austinae* 18S ribosomal RNA gene, partial sequence. |
| 700259645H1 | g170094 | 38 | −6 | gb105eukp | HSP80; 80 kDa heat shock protein |
| 700262267H1 | g1622938 | 22 | 2 | gb105pln | *Bromus secalinus* oleosin (ole16) mRNA, complete cds. |
| 700262516H1 | g2088621 | 45 | −18 | gb105eukp | mix-1; mitotic chromosome condensation and segregation; X-chromosome dosage compensation; mitotic chromosome and X-chromosome associated MIX-1 protein |
| 700264537H1 | g2708737 | 25 | −3 | gb105eukp | T13L16.1; putative nuclear protein |
| 700268139H1 | g968901 | 53 | −43 | gb105pln | Rice mRNA for ribosomal protein S8, complete cds. |
| 700259168H2 | g1019405 | 21 | −4 | gb105eukp | SPAC2G11.07c; unknown |
| 700258777H1 | g1370173 | 16 | −6 | gb105pln | *L. japonicus* mRNA for small GTP-binding protein, RAB1Y. |
| 700261965H1 | g2827619 | 20 | 0 | gb105allp | hypothetical protein |
| 700262488H1 | g2345153 | 75 | −24 | gb105pln | *Zea mays* ribosomal protein S4 (rps4) mRNA, complete cds. |
| 700265048H1 | g687244 | 50 | −83 | gb105pln | *Zea mays* oil body protein 16 kDa oleosin (ole16) gene, complete cds. |
| 700259467H1 | g457709 | 34 | 4 | gb105eukp | protein kinase |
| 700264562H1 | g457406 | 29 | −2 | gb105eukp | ATMPK7; MAP kinase |
| 700266730H1 | g22281 | 51 | −76 | gb105pln | *Zea mays* Glb1-0 gene for vicilin-like storage protein (truncated). |
| 700266739H1 | g2282583 | 79 | −13 | gb105pln | *Zea mays* elongation factor 1-alpha (EF1-A) mRNA, complete cds. |
| 700260178H1 | g1171351 | 21 | −21 | gb105pln | *Oryza sativa* 16 kDa oleosin (ole16) mRNA, complete cds. |
| 700263334H1 | g927695 | 11 | 5 | gb105eukp | YDR456W; Ydr456wp |
| 700264896H1 | g395157 | 6 | 4 | gb105eukp | PRP8; pre-mRNA splicing factor, U5 snRNP protein; PRP8 |
| 700263669H1 | g404589 | 13 | 5 | gb105allp | A22 |
| 700261534H1 | g396209 | 53 | −47 | gb105pln | *S. polyrrhiza* mRNA for D-myo-inositol-3-phosphate synthase. |
| 700265470H1 | g170899 | 17 | −2 | gb105eukp | peroxisomal membrane protein (PMP20A) |
| 700264937H1 | g927238 | 51 | −56 | gb105pln | *Zea mays* globulin1 (Glb1) gene, allele Glb1-Hb, complete cds. |
| 700256805H1 | g2570506 | 48 | −39 | gb105pln | *Oryza sativa* ribosomal protein mRNA, complete cds. |
| 700262285H1 | g2435519 | 18 | 6 | gb105eukp | A_TM017A05.7 |
| 700262544H1 | g1171351 | 17 | −1 | gb105pln | *Oryza sativa* 16 kDa oleosin (ole16) mRNA, complete cds. |
| 700260688H1 | g1143444 | 18 | −2 | gb105pln | *E. gunnii* mRNA for cinnamyl alcohol dehydrogenase. |
| 700262588H1 | g975887 | 46 | −39 | gb105pln | *Mesembryanthemum crystallinum* myo-inositol-1-phosphate synthase mRNA, complete cds. |
| 700268122H1 | g388291 | 31 | 5 | gb105eukp | RNA binding protein |
| 700257804H1 | g168490 | 57 | −37 | gb105pln | Maize glutathione S-transferase (GST-I) mRNA, complete cds. |
| 700263915H1 | g166850 | 18 | 5 | gb105allp | receptor-like protein kinase |
| 700264606H1 | g1419369 | 83 | −76 | gb105pln | *Z. mays* ZmABP3 mRNA for actin depolymerizing factor. |
| 700265861H1 | g927239 | 16 | −6 | gb105eukp | Glb1, globulin1 |
| 700267281H1 | g927238 | 29 | −50 | gb105pln | *Zea mays* globulin1 (Glb1) gene, allele Glb1-Hb, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700261160H1 | g19074 | 31 | −26 | gb105pln | Barley mRNA for peroxidase (BP1), C-term. |
| 700258564H1 | g1209317 | 14 | 7 | gb105eukp | ER1; ethylene-inducible protein |
| 700263073H1 | g429021 | 57 | −34 | gb105pln | Rice mRNA for ribosomal protein S4 (gene name SS536), partial cds. |
| 700262410H1 | g395071 | 23 | 15 | gb105pln | *V. faba* guanine nucleotide regulatory protein mRNA, complete CDS. |
| 700262604H1 | g486248 | 36 | −28 | gb105pln | Yeast (*Saccharomyces cerevisiae*) chromosome XI reading frame ORF YKL145w. |
| 700266960H1 | g313135 | 94 | −88 | gb105pln | *Z. mays* mRNA for porin. |
| 700266432H1 | g1054845 | 35 | −21 | gb105eukp | END13 |
| 700258432H1 | g2267005 | 40 | −19 | gb105pln | *Oryza sativa* endosperm lumenal binding protein (BiP) mRNA, complete cds. |
| 700264872H1 | g971279 | 46 | −47 | gb105pln | Rice mRNA for RAB24 protein, complete cds. |
| 700266590H1 | g471320 | 51 | −43 | gb105pln | *H. vulgare* (cv. Bomi) B15C mRNA. |
| 700266983H1 | g971279 | 58 | −33 | gb105pln | Rice mRNA for RAB24 protein, complete cds. |
| 700259823H1 | g450548 | 35 | −16 | gb105pln | *O. sativa* (pRSAM-1) gene for S-adenosyl methionine synthetase. |
| 700262715H1 | g2102693 | 27 | −17 | gb105eukp | Frk2; fructokinase; EC 2.7.1.4 |
| 700261379H1 | g1171351 | 21 | −1 | gb105pln | *Oryza sativa* 16 kDa oleosin (ole16) mRNA, complete cds. |
| 700261128H1 | g2829212 | 17 | 3 | gb105eukp | Rgpi9; proteinase inhibitor |
| 700257364H1 | g22292 | 63 | −44 | gb105pln | *Z. mays* mRNA for glycine-rich protein. |
| 700267083H1 | g168480 | 64 | −70 | gb105pln | Maize embryo globulin S allele (7S-like) mRNA, complete cds. |
| 700261285H1 | g1622938 | 17 | −17 | gb105pln | *Bromus secalinus* oleosin (ole16) mRNA, complete cds. |
| 700267215H1 | g168512 | 85 | −82 | gb105pln | Maize major protein (L3) mRNA from the surface of lipid bodies, 3' end. |
| 700258627H1 | g1181672 | 76 | −77 | gb105pln | *Sorghum bicolor* heat shock protein 70 cognate (hsc70) mRNA, partial cds. |
| 700267976H1 | g312178 | 33 | −66 | gb105pln | *Z. mays* GapC2 gene. |
| 700265891H1 | g1658314 | 33 | −12 | gb105pln | *O. sativa* osr40g3 gene. |
| 700259194H2 | g2511595 | 22 | −13 | gb105pln | *Arabidopsis thaliana* mRNA for proteasome subunit prce. |
| 700263007H1 | g1066165 | 21 | −8 | gb105allp | coat protein gamma-cop |
| 700267020H1 | g1151134 | 18 | 2 | gb105eukp | permease 1 |
| 700264511H1 | g168481 | 8 | 7 | gb105eukp | globulin precursor |
| 700262855H1 | g1167955 | 11 | 2 | gb105eukp | putative 32.7 kDa jasmonate-induced protein |
| 700265066H1 | g1345546 | 6 | 5 | gb105allp | polygalacturonase |
| 700265731H1 | g393400 | 93 | −17 | gb105pln | *Z. mays* mRNA for alpha-tubulin. |
| 700258375H1 | g687244 | 67 | −69 | gb105pln | *Zea mays* oil body protein 16 kDa oleosin (ole16) gene, complete cds. |
| 700259733H1 | g22292 | 59 | −8 | gb105pln | *Z. mays* mRNA for glycine-rich protein. |
| 700261823H1 | g798969 | 58 | −22 | gb105pln | Rice mRNA for aldolase C-1, complete cds. |
| 700266119H1 | g20255 | 45 | −51 | gb105pln | *O. sativa* gene for heat shock protein 82 HSP82. |
| 700257414H1 | g297424 | 12 | 5 | gb105allp | glycogen (starch) synthase |
| 700263693H1 | g166843 | 25 | −9 | gb105pln | *Arabidopsis thaliana* ribonucleoprotein mRNA, complete cds. |
| 700264638H1 | g22302 | 9 | 16 | gb105pln | Maize Gpc1 gene for glyceraldehyde-3-phosphate dehydrogenase (GADPH) subunit C. |
| 700258045H1 | g248336 | 85 | −68 | gb105pln | polyubiquitin [maize, Genomic, 3841 nt]. |
| 700267259H1 | g1200160 | 24 | −9 | gb105pln | *T. gesneriana* mRNA for tonoplast intrinsic protein. |
| 700256748H1 | g562086 | 5 | 7 | gb105allp | hyaluronidase |
| 700263441H1 | g21832 | 46 | −6 | gb105pln | Wheat mRNA for chloroplast phosphoglycerate kinase (EC 2.7.2.3). |
| 700260033H1 | g790641 | 14 | −1 | gb105eukp | HTH3; gamma-thionin |
| 700261864H1 | g1778442 | 8 | 6 | gb105eukp | PK5; putative protein kinase PK5 |
| 700262210H1 | g1724111 | 11 | 17 | gb105pln | *Triticum aestivum* ABA induced plasma membrane protein PM-19 (WTABAPM) mRNA, complete cds. |
| 700257321H1 | g2407790 | 16 | 5 | gb105eukp | grr1; grr1 |
| 700266361H1 | g1209258 | 19 | 1 | gb105allp | protease inhibitor II |
| 700259063H1 | g1519248 | 19 | 10 | gb105pln | *Oryza sativa* GF14-b protein mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700261573H1 | g514945 | 85 | −13 | gb105pln | *Zea mays* sucrose synthase (Sus1) mRNA, complete cds. |
| 700259636H1 | g471320 | 43 | −45 | gb105pln | *H. vulgare* (cv. Bomi) B15C mRNA. |
| 700258847H1 | g1872523 | 20 | −0 | gb105eukp | LSD1; negative regulator of cell death; zinc-finger protein Lsd1 |
| 700264135H1 | g168512 | 27 | 3 | gb105pln | Maize major protein (L3) mRNA from the surface of lipid bodies, 3' end. |
| 700266514H1 | g1519248 | 70 | −67 | gb105pln | *Oryza sativa* GF14-b protein mRNA, complete cds. |
| 700258763H1 | g2801432 | 32 | −8 | gb105pln | *Arabidopsis thaliana* salt stress inducible small GTP binding protein Ran1 homolog mRNA, complete cds. |
| 700264427H1 | g2760173 | 18 | −15 | gb105pln | *Arabidopsis thaliana* genomic DNA, chromosome 5, P1 clone: MYH19, complete sequence. |
| 700265493H1 | g469069 | 5 | 7 | gb105allp | NMDA receptor subunit NR2D |
| 700263769H1 | g1931628 | 34 | −72 | gb105pln | *Zea mays* glutamate dehydrogenase mutant (GDH1) mRNA, complete cds. |
| 700257137H1 | g599958 | 15 | −1 | gb105eukp | chloroplast outer envelope protein 86 |
| 700258566H1 | g158313 | 36 | −17 | gb105eukp | Hel25E; DECD family putative RNA helicase |
| 700262747H1 | g433872 | 26 | 3 | gb105allp | HMG protein |
| 700263638H1 | g1432083 | 16 | −1 | gb105allp | homolog to Skp1p, an evolutionarily conserved kinetochore protein in budding yeast |
| 700259484H1 | g1814402 | 24 | 8 | gb105pln | *Mesembryanthemum crystallinum* methionine synthase (MetE) mRNA, complete cds. |
| 700262190H1 | g168423 | 100 | −84 | gb105pln | *Zea mays* polypeptide chain-binding protein mRNA, 3' end. |
| 700267445H1 | g1289203 | 38 | −12 | gb105pln | *A. glutinosa* mRNA for thiazole biosynthetic enzyme. |
| 700265638H1 | g971279 | 58 | −51 | gb105pln | Rice mRNA for RAB24 protein, complete cds. |
| 700262207H1 | g168481 | 7 | 8 | gb105allp | globulin precursor |
| 700264335H1 | g18259 | 21 | 5 | gb105pln | *C. sativus* mRNA for cs DnaJ-1. |
| 700258684H1 | g2464934 | 10 | −1 | gb105eukp | serine C-palmitoyltransferase homolog |
| 700207157H1 | g397395 | 30 | 15 | gb105pln | *Z. mays* MNB1b mRNA for DNA-binding protein. |
| 700262190H1 | g1575127 | 98 | −83 | gb105pln | *Zea mays* lumenal binding protein cBiPe2 mRNA, complete cds. |
| 700262109H1 | g168512 | 40 | −37 | gb105pln | Maize major protein (L3) mRNA from the surface of lipid bodies, 3' end. |
| 700262445H1 | g22237 | 98 | −81 | gb105pln | Maize mRNA for cytosolic GAPDH (GapC) glyceraldehyde-3-phosphate dehydrogenase. |
| 700207144H1 | g662871 | 24 | −5 | gb105eukp | Cnx2 |
| 700258244H1 | g22614 | 29 | −10 | gb105pln | *S. vulgare* pepC gene for PEP carboxylase. |
| 700263331H1 | g19538 | 16 | −5 | gb105pln | *M. crystallinum* mRNA for ribosomal protein YL16. |
| 700260556H2 | g22314 | 82 | −89 | gb105pln | Maize mRNA for GSH gluthathione S-transferase I (GST; EC 2.5.1.18). |
| 700257788H1 | g168480 | 93 | −59 | gb105pln | Maize embryo globulin S allele (7S-like) mRNA, complete cds. |
| 700257534H1 | g520935 | 26 | 13 | gb105pln | *H. vulgare* mRNA for gamma-TIP-like protein. |
| 700258490H1 | g168541 | 52 | −21 | gb105pln | *Zea mays* putative proteolipid subunit of vacuolar H+ ATPase mRNA, partial cds. |
| 700265887H1 | g167004 | 3 | 8 | gb105allp | embryo globulin |
| 700263245H1 | g168604 | 95 | −37 | gb105pln | *Zea mays* viviparous-1 mRNA, complete cds. |
| 700264351H1 | g780813 | 31 | −17 | gb105pln | *Arabidopsis thaliana* 3-ketoacyl-acyl carrier protein synthase I (KAS I) mRNA, complete cds. |
| 700267912H1 | g747886 | 9 | 6 | gb105eukp | unknown |
| 700257056H1 | g347527 | 31 | 7 | gb105allp | ribosomal protein S3 |
| 700263380H1 | g22281 | 86 | −22 | gb105pln | *Zea mays* Glb1-0 gene for vicilin-like storage protein (truncated). |
| 700257371H1 | g218176 | 36 | −31 | gb105pln | Rice mRNA for 21 kd polypeptide. |
| 700266756H1 | g303838 | 42 | −25 | gb105pln | Rice mRNA for 40S subunit ribosomal protein, complete cds. |
| 700266602H1 | g1742962 | 25 | −3 | gb105pln | *A. thaliana* mRNA for putative gamma-glutamylcysteine synthetase. |
| 700266803H1 | g1532072 | 29 | 1 | gb105pln | *Z. mays* mRNA for S-adenosylmethionine decarboxylase. |
| 700265358H1 | g294844 | 19 | 9 | gb105pln | Sugarcane membrane protein mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700264320H1 | g170746 | 73 | −56 | gb105pln | Wheat histone H4 TH091 gene, complete cds. |
| 700259306H1 | g1628083 | 20 | −0 | gb105eukp | R07H5.8 |
| 700262427H1 | g1001532 | 31 | −12 | gb105allp | hypothetical protein |
| 700265932H1 | g1279512 | 9 | 8 | gb105pln | *H. vulgare* bepl mRNA for ADP-glucose pyrophosphorylase. |
| 700258383H1 | g167244 | 37 | −28 | gb105pln | *Chlorella kessleri* elongation factor 2 mRNA, complete cds. |
| 700261004H1 | g7637 | 11 | 6 | gb105allp | 52-kD bracketing protein |
| 700268017H1 | g22393 | 39 | −56 | gb105pln | *Z. mays* RNA for pyruvat decarboxylase. |
| 700267275H1 | g166829 | 20 | −4 | gb105pln | *Arabidopsis thaliana* proteasome (PSM30) gene, complete cds. |
| 700259419H1 | g2827715 | 21 | 7 | gb105eukp | F6H11.170; receptor protein kinase - like protein |
| 700257391H1 | g2463334 | 26 | −45 | gb105pln | *Oryza sativa* mRNA for ribosomal protein S4. |
| 700262363H1 | g1107488 | 30 | 5 | gb105pln | *A. thaliana* mRNA for 60S ribosomal protein L9. |
| 700264514H1 | g22283 | 61 | −79 | gb105pln | *Zea mays* Glb1-L gene for vicilin-like embryo storage protein. |
| 700265656H1 | g726279 | 13 | 5 | gb105allp | Sgs1p |
| 700258633H1 | g687244 | 83 | −84 | gb105pln | *Zea mays* oil body protein 16 kDa oleosin (ole16) gene, complete cds. |
| 700267755H1 | g22461 | 90 | −11 | gb105pln | Maize RAB-17 gene. |
| 700267183H1 | g1046225 | 11 | 6 | gb105allp | ethylene response sensor |
| 700260910H1 | g168512 | 32 | −22 | gb105pln | Maize major protein (L3) mRNA from the surface of lipid bodies, 3' end. |
| 700257054H1 | g1627629 | 33 | 3 | gb105allp | C27H6.2 |
| 700267653H1 | g1171351 | 26 | −14 | gb105pln | *Oryza sativa* 16 kDa oleosin (ole16) mRNA, complete cds. |
| 700260358H2 | g168512 | 22 | −4 | gb105pln | Maize major protein (L3) mRNA from the surface of lipid bodies, 3' end. |
| 700207128H1 | g1173555 | 45 | 1 | gb105eukp | galE; catabolism of galactose to glucose in Leloir pathway, and in galactose synthesis from glucose.; UDP-galactose-4-epimerase; EC 5.1.3.2 |
| 700257804H1 | g168486 | 71 | −61 | gb105pln | Maize glutathione S-transferase gene (GST-I), exon 1. |
| 700263993H1 | g21732 | 26 | −17 | gb105pln | Wheat mRNA for Em protein. |
| 700207236H1 | g1036802 | 23 | −17 | gb105pln | *Arabidopsis thaliana* TGF-beta receptor interacting protein 1 homolog mRNA, complete cds. |
| 700265839H1 | g1841501 | 52 | −57 | gb105pln | *Z. mays* mRNA for glutathione-dependent formaldehyde dehydrogenase. |
| 700259189H1 | g168500 | 39 | −9 | gb105pln | Maize (*Zea mays*) histone H4 gene (H4C14), complete cds. |
| 700257617H1 | g10399 | 25 | 6 | gb105eukp | ald orfU protein (AA 1-190) |
| 700256860H1 | g1203905 | 19 | −15 | gb105eukp | M(1)15D; M(1)15D |
| 700261586H1 | g2809258 | 31 | −1 | gb105eukp | F21B7.27 |
| 700260660H1 | g2290403 | 18 | 5 | gb105pln | *Helianthus annuus* delta-12 oleate desaturase mRNA, complete cds. |
| 700258632H1 | g18890 | 43 | −34 | gb105pln | *H. vulgare* gene for aldose reductase-related protein. |
| 700267280H1 | g1279563 | 13 | 1 | gb105eukp | nuM1 |
| 700260232H1 | g36088 | 26 | −5 | gb105allp | C6.1A gene product |
| 700258656H1 | g2645198 | 18 | 4 | gb105pln | *Arabidopsis thaliana* chromosome I BAC T26J12 genomic sequence, complete sequence. |
| 700258817H1 | g1171351 | 16 | −21 | gb105pln | *Oryza sativa* 16 kDa oleosin (ole16) mRNA, complete cds. |
| 700258766H1 | g1620753 | 8 | 4 | gb105eukp | RPI; proteinase inhibitor |
| 700267925H1 | g22281 | 50 | −72 | gb105pln | *Zea mays* Glb1-0 gene for vicilin-like storage protein (truncated). |
| 700266941H1 | g2464865 | 24 | 2 | gb105allp | pectinesterase |
| 700265666H1 | g1136121 | 62 | −62 | gb105pln | *O. sativa* mRNA for alpha-tubulin (clone OSTA-136). |
| 700262853H1 | g432367 | 40 | −10 | gb105pln | Rice mRNA for elongation factor 1 beta, complete cds. |
| 700263144H1 | g1321992 | 29 | 16 | gb105pln | *S. tuberosum* mRNA for 14-3-3 protein. |
| 700268185H1 | g1155264 | 55 | −39 | gb105pln | *Pennisetum ciliare* possible apospory-associated protein mRNA, complete cds. |
| 700265928H1 | g1502356 | 15 | −12 | gb105eukp | PUP2 |
| 700260908H1 | g2298897 | 20 | 4 | gb105allp | unnamed protein product |
| 700256857H1 | g2632251 | 21 | −2 | gb105pln | *S. bicolor* DNA for gene encoding putative protein serine/threonine kinase, clone cSNFL1. |
| 700263156H1 | g168512 | 29 | −11 | gb105pln | Maize major protein (L3) mRNA from the surface of lipid bodies, 3' end. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700258792H1 | g293888 | 71 | −60 | gb105pln | *Zea mays*, glyceraldehyde-3-phosphate dehydrogenase mRNA, 3' end (clone GAPC2). |
| 700257406H2 | g780371 | 65 | −69 | gb105pln | *Oryza sativa* enolase mRNA, complete cds. |
| 700260862H1 | g2632252 | 31 | 8 | gb105eukp | SNFL1; serine/threonine kinase |
| 700261004H1 | g1049082 | 9 | 5 | gb105allp | SRp40-3 |
| 700261104H1 | g1519248 | 36 | −22 | gb105pln | *Oryza sativa* GF14-b protein mRNA, complete cds. |
| 700256818H1 | g804655 | 11 | 13 | gb105pln | *Hordeum vulgare* L. beta-glucosidase (BGQ60) gene, complete cds. |
| 700260865H1 | g2618602 | 29 | −10 | gb105pln | *Arabidopsis thaliana* genomic DNA, chromosome 5, P1 clone: MSJ1, complete sequence. |
| 700260566H1 | g687244 | 54 | 3 | gb105pln | *Zea mays* oil body protein 16 kDa oleosin (ole16) gene, complete cds. |
| 700260273H1 | g406306 | 24 | 7 | gb105pln | *A. cliftonii* mRNA for protein phosphatase 2A. |
| 700257989H1 | g1132482 | 36 | −16 | gb105pln | Rice mRNA for ADP-ribosylation factor, complete cds. |
| 700260384H1 | g414716 | 15 | 4 | gb105eukp | pre-mRNA splicing factor; pre-mRNA spicing factor |
| 700207115H1 | g1304213 | 20 | 6 | gb105pln | Rice mRNA for cytosolic glutathione reductase, complete cds. |
| 700260490H1 | g1556445 | 45 | −41 | gb105pln | *Hordeum vulgare* alpha tubulin (tubA) mRNA, complete cds. |
| 700262908H1 | g414735 | 12 | 4 | gb105pln | Yeast (*Saccharomyces cerevisiae*) translation elongation factor 2 (EFT2) gene, complete cds. |
| 700258319H1 | g899607 | 62 | −53 | gb105pln | *Zea mays* polyubiquitin (MubC5) mRNA, complete cds. |
| 700263709H1 | g2160438 | 4 | 7 | gb105allp | glutamate receptor channel subunit epsilon 4 |
| 700262436H1 | g22281 | 46 | −70 | gb105pln | *Zea mays* Glb1-0 gene for vicilin-like storage protein (truncated). |
| 700264184H1 | g22281 | 64 | −23 | gb105pln | *Zea mays* Glb1-0 gene for vicilin-like storage protein (truncated). |
| 700266590H1 | g971279 | 49 | −41 | gb105pln | Rice mRNA for RAB24 protein, complete cds. |
| 700256996H1 | g2282583 | 76 | −15 | gb105pln | *Zea mays* elongation factor 1-alpha (EF1-A) mRNA, complete cds. |
| 700265106H1 | g1184773 | 86 | −76 | gb105pln | *Zea mays* glyceraldehyde-3-phosphate dehydrogenase GAPC3 (gpc3) mRNA, complete cds. |
| 700260667H1 | g1408471 | 17 | −12 | gb105eukp | ADF1; actin depolymerizing factor 1 |
| 700265172H1 | g915312 | 21 | −14 | gb105pln | *Nicotiana glutinosa* ribosomal protein L31 mRNA, complete cds. |
| 700267254H1 | g22281 | 24 | −57 | gb105pln | *Zea mays* Glb1-0 gene for vicilin-like storage protein (truncated). |
| 700265455H1 | g312516 | 21 | 0 | gb105pln | *T. aestivum* Em mRNA. |
| 700261181H1 | g168480 | 84 | −33 | gb105pln | Maize embryo globulin S allele (7S-like) mRNA, complete cds. |
| 700261612H1 | g1154953 | 42 | −28 | gb105pln | *T. aestivum* histone H2A gene. |
| 700262104H1 | g2306767 | 15 | 8 | gb105pln | *Triticum aestivum* eIF-2 beta subunit mRNA, complete cds. |
| 700263587H1 | g1220177 | 24 | 11 | gb105pln | *T. ledebourii* mRNA for pG31-like dormancy related protein. |
| 700266439H1 | g463856 | 26 | −29 | gb105pln | *Chlamydomonas reinhardtii* 21gr ribosomal protein S14 (CRY1) gene, complete cds. |
| 700257813H1 | g975887 | 39 | −12 | gb105pln | *Mesembryanthemum crystallinum* myo-inositol-1-phosphate synthase mRNA, complete cds. |
| 700259044H1 | g662845 | 8 | 6 | gb105allp | aldose reductase |
| 700256712H1 | g1181672 | 32 | −17 | gb105pln | *Sorghum bicolor* heat shock protein 70 cognate (hsc70) mRNA, partial cds. |
| 700263723H1 | g1129160 | 7 | 7 | gb105eukp | J1545 |
| 700263956H1 | g1536964 | 16 | −46 | gb105pln | *Z. mays* cat2 gene. |
| 700267332H1 | g1052972 | 23 | −10 | gb105pln | *Beta vulgaris* fructokinase mRNA, complete cds. |
| 700266109H1 | g1314710 | 18 | −30 | gb105pln | *Arabidopsis thaliana* calcium-dependent protein kinase gene, complete cds. |
| 700266064H1 | g286238 | 5 | 7 | gb105allp | N-methyl-D-aspartate receptor subunit |
| 700266262H1 | g1845194 | 97 | −50 | gb105pln | *Z. mays* mRNA for HMGc1 protein. |
| 700259570H1 | g1373149 | 48 | −54 | gb105pln | *Triticum aestivum* soluble starch synthase mRNA, partial cds. |
| 700262566H1 | g1550813 | 53 | −68 | gb105pln | *Z. mays* mRNA for acidic ribosomal protein P0. |
| 700265219H1 | g1848282 | 92 | −39 | gb105pln | *Sorghum bicolor* aldehyde dehydrogenase (Dha1) mRNA, partial cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700263302H1 | g498932 | 18 | 7 | gb105eukp | ORF217; homologous to C-terminal domains of RNA polymerases encoded by linear plasmids from fungi and S-2 plasmid from maize |
| 700261856H1 | g294665 | 24 | −1 | gb105pln | Castor bean chloroplast beta-ketoacyl-ACP synthase mRNA, complete cds. |
| 700261649H1 | g218341 | 25 | 4 | gb105eukp | elongation factor 1 beta' |
| 700265490H1 | g170434 | 41 | −41 | gb105pln | Tomato ATP-dependent protease (CD4B) gene, complete cds. |
| 700260649H1 | g1694832 | 15 | −42 | gb105pln | *H. vulgare* Per1 gene. |
| 700264661H1 | g1575129 | 97 | −92 | gb105pln | *Zea mays* lumenal binding protein cBiPe3 mRNA, complete cds. |
| 700257225H1 | g22283 | 54 | −78 | gb105pln | *Zea mays* GIb1-L gene for vicilin-like embryo storage protein. |
| 700264077H1 | g218160 | 38 | −29 | gb105pln | *Oryza sativa* mRNA for elongation factor 1 beta'. |
| 700266147H1 | g1653966 | 15 | 5 | gb105allp | 47 kD protein |
| 700258692H1 | g168481 | 8 | 8 | gb105allp | globulin precursor |
| 700267885H1 | g2632527 | 22 | 6 | gb105allp | similar to hypothetical proteins |
| 700259174H2 | g575959 | 35 | −33 | gb105pln | *Z. mays* (Black Mexican Sweet) mRNA for 1-acyl-glycerol-3-phosphate acyltransferase (putative). |
| 700258859H1 | g2196541 | 26 | −6 | gb105pln | *Oryza sativa* glycine-rich protein mRNA, complete cds. |
| 700259555H1 | g2318117 | 27 | −8 | gb105eukp | Ch1D; one of three subunit of a complex which catalyzes the Mg insertion step in chlorophyll biosynthesis; Mg-chelatase subunit D |
| 700257973H1 | g2463334 | 27 | −38 | gb105pln | *Oryza sativa* mRNA for ribosomal protein S4. |
| 700265775H1 | g1622938 | 19 | −13 | gb105pln | *Bromus secalinus* oleosin (ole16) mRNA, complete cds. |
| 700260538H2 | g1592681 | 8 | 8 | gb105eukp | LEA D113 homologue type2 |
| 700261217H1 | g1854377 | 13 | −1 | gb105pln | *Saccharum officinarum* RNA for Sucrose-Phosphate Synthase, complete cds. |
| 700267995H1 | g22287 | 8 | 7 | gb105allp | vicilin-like embryo storage protein |
| 700264056H1 | g167112 | 29 | −33 | gb105pln | *Bromus inermis* aldose reductase-related protein, complete cds. |
| 700265755H1 | g2464884 | 13 | −4 | gb105eukp | RNA-binding protein homolog |
| 700266326H1 | g2245081 | 14 | −1 | gb105eukp | myosin II heavy chain homolog |
| 700261496H1 | g168512 | 26 | −0 | gb105pln | Maize major protein (L3) mRNA from the surface of lipid bodies, 3' end. |
| 700264851H1 | g2586332 | 12 | 9 | gb105pln | *Lycopersicon esculentum* importin alpha (LeKAP alpha) mRNA, partial cds. |
| 700265061H1 | g406310 | 18 | 1 | gb105pln | *B. napus* (Topas) c1pA mRNA. |
| 700257259H1 | g168512 | 34 | 13 | gb105pln | Maize major protein (L3) mRNA from the surface of lipid bodies, 3' end. |
| 700267107H1 | g2662342 | 84 | −3 | gb105pln | *Oryza sativa* mRNA for EF-1 alpha, complete cds. |
| 700259675H1 | g1203905 | 11 | 1 | gb105eukp | M(1)15D; M(1)15D |
| 700259636H1 | g971279 | 40 | −41 | gb105pln | Rice mRNA for RAB24 protein, complete cds. |
| 700267938H1 | g22149 | 99 | −88 | gb105pln | *Z. mays* mRNA for alpha-tubulin 3. |
| 700617923H1 | g1019903 | 35 | −20 | gb105pln | *Arabidopsis thaliana* cell division cycle protein (CDC48) mRNA, complete cds. |
| 700615807H1 | g167244 | 21 | −15 | gb105pln | *Chlorella kessleri* elongation factor 2 mRNA, complete cds. |
| 700614812H1 | g2735659 | 35 | −9 | gb105allp | preprocathepsin H |
| 700617143H1 | g1667591 | 25 | 2 | gb105pln | *Oryza sativa* histone 3 mRNA, complete cds. |
| 700615341H1 | g2627057 | 56 | 3 | gb105pln | *Oryza sativa* mRNA for ADP glucose pyrophosphorylase large subunit, complete cds. |
| 700612521H1 | g217836 | 55 | −47 | gb105pln | *A. thaliana* mRNA for ara-3, complete cds. |
| 700616517H1 | g998429 | 41 | −18 | gb105pln | GRF1 = general regulatory factor [Zea mays, XL80, Genomic, 5348 nt]. |
| 700613472H1 | g22314 | 50 | −88 | gb105pln | Maize mRNA for GSH gluthathione S-transferase I (GST; EC 2.5.1.18). |
| 700618512H1 | g2224911 | 10 | 1 | gb105eukp | somatic embryogenesis receptor-like kinase |
| 700612895H1 | g2160318 | 24 | 17 | gb105pln | Rice mRNA for ribosomal protein L9, partial sequence. |
| 700612907H1 | g348717 | 26 | −15 | gb105pln | *Medicago truncatula* protochlorophyllide reductase homolgue protein mRNA, complete cds. |
| 700618677H1 | g2668737 | 26 | 8 | gb105pln | *Zea mays* translation initiation factor 5A (TIF5A) mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700613075H1 | g1272684 | 60 | −59 | gb105pln | Z. mays mRNA for acetyl CoA carboxylase (partial). |
| 700612750H1 | g992966 | 17 | −2 | gb105eukp | thioredoxin |
| 700616447H1 | g307078 | 8 | 2 | gb105allp | alpha-keto acid dehydrogenase precursor |
| 700617252H1 | g2689469 | 21 | −9 | gb105eukp | IAA22 |
| 700614201H1 | g633607 | 39 | −6 | gb105eukp | chloroplastic outer envelope membrane protein (OEP75) |
| 700614765H1 | g515376 | 31 | 8 | gb105pln | L. temulentum mRNA for histone H4. |
| 700613717H1 | g602605 | 52 | −42 | gb105pln | Zea mays tandem genes for alpha1-tubulin and alpha2-tubulin. |
| 700612741H1 | g170746 | 43 | −36 | gb105pln | Wheat histone H4 TH091 gene, complete cds. |
| 700616887H1 | g2317907 | 23 | 4 | gb105allp | Mago Nashi-like protein |
| 700613877H1 | g809594 | 12 | −0 | gb105eukp | unknown |
| 700615210H1 | g1184773 | 65 | −41 | gb105pln | Zea mays glyceraldehyde-3-phosphate dehydrogenase GAPC3 (gpc3) mRNA, complete cds. |
| 700614372H1 | g1498052 | 62 | −10 | gb105pln | Zea mays ribosomal protein S8 mRNA, complete cds. |
| 700612353H1 | g2351061 | 21 | 15 | gb105pln | Arabidopsis thaliana genomic DNA, chromosome 5, P1 clone: MAF19. |
| 700613919H1 | g388052 | 95 | −97 | gb105pln | Zea mays alcohol dehydrogenase (Adh1-S) mRNA, complete cds. |
| 700461268H1 | g1532072 | 24 | 8 | gb105pln | Z. mays mRNA for S-adenosylmethionine decarboxylase. |
| 700616539H1 | g340074 | 22 | 5 | gb105allp | ubiquitin carboxyl-terminal hydrolase |
| 700615469H1 | g22163 | 27 | 7 | gb105pln | Z. mays MANT2 mRNA for adenine nucleotide translocator (ADP/ATP translocase). |
| 700616112H1 | g168496 | 24 | −40 | gb105pln | Maize (Zea mays) histone H3 gene (H3C4), complete cds. |
| 700612525H1 | g19280 | 36 | −31 | gb105pln | L. esculentum mRNA for enolase. |
| 700614290H1 | g2160173 | 7 | 5 | gb105eukp | F21M12.21 |
| 700612458H1 | g619928 | 31 | −10 | gb105eukp | hexokinase; EC 2.7.1.1 |
| 700616461H1 | g17561 | 10 | 6 | gb105allp | PROTEINASE INHIBITOR |
| 700616908H1 | g169131 | 30 | −20 | gb105pln | P. sativum phytochrome gene, complete cds. |
| 700616579H1 | g1419369 | 62 | 11 | gb105pln | Z. mays ZmABP3 mRNA for actin depolymerizing factor. |
| 700613133H1 | g1652990 | 9 | 3 | gb105allp | (3R)-hydroxymyristol acyl carrier protein dehydrase |
| 700613721H1 | g416252 | 27 | −50 | gb105pln | Rice mRNA for 3-deoxy-D-arabino-heptulosonate 7-phosphate synthase, partial sequence. |
| 700612528H1 | g829024 | 57 | −24 | gb105allp | ATPase |
| 700616387H1 | g22531 | 30 | −29 | gb105pln | Zea mays mRNA encoding a zein (clone pZ22.1). |
| 700615918H1 | g1015315 | 19 | 7 | gb105pln | Pisum sativum (clone PsRCI35-2) ribosomal protein L41 mRNA, complete cds. |
| 700461158H1 | g1314859 | 40 | −27 | gb105pln | Arabidospis thaliana GTP binding protein, Sar1 homolog (ASAR1) mRNA, complete cds. |
| 700616186H1 | g1143864 | 15 | −15 | gb105eukp | catalyzes the release of either giberellin or cyanogenic substances from their glucoconjugates; beta glucosidase; EC 3.2.1.21 |
| 700614294H1 | g2832242 | 44 | −2 | gb105pln | Zea mays 22-kDa alpha zein gene cluster, complete sequence. |
| 700615509H1 | g510190 | 14 | −20 | gb105eukp | unknown; chloroplast outer envelope protein 34 |
| 700461195H1 | g1098977 | 17 | 4 | gb105eukp | IMP1; myo-inositol monophosphatase 1 |
| 700616068H1 | g170899 | 6 | 5 | gb105eukp | peroxisomal membrane protein (PMP20A) |
| 700617184H1 | g168419 | 88 | −23 | gb105pln | Maize (Z. mays) aldolase mRNA, complete cds. |
| 700614715H1 | g2301622 | 17 | 8 | gb105allp | CODING REGION FOR MATURE PROLYLENDOPEPTIDASE |
| 700613969H1 | g1814402 | 31 | 10 | gb105pln | Mesembryanthemum crystallinum methionine synthase (MetE) mRNA, complete cds. |
| 700613042H1 | g337506 | 12 | 0 | gb105allp | ribosomal protein S24 |
| 700617202H1 | g22531 | 18 | −7 | gb105pln | Zea mays mRNA encoding a zein (clone pZ22.1). |
| 700615166H1 | g514945 | 86 | −10 | gb105pln | Zea mays sucrose synthase (Sus1) mRNA, complete cds. |
| 700618491H2 | g1161601 | 20 | −3 | gb105pln | N. tabacum mRNA for phosphoglycerate kinase (cytosolic isoenzyme). |
| 700615089H1 | g984964 | 19 | 0 | gb105eukp | SIK1; suppressor of toxicity |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | of GAL4-IKB; Sik1p |
| 700612379H1 | g168484 | 100 | −13 | gb105pln | Maize endosperm glutelin-2 gene, complete cds. |
| 700614569H1 | g22144 | 45 | −12 | gb105pln | Maize anaerobically regulated gene for fructose bisphosphate aldolase (EC 4.1.2.13). |
| 700613911H1 | g313028 | 53 | −52 | gb105pln | *L. esculentum* ypt2 mRNA for GTP-binding protein. |
| 700461240H1 | g2827138 | 15 | −2 | gb105pln | *Arabidopsis thaliana* cellulose synthase catalytic subunit (RSW1) gene, complete cds. |
| 700614265H1 | g22544 | 51 | 6 | gb105pln | Maize mRNA (clone A30) for zein (a plant storage protein). |
| 700614809H1 | g435172 | 36 | −49 | gb105pln | *A. sativa* (Pewi) ASTCP-K19 mRNA for t complex polypeptide 1. |
| 700616425H1 | g1136121 | 24 | 6 | gb105pln | *O. sativa* mRNA for alpha-tubulin (clone OSTA-136). |
| 700615605H1 | g19103 | 38 | −39 | gb105pln | *H. vulgare* mRNA for ribosomal protein L17-2. |
| 700615454H1 | g1711035 | 25 | −16 | gb105pln | *Pisum sativum* hydroxyproline rich glycoprotein PsHRGP1 mRNA, partial cds. |
| 700614868H1 | g168500 | 76 | −5 | gb105pln | Maize (*Zea mays*) histone H4 gene (H4C14), complete cds. |
| 700615246H1 | g1053058 | 25 | −37 | gb105pln | *Triticum aestivum* histone H3 gene, partial cds, clone W2. |
| 700614376H1 | g1430979 | 20 | −2 | gb105eukp | NOP1 |
| 700612910H1 | g168679 | 60 | −62 | gb105pln | Maize 19 kDa zein mRNA, clone cZ19C2, complete cds. |
| 700618643H1 | g1789373 | 6 | 5 | gb105allp | f136 |
| 700618479H2 | g310932 | 17 | 4 | gb105pln | *Nicotiana tabacum* ribosomal protein L17 mRNA, complete cds. |
| 700614328H1 | g169843 | 89 | −85 | gb105pln | Saccarum hybrid phosphoenolpyruvate carboxylase (SCPEPCD1) gene, complete cds. |
| 700614030H1 | g22118 | 16 | −5 | gb105pln | *Z. mays* DNA for Adh1-Cm allele. |
| 700617057H1 | g294284 | 33 | −31 | gb105pln | Potato 3-deoxy-D-arabino-heptulosonate 7-phosphate synthase (shkB) mRNA, complete cds. |
| 700612819H1 | g1296662 | 38 | 4 | gb105allp | piectin |
| 700615496H1 | g2258468 | 14 | 16 | gb105pln | *Oryza sativa* replication protein A1 (Os-RPA1) mRNA, complete cds. |
| 700613857H1 | g1276967 | 27 | −21 | gb105eukp | putative ribosomal protein |
| 700614903H1 | g1181330 | 93 | −63 | gb105pln | *Z. mays* CNX mRNA. |
| 700617467H1 | g927239 | 9 | 4 | gb105eukp | Glb1; globulin1 |
| 700612330H1 | g700195 | 12 | 1 | gb105eukp | K01C8.9 |
| 700461174H1 | g999189 | 25 | −4 | gb105pln | dihydrofolate reductase-thymidylate synthase = bifunctional enzyme [Glycine max, seedling, mRNA, 1794 nt]. |
| 700615406H1 | g602605 | 59 | −52 | gb105pln | *Zea mays* tandem genes for alpha1-tubulin and alpha2-tubulin. |
| 700612506H1 | g903689 | 21 | −8 | gb105eukp | acyl carrier protein precursor |
| 700612819H1 | g57127 | 46 | 2 | gb105allp | ribosomal protein S10 (AA 1-165) |
| 700615096H1 | g432446 | 16 | −18 | gb105eukp | FUS6 |
| 700616493H1 | g1303788 | 7 | 7 | gb105allp | YqeH |
| 700613016H1 | g2245038 | 9 | −4 | gb105eukp | hypothetical protein |
| 700613007H1 | g1597723 | 8 | −2 | gb105eukp | cr4; CRINKLY4 precursor |
| 700617176H1 | g2460200 | 12 | 1 | gb105allp | eukaryotic translation initiation factor 3 subunit |
| 700616377H1 | g1399512 | 18 | −10 | gb105eukp | repE; repE |
| 700612828H1 | g1045304 | 76 | −9 | gb105pln | *Zea mays* acetyl-coenzyme A carboxylase mRNA, complete cds. |
| 700612453H1 | g1335861 | 45 | 3 | gb105pln | Glycine max clathrin heavy chain mRNA, complete cds. |
| 700616575H1 | g2394299 | 16 | −40 | gb105pln | *Oryza sativa* cytochrome C mRNA, complete cds. |
| 700614342H1 | g18210 | 20 | −3 | gb105pln | *C. reinhardtii* mRNA for ribosomal protein P1. |
| 700612927H1 | g1850559 | 7 | 5 | gb105eukp | bmmif; macrophage migration inhibitory factor |
| 700616968H1 | g2262148 | 34 | −33 | gb105eukp | T10P11.14; predicted NADH dehydrogenase 24 kDa subunit |
| 700617175H1 | g1171351 | 29 | 11 | gb105pln | *Oryza sativa* 16 kDa oleosin (ole16) mRNA, complete cds. |
| 700615714H1 | g167197 | 25 | −8 | gb105eukp | stearoyl-acyl-carrier protein desaturase; EC 1.14.99.6 |
| 700617692H1 | g1143524 | 25 | −2 | gb105pln | *O. sativa* mRNA for g protein b subunit. |
| 700614902H1 | g468425 | 17 | 1 | gb105pln | Yeast ribosomal protein S3 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700461175H1 | g2274990 | 59 | −45 | gb105pln | (RPS3) gene, complete cds.<br>*Hordeum vulgare* mRNA for<br>expressed sequence tag. |
| 700617786H1 | g2345153 | 28 | −28 | gb105pln | *Zea mays* ribosomal protein S4<br>(rps4) mRNA, complete cds. |
| 700612763H1 | g182424 | 8 | −3 | gb105allp | alpha-fibrinogen precursor |
| 700612802H1 | g829147 | 59 | −5 | gb105pln | *Z. mays* gene for cyclophilin. |
| 700615030H1 | g2738749 | 28 | −54 | gb105pln | *Zea mays* ATP sulfurylase mRNA,<br>complete cds. |
| 700461285H1 | g2393774 | 60 | −55 | gb105pln | *Zea mays* endosperm-specific<br>prolamin box binding factor (PBF) mRNA, complete cds. |
| 700612851H1 | g829147 | 76 | −8 | gb105pln | *Z. mays* gene for cyclophilin. |
| 700461183H1 | g22516 | 89 | −76 | gb105pln | Maize Zc2 gene for zein Zc2<br>(28 kD glutelin-2). |
| 700614862H1 | g1532118 | 5 | 7 | gb105allp | beta-prime-adaptin |
| 700613245H1 | g1053052 | 15 | −19 | gb105pln | *Hordeum vulgare* histone H3<br>gene, partial cds, clone B1. |
| 700613026H1 | g2465558 | 14 | 1 | gb105allp | YedB |
| 700461203H1 | g287297 | 58 | −52 | gb105pln | *Oryza sativa* mRNA for<br>aspartate aminotransferase, complete cds. |
| 700617605H1 | g416251 | 42 | −47 | gb105pln | Rice mRNA for acetohydroxy<br>acid reductoisomerase, partial sequence. |
| 700615173H1 | g1061304 | 61 | −8 | gb105pln | *Z. mays* ZSF4C5 gene for zein. |
| 700613335H1 | g2245000 | 9 | −7 | gb105eukp | hypothetical protein |
| 700613462H1 | g2565000 | 10 | 1 | gb105eukp | T3F12.1; putative<br>phosphoglyceride transfer protein |
| 700461136H1 | g1049252 | 95 | −83 | gb105pln | *Zea mays* vacuolar ATPase 69<br>kDa subunit mRNA, partial cds. |
| 700617253H1 | g416150 | 53 | −65 | gb105pln | *Zea mays* beta-8 tubulin (tub8)<br>mRNA, complete cds. |
| 700613222H1 | g2464933 | 12 | 7 | gb105eukp | hypothetical protein |
| 700617427H1 | g429013 | 17 | 12 | gb105pln | Rice mRNA for<br>pyrophosphate-fructose 6-phosphate 1-phosphotransferase (gene name SS420),<br>partial cds. |
| 700615016H1 | g173155 | 9 | 1 | gb105eukp | URP1; ribosomal protein |
| 700612683H1 | g531483 | 75 | −61 | gb105pln | *P. ciliare* (Higgins) apospory<br>associated mRNA, 876 bp. |
| 700613651H1 | g2702284 | 24 | −14 | gb105eukp | T21L14.12; Argonaute<br>(AGO1)-like protein |
| 700616988H1 | g2827544 | 29 | −9 | gb105eukp | T12H17.60; HSP associated<br>protein like |
| 700614079H1 | g2564051 | 16 | −3 | gb105pln | *Arabidopsis thaliana* genomic<br>DNA, chromosome 5, P1 clone: MWD9, complete sequence. |
| 700614120H1 | g22544 | 47 | 7 | gb105pln | Maize mRNA (clone A30) for<br>zein (a plant storage protein). |
| 700616939H1 | g168679 | 59 | −91 | gb105pln | Maize 19 kDa zein mRNA, clone<br>cZ19C2, complete cds. |
| 700612691H1 | g290956 | 18 | −3 | gb105eukp | H+-ATPase V-type subunit |
| 700618607H1 | g1532051 | 19 | −25 | gb105pln | *P. argentatum* mRNA for farnesyl<br>diphosphate synthase (FPS2). |
| 700614470H1 | g1498052 | 37 | −25 | gb105pln | *Zea mays* ribosomal protein S8<br>mRNA, complete cds. |
| 700461284H1 | g310932 | 30 | −13 | gb105pln | *Nicotiana tabacum* ribosomal<br>protein L17 mRNA, complete cds. |
| 700616609H1 | g2829918 | 11 | 2 | gb105eukp | F22K20.1 |
| 700612613H1 | g2343185 | 66 | −14 | gb105allp | tubulin folding cofactor B |
| 700612761H1 | g606969 | 17 | −12 | gb105pln | *Arabidopsis thaliana*<br>cytoplasmic ribosomal protein L18 mRNA, complete cds. |
| 700461236H1 | g1051257 | 59 | −46 | gb105pln | *Hordeum vulgare* vacuolar<br>ATPase catalytic subunit mRNA, partial cds. |
| 700612766H1 | g514945 | 49 | −94 | gb105pln | *Zea mays* sucrose synthase<br>(Sus1) mRNA, complete cds. |
| 700612559H1 | g22118 | 46 | −65 | gb105pln | *Z. mays* DNA for Adh1-Cm allele. |
| 700613857H1 | g1669623 | 18 | −5 | gb105eukp | ribosomal protein L39 |
| 700617396H1 | g624936 | 30 | −36 | gb105eukp | sksl+; essential for<br>vegetative growth; 308 AA protein |
| 700614782H1 | g397395 | 86 | −27 | gb105pln | *Z. mays* MNB1b mRNA for<br>DNA-binding protein. |
| 700613970H1 | g4038 | 12 | −3 | gb105pln | Yeast (*Saccharomyces cerevisiae*) DNA<br>for 38 kd nukleolar protein NOP1. |
| 700613452H1 | g436782 | 21 | −29 | gb105pln | Rice mRNA for cyc07, complete<br>cds. |
| 700617146H1 | g22528 | 85 | −24 | gb105pln | *Zea mays* mRNA encoding a zein<br>(clone A20). |
| 700613444H1 | g558095 | 14 | 0 | gb105eukp | ribonucleotide reductase small<br>subunit |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700461134H1 | g1129084 | 28 | −24 | gb105pln | Wheat mRNA for protein H2A, complete cds, clone wcH2A-3. |
| 700617283H1 | g473604 | 36 | −39 | gb105pln | *Zea mays* W-22 histone H2B mRNA, complete cds. |
| 700617039H1 | g2773051 | 26 | −23 | gb105pln | *Spinacia oleracea* heat shock 70 protein (HSC70-11) gene, nuclear gene encoding mitochondrial protein, complete cds. |
| 700616785H1 | g2194141 | 86 | −0 | gb105eukp | F20P5.30 |
| 700615694H1 | g294639 | 15 | −5 | gb105allp | sulfite oxidase |
| 700615480H1 | g2246378 | 21 | 2 | gb105eukp | plastid development; plastid protein |
| 700615254H1 | g2245040 | 25 | 6 | gb105eukp | hypothetical protein |
| 700615018H1 | g2270994 | 33 | −6 | gb105eukp | GmPM13; Ca+2-binding EF hand protein |
| 700617947H1 | g396209 | 20 | −1 | gb105pln | *S. polyrrhiza* mRNA for D-myo-inositol-3-phosphate synthase. |
| 700617051H1 | g1620985 | 25 | −10 | gb105pln | *N. plumbaginifolia* mRNA for 40S ribosomal protein S17. |
| 700613936H1 | g2645165 | 54 | 2 | gb105pln | *Oryza sativa* mRNA, similar to ribosomal protein 41. |
| 700618126H1 | g168557 | 63 | −46 | gb105pln | *Zea mays* putative GTP-binding protein homolog mRNA, partial cds. |
| 700616348H1 | g2511759 | 12 | 5 | gb105allp | multidrug resistance protein |
| 700618219H1 | g1617014 | 21 | −9 | gb105pln | *A. thaliana* mRNA ribonucleotide reductase RNR1 like protein. |
| 700617539H1 | g2586126 | 13 | −15 | gb105pln | *Hordeum vulgare* b-keto acyl reductase (glossy8) mRNA, complete cds. |
| 700613259H1 | g171429 | 10 | −5 | gb105eukp | pyruvate dehydrogenase E1-beta subunit; E1beta |
| 700618645H1 | g1044848 | 20 | −0 | gb105eukp | T13H5.2 |
| 700617108H1 | g527680 | 26 | −10 | gb105eukp | ribosomal protein S3 |
| 700618227H1 | g1335965 | 16 | −13 | gb105pln | *Zea mays* acetyl CoA carboxylase mRNA, partial cds. |
| 700617439H1 | g395155 | 20 | −15 | gb105eukp | HIS7; glutamine amidotransferase |
| 700613053H1 | g474006 | 51 | −56 | gb105pln | Rice mRNA, partial homologous to ribosomal protein S11 gene. |
| 700461134H1 | g473602 | 44 | −45 | gb105pln | *Zea mays* W-22 histone H2A mRNA, complete cds. |
| 700613858H1 | g21598 | 27 | −16 | gb105pln | *S. tuberosum* mRNA for UDP-glucose pyrophosphorylase. |
| 700612520H1 | g313028 | 48 | −38 | gb105pln | *L. esculentum* ypt2 mRNA for GTP-binding protein. |
| 700613972H1 | g28935 | 25 | 1 | gb105allp | ATP-citrate (pro-S-)-lyase |
| 700615916H1 | g2464938 | 36 | −1 | gb105eukp | mitogen-activated protein kinase 7 |
| 700614340H1 | g170784 | 52 | −6 | gb105pln | Wheat ubiquitin carrier protein (UBC1) mRNA, complete cds. |
| 700616364H1 | g22324 | 33 | −59 | gb105pln | *Z. mays* mRNA for H2B histone (clone cH2B221). |
| 700614008H1 | g639613 | 12 | 5 | gb105allp | T-cell receptor alpha chain constant region(c6.1A product, T-cell receptor alpha chain-c6.1A fusion protein = c6.1A-TCR C alpha) [human, ataxia telangiectasi patient AT8BI, Peptide Partial Mutant, 363 aa] |
| 700617914H1 | g22215 | 53 | −22 | gb105pln | *Z. mays* ZSF4C1 gene for zein. |
| 700613337H1 | g1930071 | 25 | −36 | gb105pln | *Oryza sativa* thioredoxin h mRNA, complete cds. |
| 700614503H1 | g2827529 | 14 | −14 | gb105eukp | F8F16.160; putative protein |
| 700618054H1 | g473186 | 58 | −81 | gb105pln | *Z. mays* (A619) PKCI mRNA for protein kinase C Inhibitor. |
| 700615634H1 | g2464934 | 10 | 4 | gb105allp | serine C-palmitoyitransferase homolog |
| 700614351H1 | g169702 | 14 | 15 | gb105pln | *Ricinus communis* ATP:pyruvate phosphotransferase (PK-p-alpha) mRNA, complete cds. |
| 700613211H1 | g2642427 | 17 | 5 | gb105pln | *Arabidopsis thaliana* chromosome II BAC T20D16 genomic sequence, complete sequence. |
| 700618645H1 | g949849 | 15 | −2 | gb105eukp | R166.2 |
| 700614527H1 | g2160155 | 14 | −3 | gb105pln | Sequence of BAC F21M12 from *Arabidopsis thaliana* chromosome 1, complete sequence. |
| 700614346H1 | g289371 | 45 | −41 | gb105pln | *Brassica napus* serine/threonine protein kinase (BSK1) mRNA, complete cds. |
| 700612774H1 | g639685 | 40 | −36 | gb105pln | Rice mRNA for phosphoglucose isomerase (Pgi-b), complete cds. |
| 700617340H1 | g1924921 | 36 | −1 | gb105eukp | hydroxyacylglutathione hydrolase; EC 3.1.2.6; glyoxalase II |
| 700612363H1 | g1622720 | 30 | 2 | gb105pln | *Kalanchoe daigremontiana* |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | V-type H+-ATPase 16 kDa subunit mRNA, complete cds. |
| 700615616H1 | g2707215 | 8 | 7 | gb105allp | Su(var)3-9 homolog |
| 700612907H1 | g957250 | 14 | 5 | gb105pln | FEY = forever young gene [Arabidopsis thaliana, Genomic/mRNA, 1450 nt]. |
| 700613444H1 | g840719 | 13 | −2 | gb105eukp | ribonucleotide reductase R2 |
| 700461226H1 | g296094 | 21 | −13 | gb105eukp | M(3)95A; ribosomal protein S3 |
| 700617006H1 | g517221 | 11 | 0 | gb105allp | ribosomal protein S24 |
| 700617741H1 | g21271 | 24 | −20 | gb105pln | *S. oleracea* mRNA for phosphoglycerate kinase (chloroplast isoenzyme). |
| 700617191H1 | g1276923 | 55 | −13 | gb105pln | *Zea perennis* USDA Ames 21881 ITS1, 5.8S ribosomal RNA, ITS2. |
| 700617285H1 | g166969 | 34 | 3 | gb105eukp | Ac12; acyl carrier protein II |
| 700614014H1 | g1872162 | 32 | −37 | gb105pln | *Arabidopsis thaliana* DnaJ homolog (atj) mRNA, complete cds. |
| 700616952H1 | g886739 | 33 | −15 | gb105pln | *Z. mays* histone H4 gene. |
| 700613633H1 | g2832672 | 20 | 3 | gb105eukp | T10I14.50; nifU-like protein |
| 700617976H1 | g2511567 | 13 | 10 | gb105pln | *Arabidopsis thaliana* mRNA for proteasome subunit prct. |
| 700612525H1 | g700371 | 32 | −32 | gb105pln | *Oryza sativa* enolase mRNA, complete cds. |
| 700614488H1 | g576506 | 18 | −0 | gb105pln | *P. sativum* outer membrane protein (IAP75) mRNA, complete cds. |
| 700617451H1 | g1890353 | 23 | −21 | gb105pln | *B. napus* mRNA for ascorbate peroxidase. |
| 700613147H1 | g22272 | 78 | −96 | gb105pln | Maize mRNA for enolase (2-phospho-D-glycerate hydrolase). |
| 700615064H1 | g429010 | 40 | −52 | gb105pln | Rice mRNA for cytochrome c (gene name SS393), partial cds. |
| 700612840H1 | g1256495 | 29 | 6 | gb105eukp | R10H10.1 |
| 700616880H1 | g486175 | 17 | 4 | gb105allp | ORF YKL104c |
| 700612460H1 | g599723 | 62 | −2 | gb105eukp | Aco; aconitase; EC 4.2.1.3 |
| 700614329H1 | g2558943 | 64 | −63 | gb105pln | *Gossypium hirsutum* histone 3 mRNA, complete cds. |
| 700617923H1 | g1669659 | 35 | −22 | gb105pln | *C. annuum* mRNA for CDC48p-like protein. |
| 700617625H1 | g1160445 | 8 | 2 | gb105allp | ribosomal protein S7 |
| 700615472H1 | g2832242 | 21 | 15 | gb105pln | *Zea mays* 22-kDa alpha zein gene cluster, complete sequence. |
| 700614020H1 | g1045304 | 61 | −90 | gb105pln | *Zea mays* acetyl-coenzyme A carboxylase mRNA, complete cds. |
| 700461178H1 | g468055 | 69 | −57 | gb105pln | *Zea mays* B73 QM protein mRNA, complete cds. |
| 700617038H1 | g168673 | 48 | −85 | gb105pln | Maize 19 kDa zein mRNA, clone cZ19B1, complete cds. |
| 700613988H1 | g1177337 | 65 | −10 | gb105eukp | SPAC1D4.04; unknown |
| 700617253H1 | g460988 | 39 | −41 | gb105pln | *O. sativa* (Arborio) Beta Tubulin mRNA, clone OSTB-34. |
| 700616950H1 | g603609 | 8 | 5 | gb105allp | Afg3p |
| 700615216H1 | g1556445 | 21 | −59 | gb105pln | *Hordeum vulgare* alpha tubulin (tubA) mRNA, complete cds. |
| 700613749H1 | g862479 | 40 | −26 | gb105pln | Glycine max valosin-containing protein mRNA, complete cds. |
| 700612649H1 | g1370204 | 22 | 5 | gb105pln | *L. japonicus* mRNA for small GTP-binding protein, RAN1B. |
| 700616777H1 | g498774 | 57 | −29 | gb105pln | *Z. mays* (cv DH5xDH7) hsp70-5 mRNA for heat shock protein 70. |
| 700612461H1 | g21492 | 37 | −5 | gb105pln | *S. tuberosum* mRNA for mitochondrial processing peptidase. |
| 700618084H1 | g463269 | 20 | −14 | gb105eukp | YBL0410 |
| 700613038H1 | g927575 | 11 | −8 | gb105eukp | alpha galactosidase |
| 700613388H1 | g1136119 | 42 | −90 | gb105pln | *O. sativa* mRNA for alpha-tubulin (clone OSTA-111). |
| 700618123H1 | g1184773 | 48 | −98 | gb105pln | *Zea mays* glyceraldehyde-3-phosphate dehydrogenase GAPC3 (gpc3) mRNA, complete cds. |
| 700614928H1 | g2282583 | 65 | −87 | gb105pln | *Zea mays* elongation factor 1-alpha (EF1-A) mRNA, complete cds. |
| 700615109H1 | g435456 | 35 | 13 | gb105pln | Proso millet gene for aspartate aminotransferase, complete cds. |
| 700615884H1 | g2832242 | 50 | −65 | gb105pln | *Zea mays* 22-kDa alpha zein gene cluster, complete sequence. |
| 700615230H1 | g21629 | 47 | −67 | gb105pln | *Sorghum vulgare* mRNA for phosphoenolpyruvate carboxylase (PEPC). |
| 700613626H1 | g340520 | 14 | 3 | gb105pln | *Coptis japonica* triosphosphate isomerase mRNA, complete cds. |
| 700612758H1 | g515376 | 34 | −75 | gb105pln | *L. temulentum* mRNA for histone H4. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700612522H1 | g758354 | 57 | −45 | gb105pln | *Z. mays* mRNA for plasma membrane H+ ATPase. |
| 700618455H2 | g790640 | 17 | −2 | gb105pln | *Hordeum vulgare* gamma-thionin (HTH3) mRNA, complete cds. |
| 700612568H1 | g1107460 | 51 | −37 | gb105pln | Rice mRNA for aspartate kinase-homoserine dehydrogenase, complete cds. |
| 700613413H1 | g1185553 | 21 | −58 | gb105pln | *Zea mays* glyceraldehyde-3-phosphate dehydrogenase (gpc2) gene, complete cds. |
| 700615968H1 | g836939 | 39 | −2 | gb105pln | *Arabidopsis thaliana* calcium-dependent protein kinase (CDPK6) mRNA, complete cds. |
| 700612548H1 | g22524 | 82 | −80 | gb105pln | *Zea mays* mRNA encoding a zein (clone ZG31A). |
| 700615729H1 | g166680 | 22 | 0 | gb105allp | protein kinase |
| 700612746H1 | g168679 | 55 | −74 | gb105pln | Maize 19 kDa zein mRNA, clone cZ19C2, complete cds. |
| 700618168H1 | g170772 | 18 | −33 | gb105pln | *Triticum aestivum* S-adenosyl-L-homocysteine hydrolase (SH6.2) mRNA, complete cds. |
| 700614807H1 | g1173637 | 34 | −57 | gb105pln | *Triticum aestivum* 1-aminocyclopropane-1-carboxylate synthase (ACS1) mRNA, partial cds. |
| 700613847H1 | g218227 | 35 | 13 | gb105pln | Rice mRNA for ras-related GTP binding protein, complete cds. |
| 700617908H1 | g1710151 | 8 | 6 | gb105eukp | proline iminopeptidase |
| 700615411H1 | g2190255 | 14 | −15 | gb105eukp | ucbP4; UcbP4 |
| 700461128H1 | g296203 | 20 | −4 | gb105pln | *P. miliaceum* mRNA for alanine aminotransferase. |
| 700615901H1 | g1408206 | 17 | 7 | gb105allp | methyl sterol oxidase |
| 700614909H1 | g2264369 | 7 | 6 | gb105allp | predicted protein of unknown function |
| 700614252H1 | g829147 | 56 | −52 | gb105pln | *Z. mays* gene for cyclophilin. |
| 700616528H1 | g602605 | 43 | −54 | gb105pln | *Zea mays* tandem genes for alpha1-tubulin and alpha2-tubulin. |
| 700615406H1 | g2511530 | 44 | −35 | gb105pln | *Eleusine indica* alpha tubulin 1 (TUA1) mRNA, complete cds. |
| 700613259H1 | g1276732 | 28 | −27 | gb105eukp | odpB; pyruvate dehydrogenase E1 component, beta subunit |
| 700616865H1 | g849080 | 11 | 1 | gb105pln | *Orpinomyces sp.* cyclophilin B precursor (cypB) mRNA, complete cds. |
| 700612901H1 | g602605 | 45 | −35 | gb105pln | *Zea mays* tandem genes for alpha1-tubulin and alpha2-tubulin. |
| 700613630H1 | g1568634 | 23 | −17 | gb105pln | *Arabidopsis thaliana* AtKAP alpha mRNA, complete cds. |
| 700613453H1 | g473604 | 33 | −23 | gb105pln | *Zea mays* W-22 histone H2B mRNA, complete cds. |
| 700612748H1 | g1431223 | 19 | −10 | gb105eukp | CCT4 |
| 700616955H1 | g2564051 | 14 | 13 | gb105pln | *Arabidopsis thaliana* genomic DNA, chromosome 5, P1 clone: MWD9, complete sequence. |
| 700613970H1 | g296703 | 20 | −5 | gb105pln | Yeast (*Saccharomyces pombe*) FIB gene encoding fibrillarin. |
| 700612650H1 | g1061237 | 12 | 6 | gb105allp | putative protein |
| 700617247H1 | g218160 | 27 | 13 | gb105pln | *Oryza sativa* mRNA for elongation factor 1 beta'. |
| 700614268H1 | g416146 | 66 | −0 | gb105pln | *Zea mays* beta-6 tubulin (tub6) gene and mRNA, complete cds. |
| 700614795H1 | g2160155 | 42 | 17 | gb105pln | Sequence of BAC F21M12 from *Arabidopsis thaliana* chromosome 1, complete sequence. |
| 700614557H1 | g166968 | 21 | −27 | gb105pln | Barley acyl carrier protein II (Acl2) mRNA, complete cds. |
| 700614290H1 | g2335106 | 5 | 8 | gb105eukp | T11A07.18; salt inducible protein isolog |
| 700614201H1 | g576507 | 39 | −6 | gb105eukp | IAP75; component of chloroplast outer membrane protein import machinery; outer membrane protein |
| 700616475H1 | g285637 | 40 | −70 | gb105pln | *Hordeum vulgare* mRNA for vacuolar membrane proton-translocating inorganic pyrophosphat. |
| 700613342H1 | g1899026 | 55 | −7 | gb105pln | *Zea mays* superoxide dismutase 4A (sod4A) gene, complete cds. |
| 700617511H1 | g1154858 | 32 | 9 | gb105pln | *H. vulgare* mRNA for L24 ribosomal protein. |
| 700612462H1 | g168669 | 82 | −68 | gb105pln | Maize 19 kDa zein mRNA, clone cZ19A2, partial cds. |
| 700461236H1 | g1041676 | 78 | −65 | gb105pln | *Z. mays* mRNA for V-type H+-ATPase, clone 70-3. |
| 700614544H1 | g2622714 | 9 | 8 | gb105allp | phosphonopyruvate decarboxylase |
| 700617247H1 | g218340 | 31 | 10 | gb105pln | *Triticum aestivum* mRNA for elongation factor 1 beta'. |
| 700616451H1 | g2335099 | 22 | −16 | gb105eukp | T11A07.10 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700616217H1 | g644492 | 56 | −71 | gb105pln | Corn elongation factor 1alpha gene, complete cds. |
| 700615156H1 | g2065021 | 34 | 8 | gb105allp | alanyl t-RNA synthetase |
| 700614719H1 | g340933 | 27 | −42 | gb105pln | Zea mays 10-kDa zein gene, complete cds. |
| 700612527H1 | g2058284 | 22 | 6 | gb105allp | atranbp1b |
| 700616429H1 | g2852373 | 9 | −8 | gb105eukp | mapk; mitogen-activated protein kinase |
| 700617152H1 | g2662342 | 70 | −17 | gb105pln | Oryza sativa mRNA for EF-1 alpha, complete cds. |
| 700616813H1 | g2645165 | 42 | 9 | gb105pln | Oryza sativa mRNA, similar to ribosomal protein 41. |
| 700613734H1 | g2958 | 20 | −0 | gb105pln | Mucor racemosus RPG19 gene for ribosomal protein. |
| 700613655H1 | g1658314 | 8 | 10 | gb105pln | O. sativa osr40g3 gene. |
| 700616255H1 | g1946354 | 16 | 13 | gb105pln | Arabidopsis thaliana chromosome II BAC T06B20 genomic sequence, complete sequence. |
| 700615848H1 | g35555 | 51 | −0 | gb105allp | PM/Sc1 100 kD nucleolar protein |
| 700615106H1 | g1181672 | 30 | −54 | gb105pln | Sorghum bicolor heat shock protein 70 cognate (hsc70) mRNA, partial cds. |
| 700616666H1 | g1498052 | 33 | 11 | gb105pln | Zea mays ribosomal protein S8 mRNA, complete cds. |
| 700616480H1 | g479146 | 31 | −4 | gb105eukp | putative ATP synthase subunit |
| 700612744H1 | g2408019 | 10 | −5 | gb105eukp | SPAC17G6.06; 40s ribosomal protein |
| 700617890H1 | g2264305 | 10 | 16 | gb105pln | Arabidopsis thaliana genomic DNA, chromosome 5, P1 clone: MBK23, complete sequence. |
| 700617120H1 | g483547 | 27 | 3 | gb105eukp | pyrophosphate-dependent phosphofructokinase alpha subunit |
| 700614532H1 | g2522194 | 72 | −40 | gb105pln | Triticum aestivum ornithine/acetylornithine aminotransferase mRNA, partial cds. |
| 700614963H1 | g533251 | 36 | −87 | gb105pln | Zea mays (clone pSM8) sucrose synthase 2 (Sus1) gene, complete cds. |
| 700614832H1 | g2792508 | 58 | −4 | gb105eukp | ribosomal protein S3a |
| 700616687H1 | g536895 | 21 | 15 | gb105pln | Wheat mRNA for protein H2A, complete cds, clone wcH2A-10. |
| 700615261H1 | g1002369 | 8 | 0 | gb105allp | coatomer protein |
| 700613674H1 | g960289 | 11 | −4 | gb105eukp | anthranilate synthase alpha subunit |
| 700616088H1 | g498902 | 49 | 4 | gb105eukp | RPL27-3; ribosomal protein L27 homolog |
| 700616633H1 | g736720 | 38 | −7 | gb105pln | Sesame mRNA for stearoyl-acyl carrier protein desaturase, partial cds, clone CDES04. |
| 700615171H1 | g624937 | 34 | 15 | gb105pln | A. thaliana RPL16A gene. |
| 700613383H1 | g168481 | 5 | 6 | gb105allp | globulin precursor |
| 700613130H1 | g577818 | 10 | 13 | gb105pln | Z. mays gene for H2B histone (gH2B4). |
| 700617281H1 | g1498394 | 65 | −18 | gb105pln | Zea mays actin (Maz56) gene, partial cds. |
| 700615148H1 | g2282583 | 47 | 1 | gb105pln | Zea mays elongation factor 1-alpha (EF1-A) mRNA, complete cds. |
| 700618540H1 | g482938 | 28 | −14 | gb105eukp | glycolytic enzyme; Pyruvate kinase; plastid isozyme |
| 700617404H1 | g870867 | 15 | 3 | gb105pln | A. thaliana p5csB gene. |
| 700616925H1 | g2224766 | 10 | 8 | gb105allp | product highly similar to elongation factor EF-G |
| 700615542H1 | g170746 | 70 | −78 | gb105pln | Wheat histone H4 TH091 gene, complete cds. |
| 700616517H1 | g168602 | 49 | −27 | gb105pln | Zea mays regulatory protein GF14-12 mRNA, complete cds. |
| 700461237H1 | g218169 | 21 | −4 | gb105pln | Rice mRNA for acyl carrier protein (KN33 gene), partial sequence. |
| 700616457H1 | g5069 | 23 | −18 | gb105pln | Yeast (Saccharomyces pombe) rpl7 gene for ribosomal protein L7. |
| 700615505H1 | g1262453 | 19 | −15 | gb105eukp | TpCCTeta; CCTeta |
| 700461116H1 | g473604 | 46 | −35 | gb105pln | Zea mays W-22 histone H2B mRNA, complete cds. |
| 700617508H1 | g20328 | 19 | −43 | gb105pln | O. sativa RAc2 gene for actin. |
| 700461144H1 | g436782 | 48 | −36 | gb105pln | Rice mRNA for cyc07, complete cds. |
| 700614812H1 | g29708 | 36 | −11 | gb105allp | cathepsin H |
| 700614087H1 | g1841307 | 15 | 6 | gb105pln | Fission Yeast mRNA for ribosomal protein S16 homolog, partial cds. |
| 700613926H1 | g1841869 | 22 | −5 | gb105pln | Pimpinella brachycarpa elongation factor 1-beta (EF-1-beta) mRNA, complete cds. |
| 700618106H1 | g1162979 | 7 | 11 | gb105pln | Spinacia oleracea |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | nuclear-encoded chloroplast ribulose-5-phosphate 3-epimerase mRNA, complete cds. |
| 700615903H1 | g2760334 | 30 | −16 | gb105eukp | F1N21.5 |
| 700614688H1 | g974301 | 34 | −24 | gb105pln | *Chlamydomonas reinhardtii* ribosomal protein L41 (RPL41) mRNA, complete cds. |
| 700615274H1 | g1542941 | 25 | −9 | gb105eukp | AACT; Acetoacetyl-coenzyme A thiolase; EC 2.3.1.9 |
| 700615259H1 | g22119 | 31 | −87 | gb105pln | Maize Adh1-F mRNA for alcohol dehydrogenase. |
| 700614703H1 | g1161311 | 27 | −7 | gb105pln | *Arabidopsis thaliana* Columbia myo-inositol-1-phosphate synthase mRNA, complete cds. |
| 700613867H1 | g2414681 | 12 | 3 | gb105eukp | processing of protein precursors; cysteine proteinase precursor |
| 700613664H1 | g22324 | 8 | 7 | gb105pln | *Z. mays* mRNA for H2B histone (clone cH2B221). |
| 700612922H1 | g2651294 | 11 | 17 | gb105pln | *Arabidopsis thaliana* chromosome II BAC T2P4 genomic sequence, complete sequence. |
| 700612615H1 | g19280 | 43 | −15 | gb105pln | *L. esculentum* mRNA for enolase. |
| 700461176H1 | g1871173 | 22 | −0 | gb105pln | *Arabidopsis thaliana* chromosome II BAC T06D20 genomic sequence, complete sequence. |
| 700616360H1 | g520545 | 25 | −53 | gb105pln | Sorghum bicolor clone BADH15 betaine aldehyde dehydrogenase mRNA, complete cds. |
| 700614703H1 | g396209 | 31 | −12 | gb105pln | *S. polyrrhiza* mRNA for D-myo-inositol-3-phosphate synthase. |
| 700614172H1 | g1107486 | 19 | 5 | gb105pln | *A. thaliana* mRNA for 60S ribosomal protein L27a. |
| 700461178H1 | g1293783 | 62 | −45 | gb105pln | *Oryza sativa* QM gene, complete cds. |
| 700615089H1 | g1272634 | 20 | −2 | gb105eukp | K07C5.4 |
| 700614247H1 | g2827313 | 26 | 2 | gb105pln | *Oryza sativa* casein kinase mRNA, partial cds. |
| 700618080H1 | g1161511 | 41 | 9 | gb105pln | *A. thaliana* mRNA for shaggy-like kinase etha. |
| 700612728H1 | g168419 | 28 | 10 | gb105pln | Maize (*Z. mays*) aldolase mRNA, complete cds. |
| 700618372H1 | g395078 | 18 | 9 | gb105pln | *B. rapa* ubiquitin and ribosomal protein mRNA, complete CDS's. |
| 700614265H1 | g168673 | 49 | 7 | gb105pln | Maize 19 kDa zein mRNA, clone cZ19B1, complete cds. |
| 700616325H1 | g296094 | 17 | −11 | gb105eukp | M(3)95A; ribosomal protein S3 |
| 700614254H1 | g2408027 | 42 | −30 | gb105eukp | SPAC17G6.14c; atp-dependent rna helicase |
| 700615835H1 | g2213602 | 20 | 0 | gb105eukp | T7N9.22 |
| 700613001H1 | g1945609 | 15 | 5 | gb105allp | 26S proteasome subunit p44.5 |
| 700612567H1 | g2641210 | 8 | 8 | gb105pln | *Fritillaria agrestis* histone-like protein mRNA, complete cds. |
| 700613124H1 | g393400 | 57 | −68 | gb105pln | *Z. mays* mRNA for alpha-tubulin. |
| 700613783H1 | g263480 | 19 | 13 | gb105pln | RP59 = ribosomal protein . . . L46 = ribosomal protein [Yeast (*Kluyveromyces marxianus*), Genomic, 3 genes, 1722 nt, segment 1 of 3]. |
| 700612458H1 | g1899025 | 25 | −5 | gb105eukp | AtHXK2; hexokinase 2; EC 2.7.1.1 |
| 700613229H1 | g22144 | 33 | −56 | gb105pln | Maize anaerobically regulated gene for fructose bisphosphate aldolase (EC 4.1.2.13). |
| 700618229H1 | g1314090 | 25 | −1 | gb105eukp | YPR015C; unknown |
| 700615496H1 | g2258469 | 17 | 4 | gb105allp | replication protein A1 |
| 700613106H1 | g1006641 | 15 | −7 | gb105eukp | F46C5.8 |
| 700616828H1 | g763263 | 9 | 6 | gb105eukp | unknown |
| 700461144H1 | g217902 | 40 | −27 | gb105pln | *C. roseus* (periwinkle) cyc07 gene. |
| 700615914H1 | g2668741 | 21 | 17 | gb105pln | *Zea mays* glycine-rich RNA binding protein (GRP) mRNA, complete cds. |
| 700614394H1 | g703100 | 15 | −7 | gb105allp | thyroid receptor interactor |
| 700617222H1 | g22272 | 60 | −46 | gb105pln | Maize mRNA for enolase (2-phospho-D-glycerate hydrolase) |
| 700615189H1 | g287297 | 24 | 5 | gb105pln | *Oryza sativa* mRNA for aspartate aminotransferase, complete cds. |
| 700614476H1 | g872079 | 9 | 7 | gb105eukp | M28.5 |
| 700612453H1 | g1335862 | 77 | −4 | gb105eukp | clathrin heavy chain |
| 700616239H1 | g313026 | 23 | −10 | gb105pln | *L. esculentum* rpl38 mRNA for ribosomal protein L38. |
| 700461167H1 | g693999 | 5 | 8 | gb105eukp | unknown |
| 700614118H1 | g435172 | 29 | 9 | gb105pln | *A. sativa* (Pewi) ASTCP-K19 mRNA for t complex polypeptide 1. |
| 700618678H1 | g313027 | 41 | 4 | gb105eukp | rp138; ribosomal protein L38 |
| 700615729H1 | g2370253 | 23 | 0 | gb105eukp | putative protein kinase |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700614311H1 | g168500 | 53 | −47 | gb105pln | Maize (*Zea mays*) histone H4 gene (H4C14), complete cds. |
| 700613676H1 | g1872131 | 21 | −12 | gb105eukp | ORF YBR245c |
| 700614556H1 | g2564050 | 21 | 1 | gb105pln | *Arabidopsis thaliana* genomic DNA, chromosome 5, P1 clone: MUA22, complete sequence. |
| 700612471H1 | g2388578 | 12 | 6 | gb105eukp | YUP8H12.20 |
| 700614263H1 | g1155264 | 41 | −23 | gb105pln | *Pennisetum ciliare* possible apospory-associated protein mRNA, complete cds. |
| 700618679H1 | g861009 | 48 | −38 | gb105pln | *Hordeum vulgare* mRNA for bas1 protein. |
| 700617151H1 | g474007 | 31 | −7 | gb105pln | Rice mRNA, partial homologous to ribosomal protein S12 gene. |
| 700615054H1 | g2586332 | 20 | −4 | gb105pln | *Lycopersicon esculentum* importin alpha (LeKAP alpha) mRNA, partial cds. |
| 700614372H1 | g968901 | 61 | −8 | gb105pln | Rice mRNA for ribosomal protein S8, complete cds. |
| 700617284H1 | g170783 | 30 | −50 | gb105pln | *T. aestivum* ubiquitin carrier protein mRNA. |
| 700614566H1 | g927798 | 10 | −2 | gb105eukp | YDR531W; Ydr531wp |
| 700461145H1 | g886100 | 12 | 6 | gb105allp | putative water channel protein; plasmalemma intrinsic protein; similar to Arabidopsis Pip2a gene product, PIR Accession Number S44084 |
| 700613727H1 | g1143389 | 40 | −32 | gb105pln | *A. thaliana* mRNA for 3-hydroxy-3-methylglutaryl-CoA synthase. |
| 700615033H1 | g168579 | 60 | −69 | gb105pln | Maize pyruvate, orthophosphate dikinase mRNA, complete cds. |
| 700613858H1 | g218000 | 27 | −16 | gb105pln | Potato mRNA for UDP-glucose pyrophosphorylase (EC 2.7.7.9). |
| 700618293H1 | g2345150 | 28 | 5 | gb105allp | developmentally regulated GTP binding protein |
| 700461230H1 | g1144535 | 50 | −70 | gb105pln | *Zea mays* opaque-2 heterodimerizing protein 1b (ohp1b) mRNA, complete cds. |
| 700616011H1 | g1513227 | 47 | −55 | gb105pln | *Brassica napus* myo-inositol 1-phosphate synthase mRNA, complete cds. |
| 700615388H1 | g169818 | 58 | −107 | gb105pln | Rice 25S ribosomal RNA gene. |
| 700613920H1 | g2832242 | 92 | −38 | gb105pln | *Zea mays* 22-kDa alpha zein gene cluster, complete sequence. |
| 700615261H1 | g1237029 | 9 | −0 | gb105allp | alpha-cop protein |
| 700615563H1 | g168700 | 33 | −7 | gb105pln | *Z. mays* zein mRNA, complete cds. |
| 700614362H1 | g2529657 | 14 | −3 | gb105pln | *Arabidopsis thaliana* chromosome II BAC T30B22 genomic sequence, complete sequence. |
| 700617140H1 | g167005 | 18 | 10 | gb105pln | *Hordeum vulgare* chloroplast beta-ketoacyl-ACP sythase I isozyme (Kas12) gene, exons 1 through 7 and complete cds. |
| 700618531H1 | g2559010 | 18 | 1 | gb105allp | chaperonin containing t-complex polypeptide 1, eta subunit; CCT-eta |
| 700618510H1 | g17863 | 30 | −6 | gb105eukp | r-protein BnS15a |
| 700617324H1 | g22524 | 43 | 15 | gb105pln | *Zea mays* mRNA encoding a zein (clone ZG31A). |
| 700616777H1 | g2827001 | 40 | −17 | gb105pln | *Triticum aestivum* 70 kDa heat shock protein (TaHSP70d) mRNA, complete cds. |
| 700612922H1 | g3075 | 12 | 14 | gb105pln | *N. crassa* mRNA for a ribosomal protein |
| 700461295H1 | g1098971 | 12 | 6 | gb105eukp | myo-inositol monophosphatase 3 |
| 700614306H1 | g7299 | 37 | −3 | gb105eukp | DdLLRep3 |
| 700612774H1 | g596022 | 87 | −97 | gb105pln | *Zea mays* glucose-6 phosphate isomerase (phil) mRNA, complete cds. |
| 700613828H1 | g2244878 | 11 | −2 | gb105eukp | hypothetical protein; Author-given protein sequence is in conflict with the conceptual translation |
| 700614009H1 | g1213066 | 41 | −43 | gb105pln | *N. tabacum* mRNA for coproporphyrinogen oxidase. |
| 700617372H1 | g2618605 | 30 | 11 | gb105pln | *Arabidopsis thaliana* genomic DNA, chromosome 5, P1 clone: MUK11, complete sequence. |
| 700618213H1 | g22119 | 22 | −19 | gb105pln | Maize Adh1-F mRNA for alcohol dehydrogenase. |
| 700616274H1 | g486248 | 23 | −18 | gb105pln | Yeast (*Saccharomyces cerevisiae*) chromosome XI reading frame ORF YKL145w. |
| 700613884H1 | g10399 | 13 | 5 | gb105eukp | ald orfU protein (AA 1-190) |
| 700613807H1 | g168677 | 63 | −72 | gb105pln | Maize 19 kDa zein mRNA, clone cZ19C1, complete cds. |
| 700617937H1 | g1480011 | 34 | −3 | gb105pln | *Brassica rapa* mRNA for putative ubiquitin extension protein, partial cds. |
| 700615449H1 | g2264306 | 10 | 10 | gb105pln | *Arabidopsis thaliana* genomic DNA, chromosome 5, P1 clone: MBK5, complete sequence. |
| 700461134H1 | g1129085 | 26 | −21 | gb105pln | Wheat mRNA for protein H2A, |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | complete cds, clone wcH2A-9. |
| 700616313H1 | g2145356 | 57 | −34 | gb105eukp | ATHB-14; HD-Zip protein |
| 700616386H1 | g485952 | 32 | −15 | gb105pln | O. sativa mRNA for glutaredoxin. |
| 700615254H1 | g2245041 | 25 | 6 | gb105eukp | hypothetical protein |
| 700614224H1 | g2842482 | 20 | 8 | gb105eukp | F2109.80; protein phosphatase 2C-like protein |
| 700616454H1 | g2529707 | 7 | −1 | gb105allp | Hpast |
| 700616134H1 | g1419369 | 18 | 3 | gb105pln | Z. mays ZmABP3 mRNA for actin depolymerizing factor. |
| 700461190H1 | g577824 | 33 | −31 | gb105pln | Z. mays gene for H2B histone (gH2B3). |
| 700618036H1 | g20250 | 36 | −51 | gb105pln | Oryza sativa H3 histone gene H3R-11. |
| 700612618H1 | g1706955 | 33 | 4 | gb105pln | Gossypium hirsutum cellulose synthase (celA1) mRNA, complete cds. |
| 700616769H1 | g2345102 | 80 | −4 | gb105eukp | SmPOH.Trans; trans-spliced variant protein |
| 700615353H1 | g556685 | 46 | −43 | gb105pln | Z. mays mRNA for ADP-ribosylation factor. |
| 700612549H1 | g1770020 | 62 | −53 | gb105pln | Oryza sativa S-adenosyl-L-methionine synthetase (pOS-SAMS2) mRNA, complete cds. |
| 700615374H1 | g1335205 | 55 | 6 | gb105allp | ORFII |
| 700615411H1 | g295933 | 13 | −5 | gb105eukp | UBC4; ubiquitin conjugating enzyme |
| 700615074H1 | g603221 | 13 | −9 | gb105eukp | 6-phosphogluconate dehydrogenase |
| 700616206H1 | g2618691 | 11 | −9 | gb105eukp | T32G6.8; putative chloroplast envelope Ca2+-ATPase |
| 700617371H1 | g2351065 | 9 | 14 | gb105pln | Arabidopsis thaliana genomic DNA, chromosome 5, P1 clone: MHF15. |
| 700617091H1 | g22531 | 51 | −63 | gb105pln | Zea mays mRNA encoding a zein (clone pZ22.1). |
| 700614147H1 | g22237 | 43 | 7 | gb105pln | Maize mRNA for cytosolic GAPDH (GapC) glyceraldehyde-3-phosphate dehydrogenase. |
| 700613337H1 | g426441 | 25 | −36 | gb105pln | Rice mRNA for thioredoxin h, complete cds. |
| 700616415H1 | g170064 | 6 | 4 | gb105eukp | sbp; glucose binding protein |
| 700613880H1 | g297035 | 37 | 8 | gb105allp | siah-1A protein |
| 700615807H1 | g1749509 | 15 | 6 | gb105pln | Fission Yeast mRNA, partial cds. |
| 700617192H1 | g602605 | 36 | −67 | gb105pln | Zea mays tandem genes for alpha1-tubulin and alpha2-tubulin. |
| 700616541H1 | g2570118 | 31 | 9 | gb105pln | S. latifolia mRNA, clone CCLS 17. |
| 700612812H1 | g2198852 | 29 | 15 | gb105pln | Zea mays cystathionine gamma-synthase (CGS1) gene, complete cds. |
| 700617471H1 | g1788589 | 5 | 6 | gb105allp | o660; This 660 aa ORF is 30 pct identical (9 gaps) to 301 residues of an approx. 320 aa protein FMT_ECOLI SW: P23882 |
| 700616524H1 | g1542941 | 42 | 5 | gb105allp | Acetoacetyl-coenzyme A thiolase |
| 700614975H1 | g473602 | 60 | −81 | gb105pln | Zea mays W-22 histone H2A mRNA, complete cds. |
| 700618091H1 | g836776 | 6 | 5 | gb105allp | YFR021W |
| 700613353H1 | g2191181 | 13 | 1 | gb105pln | Arabidopsis thaliana BAC TM021B04. |
| 700612427H1 | g2065531 | 40 | 2 | gb105eukp | Ce13; endo-1,4-beta-glucanase; EC 3.2.1.4 |
| 700616007H1 | g303852 | 32 | −26 | gb105pln | Rice mRNA for ribosomal protein L3, complete cds. |
| 700613769H1 | g2511530 | 56 | −47 | gb105pln | Eleusine indica alpha tubulin 1 (TUA1) mRNA, complete cds. |
| 700614847H1 | g2792208 | 9 | 6 | gb105eukp | b4; NBS-LRR type resistance protein |
| 700615634H1 | g2464935 | 10 | 4 | gb105eukp | serine C-palmitoyltransferase homolog |
| 700613032H1 | g1314093 | 19 | −9 | gb105eukp | CDC54; Cdc54p |
| 700615075H1 | g556685 | 52 | −34 | gb105pln | Z. mays mRNA for ADP-ribosylation factor. |
| 700617389H1 | g168498 | 57 | −76 | gb105pln | Corn histone H4 (H4C13) gene, complete cds. |
| 700612570H1 | g558651 | 23 | −1 | gb105pln | T. aestivum VDAC3 mRNA for voltage dependent anion channel. |
| 700618226H1 | g2623310 | 47 | 2 | gb105allp | unknown protein |
| 700461180H1 | g2465428 | 8 | 7 | gb105eukp | JRG1.2; 32 kDa protein |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700616186H1 | g1374991 | 8 | −1 | gb105eukp | saponin metabolite; furostanol glycoside 26-O-beta-glucosidase (F26G); EC 3.2.1.21 |
| 700616018H1 | g22576 | 13 | 1 | gb105eukp | pyruvate kinase; EC 2.7.1.40 |
| 700615990H1 | g1272684 | 50 | −21 | gb105pln | *Z. mays* mRNA for acetyl CoA carboxylase (partial). |
| 700616328H1 | g1002916 | 29 | 5 | gb105pln | *Oryza sativa* cap-binding protein p28 mRNA, complete cds. |
| 700614755H1 | g1293783 | 57 | −59 | gb105pln | *Oryza sativa* QM gene, complete cds. |
| 700613327H1 | g157127 | 6 | 0 | gb105eukp | Csp |
| 700618396H1 | g168677 | 35 | −65 | gb105pln | Maize 19 kDa zein mRNA, clone cZ19C1, complete cds. |
| 700612379H1 | g168694 | 100 | −13 | gb105pln | Maize gamma zein mRNA, partial cds. |
| 700612803H1 | g2330786 | 11 | −3 | gb105eukp | SPAC24C9.03; diphosphomevalonate decarboxylase |
| 700617976H1 | g2511568 | 32 | −7 | gb105eukp | prct; multicatalytic endopeptidase; EC 3.4.99.46 |
| 700461178H1 | g575354 | 63 | −51 | gb105pln | *O. sativa* SC34 mRNA for tumor suppressor. |
| 700618362H1 | g1519250 | 35 | 9 | gb105pln | *Oryza sativa* GF14-c protein mRNA, complete cds. |
| 700615446H1 | g22526 | 11 | 9 | gb105pln | *Zea mays* mRNA encoding a zein (clone zA1). |
| 700614226H1 | g786322 | 13 | −19 | gb105eukp | VPS4; Vps4p |
| 700615856H1 | g2781357 | 51 | −3 | gb105eukp | F24O1.13 |
| 700612888H1 | g22528 | 54 | −88 | gb105pln | *Zea mays* mRNA encoding a zein (clone A20). |
| 700618247H1 | g535019 | 18 | −23 | gb105pln | *Z. mays* Zd1 tandem genes for zein Zd1 (19 kDa Zein). |
| 700614265H1 | g168669 | 51 | 6 | gb105pln | Maize 19 kDa zein mRNA, clone cZ19A2, partial cds. |
| 700612315H1 | g2459406 | 11 | 12 | gb105pln | *Arabidopsis thaliana* chromosome II BAC F4P9 genomic sequence, complete sequence. |
| 700615110H1 | g293890 | 27 | 11 | gb105pln | *Zea mays* alcohol dehydrogenase 1 (Adh1) gene, exons 4 through 10. |
| 700615003H1 | g600750 | 34 | −1 | gb105allp | Sm D3 |
| 700614060H1 | g2634023 | 29 | −11 | gb105allp | uridylate kinase |
| 700617209H1 | g1781347 | 33 | −18 | gb105pln | *S. tuberosum* mRNA for protein homologous to plastidic aldolase, partial. |
| 700613642H1 | g1841501 | 29 | −35 | gb105pln | *Z. mays* mRNA for glutathione-dependent formaldehyde dehydrogenase. |
| 700616772H1 | g668986 | 55 | −7 | gb105pln | *S. tuberosum* TYKY2 mRNA for NADH:ubiquinone oxidoreductase. |
| 700615384H1 | g22537 | 56 | −104 | gb105pln | Maize mRNA for zein polypeptide (clone M6). |
| 700461240H1 | g1706955 | 14 | 16 | gb105pln | *Gossypium hirsutum* cellulose synthase (celA1) mRNA, complete cds. |
| 700614338H1 | g1129083 | 50 | 1 | gb105pln | Wheat mRNA for protein H2A, complete cds, clone wcH2A-2. |
| 700613038H1 | g2204226 | 10 | −8 | gb105eukp | cleave terminal galactose residue; alpha-galactosidase; EC 3.2.1.22 |
| 700616552H1 | g1063617 | 9 | 16 | gb105pln | Yeast (*Schizosaccharomyces pombe*) cosmids 359, 1198 and 1683. |
| 700615247H1 | g1839580 | 35 | 12 | gb105pln | putative glycine-rich protein {clone CHEM 11} [*Zea mays* = maize, cv. INRA 258, mercuric chloride-treated, leaves, mRNA Partial, 149 nt]. |
| 700614715H1 | g216707 | 17 | 8 | gb105allp | prolyl endopeptidase |
| 700612559H1 | g22119 | 87 | −74 | gb105pln | Maize Adh1-F mRNA for alcohol dehydrogenase. |
| 700614172H1 | g1150621 | 13 | 14 | gb105pln | Yeast (*Saccharomyces pombe*) rad18 and rpgL29 genes. |
| 700612468H1 | g1749824 | 35 | −3 | gb105pln | *N. plumbaginfolia* mRNA for G protein beta-subunit-like protein. |
| 700614219H1 | g536895 | 23 | −46 | gb105pln | Wheat mRNA for protein H2A, complete cds, clone wcH2A-10. |
| 700618434H2 | g968901 | 42 | −62 | gb105pln | Rice mRNA for ribosomal protein S8, complete cds. |
| 700615166H1 | g459894 | 67 | −7 | gb105pln | *Zea mays* sus1 gene, complete cds. |
| 700613960H1 | g432367 | 30 | −15 | gb105pln | Rice mRNA for elongation factor 1 beta, complete cds. |
| 700612372H1 | g2257755 | 89 | −68 | gb105pln | *Zea mays* nucleolar histone deacetylase HD2-p39 mRNA, complete cds. |
| 700618362H1 | g2689478 | 29 | 14 | gb105pln | *Nicotiana tabacum* 14-3-3 isoform e T14-3e mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700618263H1 | g2443404 | 28 | −1 | gb105pln | *Oryza sativa* gene for orthophosphate dikinase, exon 3–21 and complete cds. |
| 700618255H1 | g2160155 | 11 | 17 | gb105pln | Sequence of BAC F21M12 from *Arabidopsis thaliana* chromosome 1, complete sequence. |
| 700616782H1 | g438451 | 86 | 1 | gb105eukp | Fad2; delta-12 desaturase |
| 700612323H1 | g2282583 | 48 | −1 | gb105pln | *Zea mays* elongation factor 1-alpha (EF1-A) mRNA, complete cds. |
| 700616673H1 | g886739 | 39 | 2 | gb105pln | *Z. mays* histone H4 gene. |
| 700614840H1 | g416037 | 26 | −39 | gb105pln | *O. sativa* rub1 mRNA for polyubiquitin. |
| 700616014H1 | g1154953 | 35 | −10 | gb105pln | *T. aestivum* histone H2A gene. |
| 700612555H1 | g166575 | 48 | −38 | gb105pln | *A. thaliana* plastid 60-kDa chaperonin-60 beta-polypeptide (cpn-60 beta) mRNA, partial cds. |
| 700618652H1 | g1212995 | 37 | −33 | gb105pln | *H. vulgare* mRNA for UDP-glucose pyrophosphorylase. |
| 700614922H1 | g2809247 | 9 | 1 | gb105eukp | F21B7.16 |
| 700614879H1 | g1177557 | 16 | −8 | gb105pln | *Megaceros* sp. mitochondrial coxI gene. |
| 700612539H1 | g1100224 | 34 | −14 | gb105pln | *Pinus sylvestris* chloroplast NAD+-dependent glyceraldehyde-3-phosphate dehydrogenase mRNA, complete cds. |
| 700617274H1 | g303626 | 48 | −5 | gb105eukp | F1-ATPase gammma subunit; EC 3.6.1.3 |
| 700616569H1 | g17928 | 40 | −35 | gb105pln | *B. rapa* cv.R500 mRNA for stearoyl-acyl carrier protein desaturase. |
| 700612329H1 | g396252 | 71 | −10 | gb105eukp | 40S ribosomal protein S14 |
| 700614807H1 | g1658061 | 9 | 4 | gb105pln | *Malus domestica* ACC synthase (MdACS-3) mRNA, complete cds. |
| 700613933H1 | g189310 | 10 | 6 | gb105allp | nucleolysin TIAR |
| 700615207H1 | g403318 | 10 | 0 | gb105eukp | COQ1 (YBR0109); hexaprenyl pyrophosphate synthetase |
| 700613744H1 | g2565036 | 12 | 4 | gb105allp | APC binding protein EB1 |
| 700615895H1 | g687244 | 89 | −30 | gb105pln | *Zea mays* oil body protein 16 kDa oleosin (ole16) gene, complete cds. |
| 700613857H1 | g458972 | 9 | −1 | gb105eukp | F37C12.4 |
| 700613741H1 | g1209700 | 61 | −66 | gb105pln | *Zea mays* ribosomal protein L12 mRNA, complete cds. |
| 700612414H1 | g496705 | 8 | 3 | gb105eukp | YBL0732; E-117 protein |
| 700613242H1 | g508974 | 39 | −36 | gb105pln | *Triticum aestivum* Chinese spring protein disulfide isomerase (PDI) mRNA, complete cds. |
| 700616231H1 | g2827709 | 17 | 6 | gb105eukp | F6H11.110; predicted protein |
| 700613478H1 | g2827001 | 22 | −20 | gb105pln | *Triticum aestivum* 70 kDa heat shock protein (TaHSP70d) mRNA, complete cds. |
| 700616205H1 | g20185 | 36 | −60 | gb105pln | *O. sativa* mRNA for calmodulin. |
| 700615850H1 | g2702284 | 24 | −19 | gb105eukp | T21L14.12; Argonaute (AGO1)-like protein |
| 700615480H1 | g2440029 | 21 | 2 | gb105eukp | dal1; DAL1 protein |
| 700615157H1 | g1151171 | 30 | 16 | gb105pln | *Arabidopsis thaliana* myo-inositol 1-phosphate synthase Inps1 mRNA, partial cds. |
| 700614983H1 | g2645165 | 36 | 10 | gb105pln | *Oryza sativa* mRNA, similar to ribosomal protein 41. |
| 700616578H1 | g2351061 | 12 | 13 | gb105pln | *Arabidopsis thaliana* genomic DNA, chromosome 5, P1 clone: MAF19. |
| 700616964H1 | g1419371 | 29 | −21 | gb105pln | *Z. mays* mRNA for 40S subunit ribosomal protein S21. |
| 700614923H1 | g1279512 | 48 | −59 | gb105pln | *H. vulgare* bep1 mRNA for ADP-glucose pyrophosphorylase. |
| 700618226H1 | g2623294 | 31 | 10 | gb105pln | *Arabidopsis thaliana* chromosome II BAC T20B5 genomic sequence, complete sequence. |
| 700616880H1 | g171596 | 17 | 4 | gb105eukp | D-fructose-6-phosphate amidotransferase (EC 2.6.1.16) |
| 700617045H1 | g22509 | 85 | −61 | gb105pln | *Zea mays* waxy (wx+) locus for UDP-glucose starch glycosyl transferase. |
| 700613974H1 | g1015849 | 11 | 7 | gb105eukp | RPS5 |
| 700616625H1 | g2736287 | 23 | −9 | gb105pln | *Camptotheca acuminata* isopentenyl diphosphate isomerase II (IPI2) mRNA, complete cds. |
| 700614321H1 | g736271 | 55 | −23 | gb105pln | *O. sativa* hsp70 gene for heat shock protein 70. |
| 700618154H1 | g400448 | 10 | −2 | gb105eukp | M(2)60E; ribosomal protein L19 |
| 700617490H1 | g168690 | 20 | −13 | gb105pln | Maize zein mRNA, complete cds, clone ZG124. |
| 700618420H2 | g218130 | 18 | −6 | gb105pln | Rice mRNA for Ribosomal protein S15. |
| 700617511H1 | g1154859 | 44 | 7 | gb105allp | L24 ribosomal protein |
| 700616339H1 | g2656031 | 32 | −23 | gb105pln | *Arabidopsis thaliana* genomic DNA, chromosome 5, P1 clone: MXC20. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700618434H2 | g1498052 | 70 | −103 | gb105pln | *Zea mays* ribosomal protein S8 mRNA, complete cds. |
| 700616444H1 | g498998 | 15 | −6 | gb105eukp | HRE299 |
| 700615446H1 | g168687 | 11 | 9 | gb105pln | Maize 22 kDa zein mRNA, clone cZ22C2, partial cds. |
| 700612807H1 | g336639 | 28 | 7 | gb105allp | prephytoene pyrophosphate dehydrogenase |
| 700616068H1 | g170901 | 6 | 5 | gb105eukp | peroxisomal membrane protein (PMP20B) |
| 700612491H1 | g493695 | 93 | −6 | gb105allp | cytochrome c oxidase subunit Vb |
| 700614992H1 | g2773051 | 41 | −49 | gb105pln | *Spinacia oleracea* heat shock 70 protein (HSC70-11) gene, nuclear gene encoding mitochondrial protein, complete cds. |
| 700613988H1 | g1046266 | 57 | −8 | gb105eukp | cct-2; chaperones actin and tubulin folding in vivo, and perhaps other proteins; CCT-2 |
| 700612560H1 | g416265 | 31 | −17 | gb105pln | Rice mRNA for ribosomal protein A2, partial sequence. |
| 700617201H1 | g1483150 | 31 | −7 | gb105eukp | monodehydroascorbate reductase |
| 700615229H1 | g500734 | 20 | −3 | gb105eukp | F42A10.1 |
| 700614928H1 | g64449i | 64 | −86 | gb105pln | Corn mRNA for elongation factor 1A. |
| 700618072H1 | g2746079 | 28 | −26 | gb105eukp | BTH1 |
| 700616641H1 | g21794 | 28 | 16 | gb105pln | Wheat histone H4 gene. |
| 700614263H1 | g2317873 | 27 | −6 | gb105pln | *Prunus armeniaca* Rab7 GTP binding protein mRNA, complete cds. |
| 700612389H1 | g1673425 | 58 | 4 | gb105pln | Forsythia x intermedia factor 1-alpha gene. |
| 700616861H1 | g19880 | 29 | 7 | gb105eukp | Nthsp82; heat shock protein 82 |
| 700616976H1 | g168654 | 31 | −59 | gb105pln | *Zea mays* ADP glucose pyrophosphorylase (shrunken-2) gene, complete cds. |
| 700612554H1 | g168512 | 66 | −77 | gb105pln | Maize major protein (L3) mRNA from the surface of lipid bodies, 3' end. |
| 700612528H1 | g1332386 | 55 | −22 | gb105allp | *Rattus norvegicus* ATPase subunit 6 |
| 700613895H1 | g2632251 | 77 | −11 | gb105pln | S. bicolor DNA for gene encoding putative protein serine/threonine kinase, clone cSNFL1. |
| 700461142H1 | g22535 | 48 | −78 | gb105pln | *Zea mays* mRNA encoding a zein (clone pZ22.3). |
| 700615409H1 | g1814400 | 34 | −44 | gb105pln | *Mesembryanthemum crystallinum* phosphoglucomutase (PGM) mRNA, complete cds. |
| 700617072H1 | g2511530 | 18 | 8 | gb105pln | *Eleusine undica* alpha tubulin 1 (TUA1) mRNA, complete cds. |
| 700616316H1 | g1054795 | 27 | −27 | gb105pln | *H. vulgare* mRNA for transmembrane protein. |
| 700615033H1 | g168584 | 41 | −64 | gb105pln | Corn pyruvate, orthophosphate dikinase gene, exons 2–19. |
| 700616331H1 | g2244898 | 27 | −12 | gb105eukp | strong similarity to protein phosphatase 2A regulatory chain, 74K |
| 700614047H1 | g2827079 | 23 | −4 | gb105pln | *Medicago sativa* mitochondrial malate dehydrogenase precursor (mmdh) mRNA, nuclear gene encoding mitochondrial protein, complete cds. |
| 700613486H1 | g169760 | 16 | −40 | gb105pln | *O. sativa* ADPglucose pyrophosphorylase gene, complete cds. |
| 700613051H1 | g1132482 | 18 | −5 | gb105pln | Rice mRNA for ADP-ribosylation factor, complete cds. |
| 700612766H1 | g459894 | 39 | −78 | gb105pln | *Zea mays* sus1 gene, complete cds. |
| 700615123H1 | g2341028 | 66 | 0 | gb105eukp | F19P19.5 |
| 700613475H1 | g396209 | 16 | −6 | gb105pln | *S. polyrrhiza* mRNA for D-myo-inositol-3-phosphate synthase. |
| 700612987H1 | g2464869 | 14 | −3 | gb105eukp | hypothetical protein |
| 700612937H1 | g2801432 | 33 | −20 | gb105pln | *Arabidopsis thaliana* salt stress inducible small GTP binding protein Ran1 homolog mRNA, complete cds. |
| 700612389H1 | g2662340 | 55 | 5 | gb105pln | *Oryza sativa* mRNA for EF-1 alpha, complete cds. |
| 700614761H1 | g166766 | 64 | 3 | gb105eukp | heat shock protein HSP70-2 |
| 700613828H1 | g2194126 | 9 | 1 | gb105eukp | F20P5.14 |
| 700612923H1 | g1353644 | 27 | −1 | gb105eukp | L43 |
| 700612784H1 | g167244 | 33 | −31 | gb105pln | *Chlorella kessleri* elongation factor 2 mRNA, complete cds. |
| 700613744H1 | g998357 | 11 | 6 | gb105allp | EB1 |
| 700612750H1 | g1388076 | 16 | −1 | gb105eukp | TRX3; thioredoxin h |
| 700616082H1 | g2251187 | 30 | −4 | gb105allp | uridylate kinase |
| 700614786H1 | g2584785 | 32 | −9 | gb105allp | p64 bovine chloride channel-like protein |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700613373H1 | g168502 | 28 | 15 | gb105pln | Maize (*Zea mays*) histone H4 gene (H4C7), complete cds. |
| 700615411H1 | g1493838 | 19 | −16 | gb105eukp | transfers ubiquitin to mitotic cyclins A and B; is required for mitotic cyclin destruction at the end of mitosis; cyclin-specific ubiquitin carrier protein E2-C |
| 700618524H1 | g1617267 | 13 | 9 | gb105pln | *B. napus* mRNA for acyl CoA synthetase. |
| 700612763H1 | g458554 | 8 | −3 | gb105allp | common fibrinogen alpha chain |
| 700613115H1 | g1246484 | 8 | −1 | gb105eukp | R11A8.5 |
| 700617247H1 | g218341 | 38 | 6 | gb105eukp | elongation factor 1 beta' |
| 700616018H1 | g444023 | 12 | 2 | gb105eukp | glycolytic enzyme; pyruvate kinase |
| 700613408H1 | g168685 | 19 | −55 | gb105pln | Maize 22 kd (Mw = 26.99 kd) zein protein 3, mRNA. |
| 700613368H1 | g1244707 | 25 | 13 | gb105pln | *Arabidopsis thaliana* ANT (AINTEGUMENTA) mRNA, complete cds. |
| 700613178H1 | g168500 | 40 | −39 | gb105pln | Maize (*Zea mays*) histone H4 gene (H4C14), complete cds. |
| 700616769H1 | g624936 | 77 | −3 | gb105eukp | sks1+; essential for vegetative growth; 308 AA protein |
| 70061603iH1 | g168502 | 22 | −2 | gb105pln | Maize (*Zea mays*) histone H4 gene (H4C7), complete cds. |
| 700614560H1 | g603225 | 22 | 6 | gb105allp | p67 |
| 700612807H1 | g403318 | 36 | 7 | gb105allp | hexaprenyl pyrophosphate synthetase |
| 700618258H1 | g1403043 | 15 | 1 | gb105pln | *H. chilense* × *T. turgidum* conv. durum (Tritordeum) mRNA for S-adenosylmethionine decarboxylase. |
| 700613383H1 | g22287 | 5 | 5 | gb105allp | vicilin-like embryo storage protein |
| 700616989H1 | g5350i9 | 61 | −20 | gb105pln | *Z. mays* Zd1 tandem genes for zein Zd1 (19 kDa Zein). |
| 700613129H1 | g505146 | 10 | −10 | gb105eukp | protein-serine/threonine kinase |
| 700618146H1 | g975887 | 33 | −50 | gb105pln | *Mesembryanthemum crystallinum* myo-inositol-1-phosphate synthase mRNA, complete cds. |
| 700617253H1 | g398848 | 52 | −64 | gb105pln | *Z. mays* mRNA for beta 5 tubulin. |
| 700616419H1 | g170919 | 28 | −34 | gb105pln | Yeast (*Candida maltose*) ribosomal protein L41 (LEL41) gene, complete cds. |
| 7aG612515H1 | g577824 | 95 | −80 | gb105pln | *Z. mays* gene for H2B histone (gH2B3). |
| 700612504H1 | g609541 | 33 | −24 | gb105allp | glucocorticoid-regulated endocrine protein |
| 7GO618556H1 | g1015315 | 16 | 10 | gb105pln | *P. sativum* (clone PsRCI35-2) ribosomal protein L41 mRNA, complete cds. |
| 700616761H1 | g16931 | 33 | −1 | gb105allp | 60S ribosomal protein L32 |
| 700615910H1 | g927239 | 8 | 2 | gb105allp | globulin1 |
| 7Oa615669H1 | g2226328 | 18 | −5 | gb105pln | *Zea mays* physical impedance induced protein (IIG1) mRNA, complete cds. |
| 700615893H1 | g1184773 | 40 | −8 | gb105pln | *Zea mays* glyceraldehyde-3-phosphate dehydrogenase GAPC3 (gpc3) mRNA, complete cds. |
| 700612968H1 | g170746 | 24 | −22 | gb105pln | Wheat histone H4 TH091 gene, complete cds. |
| 700617936H1 | g840731 | 67 | −4 | gb105eukp | Gpdh; glycerol-3-phosphate dehydrogenase (NAD+); EC 1.1.1.8 |
| 700618051H1 | g1177314 | 19 | −3 | gb105eukp | glyoxalase-I; EC 4.4.1.5 |
| 700617703H1 | g21800 | 57 | 7 | gb105pln | *T. aestivum* L mRNA for histone H2B. |
| 700617126H1 | g169792 | 26 | −36 | gb105pln | Rice histone 3 gene, complete cds. |
| 700618591H1 | g409074 | 7 | 8 | gb105allp | HBp15/L22 |
| 700616716H1 | g22469 | 50 | −38 | gb105pln | Maize mRNA for cytoplasmic ribosomal protein S11. |
| 700612569H1 | g169539 | 40 | −26 | gb105pln | Potato pyrophosphate-fructose 6-phosphate 1-phosphotransferase (PFP) beta-subunit mRNA, complete cds. |
| 700612561H1 | g551289 | 100 | −82 | gb105pln | *Z. mays* (W22) phosphoglycerate mutase gene exons 2–8. |
| 700612561H1 | g168587 | 100 | −82 | gb105pln | *Zea mays* cofactor-1ndependent phosphoglycerate mutase mRNA, complete cds. |
| 700618021H1 | g21800 | 14 | 13 | gb105pln | *T. aestivum* L mRNA for histone H2B. |
| 700616751H1 | g471342 | 28 | −3 | gb105pln | *S. tuberosum* mRNA for ATP-sulfurylase. |
| 700612584H1 | g1163126 | 17 | −4 | gb105eukp | F36H1.1 |
| 700614264H1 | g168673 | 22 | 17 | gb105pln | Maize 19 kDa zein mRNA, clone cZ19B1, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700613054H1 | g410509 | 24 | −26 | gb105pln | Yeast (*Saccharomyces cerevisiae*) CIM5 gene for putative ATPase. |
| 700616584H1 | g397395 | 100 | −12 | gb105pln | *Z. mays* MNB1b mRNA for DNA-binding protein. |
| 700613075H1 | g1335965 | 48 | −41 | gb105pln | *Zea mays* acetyl CoA carboxylase mRNA, partial cds. |
| 700615833H1 | g1772495 | 6 | 6 | gb105eukp | HMG-CoA synthase; hydroxymethylglutaryl-CoA synthase; EC 4.1.3.5 |
| 700618695H1 | g456671 | 33 | −23 | gb105pln | *T. aestivum* VDAC 1 mRNA. |
| 700616611H1 | g485376 | 36 | −25 | gb105pln | *Zea mays* alpha-3-tubulin gene, complete cds. |
| 700615815H1 | g1360212 | 20 | −6 | gb105eukp | ORF YLL029w |
| 700614823H1 | g289767 | 31 | −5 | gb105eukp | ZK652.1 protein |
| 700614319H1 | g398222 | 54 | 7 | gb105allp | Protein kinase inhibitor |
| 700614144H1 | g1045304 | 54 | 4 | gb105pln | *Zea mays* acetyl-coenzyme A carboxylase mRNA, complete cds. |
| 700613404H1 | g168677 | 60 | −57 | gb105pln | Maize 19 kDa zein mRNA, clone cZ19C1, complete cds. |
| 700612904H1 | g1381127 | 22 | −14 | gb105pln | Yeast (*Saccharomyces cerevisiae*) chromosome V lambda clones 6592, 4678, 4742, and 3612. |
| 700612907H1 | g348719 | 26 | −15 | gb105pln | MtNMedicago truncatula protochlorophyllide reductase homolgue mRNA, complete cds. |
| 700614206H1 | g1419369 | 96 | −42 | gb105pln | *Z. mays* ZmABP3 mRNA for actin depolymerizing factor. |
| 700616895H1 | g2454184 | 27 | 5 | gb105allp | pyruvate dehydrogenase E1 beta subunit |
| 700613487H1 | g2252841 | 6 | 6 | gb105eukp | A_IG005I10.22 |
| 700616714H1 | g22542 | 36 | −27 | gb105pln | Maize gene for Mr 19000 alpha zein and 5'-flanking region. |
| 700616465H1 | g22322 | 64 | −28 | gb105pln | *Z. mays* mRNA for H2B histone (clone cH2B214). |
| 700617159H1 | g1353747 | 11 | 7 | gb105allp | 40s ribosomal protein S9 homolog |
| 700612735H1 | g1321660 | 43 | −49 | gb105pln | Rice mRNA for ascorbate peroxidase, complete cds. |
| 700618666H1 | g2222784 | 14 | 8 | gb105eukp | SPAC16A10.02; hypothetical protein |
| 700615952H1 | g469247 | 45 | −1 | gb105pln | *Helianthus annuus* ribosomal protein S3a mRNA, complete cds. |
| 700613961H1 | g2290782 | 18 | −5 | gb105eukp | GST1; glutathione S-transferase, class-phi |
| 700614993H1 | g2282583 | 29 | −58 | gb105pln | *Zea mays* elongation factor 1-alpha (EF1-A) mRNA, complete cds. |
| 700613413H1 | g293888 | 26 | −64 | gb105pln | Zea mays, glyceraldehyde-3-phosphate dehydrogenase mRNA, 3' end (clone GAPC2). |
| 700617088H1 | g2642157 | 11 | −6 | gb105eukp | T5I7.5; ankyrin-like protein |
| 700616427H1 | g1143387 | 23 | −26 | gb105pln | *A. thaliana* mRNA for Class III ADH. |
| 700614706H1 | g557804 | 6 | 6 | gb105allp | orf, len. 155, CAI: 0.11 |
| 700615671H1 | g1915973 | 16 | −1 | gb105pln | *Lycopersicon esculentum* fructokinase (FK) mRNA, complete cds. |
| 700612491H1 | g473729 | 93 | −6 | gb105allp | cytochrome c oxidase subunit Vb |
| 700612522H1 | g1743413 | 52 | −43 | gb105pln | *T. aestivum* mRNA for transmembrane proton pump, partial. |
| 700615283H1 | g2801447 | 23 | 0 | gb105pln | *Arabidopsis thaliana* ubiquitin-conjugating enzyme 18 (UBC18) mRNA, partial cds. |
| 700617703H1 | g473986 | 51 | 9 | gb105pln | Rice mRNA, partial homologous to histone H2B gene. |
| 700461164H1 | g2632156 | 35 | −5 | gb105pln | *Aspergillus niger* mRNA for ribosomal protein L15. |
| 700461242H1 | g22215 | 89 | −71 | gb105pln | *Z. mays* ZSF4C1 gene for zein. |
| 700617054H1 | g2258468 | 33 | −41 | gb105pln | *Oryza sativa* repiication protein A1 (Os-RPA1) mRNA, complete cds. |
| 700614676H1 | g2315764 | 13 | −6 | gb105eukp | T07D3.7 |
| 700614312H1 | g1890353 | 33 | −21 | gb105pln | *B. napus* mRNA for ascorbate peroxidase. |
| 700616364H1 | g577824 | 27 | −44 | gb105pln | *Z. mays* gene tor H2B histone (gH2B3). |
| 700614380H1 | g17928 | 31 | −31 | gb105pln | *B. rapa* cv.R500 mRNA for stearoyl-acyl carrier protein desaturase. |
| 700615134H1 | g296204 | 34 | 6 | gb105allp | alanine aminotransferase |
| 700618080H1 | g2182028 | 38 | 11 | gb105pln | Oryza sp. mRNA for shaggy-like kinase etha. |
| 700616586H1 | g1177363 | 13 | 5 | gb105allp | unknown |
| 700615487H1 | g22215 | 38 | −54 | gb105pln | *Z. mays* ZSF4C1 gene for zein. |

TABLE 1-continued

LIST OF INCYTE CLONES DERIVED FROM SATMON022023
COPYRIGHT 1998 INCYTE PHARMACEUTICALS, INC.

| | | | | |
|---|---|---|---|---|
| 700613215H1 | g798817 | 26 | −37 | gb105pln | A. thaliana mRNA for ribosomal protein L2. |
| 700613086H1 | g483586 | 34 | 2 | gb105eukp | ribosomal protein L37 |
| 700616692H1 | g886739 | 17 | −42 | gb105pln | Z. mays histone H4 gene. |
| 700614031H1 | g168683 | 41 | −82 | gb105pln | Maize 22kd (Mw = 26.53 kd) zein protein 1, mRNA. |
| 700612351H1 | g1143424 | 23 | 17 | gb105pln | C. herbarum mRNA for ribosomal protein P1. |
| 700614483H1 | g1184986 | 50 | −45 | gb105pln | Nicotiana tabacum GTP-binding protein NTGB1 mRNA, partial cds. |
| 700616340H1 | g1865791 | 12 | 14 | gb105pln | E. graminis f. sp. hordei mRNA for 60S ribosomal protein L29. |
| 700617333H1 | g531392 | 17 | 16 | gb105pln | Yeast (Saccharomyces cerevisiae) V-ATPase Vo complex 14 kDa subunit Vma7p (VMA7) gene, complete cds. |
| 700615531H1 | g2316016 | 25 | 7 | gb105allp | MRP-like ABC transporter |
| 700614809H1 | g435174 | 34 | −44 | gb105pln | A. sativa (Pewi) ASTCP-K36 mRNA for t compiex polypeptide 1. |
| 708615970H1 | g2267596 | 55 | −10 | gb105pln | Oryza sativa 10 kDa chaperonin mRNA, complete cds. |
| 700615622H1 | g1262343 | 13 | −7 | gb105allp | NADH4L |
| 700614062H1 | g414704 | 24 | −32 | gb105pln | O. sativa mRNA for cytochrome b5. |
| 700614960H1 | g22469 | 11 | −19 | gb105pln | Maize mRNA for cytoplasmic ribosomal protein S11. |
| 700618021H1 | g473986 | 17 | 12 | gb105pln | Rice mRNA, partial homologous to histone H2B gene. |
| 700614232H1 | g1785861 | 28 | −8 | gb105pln | Elaeis guineensis var. tenera stearoyl-Acyl-carrier protein desaturase mRNA, partial cds. |
| 700613808H1 | g557800 | 16 | −1 | gb105eukp | spliced ribosomal protein, len: 135, CAI: 0.76, similar to RS24_HUMAN P16632 40S RIBOSOMAL PROTEIN S24 (S19) |
| 700612524H1 | g2463334 | 40 | −30 | gb105pln | Oryza sativa mRNA for ribosomal protein S4. |
| 700615445H1 | g1143387 | 26 | −34 | gb105pln | A. thaliana mRNA for Class III ADH. |
| 700615213H1 | g16348 | 15 | −3 | gb105eukp | PPA; inorganic pyrophosphatase |
| 700618374H1 | g409070 | 15 | 3 | gb105allp | HBp15/L22 |
| 700617539H1 | g2586128 | 42 | −90 | gb105pln | Zea mays b-keto acyl reductase (glossy8) mRNA, complete cds. |
| 700617228H1 | g2736371 | 21 | 6 | gb105eukp | T08B1.3 |
| 700614017H1 | g2624219 | 42 | 5 | gb105pln | M. acuminata mRNA; clone pBAN UD75. |
| 700613686H1 | g506471 | 14 | −6 | gb105eukp | unnamed protein product |
| 700613119H1 | g5445G6 | 13 | 3 | gb105eukp | SIK1; Sik1p |
| 700617324H1 | g168673 | 43 | 15 | gb105pln | Maize 19 kDa zein mRNA, clone cZ19B1, complete cds. |
| 700613712H1 | g2293565 | 36 | −26 | gb105pln | Oryza sativa ADP-ribosylation factor 1 (Os-ARF1) mRNA, complete cds. |
| 700615126H1 | g687244 | 54 | −5 | gb105pln | Zea mays oil body protein 16 kDa oleosin (ole16) gene, complete cds. |
| 700617529H1 | g32 | 6 | 5 | gb105allp | 2-oxoglutarate carrier |
| 700614940H1 | g1755004 | 33 | −38 | gb105pln | Triticum aestivum calmodulin TaCaM3-2 mRNA, complete cds. |
| 700618102H1 | g825783 | 8 | 17 | gb105pln | Nicotiana tabacum ribosomal protein L41 mRNA, complete cds. |
| 700612633H1 | g172574 | 22 | −2 | gb105eukp | SEN1 |
| 700615264H1 | g1272684 | 31 | −78 | gb105pln | Z. mays mRNA for acetyl CoA carboxylase (partial). |
| 700618666H1 | g619161 | 11 | 6 | gb105allp | PC4, p15 |
| 700618294H1 | g602605 | 21 | −6 | gb105pln | Zea mays tandem genes for alpha1-tubulin and alpha2-tubulin. |
| 700617335H1 | g143373 | 30 | 6 | gb105allp | phosphoribosyl aminoimidazole carboxy formyl formyltransferase/inosine monophosphate cyclohydrolase (PUR-H(J)) |
| 700616073H1 | g168505 | 29 | −46 | gb105pln | Zea mays histone H3 gene, complete cds. |
| 700615504H1 | g508544 | 39 | −31 | gb105pln | Zea mays 24-kD alpha-zein gene (floury2), complete cds. |
| 700615287H1 | g1947005 | 18 | −g3 | gb105eukp | T21G5.5 |
| 700618480H2 | g248338 | 40 | −46 | gb105pln | polyubiquitin [maize, Genomic, 3439 nt]. |
| 700615967H1 | g168498 | 22 | 15 | gb105pln | Corn histone H4 (H4C13) gene, complete cds. |
| 700614379H1 | g2274990 | 51 | −48 | gb105pln | Hordeum vulgare mRNA for expressed sequence tag. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700615612H1 | g2253414 | 24 | −29 | gb105pln | *Lavatera thuringiaca* stress-induced cysteine proteinase (LtCyp1) mRNA, partial cds. |
| 700614392H1 | g17645 | 66 | −7 | gb105allp | RIBOSOMAL PROTEIN L35a |
| 700614059H1 | g2275194 | 12 | 12 | gb105pln | *Arabidopsis thaliana* chromosome II BAC T08I13 genomic sequence, complete sequence. |
| 700613726H1 | g13009 | 40 | −16 | gb105allp | ATPase 6 |
| 700612692H1 | g2196671 | 82 | −35 | gb105pln | *Z. mays* mRNA for HMG protein. |
| 700616212H1 | g1931647 | 22 | −10 | gb105eukp | T19D16.13; endomembrane protein EMP70 precusor isolog |
| 700617478H1 | g624935 | 27 | −18 | gb105pln | Yeast sks1+ gene (K-252a-resistance gene) encoding 308AA protein, complete cds. |
| 700616040H1 | g1680686 | 7 | 4 | gb105allp | rust resistance kinase Lr10 |
| 700612763H1 | g182426 | 8 | −3 | gb105allp | A-alpha fibrinogen |
| 700615845H1 | g2341060 | 81 | −41 | gb105pln | *Zea mays* translational initiation factor eIF-4A (tif-4A3) mRNA, complete cds. |
| 700461164H1 | g2244991 | 41 | −9 | gb105pln | *Arabidopsis thaliana* DNA chromosome 4, ESSA I contig fragment No. 6. |
| 700618285H1 | g415314 | 48 | −3 | gb105pln | Rice mRNA for NADP dependent malic enzyme, complete cds. |
| 700613918H1 | g12G6016 | 18 | 14 | gb105pln | Yeast (*Schizosaccharomyces pombe*) ribosomal protein L5 gene, complete cds. |
| 700616946H1 | g1129084 | 21 | −26 | gb105pln | Wheat mRNA for protein H2A, complete cds, clone wcH2A-3. |
| 700615616H1 | g2707217 | 8 | 6 | gb105allp | Su(var) 3-9 homolog |
| 700612852H1 | g303854 | 24 | 11 | gb105pln | Rice mRNA for ribosomal protein L7A, complete cds. |
| 700616887H1 | g2330011 | 22 | 4 | gb105allp | mm-Mago |
| 700612664H1 | g1045304 | 100 | −31 | gb105pln | *Zea mays* acetyl-coenzyme A carboxylase mRNA, complete cds. |
| 700613736H1 | g1256607 | 11 | 15 | gb105pln | Glycine max G protein beta subunit mRNA, complete cds. |
| 700613242H1 | g625147 | 68 | −83 | gb105pln | *Zea mays* protein disulfide isomerase (pdi) mRNA, complete cds. |
| 700616328H1 | g1002917 | 34 | 3 | gb105eukp | p28 |
| 700615951H1 | g17260 | 36 | 3 | gb105allp | 60S ribosomal protein KD4/L2 |
| 700613452H1 | g387908 | 19 | −10 | gb105pln | *Brassica rapa* S-phase-specific (BIS289) mRNA, complete cds. |
| 700614787H1 | g2213626 | 8 | 6 | gb105eukp | F21J9.18 |
| 700614708H1 | g540534 | 35 | −25 | gb105pln | Rice mRNA for q group of receptor for activated C-kinase, complete cds. |
| 700613319H1 | g673433 | 6 | 5 | gb105allp | protein synthesis initiation factor 4A |
| 700613693H1 | g2266661 | 21 | −17 | gb105pln | *Hordeum vulgare* mRNA for 14-3-3 protein (Hv1433c). |
| 700613683H1 | g1184187 | 42 | −70 | gb105pln | enolase [*Echinochloa phyllopogon*, shoots, mRNA Partial, 541 nt]. |
| 700613014H1 | g2444145 | 22 | −11 | gb105pln | *Arundo donax* alcohol dehydrogenase (Adh1) gene, partial cds. |
| 700612927H1 | g2190976 | 7 | 5 | gb105eukp | bmmif; macrophage migration inhibitory factor |
| 700614569H1 | g790969 | 42 | 3 | gb105pln | Rice mRNA for aldolase C-1, complete cds. |
| 700618080H1 | g619895 | 36 | 12 | gb105pln | *P. hybrida* mRNA for petunia shaggy kinase 6. |
| 700613033H1 | g2708305 | 5 | 4 | gb105allp | U4/U6 small nuclear ribonucleoprotein hPrp4 |
| 700618512H1 | g2462749 | 13 | −5 | gb105eukp | F8A5.31; Putative Serine/Threonine protein kinase |
| 700615341H1 | g558364 | 77 | −5 | gb105pln | *Z. mays* mRNA for ADP-glucose pyrophosphorylase. |
| 700615082H1 | g1370141 | 25 | 1 | gb105pln | *L. japonicus* mRNA for small GTP-binding protein, PAB11A. |
| 700613271H1 | g340933 | 46 | −28 | gb105pln | *Zea mays* 10-kDa zein gene, complete cds. |
| 700617187H1 | g498642 | 31 | 7 | gb105pln | *Zea mays* G-box binding factor 1 (GBF1) mRNA, complete cds. |
| 700616113H1 | g1196896 | 26 | −17 | gb105pln | Glycine max acidic ribosomal protein P0 mRNA, complete cds. |
| 700615575H1 | g998429 | 28 | −40 | gb105pln | GRF1 = general regulatory factor [*Zea mays*, XL80, Genomic, 5348 nt]. |
| 700614338H1 | g1129084 | 46 | 2 | gb105pln | Wheat mRNA for protein H2A, complete cds, clone wcH2A-3. |
| 700614009H1 | g414665 | 15 | −9 | gb105pln | G. max gene for coproporphyrinogen oxidase. |
| 700613926H1 | g398607 | 19 | −0 | gb105pln | *A. thaliana* mRNA for elongation factor 1 beta. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700613108H1 | g515758 | 39 | −41 | gb105pln | *Vitis vinifera* (clone pGME1) malate dehydrogenase mRNA, complete cds. |
| 700612589H1 | g960356 | 46 | −24 | gb105pln | Barley mRNA for s-adenosylmethionine synthetase, complete cds. |
| 700615873H1 | g2654121 | 26 | 17 | gb105pln | *Arabidopsis thaliana* ribosomal protein L23a (AtrpL23a) mRNA, complete cds. |
| 700613846H1 | g2113914 | 7 | 3 | gb105allp | RpsA |
| 700615058H1 | g2246641 | 27 | 6 | gb105eukp | mnk; putative copper and heavy metal transporter; P-type ATPase |
| 700614340H1 | g166923 | 40 | 1 | gb105pln | *Arabidopsis thaliana* ubiquitin carrier protein (UBC1) mRNA, complete cds. |
| 700613026H1 | g1652678 | 15 | −2 | gb105allp | amidase |
| 700618510H1 | g440824 | 32 | −6 | gb105eukp | ribosomal protein S15 |
| 700617582H1 | g218160 | 17 | 7 | gb105pln | *Oryza sativa* mRNA for elongation factor 1 beta'. |
| 700613321H1 | g1255684 | 33 | −75 | gb105pln | Rice mRNA for aspartic protease, complete cds. |
| 700616348H1 | g1430907 | 10 | 5 | gb105allp | epithelial basolatelar chloride conductance regulator |
| 700614903H1 | g669002 | 49 | −27 | gb105pln | *Glycine max* calnexin mRNA, complete cds. |
| 700613827H1 | g2804432 | 64 | 3 | gb105eukp | C42C1.5 |
| 700618051H1 | g2113824 | 15 | 4 | gb105pln | *Brassica juncea* mRNA for glyoxalase I. |
| 700612744H1 | g557800 | 9 | 3 | gb105eukp | spliced ribosomal protein, len: 135, CAI: 0.76, similar to RS24_HUMAN P16632 40S RIBOSOMAL PROTEIN S24 (S19) |
| 700618481H2 | g1495213 | 12 | 2 | gb105eukp | L1339/SOF1; L1339/SOF1 protein |
| 700618106H1 | g902739 | 10 | −9 | gb105eukp | pentose-5-phosphate-3-epimerase; EC 5.1.3.1 |
| 700617582H1 | g218340 | 19 | −7 | gb105pln | *Triticum aestivum* mRNA for elongation factor 1 beta'. |
| 700615434H1 | g1272684 | 43 | −15 | gb105pln | *Z. mays* mRNA for acetyl CoA carboxylase (partial). |
| 700614204H1 | g310190 | 51 | −23 | gb105allp | ATP synthase gamma-subunit |
| 700618123H1 | g1184775 | 51 | −105 | gb105pln | *Zea mays* glyceraldehyde-3-phosphate dehydrogenase GAPC4 (gpc4) mRNA, complete cds. |
| 700615409H1 | g1881692 | 66 | −93 | gb105pln | *Zea mays* phosphoglucomutase mRNA, partial cds. |
| 700614245H1 | g600710 | 12 | 0 | gb105eukp | SAR1 |
| 700613488H1 | g2281089 | 9 | 6 | gb105eukp | F18O19.8; Sm protein F isolog |
| 700615349H1 | g2117303 | 14 | −15 | gb105eukp | SPBC3D5.07; unknown |
| 700613134H1 | g1556445 | 26 | −26 | gb105pln | *Hordeum vulgare* alpha tubulin (tubA) mRNA, complete cds. |
| 700617445H1 | g2257755 | 66 | −97 | gb105pln | *Zea mays* nucleolar histone deacetylase HD2-p39 mRNA, complete cds. |
| 700612812H1 | g168508 | 40 | 9 | gb105pln | Maize oleosin KD18 (KD18; L2) gene, complete cds. |
| 700613852H1 | g1209700 | 23 | 6 | gb105pln | *Zea mays* ribosomal protein L12 mRNA, complete cds. |
| 700614120H1 | g168669 | 50 | 6 | gb105pln | Maize 19 kDa zein mRNA, clone cZ19A2, partial cds. |
| 700612735H1 | g2274983 | 39 | −46 | gb105pln | *Hordeum vulgare* mRNA for expressed sequence tag. |
| 700617820H1 | g550543 | 35 | −1 | gb105pln | *A. thaliana* mRNA for ribosomal protein L16. |
| 700617238H1 | g22537 | 84 | −42 | gb105pln | Maize mRNA for zein polypeptide (clone M6). |
| 700612888H1 | g168679 | 52 | −81 | gb105pln | Maize 19 kDa zein mRNA, clone cZ19C2, complete cds. |
| 700614351H1 | g169704 | 14 | 15 | gb105pln | *Ricinus communis* ATP:pyruvate phosphotransferase (PK-p-beta) mRNA, complete cds. |
| 700615274H1 | g1749576 | 9 | 8 | gb105eukp | similar to *Saccharomyces cerevisiae* acetyl-CoA acetyltransferase, SWISS-PROT Accession Number P41338 |
| 700461256H1 | g170746 | 58 | −37 | gb105pln | Wheat histone H4 TH091 gene, complete cds. |
| 700614346H1 | g289373 | 43 | −39 | gb105pln | *Brassica napus* serine/threonine protein kinase (BSK2) mRNA, complete cds. |
| 700615854H1 | g304106 | 23 | −19 | gb105pln | *Arabidopsis thaliana* cytosine-5 methyltransferase mRNA, complete cds. |
| 700615524H1 | g1488520 | 13 | −7 | gb105pln | *A. thaliana* mRNA for RNA helicase, PRH75. |
| 700612995H1 | g186590 | 19 | −4 | gb105allp | inter-alpha-trypsin inhibitor heavy chain |
| 700617205H1 | g458972 | 15 | 6 | gb105eukp | F37C12.4 |
| 700614721H1 | g2264302 | 21 | −13 | gb105pln | *Arabidopsis thaliana* genomic |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700618080H1 | g1617199 | 39 | 10 | gb105pln | DNA, chromosome 5, P1 clone: MAC12, complete sequence. *N. tabacum* mRNA for shaggy-like kinase 6. |
| 700612696H1 | g2827716 | 30 | 0 | gb105eukp | F6H11.180; predicted protein |
| 700615250H1 | g2564051 | 36 | −6 | gb105pln | *Arabidopsis thaliana* genomic DNA, chromosome 5, P1 clone: MWD9, complete sequence |
| 700612995H1 | g553647 | 19 | −4 | gb105allp | inter-alpha-trypsin inhibitor heavy chain old gene name 'ITI' |
| 700617424H1 | g22328 | 29 | −16 | gb105pln | Maize mRNA for a high mobility group protein. |
| 700617168H1 | g16072 | 74 | −43 | gb105pln | *A. mediterranea* zein gene. |
| 700615886H1 | g1184771 | 49 | −71 | gb105pln | *Zea mays* glyceraldehyde-3-phosphate dehydrogenase GAPC2 (gpc2) mRNA, complete cds. |
| 700615885H1 | g168690 | 41 | −32 | gb105pln | Maize zein mRNA, complete cds, clone ZG124. |
| 700616172H1 | g313026 | 33 | −2 | gb105pln | *L. esculentum* rp138 mRNA for ribosomal protein L38. |
| 700613676H1 | g142067i | 21 | −12 | gb105eukp | ORE YOR304w |
| 700615410H1 | g1561773 | 29 | −39 | gb105pln | *Vitis vinifera* malate dehydrogenase (VVME2) mRNA, complete cds. |
| 700461222H1 | g168665 | 82 | −0 | gb105pln | Maize 16-kDa zein-2 mRNA, complete cds. |
| 700612706H1 | g603189 | 34 | −44 | gb105pln | *Zea mays* translation initiation factor eIF-4A mRNA, complete cds. |
| 700613962H1 | g1321660 | 65 | −23 | gb105pln | Rice mRNA for ascorbate peroxidase, complete cds. |
| 700613433H1 | g2245378 | 24 | 5 | gb105eukp | ARF1; auxin response factor 1 |
| 700613161H1 | g2656028 | 15 | −4 | gb105pln | *Arabidopsis thaliana* genomic DNA, chromosome 5, P1 clone: MNF13. |
| 700614366H1 | g1561773 | 56 | −12 | gb105pln | *Vitis vinifera* malate dehydrogenase (VVME2) mRNA, complete cds. |
| 700614785H1 | gi946361 | 15 | −2 | gb105eukp | T06B20.7 |
| 700613032H1 | g608171 | 19 | −9 | gb105eukp | CDC54; Cdc54p |
| 700615668H1 | g166866 | 30 | −32 | gb105pln | *A. thaliana* ribosomal protein S11 mRNA, 3' end. |
| 700618502H1 | g168553 | 21 | −36 | gb105pln | *Zea mays* putative cytoplasmic malate dehydrogenase homolog mRNA, partial cds. |
| 700461237H1 | g166970 | 14 | −11 | gb105pln | *Hordeum vulgare* acyl carrier protein III (Ac13) gene, complete cds. |
| 700618643H1 | g882528 | 6 | 5 | gb105allp | ORF_f136 |
| 700616621H1 | g21628 | 20 | −20 | gb105pln | *Sorghum vulgare* mRNA for phosphoenolpyruvate involved in C4 photosynthesis (EC 4.1.1.31). |
| 700613447H1 | g168690 | 66 | −75 | gb105pln | Maize zein mRNA, complete cds, clone ZG124. |
| 700615951H1 | g798818 | 40 | 4 | gb105allp | 60S ribosomal protein L2 |
| 700615191H1 | g34194 | 29 | 6 | gb105allp | HL23 ribosomal protein |
| 700612462H1 | g22520 | 78 | −67 | gb105pln | *Zea mays* mRNA fragment encoding a zein gene (clone PZ19.1) (homologous to <ZMZE01>). |
| 700612560H1 | g790507 | 89 | −75 | gb105pln | *Z. mays* mRNA for 60S acidic ribosomal protein. |
| 700615109H1 | g287297 | 32 | 15 | gb105pln | *Oryza sativa* mRNA for aspartate aminotransferase, complete cds. |
| 700618371H1 | g1100222 | 26 | −39 | gb105pln | *Pinus sylvestris* chloroplast NAD+-dependent glyceraldehyde-3-phosphate dehydrogenase mRNA, complete cds. |
| 700614887H1 | g1523915 | 19 | −16 | gb105eukp | F25H2.10 |
| 700614955H1 | g303856 | 47 | −71 | gb105pln | Rice mRNA for ubiquitin protein fused to a ribosomal protein, complete cds. |
| 700613016H1 | g2244839 | 12 | −4 | gb105eukp | hypothetical protein |
| 700612923H1 | g1565197 | 21 | 4 | gb105eukp | ribosomal protein L43 homolog |
| 700615481H1 | g459267 | 18 | 16 | gb105pln | *Z. mays* gene for HMG protein. |
| 700616970H1 | g2072724 | 35 | −42 | gb105pln | *O. sativa* mRNA for Fd-GOGAT, partial, clone OsGog1. |
| 700614203H1 | g2288886 | 24 | −36 | gb105pln | *Arabidopsis thaliana* mRNA for mevalonate diphosphate decarboxylase. |
| 700612557H1 | g16086 | 37 | −24 | gb105pln | *A. porrum* dnaJ mRNA for DNA J protein (partial). |
| 700612865H1 | g644491 | 57 | −7 | gb105pln | Corn mRNA for elongation factor 1A. |
| 700614392H1 | g4392 | 12 | 2 | gb105eukp | RPL37A; ribosomal protein L37a |
| 700612754H1 | g168704 | 63 | −1 | gb105pln | *Zea mays* zein protein gene, complete cds. |
| 700616414H1 | g2286152 | 41 | −60 | gb105pln | *Zea mays* cytoplasmic malate dehydrogenase mRNA, complete cds. |
| 700615091H1 | g21800 | 14 | −16 | gb105pln | *T. aestivum* L mRNA for histone H2B. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700613073H1 | g414704 | 28 | −11 | gb105pln | *O. sativa* mRNA for cytochrome b5. |
| 700615229H1 | g1408178 | 17 | −1 | gb105eukp | pfgcn20; elongation factor 3 related protein |
| 700615014H1 | g1762944 | 9 | 11 | gb105pln | *Nicotiana tabacum* ORF mRNA, complete cds. |
| 700613373H1 | g21794 | 26 | 15 | gb105pln | Wheat histone H4 gene. |
| 700615744H1 | g2668743 | 42 | 4 | gb105pln | *Zea mays* ubiquitin conjugating enzyme (UBC) mRNA, complete cds. |
| 700616031H1 | g21794 | 22 | −2 | gb105pln | Wheat histone H4 gene. |
| 700612945H1 | g22119 | 70 | −25 | gb105pln | Maize Adh1-F mRNA for alcohol dehydrogenase. |
| 700618619H1 | g22484 | 41 | −5 | gb105pln | *Z. mays* RNA for superoxide dismutase Sod4A. |
| 700612392H1 | g20255 | 50 | −4 | gb105pln | *O. sativa* gene for heat shock protein 82 HSP82. |
| 700612623H1 | g20321 | 45 | −14 | gb105pln | *Oryza sativa* RAc1 mRNA for actin. |
| 700617791H1 | g2150129 | 37 | −15 | gb105pln | *Arabidopsis thaliana* cytoplasmic ribosomal protein S15a mRNA, complete cds. |
| 700616366H1 | g1619242 | 57 | −0 | gb105allp | iron-responsive element binding protein |
| 700618387H1 | g514945 | 51 | −64 | gb105pln | *Zea mays* sucrose synthase (Sus1) mRNA, complete cds. |
| 700617140H1 | g167064 | 28 | 5 | gb105pln | *Hordeum vulgare* beta-ketoacyl-ACP synthase I (Kas12) mRNA, complete cds. |
| 700615729H1 | g166682 | 22 | 0 | gb105eukp | CTR1; protein kinase |
| 700613624H1 | g2245394 | 22 | −4 | gb105eukp | putative transcription factor; ARF1-binding protein |
| 700614728H1 | g16204 | 33 | −21 | gb105pln | *A. thaliana* mRNA for beta-oxoacyl-(acyl carrier protein) reductase. |
| 700613130H1 | g168406 | 24 | −1 | gb105pln | *Z. mays* alcohol dehydrogenase (ADH-1 C-m allele) gene, complete cds. |
| 700461201H1 | g1931649 | 12 | 1 | gb105eukp | T19D16.15; DNA helicase isolog |
| 700616418H1 | g1321917 | 8 | −0 | gb105eukp | su12; cytoplasmic ribosomal protein S7 |
| 700618084H1 | g1015810 | 21 | −14 | gb105eukp | URA8 |
| 700614928H1 | g644492 | 64 | −85 | gb105pln | Corn elongation factor 1alpha gene, complete cds. |
| 700612743H1 | g2662346 | 70 | −81 | gb105pln | *Oryza sativa* mRNA for EF-1 alpha, complete cds. |
| 700612903H1 | g2264317 | 11 | −5 | gb105pln | *Arabidopsis thaliana* genomic DNA, chromosome 5, P1 clone: MUG13, complete sequence. |
| 700617285H1 | g473981 | 30 | 3 | gb105pln | Rice mRNA, sequence homologous to acyl carrier protein II gene. |
| 700614693H1 | g300418 | 19 | −5 | gb105pln | aspartate aminotransferase isozyme 5 [*Glycine max* = soybeans, cv. Century, mRNA, 1755 nt]. |
| 700613719H1 | g168665 | 98 | −41 | gb105pln | Maize 16-kDa zein-2 mRNA, complete cds. |
| 700616796H1 | g168673 | 43 | −38 | gb105pln | Maize 19 kDa zein mRNA, clone cZ19B1, complete cds. |
| 700615047H1 | g2326874 | 34 | 2 | gb105eukp | plastidic ATP/ADP-transporter |
| 700613967H1 | g2245073 | 17 | 9 | gb105pln | *Arabidopsis thaliana* DNA chromosome 4, ESSA I contig fragment No. 8. |
| 700617848H1 | g1208445 | 38 | −43 | gb105pln | Rice (YK426) mRNA, complete cds. |
| 700615473H1 | g171085 | 7 | −7 | gb105eukp | argininosuccinate synthetase (ARG1; E.C. 6.8.4.5) |
| 700615210H1 | g1185555 | 32 | −16 | gb105pln | *Zea mays* glyceraldehyde-3-phosphate dehydrogenase (gpc4) gene, partial cds |
| 700614996H1 | g2795807 | 11 | 2 | gb105eukp | F17A14.6 |
| 700612353H1 | g474009 | 62 | −21 | gb105pln | Rice mRNA, partial homologous to ribosomal protein S19 gene. |
| 700618293H1 | g2058456 | 28 | 5 | gb105allp | GTP-binding protein |
| 700614022H1 | g2062169 | 25 | −15 | gb105eukp | T02O04.17; ABC transporter (PDR5-like) isolog |
| 700617611H1 | g984524 | 40 | −38 | gb105pln | *Zea mays* high-methionine zein DZS18 (dzs18) gene, complete cds. |
| 700617333H1 | g2262135 | 44 | −7 | gb105pln | *Arabidopsis thaliana* BAC T10P11, complete sequence. |
| 700612428H1 | g2661380 | 31 | 14 | gb105pln | Cytochrome C oxidase subunit I, partial genomic DNA sequence. |
| 700612544H1 | g474001 | 29 | −6 | gb105pln | Rice mRNA, partial homologous to ribosomal protein L38 gene. |
| 700617241H1 | g454881 | 23 | 17 | gb105pln | Rice gene for thioredoxin h, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700617467H1 | g170696 | 9 | 4 | gb105eukp | Gb11; storage protein |
| 700613936H1 | g2739216 | 21 | 5 | gb105pln | *Hordeum vulgare* L41 ribosomal protein. |
| 700616430H1 | g20203 | 19 | −34 | gb105pln | Rice mRNA for fructose-diphosphate aldolase (EC 4.1.2.13). |
| 700618142H1 | g2443755 | 10 | 1 | gb105eukp | CYP5; cyclophilin |
| 700615853H1 | g167244 | 42 | −6 | gb105pln | *Chlorella kessleri* elongation factor 2 mRNA, complete cds. |
| 700614569H1 | g168419 | 46 | −9 | gb105pln | Maize (*Z. mays*) aldolase mRNA, complete cds. |
| 700613933H1 | g608539 | 8 | 8 | gb105allp | ribonucleoprotein |
| 700615054H1 | g2154716 | 22 | −6 | gb105pln | *A. thaliana* mRNA for Kap alpha protein. |
| 700617357H1 | g2832242 | 98 | −18 | gb105pln | *Zea mays* 22-kDa alpha zein gene cluster, complete sequence. |
| 700614774H1 | g1399272 | 24 | −6 | gb105pln | *Arabidopsis thaliana* calmodulin-domain protein kinase CDPK isoform 5 (CPK5) mRNA, complete cds. |
| 700614490H1 | g433608 | 33 | −21 | gb105pln | *R. communis* mRNA for enolase. |
| 700616049H1 | g169537 | 26 | −24 | gb105pln | Potato pyrophosphate-fructose 6-phosphate 1-phosphotransferase (PFP) alpha-subunit mRNA, complete cds. |
| 700614712H1 | g1177320 | 33 | −5 | gb105eukp | efa27; EFA27 for EF hand, abscisic acid, 27 kD |
| 700612731H1 | g388206 | 15 | −13 | gb105pln | *Lycopersicon esculentum* ubiquitin carrier protein (Ubc) mRNA, complete cds. |
| 700615106H1 | g2624199 | 24 | −38 | gb105pln | *M. acuminata* mRNA; clone pBAN UU93. |
| 700461275H1 | g1498052 | 79 | −55 | gb105pln | *Zea mays* ribosomal protein S8 mRNA, complete cds. |
| 700618038H1 | g551068 | 31 | 3 | gb105eukp | ESI3; unknown; salt-stress induced hydrophobic peptide |
| 700613152H1 | g601790 | 17 | −6 | gb105pln | *Arabidopsis thaliana* protein kinase (AFC3) mRNA, partial cds. |
| 700618207H1 | g2809480 | 32 | 8 | gb105pln | *Oryza sativa* calmodulin (CaM2) mRNA, complete cds. |
| 700617474H1 | g1788589 | 8 | 0 | gb105allp | o660; This 660 aa ORF is 30 pct identical (9 gaps) to 301 residues of an approx. 320 aa protein FMT_ECOLI SW: P23882 |
| 700618660H1 | g16086 | 17 | 4 | gb105pln | *A. porrum* dnaJ mRNA for DNA J protein (partial). |
| 700614957H1 | g2635374 | 15 | −3 | gb105allp | DNA polymerase I |
| 700616402H1 | g218366 | 19 | 8 | gb105eukp | CTPACTA; acetoacetyl-CoA thiolase A; EC 2.3.1.9 |
| 700613185H1 | g2351071 | 13 | 3 | gb105pln | *Arabidopsis thaliana* genomic DNA, chromosome 5, P1 clone: MVA3. |
| 700612534H1 | g2570223 | 36 | −25 | gb105pln | Sequence of BAC F20D22 from *Arabidopsis thaliana* chromosome 1, complete sequence. |
| 700617943H1 | g1173621 | 28 | −44 | gb105pln | *Phalaenopsis* sp. 'hybrid SM9108' homeobox protein mRNA, complete cds. |
| 700615055H1 | g435542 | 14 | −29 | gb105pln | *Z. mays* mRNA for calmodulin. |
| 700615509H1 | g576505 | 14 | −20 | gb105eukp | IAP34; component of chloroplast outer membrane protein import apparatus; GTP-binding protein |
| 700616871H1 | g20203 | 36 | −2 | gb105pln | Rice mRNA for fructose-diphosphate aldolase (EC 4.1.2.13) |
| 700616345H1 | g2196671 | 85 | −79 | gb105pln | *Z. mays* mRNA for HMG protein. |
| 700612314H1 | g1181614 | 41 | −1 | gb105pln | Tobacco mRNA for nitrilase, complete cds. |
| 700461144H1 | g387908 | 40 | −26 | gb105pln | *Brassica rapa* S-phase-specific (BIS289) mRNA, complete cds. |
| 700615522H1 | g2160158 | 29 | −15 | gb105eukp | F21M12.3 |
| 700613212H1 | g473986 | 31 | −20 | gb105pln | Rice mRNA, partial homologous to histone H2B gene. |
| 700612322H1 | g218160 | 31 | 13 | gb105pln | *Oryza sativa* mRNA for elongation factor 1 beta'. |
| 700461226H1 | g290275 | 23 | −17 | gb105eukp | M(3)95A; multifunctional activity and location; ribosomal protein S3/AP endonuclease DNA repair protein |
| 700616524H1 | g1749576 | 43 | 3 | gb105allp | similar to *Saccharomyces cerevisiae* acetyl-CoA acetyltransferase, SWISS-PROT Accession Number P41338 |
| 700614339H1 | g166421 | 57 | −8 | gb105pln | *Medicago sativa* ubiquitin carrier protein mRNA, complete cds. |
| 700615875H1 | g1235520 | 13 | 7 | gb105allp | orf gene product |
| 700615239H1 | g2252634 | 9 | 4 | gb105eukp | T19D16.28 |
| 700617108H1 | g1302158 | 24 | −9 | gb105eukp | RPS3 |
| 700613729H1 | g22540 | 18 | −21 | gb105pln | Maize mRNA for 10 kDa zein. |
| 700461169H1 | g1173840 | 13 | 4 | gb105allp | malonyl-CoA: ACP transacylase |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700617381H1 | g577595 | 17 | 1 | gb105eukp | NUO-24 |
| 700615884H1 | g168685 | 46 | −68 | gb105pln | Maize 22 kd (Mw = 26.99 kd) zein protein 3, mRNA. |
| 700612609H1 | g972930 | 26 | −4 | gb105pln | *Arabidopsis thaliana* IAA14 (IAA14) gene, partial cds. |
| 700618493H2 | g1519250 | 42 | −38 | gb105pln | *Oryza sativa* GF14-c protein mRNA, complete cds. |
| 700616566H1 | g1542940 | 21 | −23 | gb105pln | *R. sativus* L. (Saxa knacker) AACT mRNA. |
| 700616088H1 | g498904 | 49 | 4 | gb105eukp | RPL27-4; ribosomal protein L27 homolog |
| 700612443H1 | g22324 | 98 | −30 | gb105pln | *Z. mays* mRNA for H2B histone (clone cH2B221). |
| 700617492H1 | g218112 | 19 | −28 | gb105pln | Rice mRNA for ribosomal protein L41 (340 gene), partial sequence. |
| 700616476H1 | g533692 | 8 | 3 | gb105allp | protease inhibitor |
| 700613967H1 | g2245120 | 35 | −11 | gb105eukp | hypothetical protein |
| 700613690H1 | g857573 | 21 | 2 | gb105pln | *Oryza sativa* vacuolar H+-ATPase (vatp-P1) mRNA, complete cds. |
| 700617517H1 | g214673 | 28 | 5 | gb105allp | L5b ribosomal protein |
| 700612322H1 | g218340 | 39 | 10 | gb105pln | *Triticum aestivum* mRNA for elongation factor 1 beta'. |
| 700615317H1 | g474832 | 35 | −60 | gb105pln | *S. commersonii* mRNA for stearoyl-acyl carrier protein desaturase. |
| 700614238H1 | g168575 | 45 | 1 | gb105pln | Maize phospholipid transfer protein mRNA, complete cds. of clone 9C2. |
| 700615023H1 | g498741 | 36 | −7 | gb105pln | *H. vulgare* (pMaW25) mRNA for beta-ketoacyl-ACP synthase. |
| 700615349H1 | g1008057 | 15 | −19 | gb105eukp | D2085.6 |
| 700613969H1 | g886470 | 37 | 8 | gb105pln | *C. roseus* MetE mRNA for methionine synthase. |
| 700614329H1 | g2565418 | 53 | −52 | gb105pln | *Onobrychis viciifolia* histone H3 mRNA, complete cds. |
| 700617449H1 | g1498315 | 22 | −18 | gb105eukp | IAP100 |
| 700615454H1 | g1928865 | 18 | −28 | gb105pln | *Triticum aestivum* root abundant protein mRNA, complete cds. |
| 700612529H1 | g1256495 | 18 | −15 | gb105eukp | R10H10.1 |
| 700617757H1 | g469147 | 50 | −39 | gb105pln | *H. vulgare* mRNA for alanine aminotransferase. |
| 700614240H1 | g683705 | 17 | −9 | gb105eukp | QR11 |
| 700617954H1 | g397395 | 16 | −56 | gb105pln | *Z. mays* MNB1b mRNA for DNA-binding protein. |
| 700612859H1 | g293896 | 23 | 11 | gb105pln | *Zea mays* alcohol dehydrogenase I (Adh1) gene, exons 4 through 10. |
| 700613710H1 | g21233 | 45 | −40 | gb105pln | *S. oleracea* AHR1 mRNA for acetohydroxy acid reductoisomerase. |
| 700617389H1 | g168500 | 55 | −69 | gb105pln | Maize (*Zea mays*) histone H4 gene (H4C14), complete cds. |
| 700617810H1 | g1129084 | 39 | −32 | gb105pln | Wheat mRNA for protein H2A, complete cds, clone wcH2A-3. |
| 700614908H1 | g166866 | 38 | −37 | gb105pln | *A. thaliana* ribosomal protein S11 mRNA, 3' end. |
| 700617605H1 | g21233 | 33 | −9 | gb105pln | *S. oleracea* AHRI mRNA for acetohydroxy acid reductoisomerase. |
| 700612580H1 | g1438877 | 13 | 3 | gb105allp | zinc finger protein |
| 700618383H1 | g1389566 | 12 | 3 | gb105eukp | ER; receptor protein kinase |
| 700461184H1 | g2341023 | 27 | −16 | gb105pln | Sequence of BAC F19P19 from *Arabidopsis thaliana* chromosome 1, complete sequence. |
| 700613962H1 | g2274983 | 59 | −19 | gb105pln | *Hordeum vulgare* mRNA for expressed sequence tag. |
| 700618411H2 | g2454183 | 30 | −18 | gb105pln | *Arabidopsis thaliana* pyruvate dehydrogenase E1 beta subunit mRNA, nuclear gene encoding plastid protein, complete cds. |
| 700613285H1 | g2282583 | 27 | −67 | gb105pln | *Zea mays* elongation factor 1-alpha (EF1-A) mRNA, complete cds. |
| 700612794H1 | g790969 | 45 | −57 | gb105pln | Rice mRNA for aldolase C-1, complete cds. |
| 700614724H1 | g218241 | 22 | −29 | gb105pln | Rice mRNA for ribosomal protein L3 (T82 gene), partial sequence. |
| 700618384H1 | g2196671 | 24 | −75 | gb105pln | *Z. mays* mRNA for HMG protein. |
| 700614265H1 | g168675 | 51 | 7 | gb105pln | Maize mutant zein (zE19) gene, complete cds. |
| 700618222H1 | g1132482 | 31 | −31 | gb105pln | Rice mRNA for ADP-ribosylation factor, complete cds. |
| 700614936H1 | g1806140 | 11 | 8 | gb105eukp | cdc2MsC |
| 700616007H1 | g166857 | 23 | −10 | gb105pln | *Arabidopsis thaliana* |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | cytoplasmic ribosomal protein mRNA, complete cds. |
| 700618005H1 | g16086 | 33 | −38 | gb105pln | *A. porrum* dnaJ mRNA for DNA J protein (partial). |
| 700618003H1 | g1064935 | 13 | −4 | gb105eukp | gyp7; Gyp7p |
| 700615609H1 | g2190991 | 23 | −11 | gb105pln | *Aegilops squarrosa* glutathione S-transferase TSI-1 mRNA, complete cds. |
| 700616313H1 | g2145358 | 48 | −29 | gb105eukp | ATHB-9; transcription factor; HD-Zip protein |
| 700615575H1 | g2266661 | 23 | −10 | gb105pln | *Hordeum vulgare* mRNA for 14-3-3 protein (Hv1433c). |
| 700616506H1 | g19342 | 52 | −26 | gb105pln | *L. esculentum* mRNA for ribosomal protein L2. |
| 700615389H1 | g396133 | 50 | −63 | gb105pln | *H. vulgare* BLT63 mRNA, complete CDS. |
| 700616147H1 | g168460 | 38 | 10 | gb105pln | *Zea mays* cyclophilin (CyP) mRNA, complete cds. |
| 700614708H1 | g1256607 | 11 | 14 | gb105pln | Glycine max G protein beta subunit mRNA, complete cds. |
| 700612618H1 | g1706957 | 47 | −4 | gb105pln | *Gossypium hirsutum* cellulose synthase (ce1A2) mRNA, partial cds. |
| 700616315H1 | g168673 | 68 | 4 | gb105pln | Maize 19 kDa zein mRNA, clone cZ19B1, complete cds. |
| 700617931H1 | g563986 | 38 | 1 | gb105allp | RNA helicase like protein DB10 |
| 700614840H1 | g303856 | 31 | −46 | gb105pln | Rice mRNA for ubiquitin protein fused to a ribosomal protein, complete cds. |
| 700613664H1 | g577818 | 10 | −3 | gb105pln | *Z. mays* gene for H2B histone (gH2B4). |
| 700461205H1 | g1711035 | 32 | −14 | gb105pln | *P. sativum* hydroxyproline rich glycoprotein PsHRGP1 mRNA, partial cds. |
| 700617104H1 | g603269 | 10 | 7 | gb105eukp | YER036C, Yer036cp |
| 700614047H1 | g473205 | 25 | −38 | gb105pln | *E. gunnii* mRNA for mitochondrial malate dehydrogenase. |
| 700613840H1 | g886739 | 64 | −6 | gb105pln | *Z. mays* histone H4 gene. |
| 700618502H1 | g2286152 | 30 | −47 | gb105pln | *Zea mays* cytoplasmic malate dehydrogenase mRNA, complete cds. |
| 700617648H1 | g847833 | 71 | −36 | gb105pln | *Zea mays* 10 kDa zein gene, complete cds. |
| 700614951H1 | g22528 | 46 | −82 | gb105pln | *Zea mays* mRNA encoding a zein (clone A20). |
| 700612649H1 | g2801432 | 27 | 3 | gb105pln | *Arabidopsis thaliana* salt stress inducible small GTP binding protein Ran1 homolog mRNA, complete cds. |
| 700612904H1 | g297446 | 23 | −9 | gb105pln | Yeast (*Saccharomyces pombe*) cdc22+ gene for ribonucleotide reductase large subunit. |
| 700616885H1 | g439522 | 33 | 3 | gb105allp | ribosomal protein S3 |
| 700614547H1 | g854270 | 32 | −9 | gb105allp | NADH subunit 2 |
| 700618636H1 | g2511588 | 31 | −29 | gb105eukp | prc1; multicatalytic endopeptidase complex, proteasome component, alpha subunit; EC 3.4.99.46 |
| 700612462H1 | g22544 | 81 | −66 | gb105pln | Maize mRNA (clone A30) for zein (a plant storage protein). |
| 700612301H1 | g2388688 | 25 | −3 | gb105pln | Glycine max GH1 protein (GH1) mRNA, partial cds. |
| 700615317H1 | g575941 | 34 | −59 | gb105pln | Sesame mRNA for stearoyl-acyl carrier protein desaturase, complete cds, clone CDES01. |
| 700612549H1 | g960356 | 63 | −54 | gb105pln | Barley mRNA for S-adenosylmethionine synthetase, complete cds. |
| 700617357H1 | g168702 | 76 | −11 | gb105pln | Corn 22 kDa zein protein gene, complete cds. |
| 700617126H1 | g168505 | 28 | −46 | gb105pln | *Zea mays* histone H3 gene, complete cds. |
| 700613846H1 | g46339 | 5 | 3 | gb105allp | ribosomal protein S1 (AA 1-568) |
| 700616331H1 | g313740 | 8 | 3 | gb105eukp | YBL0515; YBL0515 |
| 700616150H1 | g218130 | 15 | −4 | gb105pln | Rice mRNA for Ribosomal protein S15. |
| 700614989H1 | g2073478 | 5 | 6 | gb105allp | DNA polymerase I |
| 700616541H1 | g407800 | 33 | 9 | gb105pln | *G. hirsutum* mRNA for ribosomal protein 41, large subunit (RL41). |
| 700614118H1 | g435174 | 29 | 9 | gb105pln | *A. sativa* (Pewi) ASTCP-K36 mRNA for t complex polypeptide 1. |
| 700615009H1 | g2244950 | 21 | 11 | gb105pln | *Arabidopsis thaliana* DNA chromosome 4, ESSA I contig fragment No. 5. |
| 700461145H1 | g2662310 | 13 | 3 | gb105eukp | BPW1; bpw1 |
| 700617335H1 | g1653951 | 32 | 6 | gb105allp | phosphoribosyl aminoimidazole carboxy formyl formyltransferase |
| 700613086H1 | g577198 | 15 | 8 | gb105eukp | RPL35A; Rpl35ap: 60S ribosomal protein L37 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700618372H1 | g303856 | 18 | 7 | gb105pln | Rice mRNA for ubiquitin protein fused to a ribosomal protein, complete cds. |
| 700617202H1 | g508544 | 15 | −3 | gb105pln | Zea mays 24-kD alpha-zein gene (floury2), complete cds. |
| 700614395H1 | g1321740 | 16 | 7 | gb105eukp | B0035.3 |
| 700615668H1 | g474006 | 45 | −54 | gb105pln | Rice mRNA, partial homologous to ribosomal protein S11 gene. |
| 700612621H1 | g1638836 | 48 | −26 | gb105pln | H. vulgare mRNA for alpha-tubulin 2. |
| 700616946H1 | g1129085 | 21 | −25 | gb105pln | Wheat mRNA for protein H2A, complete cds, clone wcH2A-9. |
| 700616301H1 | g500716 | 6 | 4 | gb105eukp | T20B12.3 |
| 700612639H1 | g168673 | 71 | −75 | gb105pln | Maize 19 kDa zein mRNA, clone cZ19B1, complete cds. |
| 700461290H1 | g473986 | 18 | 7 | gb105pln | Rice mRNA, partial homologous to histone H2B gene. |
| 700612389H1 | g1669667 | 58 | 4 | gb105pln | Forsythia x intermedia mRNA for EF-1-alpha. |
| 700612372H1 | g2392762 | 11 | 17 | gb105pln | Arabidopsis thaliana BAC T32N15 from chromsome V, complete sequence. |
| 700617957H1 | g313135 | 18 | −4 | gb105pln | Z. mays mRNA for porin. |
| 700616212H1 | g2435604 | 6 | 8 | gb105eukp | F08F1.7 |
| 700614782H1 | g22328 | 86 | −27 | gb105pln | Maize mRNA for a high mobility group protein. |
| 700615671H1 | g1052972 | 19 | −7 | gb105pln | Beta vulgaris fructokinase mRNA, complete cds. |
| 700616087H1 | g790623 | 16 | −2 | gb105eukp | UFD2; Ufd2p |
| 700617608H1 | g793879 | 20 | 0 | gb105allp | Uba2 protein |
| 700616813H1 | g2739216 | 23 | 4 | gb105pln | Hordeum vulgare L41 ribosomal protein. |
| 700614120H1 | g22447 | 60 | 2 | gb105pln | Zea mays ZMPMS2 gene for 19 kDa zein protein. |
| 700615484H1 | g1159945 | 15 | −3 | gb105eukp | M18.5 |
| 700615136H1 | g710329 | 26 | 15 | gb105pln | Arabidopsis thaliana 55 kDa B regulatory subunit of phosphatase 2A mRNA, complete cds. |
| 700614274H1 | g436782 | 38 | 15 | gb105pln | Rice mRNA for cyc07, complete cds. |
| 700617442H1 | g2341023 | 27 | −6 | gb105pln | Sequence of BAC F19P19 from Arabidopsis thaliana chromosome 1, complete sequence. |
| 700614869H1 | g1923256 | 17 | −1 | gb105allp | 26S proteasome-associated pad1 homolog |
| 700614076H1 | g2435511 | 19 | −13 | gb105eukp | A_TM017A05.10 |
| 700617020H1 | g22058 | 38 | −26 | gb105pln | V. hirsuta rDNA intergenic spacer region. |
| 700615464H1 | g1917018 | 41 | −71 | gb105pln | Zea mays ribosomal protein S6 RPS6-1 (rps6-1) mRNA, complete cds. |
| 700615880H1 | g2194132 | 37 | 4 | gb105eukp | F20P5.21 |
| 700613884H1 | g1321917 | 15 | 7 | gb105eukp | su12; cytoplasmic ribosomal protein S7 |
| 700613476H1 | g17931 | 7 | 16 | gb105pln | B. secalinas embryo-specific mRNA. |
| 700618524H1 | g1617273 | 27 | −16 | gb105pln | B. napus mRNA for AMP-binding protein (2287 bp). |
| 700615141H1 | g535743 | 60 | −0 | gb105pln | Oryza sativa unknown ORF mRNA, complete cds. |
| 700613366H1 | g927239 | 9 | −1 | gb105eukp | Glb1; globulin1 |
| 700613807H1 | g168679 | 63 | −73 | gb105pln | Maize 19 kDa zein mRNA, clone cZ19C2, complete cds. |
| 700617170H1 | g2521993 | 12 | 4 | gb105allp | chaperonin |
| 700613121H1 | g1256607 | 13 | 1 | gb105pln | Glycine max G protein beta subunit mRNA, complete cds. |
| 700613981H1 | g2245018 | 15 | 7 | gb105eukp | unnamed protein product |
| 700461275H1 | g168543 | 89 | −30 | gb105pln | Zea mays putative ribosomal protein S8 mRNA, partial cds. |
| 700613033H1 | g2653736 | 5 | 4 | gb105allp | U4/U6 snRNP 60 kDa protein |
| 700618051H1 | g2113825 | 18 | −2 | gb105eukp | gly I; role in detoxification; cell proiliferation; stress; Glyoxalase I; EC 4.4.1.5 |
| 700618293H1 | g2345148 | 29 | 4 | gb105eukp | PsDRG1; developmentally regulated GTP binding protein |
| 700612742H1 | g2104948 | 33 | −30 | gb105pln | Selaginella lepidophylla MAP kinase-like protein (sdhn-6r) mRNA, partial cds. |
| 700617143H1 | g2326783 | 24 | 3 | gb105pln | Oryza sativa mRNA for histone 3. |
| 700616087H1 | g1004305 | 16 | −2 | gb105eukp | ORF 1255 |
| 700613404H1 | g22537 | 65 | −61 | gb105pln | Maize mRNA for zein polypeptide (clone M6). |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700612632H1 | g313266 | 28 | 2 | gb105pln | *T. aestivum* gene for phosphoglycerate kinase. |
| 700617126H1 | g1667591 | 26 | −36 | gb105pln | *Oryza sativa* histone 3 mRNA, complete cds. |
| 700615575H1 | g168602 | 24 | −11 | gb105pln | *Zea mays* regulatory protein GF14-12 mRNA, complete cds. |
| 700616206H1 | g493622 | 14 | −8 | gb105eukp | ACA1, chloroplast envelope Ca2+-ATPase precursor |
| 700614135H1 | g1150932 | 15 | −4 | gb105eukp | cycMs4, cyclin |
| 700616273H1 | g1532047 | 23 | 11 | gb105pln | *O. sativa* mRNA for S-adenosylmethionine decarboxylase. |
| 700613319H1 | g673434 | 6 | 5 | gb105allp | protein synthesis initiation factor 4A |
| 700615335H1 | g577824 | 38 | −60 | gb105pln | *Z. mays* gene for H2B histone (gH2B3). |
| 700615154H1 | g1199549 | 8 | −8 | gb105eukp | ORF 2371 |
| 700616328H1 | g170753 | 25 | 7 | gb105eukp | eukaryotic translation initiation factor; initiation factor (iso) 4F p28 subunit; wheat eukaryotic initiation factor (iso)-4F p28 subunit-2 |
| 700612577H1 | g2738247 | 51 | −39 | gb105pln | *Arabidopsis thaliana* cobalamin-independent methionine synthase (ATCIMS) mRNA, complete cds. |
| 700615493H1 | g1841870 | 9 | 6 | gb105allp | elongation factor 1-beta |
| 700613129H1 | g17913 | 7 | −10 | gb105eukp | S-receptor kinase related protein |
| 700618156H1 | g1136574 | 65 | −84 | gb105pln | *Sorghum bicolor* heat shock protein 70 (hsp70) pseudogene. |
| 700612504H1 | g468924 | 37 | −27 | gb105allp | neuroendocrine-specific protein |
| 700613112H1 | g1006641 | 9 | 1 | gb105eukp | F46C5.8 |
| 700616632H1 | g1513228 | 67 | −2 | gb105eukp | myo-inositol 1-phosphate synthase |
| 700613867H1 | g499294 | 12 | 3 | gb105allp | asparaginyl endopeptidase (Legumain) |
| 700618285H1 | g168527 | 59 | −3 | gb105pln | Maize NADP-dependent malic enzyme (Me1) mRNA, complete cds. |
| 700613109H1 | g8380 | 16 | 4 | gb105eukp | PROS-29 protein (AA 1-264) |
| 700613103H1 | g531031 | 41 | −52 | gb105pln | *Pennisetum ciliare* apomixis-associated mRNA. |
| 700617239H1 | g1732555 | 28 | −36 | gb105pln | *Glycine max* desiccation protective protein LEA5 (Lea5) mRNA, complete cds. |
| 700616325H1 | g290275 | 19 | −13 | gb105eukp | M(3)95A; multifunctional activity and location; ribosomal protein S3/AP endonuclease DNA repair protein |
| 700615990H1 | g1335965 | 51 | −23 | gb105pln | *Zea mays* acetyl CoA carboxylase mRNA, partial cds. |
| 700612747H1 | g2465927 | 6 | 5 | gb105eukp | RKF3; receptor-like serine/threonine kinase |
| 700615136H1 | g1408460 | 41 | 6 | gb105eukp | type 2A protein serine/threonine phosphatase 55 kDa B regulatory subunit |
| 700617125H1 | g2315210 | 40 | −15 | gb105pln | *Lycopersicon esculentum* mRNA for proteasome, alpha subunit. |
| 700618571H1 | g495697 | 16 | −2 | gb105eukp | F54E7.2 |
| 700617283H1 | g21800 | 41 | −43 | gb105pln | *T. aestivum* L mRNA for histone H2B. |
| 700616931H1 | g747916 | 72 | −95 | gb105pln | *Z. mays* CaM2 mRNA for calmodulin. |
| 700616459H1 | g172168 | 5 | 7 | gb105eukp | phosphatase |
| 700614204H1 | g599905 | 40 | −20 | gb105allp | mitochondrial F1-ATPase gamma-subunit |
| 700612794H1 | g168419 | 62 | −80 | gb105pln | Maize (*Z. mays*) aldolase mRNA, complete cds. |
| 700618506H1 | g1279563 | 6 | −4 | gb105eukp | nuM1 |
| 700615694H1 | g517356 | 6 | 5 | gb105eukp | NIA; nitrate reductase (NADH); EC 1.6.6.1 |
| 700616307H1 | g436030 | 21 | −3 | gb105eukp | 60S ribosomal protein L34 |
| 700612339H1 | g189049 | 25 | 0 | gb105allp | NADH dehydrogenase (ubiquinone) |
| 700615302H1 | g1019999 | 37 | −29 | gb105pln | *Hordeum vulgare* signal recognition particle 54 kDa subunit (Srp54-1) mRNA, complete cds. |
| 700614943H1 | g1617274 | 9 | −5 | gb105eukp | AMP-binding protein |
| 700616540H1 | g22314 | 80 | −101 | gb105pln | Maize mRNA for GSH gluthathione S-transferase I (GST;EC 2.5.1.18). |
| 700613152H1 | g642131 | 12 | −3 | gb105pln | *Arabidopsis thaliana* AME2 mRNA for protein kinase, complete cds. |
| 700617346H1 | g45050 | 19 | −14 | gb105eukp | associated with cytokinin-induced hauotonia formation in Cuscuta reflexa; cytochrome b5 |
| 700616040H1 | g2194117 | | 3 | gb105eukp | F20P5.3 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700614936H1 | g2809232 | 32 | −2 | gb105eukp | F21B7.1 |
| 700617790H1 | g2414400 | 18 | −1 | gb105eukp | Y57G11C.13 |
| 700616541H1 | g2645165 | 42 | 7 | gb105pln | *Oryza sativa* mRNA, similar to ribosomal protein 41. |
| 700615210H1 | g312180 | 32 | −17 | gb105pln | *Z. mays* GapC4 gene. |
| 700614240H1 | g1431144 | 17 | −9 | gb105eukp | QRI1 |
| 700613895H1 | g2632253 | 60 | −4 | gb105pln | *S. bicolor* mRNA for putative protein serine/threonine kinase, clone cSNFL2. |
| 700616461H1 | g1209258 | 9 | 6 | gb105eukp | protease inhibitor II |
| 700616552H1 | g2316021 | 17 | −2 | gb105pln | *Arabidopsis thaliana* MRP-like ABC transporter mRNA, partial cds. |
| 700613791H1 | g598403 | 20 | −2 | gb105eukp | ubiquitin |
| 700613783H1 | g463856 | 33 | −3 | gb105pln | *Chlamydomonas reinhardtii* 21gr ribosomal protein S14 (CRY1) gene, complete cds. |
| 700617352H1 | g29505 | 19 | 7 | gb105allp | general transcription factor |
| 700618362H1 | g1519248 | 26 | 16 | gb105pln | *Oryza sativa* GF14-b protein mRNA, complete cds. |
| 700614306H1 | g2746717 | 35 | −3 | gb105eukp | ribosomal protein S2 |
| 700612451H1 | g2285878 | 52 | −9 | gb105pln | *Eleocharis vivipara* mRNA for pyruvate orthophosphate dikinase, complete cds. |
| 700616951H1 | g1816592 | 13 | 1 | gb105eukp | TCTP; translationally controlled tumor protein |
| 700616447H1 | g30490 | 9 | 2 | gb105allp | transacylase |
| 700615606H1 | g558478 | 52 | −62 | gb105pln | *Brassica napus* tonoplast ATPase 70 kDa subunit mRNA, complete cds. |
| 700617429H1 | g21796 | 40 | −52 | gb105pln | Wheat histone H3 gene. |
| 700614560H1 | g1008089 | 22 | 6 | gb105allp | 55.11 protein |
| 700612389H1 | g2662342 | 58 | 4 | gb105pln | *Oryza sativa* mRNA for EF-1 alpha, complete cds. |
| 700461228H1 | g469148 | 13 | −2 | gb105eukp | alanine aminotransferase |
| 700461230H1 | g168529 | 96 | −78 | gb105pln | *Zea mays* opaque2 heterodimerizing protein 1 (OHP1) mRNA, complete cds. |
| 700614836H1 | g2564007 | 30 | 3 | gb105allp | proteasome p45/SUG |
| 700617346H1 | g510539 | 17 | −13 | gb105eukp | cytochrome b5 |
| 700613882H1 | g508544 | 93 | −14 | gb105pln | *Zea mays* 24-kD alpha-zein gene (floury2), complete cds. |
| 700615014H1 | g1762945 | 11 | 1 | gb105eukp | ORF; able to induce HR-like lesions |
| 700461137H1 | g453188 | 44 | −25 | gb105pln | *Z. mays* acp mRNA for acyl carrier protein. |
| 700613719H1 | g18053 | 33 | 1 | gb105pln | *C. lacryma-jobi* L. mRNA for gamma-coixin (22KDa). |
| 700612529H1 | g486050 | 12 | −2 | gb105eukp | ORF YKL040c |
| 700612732H1 | g2708484 | 7 | 3 | gb105eukp | IAA24; IAA24 |
| 700613805H1 | g557876 | 14 | 1 | gb105allp | SKD1 |
| 700612689H1 | g21233 | 22 | −40 | gb105pln | *S. oleracea* AHRI mRNA for acetohydroxy acid reductoisomerase. |
| 700615952H1 | g436782 | 53 | −6 | gb105pln | Rice mRNA for cyc07, complete cds. |
| 700614908H1 | g474006 | 55 | −65 | gb105pln | Rice mRNA, partial homologous to ribosomal protein S11 gene. |
| 700613162H1 | g22332 | 27 | 15 | gb105pln | *Z. mays* HRGP gene. |
| 700616520H1 | g407881 | 9 | 1 | gb105allp | stringent response-like protein |
| 700615510H1 | g2196671 | 66 | −96 | gb105pln | *Z. mays* mRNA for HMG protein. |
| 700618508H1 | g2264302 | 17 | −2 | gb105pln | *Arabidopsis thaliana* genomic DNA, chromosome 5, P1 clone: MAC12, complete sequence. |
| 700616920H1 | g170746 | 45 | −32 | gb105pln | Wheat histone H4 TH091 gene, complete cds. |
| 700616685H1 | g22537 | 49 | −0 | gb105pln | Maize mRNA for zein polypeptide (clone M6). |
| 700615531H1 | g2316022 | 22 | 7 | gb105eukp | MRP-like ABC transporter |
| 700616172H1 | g2288979 | 33 | −2 | gb105pln | *Arabidopsis thaliana* chromosome II BAC T01O24 genomic sequence, complete sequence. |
| 700614761H1 | g1181672 | 64 | 1 | gb105pln | *Sorghum bicolor* heat shock protein 70 cognate (hsc70) mRNA, partial cds. |
| 700617713H1 | g587561 | 22 | −0 | gb105pln | *S. tuberosum* mRNA for alpha-II MPP. |
| 700615273H1 | g16931 | 12 | 3 | gb105allp | 60S ribosomal protein L32 |
| 700613460H1 | g644491 | 49 | −45 | gb105pln | Corn mRNA for elongation factor 1A. |
| 700613490H1 | g22149 | 34 | −58 | gb105pln | *Z. mays* mRNA for alpha-tubulin 3. |
| 700461146H1 | g396209 | 49 | −46 | gb105pln | *S. polyrrhiza* mRNA for D-myo-inositol-3-phosphate synthase. |
| 700612781H1 | g1546918 | 42 | 10 | gb105pln | *Z. mays* mRNA for translation initiation factor 5A. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700613618H1 | g1107460 | 28 | −21 | gb105pln | Rice mRNA for aspartate kinase-homoserine dehydrogenase, complete cds. |
| 700615777H1 | g404026 | 15 | 3 | gb105eukp | oleoyl-acyl carrier protein thioesterase; EC 3.1.2.14 |
| 700612560H1 | g899609 | 90 | −77 | gb105pln | *Zea mays* acidic ribosomal protein P2 (RPA-2A1) mRNA, complete cds. |
| 700617606H1 | g458972 | 15 | −9 | gb105eukp | F37C12.4 |
| 700616315H1 | g22544 | 66 | 5 | gb105pln | Maize mRNA (clone A30) for zein (a plant storage protein). |
| 700614342H1 | g2431768 | 59 | −51 | gb105pln | *Zea mays* acidic ribosomal protein P1a (rpp1a) mRNA, complete cds. |
| 700613430H1 | g1256259 | 11 | 6 | gb105allp | voltage-dependent anion channel protein |
| 700613042H1 | g311297 | 12 | 0 | gb105allp | ribosomal protein S24 |
| 700612510H1 | g1045304 | 60 | −63 | gb105pln | *Zea mays* acetyl-coenzyme A carboxylase mRNA, complete cds. |
| 700612865H1 | g644492 | 57 | −6 | gb105pln | Corn elongation factor 1alpha gene, complete cds. |
| 700614319H1 | g1773327 | 41 | 14 | gb105pln | *Mesembryanthemum crystallinum* 14-3-3-like protein (GBF) mRNA, complete cds. |
| 700615649H1 | g1172158 | 27 | −18 | gb105pln | *Ipomoea batatas* starch synthase (SPSS67) mRNA, complete cds. |
| 700614380H1 | g2290401 | 29 | −32 | gb105pln | *Helianthus annuus* stearoyl-ACP desaturase mRNA, complete cds. |
| 700612639H1 | g22544 | 74 | −78 | gb105pln | Maize mRNA (clone A30) for zein (a plant storage protein). |
| 700616492H1 | g527680 | 36 | −13 | gb105eukp | ribosomal protein S3 |
| 700461192H1 | g218177 | 22 | 15 | gb105pln | Rice mRNA for ribosomal protein L35 (NH77 gene), partial sequence. |
| 700616782H1 | g1212781 | 86 | 1 | gb105allp | oleate desaturase |
| 700614034H1 | g603221 | 68 | −3 | gb105eukp | 6-phosphogluconate dehydrogenase |
| 700613259H1 | g2454184 | 35 | −34 | gb105eukp | pyruvate dehydrogenase E1 beta subunit; EC 1.2.4.1 |
| 700612916H1 | g303854 | 47 | −41 | gb105pln | Rice mRNA for ribosomal protein L7A, complete cds. |
| 700617479H1 | g2599103 | 14 | 6 | gb105pln | *Dunaliella saline* 60S ribosomal protein (DSRP1) mRNA, complete cds. |
| 700615893H1 | g1184775 | 20 | 1 | gb105pln | *Zea mays* glyceraldehyde-3-phosphate dehydrogenase GAPC4 (gpc4) mRNA, complete cds. |
| 700613972H1 | g603074 | 25 | 1 | gb105allp | ATP: citrate lyase |
| 700618207H1 | g20185 | 32 | 7 | gb105pln | *O. sativa* mRNA for calmodulin. |
| 700614887H1 | g576817 | 28 | −4 | gb105eukp | Ape; DNA repair protein |
| 700461230H1 | g168427 | 29 | −17 | gb105pln | *Zea mays* opaque2 heterodimerizing protein 2 mRNA, complete cds. |
| 700616782H1 | g2564237 | 86 | 1 | gb105eukp | omega-6 desaturase |
| 700614882H1 | g2252849 | 11 | 5 | gb105eukp | A_TM018A10.1 |
| 700618648H1 | g857573 | 65 | −62 | gb105pln | *Oryza sativa* vacuolar H+-ATPase (vatp-P1) mRNA, complete cds. |
| 700616621H1 | g21629 | 42 | −57 | gb105pln | *Sorghum vulgare* mRNA for phosphoenolpyruvate carbaxylase (PEPC). |
| 700615029H1 | g805003 | 27 | −60 | gb105pln | *O. sativa* SG12 gene. |
| 700613726H1 | g1262582 | 41 | −17 | gb105allp | ATPase subunit 6 |
| 700613342H1 | g1574937 | 29 | 4 | gb105pln | *Zea mays* superoxide dismutase 4 (sod4) gene, partial cds. |
| 700612527H1 | g1732511 | 21 | 6 | gb105allp | Ran binding protein 1 homolog |
| 700613441H1 | g22537 | 51 | −94 | gb105pln | Maize mRNA for zein polypeptide (clone M6). |
| 700614679H1 | g2335108 | 13 | −6 | gb105eukp | T11A07.11; insulinase isolog |
| 700614557H1 | g453188 | 72 | −77 | gb105pln | *Z. mays* acp mRNA for acyl carrier protein. |
| 700618477H2 | g1161311 | 27 | −36 | gb105pln | *Arabidopsis thaliana* Columbia myo-inositol-1-phosphate synthase mRNA, complete cds. |
| 700617436H1 | g1353352 | 12 | −2 | gb105eukp | catalyzes the transfer of —NH2 from ala to 2-oxoglutarate; alanine aminotransferase; EC 2.6.1.2 |
| 700612388H1 | g533251 | 100 | −18 | gb105pln | *Zea mays* (clone pSM8) sucrose synthase 2 (Sus1) gene, complete cds. |
| 700618666H1 | g309120 | 11 | 6 | gb105allp | single stranded DNA binding protein p9 precursor |
| 700612311H1 | g2245098 | 30 | 1 | gb105eukp | ribosomal protein |
| 700613360H1 | g171395 | 29 | 5 | gb105eukp | ORF 1 |
| 700617104H1 | g695169 | 41 | −6 | gb105eukp | unknown |
| 700613974H1 | g17616 | 25 | 1 | gb105allp | 40S RIBOSOMAL PROTEIN S5 |
| 700617484H1 | g1420395 | 17 | −7 | gb105eukp | SME1 |
| 700613760H1 | g1136119 | 47 | −43 | gb105pln | *O. sativa* mRNA for alpha-tubulin (clone OSTA-111). |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700618372H1 | g347063 | 18 | 9 | gb105pln | *Brassica rapa* ubiquitin/ribosomal protein mRNA, complete cds. |
| 700617479H1 | g20163 | 30 | −28 | gb105pln | *O. sativa* Rr15 mRNA for 5S ribosomal RNA. |
| 700617943H1 | g1173829 | 20 | −8 | gb105pln | *Arabidopsis thaliana* meristem L1 layer homeobox protein (ATML1) mRNA, complete cds. |
| 700615810H1 | g22537 | 51 | −91 | gb105pln | Maize mRNA for zein polypeptide (clone M6). |
| 700612732H1 | g2245378 | 16 | −16 | gb105eukp | ARF1; auxin response factor 1 |
| 700617683H1 | g736308 | 8 | −15 | gb105eukp | unknown |
| 700615508H1 | g463856 | 27 | −13 | gb105pln | *Chlamydomonas reinhardtii* 21gr ribosomal protein S14 (CRY1) gene, complete cds. |
| 700614175H1 | g602605 | 45 | 16 | gb105pln | *Zea mays* tandem genes for alpha1-tubulin and alpha2-tubulin. |
| 700613722H1 | g1778051 | 11 | −0 | gb105allp | Prt1 homolog |
| 700612557H1 | g18259 | 36 | −29 | gb105pln | *C. sativus* mRNA for cs DnaJ-1. |
| 700615804H1 | g1408470 | 16 | 7 | gb105pln | *Arabidopsis thaliana* actin depolymerizing factor 1 (AtADF1) mRNA, complete cds. |
| 700616049H1 | g483546 | 12 | −5 | gb105pln | *R. communis* gene for pyrophosphate-dependent phosphofructokinase alpha subunit. |
| 700612313H1 | g902526 | 69 | −41 | gb105pln | *Zea mays* clone MubG7 ubiquitin fusion protein gene, complete cds. |
| 700612308H1 | g460978 | 50 | −3 | gb105pln | *C. plantagineum* Hochst mRNA for glyceraldehyde-3-phosphate dehydrogenase. |
| 700612623H1 | g499011 | 51 | −19 | gb105pln | *S. vulgare* SoAc1 mRNA. |
| 700612922H1 | g971283 | 19 | 6 | gb105pln | Rice mRNA for ribosomal protein S31, complete cds. |
| 700618135H1 | g1633049 | 9 | −1 | gb105eukp | RpL22; ribosomal protein Rpl22 |
| 700615967H1 | g168500 | 62 | −18 | gb105pln | Maize (*Zea mays*) histone H4 gene (H4C14), complete cds. |
| 700615449H1 | g2252639 | 13 | 14 | gb105pln | Genomic sequence of Arabidopsis BAC F8A5, complete sequence. |
| 700617235H1 | g577088 | 61 | −12 | gb105pln | *P. sativum* mRNA for ribosomal protein L1. |
| 700616533H1 | g600768 | 25 | 6 | gb105pln | *Oryza sativa* cyclophilin 2 (Cyp2) mRNA, complete cds. |
| 700615056H1 | g1064925 | 12 | −4 | gb105eukp | cyclin A-like protein |
| 700616415H1 | g1350502 | 5 | 5 | gb105eukp | EMB18; vicilin-like storage protein |
| 700613245H1 | g1053056 | 18 | −23 | gb105pln | *Triticum aestivum* histone H3 gene, partial cds, clone W1. |
| 700617692H1 | g557695 | 40 | −28 | gb105pln | *Zea mays* GTP binding protein beta subunit (ZGB1) mRNA, complete cds. |
| 700617333H1 | g1322988 | 17 | 16 | gb105pln | Yeast (*Saccharomyces cerevisiae*) chromosome VII reading frame ORF YGR020c. |
| 700617194H1 | g2306971 | 46 | −7 | gb105eukp | mag-1; ce-Mago |
| 700615129H1 | g2464848 | 24 | −29 | gb105pln | *Arabidopsis thaliana* DNA chromosome 4, ESSA I AP2 contig fragment No. 1. |
| 700617810H1 | g1129085 | 39 | −31 | gb105pln | Wheat mRNA for protein H2A, complete cds, clone wcH2A-9. |
| 700617221H1 | g431154 | 16 | 1 | gb105eukp | LIM7; ORF |
| 700615249H1 | g902526 | 46 | −1 | gb105pln | *Zea mays* clone MubG7 ubiquitin fusion protein gene, complete cds. |
| 700618255H1 | g2160162 | 18 | 2 | gb105eukp | F21M12.8 |
| 700615191H1 | g546005 | 21 | 6 | gb105eukp | 60S ribosomal protein |
| 700614306H1 | g2335095 | 54 | −8 | gb105eukp | T11A07.6; 40S ribosomal protein S2 isolog |
| 700617322H1 | g2160692 | 36 | 0 | gb105eukp | AtB 'beta; B' regulatory subunit of PP2A |
| 700613994H1 | g1370455 | 15 | 9 | gb105pln | Yeast (*Saccharomyces cerevisiae*) chromosome XVI reading frame ORF YPL220w. |
| 700617024H1 | g2288988 | 6 | 8 | gb105eukp | T01O24.23 |
| 700616447H1 | g558295 | 10 | 0 | gb105allp | ZK669.4 |
| 700612857H1 | g561663 | 39 | 4 | gb105pln | Rice mRNA, partial homologous to ribosomal protein coding sequence. |
| 700617339H1 | g168500 | 50 | −62 | gb105pln | Maize (*Zea mays*) histone H4 gene (H4C14), complete cds. |
| 700616769H1 | g1507667 | 77 | −3 | gb105eukp | bfr2+ protein/pad1+ protein/sks1+ protein |
| 700614240H1 | g1199546 | 17 | −9 | gb105eukp | QRI1 |
| 700616770H1 | g407525 | 71 | 3 | gb105eukp | tpi gene; triosephosphate isomerase; EC 5.3.1.1 |
| 700617648H1 | g22540 | 88 | −45 | gb105pln | Maize mRNA for 10 kDa zein. |
| 708614486H1 | g1143863 | 38 | −43 | gb105pln | *Oryza sativa* beta-glucosidase mRNA, nuclear gene encoding chloroplast protein, complete cds. |
| 700612322H1 | g218341 | 43 | 8 | gb105eukp | elongation factor 1 beta' |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700613049H1 | g1296460 | 2 | 8 | gb105allp | SCO-spondin |
| 700618156H1 | g22342 | 86 | −110 | gb105pln | Maize gene for heat shock protein 70 exon 2 and 3'-UT (hsp70; clone pMON 9502). |
| 700614758H1 | g2244857 | 24 | −11 | gb105eukp | hypothetical protein |
| 700614338H1 | g473602 | 60 | −6 | gb105pln | *Zea mays* W-22 histone H2A mRNA, complete cds. |
| 700613880H1 | g2673966 | 37 | 8 | gb105allp | hSIAH1 |
| 700618481H2 | g1360177 | 12 | 2 | gb105allp | ORF YLL011w |
| 700618053H1 | g170746 | 62 | −39 | gb105pln | Wheat histone H4 TH091 gene, complete cds. |
| 700617340H1 | g2570342 | 28 | 3 | gb105eukp | Glx2-2; glyoxalase II cytoplasmic isozyme; EC 3.1.2.6 |
| 700616491H1 | g21835 | 14 | 0 | gb105eukp | phosphoglycerate kinase (AA 1-401) |
| 700614832H1 | g471279 | 40 | −0 | gb105eukp | KRP-A |
| 700612648H1 | g886739 | 54 | −42 | gb105pln | *Z. mays* histone H4 gene. |
| 700614006H1 | g2264309 | 13 | 10 | gb105pln | *Arabidopsis thaliana* genomic DNA, chromosome 5, P1 clone: MJJ3, complete sequence. |
| 700615601H1 | g303852 | 27 | −34 | gb105pln | Rice mRNA for ribosomal protein L3, complete cds. |
| 700614372H1 | g2274990 | 61 | −8 | gb105pln | *Hordeum vulgare* mRNA for expressed sequence tag. |
| 700614264H1 | g168675 | 32 | 13 | gb105pln | Maize mutant zein (zE19) gene, complete cds. |
| 700617471H1 | g1799607 | 5 | 6 | gb105allp | METHIONYL-TRNA FORMYLTRANSFERASE (EC 2.1.2.9). |
| 700616766H1 | g168698 | 85 | −24 | gb105pln | *Z. mays* zein mRNA, complete cds. |
| 700616641H1 | g886739 | 28 | 16 | gb105pln | *Z. mays* histone H4 gene. |
| 700614319H1 | g2689480 | 35 | 13 | gb105pln | *Nicotiana tabacum* 14-3-3 isoform f T14-3f mRNA, complete cds. |
| 700613805H1 | g1019404 | 12 | 2 | gb105eukp | SPAC2G11.06; unknown |
| 700617685H1 | g218160 | 36 | −20 | gb105pln | *Oryza sativa* mRNA for elongation factor 1 beta'. |
| 700616348H1 | g1764162 | 9 | 5 | gb105allp | canalicuiar multispecific organic anion transporter |
| 700614392H1 | g1244773 | 12 | 2 | gb105allp | Lpi4p |
| 700613490H1 | g1556445 | 12 | 1 | gb105pln | *Hordeum vulgare* alpha tubulin (tubA) mRNA, complete cds. |
| 700617119H1 | g1488297 | 22 | 5 | gb105eukp | osRAD23 |
| 700612819H1 | g550025 | 46 | 2 | gb105allp | ribosomal protein S10 |
| 700614773H1 | g1946692 | 81 | −27 | gb105allp | NADH: ubiquinone oxidoreductase MLRQ subunit |
| 700617241H1 | g1930071 | 23 | 17 | gb105pln | *Oryza sativa* thioredoxin h mRNA, complete cds. |
| 700614328H1 | g429148 | 45 | −41 | gb105pln | *Z. mays* pep gene for (C3 type) phosphoendopyruvate carboxylase. |
| 700461156H1 | g168500 | 64 | −49 | gb105pln | Maize (*Zea mays*) histone H4 gene (H4C14), complete cds. |
| 700615488H1 | g2149639 | 26 | −6 | gb105pln | *Arabidopsis thaliana* Argonaute protein (AGO1) mRNA, complete cds. |
| 700612321H1 | g1279512 | 53 | −6 | gb105pln | *H. vulgare* bep1 mRNA for ADP-glucose pyrophosphorylase. |
| 700612582H1 | g498902 | 25 | 4 | gb105allp | ribosomal protein L27 homolog |
| 700617449H1 | g1495768 | 22 | −18 | gb105eukp | chloroplast inner envelope protein, 110 kD (IEP110) |
| 700614983H1 | g2739216 | 38 | 4 | gb105pln | *Hordeum vulgare* L41 ribosomal protein. |
| 700612828H1 | g1272684 | 77 | −10 | gb105pln | *Z. mays* mRNA for acetyl CoA carboxylase (partial). |
| 700613404H1 | g168679 | 65 | −62 | gb105pln | Maize 19 kDa zein mRNA, clone cZ19C2, complete cds. |
| 700618660H1 | g18259 | 16 | −3 | gb105pln | *C. sativus* mRNA for cs DnaJ-1. |
| 700615606H1 | g1049252 | 92 | −108 | gb105pln | *Zea mays* vacuolar ATPase 69 kDa subunit mRNA, partial cds. |
| 700614711H1 | g602605 | 31 | −53 | gb105pln | *Zea mays* tandem genes for alpha1-tubulin and alpha2-tubulin. |
| 700614356H1 | g1899026 | 47 | −9 | gb105pln | *Zea mays* superoxide dismutase 4A (sod4A) gene, complete cds. |
| 700617685H1 | g218340 | 36 | −21 | gb105pln | *Triticum aestivum* mRNA for elongation factor 1 beta'. |
| 700612932H1 | g2708715 | 32 | 4 | gb105eukp | small nuclear ribonucleoprotein Sm D3 |
| 700613353H1 | g2191184 | 18 | −22 | gb105eukp | A_TM021B04.4 |
| 700613423H1 | g1785861 | 46 | −45 | gb105pln | *Elaeis guineensis* var. tenera stearoyl-Acyl-carrier protein desaturase mRNA, partial cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700612517H1 | g644491 | 79 | −69 | gb105pln | Corn mRNA for elongation factor 1A. |
| 700613973H1 | g22531 | 72 | −44 | gb105pln | Zea mays mRNA encoding a zein (clone pZ22.1). |
| 700617318H1 | g2641618 | 48 | −4 | gb105pln | Zea mays ubiquitin-conjugating enzyme protein E2 (ubc7) mRNA, complete cds. |
| 700616488H1 | g392868 | 9 | −6 | gb105eukp | 1(3)73Ai; proteasome subunit |
| 700612392H1 | g169295 | 39 | 3 | gb105pln | Pharbitis nil heat shock protein 83 (Hsp83) gene, complete cds. |
| 700616871H1 | g790969 | 39 | −5 | gb105pln | Rice mRNA for aldolase C-1, complete cds. |
| 700615228H1 | g1001746 | 11 | 2 | gb105allp | hypothetical protein |
| 700617771H1 | g170772 | 49 | −32 | gb105pln | Triticum aestivum S-adenosyl-L-homocysteine hydrolase (SH6.2) mRNA, complete cds. |
| 700613683H1 | g700371 | 38 | −49 | gb105pln | Oryza sativa enolase mRNA, complete cds. |
| 700612953H1 | g1737491 | 36 | −36 | gb105pln | Triticum aestivum poly(A)-binding protein (wheatpab) mRNA, complete cds. |
| 700613441H1 | g168677 | 50 | −90 | gb105pln | Maize 19 kDa zein mRNA, clone cZ19C1, complete cds. |
| 700613036H1 | g416265 | 24 | −16 | gb105pln | Rice mRNA for ribosomal protein A2, partial sequence. |
| 700615056H1 | g829260 | 12 | −5 | gb105eukp | mitotic cyclin |
| 700616734H1 | g2331300 | 18 | −3 | gb105pln | Zea mays ribosomal protein S4 type I (rps4) mRNA, complete cds. |
| 700614359H1 | g157036 | 13 | −0 | gb105eukp | cact; cactus zygotic protein |
| 700612308H1 | g16021 | 45 | 0 | gb105pln | A. majus GADPH mRNA for glycolytic glyceraldehyde-3-phosphate dehydrogenase. |
| 700617627H1 | g2668749 | 30 | −18 | gb105pln | Zea mays ribosomal protein L30 (rp130) mRNA, complete cds. |
| 700616009H1 | g22537 | 92 | −110 | gb105pln | Maize mRNA for zein polypeptide (clone M6). |
| 700616147H1 | g829147 | 47 | 4 | gb105pln | Z. mays gene for cyclophilin. |
| 700612910H1 | g22528 | 59 | −61 | gb105pln | Zea mays mRNA encoding a zein (clone A20). |
| 700615307H1 | g1262999 | 41 | −38 | gb105eukp | ZK287.5 |
| 700612692H1 | g473985 | 38 | −6 | gb105pln | Rice mRNA, partial homologous to high mobility group protein gene. |
| 700616430H1 | g168419 | 24 | −70 | gb105pln | Maize (Z. mays) aldolase mRNA, complete cds. |
| 700618387H1 | g459894 | 43 | −59 | gb105pln | Zea mays sus1 gene, complete cds. |
| 700616930H1 | g2624416 | 16 | −26 | gb105pln | Zea mays mRNA for ubiquitin carrier protein UBC7. |
| 700614976H1 | g2760334 | 17 | −18 | gb105eukp | F1N21.5 |
| 700613121H1 | g563334 | 15 | 2 | gb105pln | B. napus (Naehan) bgb1 mRNA for guanine nucleotide regulatory protein. |
| 700616576H1 | g2809232 | 51 | 6 | gb105eukp | F21B7.1 |
| 700615833H1 | g1655679 | 19 | −12 | gb105eukp | 3-hydroxy-3-methylglutaryl-CoA-synthase |
| 700613165H1 | g1132482 | 51 | −15 | gb105pln | Rice mRNA for ADP-ribosylation factor, complete cds. |
| 700614144H1 | g2827149 | 47 | 7 | gb105pln | Triticum aestivum acetyl-coenzyme A carboxylase (Acc-1) mRNA, nuclear gene encoding plastid protein, complete cds. |
| 700617438H1 | g436782 | 53 | −52 | gb105pln | Rice mRNA for cyc07, complete cds. |
| 700614085H1 | g913941 | 53 | 2 | gb105allp | aldehyde dehydrogenase homolog = btg-26 [Brassica napus, cv. Bridger, Peptide, 494 aa] |
| 700616956H1 | g2150129 | 34 | −26 | gb105pln | Arabidopsis thaliana cytoplasmic ribosomal protein S15a mRNA, complete cds. |
| 700614487H1 | g456211 | 12 | 11 | gb105pln | S. tuberosum mRNA for 60S ribosomal protein L27. |
| 700613016H1 | g2464864 | 13 | −6 | gb105eukp | selenium-binding protein homolog |
| 700618176H1 | g303854 | 21 | −53 | gb105pln | Rice mRNA for ribosomal protein L7A, complete cds. |
| 700617445H1 | g2392762 | 9 | 16 | gb105pln | Arabidopsis thaliana BAC T32H15 from chromsome V, complete sequence. |
| 700615968H1 | g2501765 | 39 | −1 | gb105pln | Glycine max calmodulin-like domain protein kinase isoenzyme gamma mRNA, complete cds. |
| 700616987H1 | g2564051 | 15 | 13 | gb105pln | Arabidopsis thaliana genomic DNA, chromosome 5, P1 clone: MWD9, complete sequence. |
| 700614487H1 | g2244829 | 12 | 12 | gb105pln | Arabidopsis thaliana DNA chromosome 4, ESSA I contig fragment No. 2. |
| 700613464H1 | g736271 | 66 | −13 | gb105pln | O. sativa hsp70 gene for heat shock protein 70. |
| 700616089H1 | g1574945 | 20 | −1 | gb105pln | Nicotiana tabacum |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | caffeoyl-coenzymeA O-methyltransferase (CCoAOMT-1) mRNA, complete cds. |
| 700613974H1 | g57137 | 15 | 4 | gb105allp | ribosomal protein S5 |
| 700461147H1 | g854578 | 10 | 2 | gb105eukp | beta-adaptin |
| 700618637H1 | g2826811 | 13 | 7 | gb105allp | AtGRP2 |
| 700613975H1 | g1145694 | 35 | −25 | gb105pln | *Arabidopsis thaliana* actin (ACT3) gene, complete cds. |
| 700617263H1 | g881615 | 21 | 5 | gb105eukp | Fae1; the condensing enzyme of the fatty acid elongase complex that converts C18 fatty acids to C20 and C22 fatty acids; substrates for the reaction are oleoyl-CoA and malonyl-CoA; fatty acid elongase 1 |
| 700618003H1 | g173243 | 12 | −3 | gb105eukp | unidentified peptide |
| 700616073H1 | g886737 | 27 | −30 | gb105pln | *Z. mays* histone H3 gene. |
| 700612636H1 | g439685 | 11 | 12 | gb105pln | Yeast (*Saccharomyces cerevisiae*) GPD1 gene. |
| 700616113H1 | g1550813 | 56 | −76 | gb105pln | *Z. mays* mRNA for acidic ribosomal protein P0. |
| 700618437H2 | g2828188 | 17 | −18 | gb105pln | *Arabidopsis thaliana* genomic DNA, chromosome 5, TAC clone: K3I3, complete sequence. |
| 700618374H1 | g409072 | 15 | 3 | gb105allp | HBp15/L22 |
| 700618219H1 | g297446 | 13 | 5 | gb105pln | Yeast (*Saccharomyces pombe*) cdc22+ gene for ribonucleotide reductase large subunit. |
| 700461173H1 | g20250 | 69 | −58 | gb105pln | *Oryza sativa* H3 histone gene H3R-11. |
| 700615264H1 | g1335965 | 33 | −86 | gb105pln | *Zea mays* acetyl CoA carboxylase mRNA, partial cds. |
| 700613486H1 | g169758 | 23 | −44 | gb105pln | *O. sativa* ADP-glucose pyrophosphorylase 51 kD subunit mRNA, complete cds. |
| 700616457H1 | g624934 | 25 | −18 | gb105pln | Yeast YL8B gene for ribosomal protein YL8, complete cds (exon1, exon2, exon3). |
| 700614321H1 | g425802 | 53 | −20 | gb105pln | Rice mRNA for heat shock protein 70 (gene name AD622), partial cds. |
| 700618673H1 | g1053044 | 14 | −17 | gb105pln | *Glycine max* histone H3 gene, partial cds, clone S1. |
| 700615409H1 | g1881694 | 59 | −85 | gb105pln | *Zea mays* phosphoglucomutase mRNA, partial cds. |
| 700618005H1 | g18259 | 33 | −38 | gb105pln | *C. sativus* mRNA for cs DnaJ-1. |
| 700617533H1 | g18045 | 19 | 1 | gb105pln | *C. lanceolata* mRNA for beta-ketoacyl-ACP reductase. |
| 700616428H1 | g1143704 | 37 | −62 | gb105pln | *Z. mays* mRNA for homeobox 2a protein. |
| 700614375H1 | g577824 | 40 | −35 | gb105pln | *Z. mays* gene for H2B histone (gH2B3). |
| 700614977H1 | g1161311 | 16 | 5 | gb105pln | *Arabidopsis thaliana* Columbia myo-inositol-1-phosphate synthase mRNA, complete cds. |
| 700614271H1 | g303854 | 14 | −38 | gb105pln | Rice mRNA for ribosomal protein L7A, complete cds. |
| 700614879H1 | g294199 | 17 | −10 | gb105pln | *Phytophthora megasperma* mitochondrial ORF152, complete cds, cytochrome c oxidase subunit I (cox1) gene, complete cds, cytochrome c oxidase subunit II (cox2) gene, complete cds. |
| 700614689H1 | g8488 | 21 | −13 | gb105eukp | RpL1 |
| 700613994H1 | g2276349 | 24 | −4 | gb105pln | Yeast (*Saccharomyces pombe*) chromosome II cosmid c30D10. |
| 700614281H1 | g1841464 | 11 | −2 | gb105eukp | SF3; LIM-domain SF3 protein |
| 700618093H1 | g458731 | 12 | −2 | gb105allp | proteasome subunit RC10-II |
| 700617632H1 | g2351065 | 20 | 15 | gb105pln | *Arabidopsis thaliana* genomic DNA, chromosome 5, P1 clone: MHF15. |
| 700612330H1 | g1302570 | 16 | −7 | gb105eukp | ORF YNR053c |
| 700616575H1 | g429010 | 18 | −44 | gb105pln | Rice mRNA for cytochrome c (gene name SS393), partial cds. |
| 700614470H1 | g2274990 | 29 | −9 | gb105pln | *Hordeum vulgare* mRNA for expressed sequence tag. |
| 700613206H1 | g22537 | 50 | −54 | gb105pln | Maize mRNA for zein polypeptide (clone M6). |
| 700618149H1 | g2832242 | 77 | −4 | gb105pln | *Zea mays* 22-kDa alpha zein gene cluster, complete sequence. |
| 700612754H1 | g168661 | 63 | −2 | gb105pln | Maize 15 kDa zein mRNA, clone cZ15A3, complete cds. |
| 700612855H1 | g862309 | 48 | −67 | gb105pln | Rice G protein alpha-subunit (RGA1) mRNA, complete cds. |
| 700461142H1 | g22215 | 100 | −84 | gb105pln | *Z. mays* ZSF4C1 gene for zein. |
| 700613923H1 | g1136121 | 77 | −23 | gb105pln | *O. sativa* mRNA for alpha-tubulin (clone OSTA-136). |
| 700614892H1 | g1001373 | 23 | 5 | gb105allp | indole-3-glycerol phosphate synthase |
| 700614761H1 | g450881 | 64 | 3 | gb105allp | heat shock cognate 70-2 |
| 700614688H1 | g1553130 | 38 | −20 | gb105pln | *Gossypium hirsutum* ribosomal protein L44 isoform b (RL44), complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700613877H1 | g600100 | 24 | −9 | gb105eukp | a component of Golgi-derived clathrin-coated vesicles; gamma-adaptin |
| 700615157H1 | g602564 | 36 | 14 | gb105pln | C. paradisi (Macf) INO1 gene. |
| 700461124H1 | g1305524 | 75 | −65 | gb105pln | Oryza sativa Wilms' tumor-related protein QM mRNA, partial cds. |
| 700613313H1 | g558364 | 51 | −105 | gb105pln | Z. mays mRNA for ADP-glucose pyrophosphorylase. |
| 700616444H1 | g895893 | 15 | −6 | gb105eukp | SCP160; hypothetical esterase |
| 700614085H1 | g20681 | 46 | 3 | gb105allp | 508 aa peptide |
| 700613725H1 | g558364 | 79 | −67 | gb105pln | Z. mays mRNA for ADP-glucose pyrophosphorylase. |
| 700613784H1 | g2443890 | 20 | −3 | gb105eukp | F11P17.16 |
| 700616569H1 | g1279218 | 40 | −35 | gb105pln | B. napus mRNA for acyl-[acyl-carrier protein] desaturase. |
| 700612741H1 | g168498 | 38 | −36 | gb105pln | Corn histone H4 (H4C13) gene, complete cds. |
| 700612812H1 | g312178 | 38 | 10 | gb105pln | Z. mays GapC2 gene. |
| 700612731H1 | g349212 | 17 | −16 | gb105pln | Arabidopsis thaliana ubiquitin conjugating enzyme mRNA, complete cds. |
| 700612927H1 | g902597 | 43 | −22 | gb105allp | MIF homologue |
| 700616772H1 | g1666176 | 57 | −8 | gb105pln | N. tabacum mRNA for subunit of NADH: ubiquinone oxidoreductase complex I. |
| 700614020H1 | g1272684 | 61 | −90 | gb105pln | Z. mays mRNA for acetyl CoA carboxylase (partial). |
| 700615059H1 | g2282583 | 84 | −51 | gb105pln | Zea mays elongation factor 1-alpha (EF1-A) mRNA, complete cds. |
| 700613958H1 | g248336 | 91 | −26 | gb105pln | polyubiquitin [maize, Genomic, 3841 nt]. |
| 700617771H1 | g1724101 | 50 | −33 | gb105pln | Mesembryanthemum crystallinum S-adenosyl-L-homocystein hydrolase mRNA, complete cds. |
| 700614529H1 | g1419445 | 16 | −12 | gb105eukp | K04G2.2 |
| 700461157H1 | g1498052 | 90 | −74 | gb105pln | Zea mays ribosomal protein S8 mRNA, complete cds. |
| 700617143H1 | g169792 | 23 | 3 | gb105pln | Rice histone 3 gene, complete cds. |
| 700612432H1 | g1037129 | 34 | 2 | gb105pln | (gamma-zeinA) = opaque2 modifier {5' region} [Zea mays = maize, Tuxpeno CMS 450, mRNA Partial, 1889 nt]. |
| 700616687H1 | g1154953 | 23 | 13 | gb105pln | T. aestivum histone H2A gene. |
| 700614712H1 | g2270994 | 37 | −6 | gb105eukp | GmPM13; Ca+2-binding EF hand protein |
| 700614744H1 | g288058 | 28 | 14 | gb105pln | Z. mays S13 mRNA for cytoplasmic ribosomal protein S13. |
| 700613778H1 | g2688979 | 20 | −12 | gb105eukp | AtKUP1; high-affinity potassium transporter |
| 700615023H1 | g498738 | 59 | −24 | gb105pln | H. vulgare (pMaW20) pseudo mRNA for beta-ketoacyl-ACP synthase (partial). |
| 700613745H1 | g527680 | 50 | −30 | gb105eukp | ribosomal protein S3 |
| 700617048H1 | g22272 | 74 | −79 | gb105pln | Maize mRNA for enolase (2-phospho-D-glycerate hydrolase). |
| 700613938H1 | g347527 | 16 | 0 | gb105allp | ribosomal protein S3 |
| 700615071H1 | g1125032 | 8 | −6 | gb105eukp | cellulase precursor |
| 700612392H1 | g300082 | 47 | −1 | gb105pln | hsp82 = 82 kda heat shock protein [Zea mays, seedling, leaves, Genomic, 3468 nt]. |
| 700613723H1 | g415314 | 49 | −40 | gb105pln | Rice mRNA for NADP dependent malic enzyme, complete cds |
| 700618378H1 | g603870 | 16 | 9 | gb105pln | P. hybrida mRNA for MAP/ERK kinase 1. |
| 700612515H1 | g22322 | 42 | −58 | gb105pln | Z. mays mRNA for H2B histone (clone cH2B214). |
| 700613027H1 | g2760920 | 10 | 5 | gb105allp | cytoplasmic aminopeptidase P |
| 700618513H1 | g809575 | 50 | −53 | gb105pln | S. bicolor mRNA for cysteine proteinase inhibitor. |
| 700618371H1 | g1100224 | 26 | −39 | gb105pln | Pinus sylvestris chloroplast NAD+-dependent glyceraldehyde-3-phosphate dehydrogenase mRNA, complete cds. |
| 700613051H1 | g2293565 | 17 | −3 | gb105pln | Oryza sativa ADP-ribosylation factor 1 (Os-ARF1) mRNA, complete cds. |
| 700618537H1 | g2702284 | 17 | −24 | gb105eukp | T21L14.12; Argonaute (AG01)-like protein |
| 700617152H1 | g2662346 | 70 | −17 | gb105pln | Oryza sativa mRNA for EF-1 alpha, complete cds. |
| 700615834H1 | g415314 | 38 | −57 | gb105pln | Rice mRNA for NADP dependent malic enzyme, complete cds. |
| 700612844H1 | g2668745 | 40 | −11 | gb105pln | Zea mays inorganic pyrophosphatase (IPP) mRNA, complete cds. |
| 700613032H1 | g887597 | 19 | −9 | gb105eukp | unknown |
| 700614570H1 | g939749 | 55 | −5 | gb105eukp | LPZ15c; Lpz15p |
| 700616970H1 | g2072726 | 35 | −42 | gb105pln | O. sativa mRNA for Fd-GOGAT, |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | partial, clone OsGog2. |
| 700615434H1 | g1335965 | 26 | 3 | gb105pln | *Zea mays* acetyl CoA carboxylase mRNA, partial cds. |
| 700612969H1 | g2444419 | 20 | −4 | gb105pln | *Glycine max* ribosome-associated protein p40 mRNA, complete cds. |
| 700614450H1 | g1439533 | 32 | −33 | gb105pln | *Ipomoea batatas* starch phosphorylase gene, complete cds. |
| 700613651H1 | g2315764 | 8 | 2 | gb105eukp | T07D3.7 |
| 700612354H1 | g415316 | 56 | −3 | gb105pln | Rice mRNA for acidic ribosomal protein P0, complete cds. |
| 700618592H1 | g2494110 | 35 | −6 | gb105pln | Sequence of BAC T1G11 from *Arabidopsis thaliana* chromosome 1, complete sequence. |
| 700614034H1 | g2529228 | 40 | 4 | gb105pln | *Glycine max* mRNA for 6-phosphogluconate dehydrogenase, complete cds. |
| 700613946H1 | g2244904 | 16 | 5 | gb105eukp | similar to hypothetical protein C02F5.7 - Caenorha |
| 700618378H1 | g457405 | 17 | −10 | gb105pln | *Arabidopsis thaliana* mRNA for MAP kinase, complete cds. |
| 700616985H1 | g847833 | 40 | −44 | gb105pln | *Zea mays* 10 kDa zein gene, complete cds. |
| 700617543H1 | g2252848 | 22 | 14 | gb105pln | *Arabidopsis thaliana* BAC TM018A10. |
| 700613182H1 | g467551 | 50 | −33 | gb105pln | Soybean mRNA for phosphoenolpyruvate carboxylase. |
| 700616871H1 | g168419 | 44 | −11 | gb105pln | Maize (*Z. mays*) aidolase mRNA, complete cds. |
| 700613113H1 | g600115 | 25 | −11 | gb105pln | *Z. mays* apx gene encoding cytosolic ascorbate peroxidase. |
| 700617127H1 | g1771380 | 43 | −17 | gb105pln | *N. rustica* mRNA for phosphoinositide-specific phosphoilpase C. |
| 700614021H1 | g2431766 | 52 | −93 | gb105pln | *Zea mays* acidic ribosomal protein P3a (rpp3a) mRNA, complete cds. |
| 700615191H1 | g57688 | 29 | 6 | gb105allp | ribosomal protein L23 |
| 700613626H1 | g609261 | 44 | −62 | gb105pln | *S. cereale* (cv. Halo) mRNA for triosephosphate isomerase. |
| 700616885H1 | g233042 | 33 | 3 | gb105allp | S3 ribosomal protein [human, colon, Peptide, 243 aa] |
| 700617325H1 | g407411 | 56 | −16 | gb105pln | *C. roseus* SAHH gene for S-adenosyl-L-homocysteine hydrolase. |
| 700613289H1 | g600768 | 21 | −27 | gb105pln | *Oryza sativa* cyclophilin 2 (Cyp2) mRNA, complete cds. |
| 700614535H1 | g458972 | 19 | −1 | gb105eukp | F37C12.4 |
| 700614268H1 | g1743276 | 57 | 3 | gb105pln | *H. vulgare* mRNA for beta tubulin. |
| 700618263H1 | g168579 | 39 | −2 | gb105pln | *Maize pyruvate*, orthophosphate dikinase mRNA, complete cds. |
| 700617471H1 | g1799612 | 5 | 6 | gb105allp | METHIONYL-TRNA FORMYLTRANSFERASE (EC 2.1.2.9). |
| 700616114H1 | g20469 | 10 | 0 | gb105allp | malic enzyme |
| 700616058H1 | g1653702 | 7 | 7 | gb105allp | dihydrolipoamide acetyltransferase component (E2) of pyruvate dehydrogenase complex |
| 700613630H1 | g2244950 | 15 | −10 | gb105pln | *Arabidopsis thaliana* DNA chromosome 4, ESSA I contig fragment No. 5. |
| 700617534H1 | g1778144 | 16 | −9 | gb105pln | *Nicotiana tabacum* plastid phosphate/phosphoenolpyruvate translocator precursor (TABPPT10) mRNA, complete cds. |
| 700616427H1 | g1841501 | 52 | −96 | gb105pln | *Z. mays* mRNA for glutathione-dependent formaldehyde dehydrogenase. |
| 700616310H1 | g572605 | 22 | −21 | gb105pln | *B. napus* ACCg8 gene. |
| 700615101H1 | g2218094 | 10 | −1 | gb105allp | sensor protein RssA |
| 700617103H1 | g602252 | 63 | −27 | gb105pln | *Zea mays* enolase (eno2) mRNA, complete cds. |
| 700612306H1 | g168460 | 85 | −25 | gb105pln | *Zea mays* cyclophilin (CyP) mRNA, complete cds. |
| 700612324H1 | g2224750 | 42 | 7 | gb105pln | *Arabidopsis thaliana* mRNA for ribosomal protein S6. |
| 700617713H1 | g21492 | 23 | −1 | gb105pln | *S. tuberosum* mRNA for mitochondrial processing peptidase. |
| 700461283H1 | g1037129 | 63 | −41 | gb105pln | (gamma-zeinA) = opaque2 modifier (5′ region} [*Zea mays* = maize, Tuxpeno CMS 450, mRNA Partial, 1889 nt]. |
| 700613457H1 | g1118055 | 19 | −12 | gb105eukp | K07E3.4 |
| 700613988H1 | g2814982 | 57 | −8 | gb105eukp | T21B10.7 |
| 700616418H1 | g536552 | 6 | 1 | gb105eukp | RPS13 = SUP46 |
| 700614719H1 | g984524 | 33 | −78 | gb105pln | *Zea mays* high-methionine zein DZS18 (dzs18) gene, complete cds. |
| 700617703H1 | g577824 | 44 | 12 | gb105pln | *Z. mays* gene for H2B histone |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700615244H1 | g1914682 | 17 | 2 | gb105pln | (gH2B3).<br>*D. carota* mRNA for RAD23 protein, isoform I. |
| 700618271H1 | g474945 | 9 | 12 | gb105pln | *Z. mays* mRNA for subtilisin-chymotrypsin inhibitor. |
| 700617115H1 | g17008 | 50 | −1 | gb105allp | NAD-dep methylenetetrahydrofolate dehydrogenase cyclohydrolase precursor |
| 700614386H1 | g173419 | 15 | 5 | gb105allp | p68 RNA helicase |
| 700612928H1 | g1136121 | 18 | 17 | gb105pln | *O. sativa* mRNA for alpha-tubulin (clone OSTA-136). |
| 700614556H1 | g1532169 | 38 | −9 | gb105eukp | AT.I.24-7 |
| 700612870H1 | g388052 | 88 | −101 | gb105pln | *Zea mays* alcohol dehydrogenase (Adh1-S) mRNA, complete cds. |
| 700618371H1 | g1184775 | 22 | −29 | gb105pln | *Zea mays* glyceraldehyde-3-phosphate dehydrogenase GAPC4 (gpc4) mRNA, complete cds. |
| 700618678H1 | g2289009 | 50 | 2 | gb105eukp | T01O24.20; ribosomal protein L38 isolog |
| 700618259H1 | g170919 | 25 | −10 | gb105pln | Yeast (*Candida maltose*) ribosomal protein L41 (LEL41) gene, complete cds. |
| 700615472H1 | g168707 | 23 | 9 | gb105pln | Maize zein gene (pML1), promoters and partial coding sequence. |
| 700613717H1 | g1136121 | 48 | −39 | gb105pln | *O. sativa* mRNA for alpha-tubulin (clone OSTA-136). |
| 700612637H1 | g1321917 | 29 | 4 | gb105eukp | su12; cytoplasmic ribosomal protein S7 |
| 700612648H1 | g170746 | 34 | −13 | gb105pln | Wheat histone H4 TH091 gene, complete cds. |
| 700613114H1 | g22535 | 49 | −73 | gb105pln | *Zea mays* mRNA encoding a zein (clone pZ22.3). |
| 700614704H1 | g416265 | 27 | −13 | gb105pln | Rice mRNA for ribosomal protein A2, partial sequence. |
| 700612363H1 | g857573 | 36 | −5 | gb105pln | *Oryza sativa* vacuolar H+-ATPase (vatp-P1) mRNA, complete cds. |
| 700616641H1 | g170746 | 27 | 17 | gb105pln | Wheat histone H4 TH091 gene, complete cds. |
| 700616593H1 | g1945611 | 5 | 4 | gb105allp | 26S proteasome subunit p55 |
| 700613460H1 | g644492 | 49 | −45 | gb105pln | Corn elongation factor 1alpha gene, complete cds. |
| 700616011H1 | g602564 | 47 | −54 | gb105pln | *C. paradisi* (Macf) INO1 gene. |
| 700613918H1 | g2414643 | 18 | 14 | gb105pln | Yeast (*Saccharomyces pombe*) chromosome I cosmid c3H5. |
| 700617957H1 | g558651 | 19 | −6 | gb105pln | *T. aestivum* VDAC3 mRNA for voltage dependent anion channel. |
| 700614359H1 | g157041 | 13 | −0 | gb105eukp | cact |
| 700613478H1 | g22342 | 28 | −46 | gb105pln | Maize gene for heat shock protein 70 exon 2 and 3'-UT (hsp70; clone pMON 9502). |
| 700615845H1 | g397632 | 51 | −22 | gb105pln | *T. aestivum* translation initiation factor 4A. |
| 700613626H1 | g806311 | 27 | −26 | gb105pln | *Spinacia oleracea* nuclear encoded triosephosphate isomerase, chloroplast isozyme mRNA, complete cds. |
| 700616849H1 | g2262073 | 7 | 4 | gb105allp | RNA polymerase II subunit 14.4 kDa |
| 700615880H1 | g2829870 | 36 | 4 | gb105allp | Hypothetical protein |
| 700614092H1 | g2244950 | 29 | 6 | gb105pln | *Arabidopsis thaliana* DNA chromosome 4, ESSA I contig fragment No. 5. |
| 700613160H1 | g2454181 | 33 | −22 | gb105pln | *Arabidopsis thaliana* pyruvate dehydrogenase E1 alpha subunit mRNA, nuclear gene encoding plastid protein, complete cds. |
| 700618021H1 | g577824 | 14 | 11 | gb105pln | *Z. mays* gene for H2B histone (gH2B3). |
| 700613162H1 | g22091 | 28 | 14 | gb105pln | *Z. diploperennis* gene for hydroxyproline-rich glycoprotein. |
| 700618102H1 | g2570118 | 9 | 16 | gb105pln | *S. latifolia* mRNA, clone CCLS 17. |
| 700614707H1 | g403497 | 35 | −11 | gb105allp | GRP94 |
| 700615504H1 | g168683 | 39 | −35 | gb105pln | Maize 22 kd (Mw = 26.53 kd) zein protein 1, mRNA. |
| 700615445H1 | g1841501 | 53 | −78 | gb105pln | *Z. mays* mRNA for glutathione-dependent formaldehyde dehydrogenase. |
| 700613652H1 | g2160155 | 27 | 7 | gb105pln | Sequence of BAC F21M12 from *Arabidopsis thaliana* chromosome 1, complete sequence. |
| 700618437H2 | g1518539 | 15 | −15 | gb105pln | Glycine max UDP-glucose dehydrogenase mRNA, complete cds. |
| 700617354H1 | g20468 | 47 | −50 | gb105pln | *P. deltoides* mRNA for malic enzyme. |
| 700616429H1 | g1279911 | 9 | −8 | gb105eukp | FsMAPK; mitogen-activated protein kinase |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700616424H1 | g459199 | 22 | −7 | gb105pln | *Gossypium hirsutum* vacuolar H+-ATPase subunit B mRNA, partial cds. |
| 700617546H1 | g790507 | 14 | −40 | gb105pln | *Z. mays* mRNA for 60S acidic ribosomal protein. |
| 700617201H1 | g1483149 | 21 | 9 | gb105pln | *Arabidopsis thaliana* mRNA for monodehydroascorbate reductase, complete cds. |
| 700613463H1 | g924629 | 32 | −35 | gb105pln | *Solanum lycopersicum* clone TPP24 leucine aminopeptidase mRNA, complete cds. |
| 700617127H1 | g2564805 | 38 | −12 | gb105pln | *P. sativum* mRNA for phospholipase C. |
| 700616023H1 | g2088722 | 12 | −2 | gb105eukp | F53G12.10 |
| 700613108H1 | g415314 | 61 | −69 | gb105pln | Rice mRNA for NADP dependent malic enzyme, complete cds. |
| 700614977H1 | g396209 | 19 | −3 | gb105pln | *S. polyrrhiza* mRNA for D-myo-inositol-3-phosphate synthase. |
| 700614737H1 | g16380 | 67 | 2 | gb105eukp | laminin receptor homologue |
| 700617977H1 | g1724101 | 21 | −2 | gb105pln | *Mesembryanthemum crystallinum* S-adenosyl-L-homocystein hydrolase mRNA, complete cds. |
| 700616069H1 | g168677 | 94 | −5 | gb105pln | Maize 19 kDa zein mRNA, clone cZ19C1, complete cds. |
| 700614988H1 | g2285801 | 28 | −20 | gb105pln | *Spinacia oleracea* mRNA for 26S proteasome alpha subunit, complete cds. |
| 700617205H1 | g1276967 | 36 | −5 | gb105eukp | putative ribosomal protein |
| 700612987H1 | g2182285 | 12 | 14 | gb105pln | Sequence of BAC F5I14 from *Arabidopsis thaliana* chromosome 1, complete sequence. |
| 700617475H1 | g886739 | 31 | −41 | gb105pln | *Z. mays* histone H4 gene. |
| 700617115H1 | g537595 | 34 | 2 | gb105eukp | trifunctional enzyme; methylenetetrahydrofolate dehydrogenase; EC 1.5.1.5 |
| 700616324H1 | g310314 | 48 | −55 | gb105pln | *Oryza sativa* calmodulin gene, complete cds. |
| 700614228H1 | g218000 | 35 | −34 | gb105pln | Potato mRNA for UDP-glucose pyrophosphorylase (EC 2.7.7.9). |
| 700612311H1 | g2245073 | 23 | 1 | gb105pln | *Arabidopsis thaliana* DNA chromosome 4, ESSA I contig fragment No. 8. |
| 700612951H1 | g1403043 | 13 | −19 | gb105pln | *H. chilense × T. turgidum* conv. durum (Tritordeum) mRNA for S-adenosylmethionine decarboxylase. |
| 700612970H1 | g971283 | 22 | 1 | gb105pln | Rice mRNA for ribosomal protein S31, complete cds. |
| 700614742H1 | g1524109 | 39 | −21 | gb105allp | TIF1beta zinc finger protein |
| 700613969H1 | g974781 | 34 | −7 | gb105pln | *C. blumei* kinetoplast met gene for cobalamine-1ndependent methionine synthase. |
| 700615863H1 | g168690 | 84 | −42 | gb105pln | Maize zein mRNA, complete cds, clone ZG124. |
| 700614215H1 | g1045497 | 8 | 7 | gb105allp | conserved ATPase domain protein 44 |
| 700612646H1 | g1655481 | 16 | 14 | gb105pln | *Arabidopsis thaliana* mRNA for delta subunit of mitochondrial F1-ATPase, complete cds. |
| 700617007H1 | g455506 | 15 | −17 | gb105pln | Rice mRNA for ras-related GTP-binding protein, partial sequence. |
| 700616366H1 | g868003 | 27 | 3 | gb105eukp | a member for glyoxylate cycle; aconitase; EC 4.2.1.3 |
| 700613965H1 | g2739385 | 22 | 5 | gb105allp | putative beta-1,3-glucanase |
| 700615163H1 | g1072187 | 6 | 7 | gb105eukp | F35C8.7 |
| 700618504H1 | g397400 | 20 | −37 | gb105pln | *B. rapa* mRNA for S phase specific gene. |
| 700615220H1 | g1480355 | 31 | 1 | gb105eukp | UBC13; ubiquitin-conjugating enzyme |
| 700461295H1 | g1098975 | 10 | 7 | gb105eukp | IMP2; myo-inositol monophosphatase 2 |
| 700617936H1 | g1553065 | 28 | 5 | gb105eukp | Daff\Gpdh; glycerolphosphate dehydrogenase; EC 1.1.1.8 |
| 700614172H1 | g547473 | 13 | 16 | gb105pln | Yeast (*Saccharomyces pombe*) Rp129p gene for ribosomal protein L29. |
| 700612647H1 | g1419369 | 46 | −55 | gb105pln | *Z. mays* ZmABP3 mRNA for actin depolymerizing factor. |
| 700613314H1 | g1255684 | 66 | −12 | gb105pln | Rice mRNA for aspartic protease, complete cds. |
| 700616662H1 | g2286152 | 10 | −21 | gb105pln | *Zea mays* cytoplasmic malate dehydrogenase mRNA, complete cds. |
| 700618357H1 | g1657768 | 10 | 2 | gb105eukp | pol |
| 700618080H1 | g1627515 | 41 | 9 | gb105pln | *A. thaliana* ASK etha gene. |
| 700613718H1 | g1495250 | 42 | −8 | gb105pln | *A. thaliana* mRNA for heat-shock protein. |
| 700617791H1 | g17862 | 35 | −13 | gb105pln | *B. napus* mRNA for ribosomal protein S15a (pPCB8). |
| 700461234H1 | g473602 | 40 | −34 | gb105pln | *Zea mays* W-22 histone H2A |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | mRNA, complete cds. |
| 700616737H1 | g2645165 | 48 | 5 | gb105pln | *Oryza sativa* mRNA, similar to ribosomal protein 41. |
| 700614131H1 | g1279512 | 37 | 6 | gb105pln | *H. vulgare* bep1 mRNA for ADP-glucose pyrophosphorylase. |
| 700615437H1 | g22198 | 15 | 11 | gb105pln | Maize transposable element Bs1. |
| 700613795H1 | g2804258 | 71 | 4 | gb105eukp | phosphoglycerate dehydrogenase |
| 700614959H1 | g2606076 | 20 | −0 | gb105pln | *Helianthus annuus* auxin-induced protein (HaAC1) mRNA, complete cds. |
| 700612622H1 | g2150130 | 46 | −2 | gb105eukp | cytoplasmic ribosomal protein S15a |
| 700613242H1 | g488779 | 39 | −33 | gb105pln | *T. aestivum* mRNA for isomerase. |
| 700616420H1 | g2257755 | 28 | −57 | gb105pln | *Zea mays* nucleolar histone deacetylase HD2-p39 mRNA, complete cds. |
| 700617284H1 | g2624416 | 52 | −43 | gb105pln | *Zea mays* mRNA for ubiquitin carrier protein UBC7. |
| 700616402H1 | g218368 | 19 | 8 | gb105eukp | CTPACTB; acetoacetyl-CoA thiolase A; EC 2.3.1.9 |
| 700612458H1 | g881521 | 31 | −10 | gb105eukp | AtHXK1; hexokinase 1; EC 2.7.1.1 |
| 700613112H1 | g2642427 | 10 | 14 | gb105pln | *Arabidopsis thaliana* chromosome II BAC T20D16 genomic sequence, complete sequence. |
| 700616723H1 | g1149570 | 13 | 16 | gb105pln | *A. thaliana* mRNA for mitochondrial elongation factor Tu. |
| 700616324H1 | g20187 | 48 | −55 | gb105pln | *O. sativa* gene encoding calmodulin. |
| 700613042H1 | g65054 | 12 | 0 | gb105allp | ribsomal protein S19 |
| 700614221H1 | g181840 | 4 | 7 | gb105allp | phosphatase tyrosine/serine |
| 700614087H1 | g2351061 | 14 | −2 | gb105pln | *Arabidopsis thaliana* genomic DNA, chromosome 5, P1 clone: MAF19. |
| 700617168H1 | g168669 | 80 | −48 | gb105pln | Maize 19 kDa zein mRNA, clone cZ19A2, partial cds. |
| 700613220H1 | g2829898 | 12 | −3 | gb105eukp | T26J12.9 |
| 700612811H1 | g1778146 | 26 | 4 | gb105pln | *Zea mays* plastid phosphate/phosphoenolpyruvate translocator precursor (MZPPT1) mRNA, complete cds. |
| 700614749H1 | g473602 | 74 | −29 | gb105pln | *Zea mays* W-22 histone H2A mRNA, complete cds. |
| 700614062H1 | g19852 | 26 | −24 | gb105pln | *N. tabacum* mRNA for cytochrome b5 (partial). |
| 700612649H1 | g496267 | 21 | 9 | gb105pln | *Nicotiana tabacum* GTP-binding protein (Ran-A1) mRNA, complete cds. |
| 700616457H1 | g487296 | 25 | −51 | gb105pln | Rice mRNA EN251, partial sequence. |
| 700461139H1 | g2104956 | 33 | −23 | gb105pln | *Arabidopsis thaliana* immunophilin (FKBP12) mRNA, complete cds. |
| 700614157H1 | g558364 | 80 | −74 | gb105pln | *Z. mays* mRNA for ADP-glucose pyrophosphorylase. |
| 700616088H1 | g498906 | 49 | 4 | gb105eukp | RPL27-5; ribosomal protein L27 homolog |
| 700461170H1 | g218176 | 22 | −19 | gb105pln | Rice mRNA for 21 kd polypeptide. |
| 700612556H1 | g169539 | 40 | −28 | gb105pln | Potato pyrophosphate-fructose 6-phosphate 1-phosphotransferase (PFP) beta-subunit mRNA, complete cds. |
| 700615837H1 | g2459418 | 29 | 4 | gb105eukp | F4P9.12 |
| 700612509H1 | g550543 | 47 | −34 | gb105pln | *A. thaliana* mRNA for ribosomal protein L16. |
| 700617209H1 | g169036 | 39 | −24 | gb105pln | *Pisum sativum* L. aldolase gene, 3' end cds. |
| 700615493H1 | g432368 | 13 | 2 | gb105allp | elongation factor 1 beta |
| 700614530H1 | g166581 | 38 | −17 | gb105pln | *A. thaliana* AAc1 gene encoding actin-1, complete cds. |
| 700613106H1 | g2642434 | 8 | −8 | gb105eukp | T20D16.6; putative Rer1 protein |
| 700617703H1 | g22322 | 45 | 12 | gb105pln | *Z. mays* mRNA for H2B histone (clone cH2B214). |
| 700616770H1 | g217974 | 68 | 3 | gb105eukp | triosephosphate isomerase; EC 5.3.1.1 |
| 700612354H1 | g18140 | 29 | 10 | gb105pln | *C. rubrum* mRNA for light-induced 34 kD protein. |
| 700612745H1 | g603269 | 5 | 0 | gb105eukp | YER036C; Yer036cp |
| 700617914H1 | g22219 | 52 | −21 | gb105pln | *Z. mays* ZSF4C2 gene for 22 kD zein. |
| 700618659H1 | g1850792 | 32 | −9 | gb105pln | *A. thaliana* at11 gene. |
| 700617947H1 | g1513227 | 17 | 2 | gb105pln | *Brassica napus* myo-inositol |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700617229H1 | g22531 | 68 | −35 | gb105pln | 1-phosphate synthase mRNA, complete cds. Zea mays mRNA encoding a zein (clone pZ22.1) |
| 700617205H1 | g1669623 | 27 | −2 | gb105eukp | ribosomal protein L39 |
| 700613175H1 | g218365 | 10 | 14 | gb105pln | Yeast (*Candida tropicalis*) CTPACTA gene for acetoacetyl-CoA thiolase A. |
| 700618021H1 | g22322 | 16 | 5 | gb105pln | Z. mays mRNA for H2B histone (clone cH2B214). |
| 700616082H1 | g2634023 | 33 | −7 | gb105allp | uridylate kinase |
| 700613036H1 | g790507 | 58 | −107 | gb105pln | Z. mays mRNA for 60s acidic ribosomal protein. |
| 700613738H1 | g857577 | 11 | 16 | gb105pln | *Populus tremuloides* caffeoyl-CoA 3-O-methyltransferase mRNA, complete cds. |
| 700615685H1 | g2463334 | 23 | −56 | gb105pln | Oryza sativa mRNA for ribosomal protein S4. |
| 700613395H1 | g1296954 | 33 | 16 | gb105pln | O. sativa mRNA for novel protein, osr40c1. |
| 700615110H1 | g22121 | 27 | 12 | gb105pln | Maize alcohol dehydrogenase 1 gene (Adh1-1F). |
| 700612369H1 | g505135 | 49 | 6 | gb105pln | Rice gene for ferredoxin, complete cds. |
| 700618068H1 | g168500 | 27 | −51 | gb105pln | Maize (*Zea mays*) histone H4 gene (H4C14), complete cds. |
| 700615001H1 | g1665831 | 32 | −24 | gb105eukp | phosphoserine aminotransferase; EC 2.6.1.52 |
| 700617334H1 | g2290399 | 43 | −9 | gb105pln | *Helianthus annuus* stearoyl-ACP desaturase mRNA, complete cds. |
| 700613388H1 | g393400 | 42 | −96 | gb105pln | Z. mays mRNA for alpha-tubulin. |
| 700617389H1 | g168502 | 57 | −75 | gb105pln | Maize (*Zea mays*) histone H4 gene (H4C7), complete cds. |
| 700461278H1 | g468055 | 62 | −47 | gb105pln | Zea mays B73 QM protein mRNA, complete cds. |
| 700618374H1 | g31062 | 15 | 3 | gb105allp | Epstein-Barr virus small RNA associated protein |
| 700614975H1 | g1129084 | 21 | −26 | gb105pln | Wheat mRNA for protein H2A, complete cds, clone wcH2A-3. |
| 700613073H1 | g19852 | 17 | 2 | gb105pln | N. tabacum mRNA for cytochrome b5 (partial). |
| 700616947H1 | g2832708 | 20 | −10 | gb105eukp | T9A21.190; beta-1, 3-glucanase-like protein |
| 700612870H1 | g293890 | 28 | −97 | gb105pln | Zea mays alcohol dehydrogenase 1 (Adh1) gene, exons 4 through 10. |
| 700614172H1 | g2992 | 17 | 12 | gb105pln | Neurospora crassa crp-1 mRNA for ribosomal protein homologous to Yeast cyH2 gene encoding L29. |
| 700612607H1 | g169326 | 24 | −27 | gb105pln | Bean (*P. vulgaris*) NADP-dependent malic enzyme mRNA, complete cds. |
| 700618493H2 | g1519248 | 33 | −25 | gb105pln | Oryza sativa GF14-b protein mRNA, complete cds. |
| 700612781H1 | g2668737 | 29 | 13 | gb105pln | Zea mays translation initiation factor 5A (TIF5A) mRNA, complete cds. |
| 700617476H1 | g2443401 | 18 | −45 | gb105pln | Oryza sativa mRNA for orthophosphate dikinase, complete cds. |
| 700614173H1 | g453188 | 22 | −4 | gb105pln | Z. mays acp mRNA for acyl carrier protein. |
| 700614496H1 | g2662340 | 41 | −56 | gb105pln | Oryza sativa mRNA for EF-1 alpha, complete cds. |
| 700614011H1 | g2191184 | 13 | 1 | gb105eukp | A_TM021B04.4 |
| 700615620H1 | g951323 | 36 | 1 | gb105eukp | pyrophosphatase |
| 700612414H1 | g2583137 | 9 | 1 | gb105eukp | F4L23.32; similar to symbiosis-related protein, 5' partial |
| 700612517H1 | g644492 | 59 | −66 | gb105pln | Corn elongation factor 1alpha gene, complete cds. |
| 700612750H1 | g1388084 | 17 | −2 | gb105eukp | TRX5; thioredoxin h |
| 700615850H1 | g1067106 | 9 | −5 | gb105eukp | ZK757.3 |
| 700617252H1 | g2618731 | 20 | −8 | gb105eukp | IAA21; IAA21 |
| 700616445H1 | g2641211 | 14 | 2 | gb105eukp | histone-like protein |
| 700614027H1 | g1127574 | 12 | 12 | gb105pln | Sorghum bicolor dhurrinase mRNA, nuclear gene encoding chloroplast protein, complete cds. |
| 700617285H1 | g1870199 | 31 | 3 | gb105eukp | ACP; acyl-[acyl-carrier protein] desaturase; EC 1.14.99.6 |
| 700614890H1 | g248336 | 51 | −63 | gb105pln | polyubiquitin [maize, Genomic, 3841 nt]. |
| 700613456H1 | g36146 | 6 | 4 | gb105allp | ribosomal protein S12 |
| 700613957H1 | g927435 | 24 | 6 | gb105allp | sui1 |
| 700614085H1 | g797410 | 33 | 8 | gb105allp | antiquitin = 26 g turgor protein homolog [human, kidney, Peptide, 511 aa] |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700616222H1 | g349211 | 20 | 6 | gb105eukp | ubiquitin conjugating enzyme |
| 700614816H1 | g1323460 | 9 | 1 | gb105eukp | PUP2 |
| 700615955H1 | g218233 | 22 | 1 | gb105pln | Rice mRNA for NDP kinase (T164 gene), partial sequence. |
| 700615955H1 | g1777929 | 37 | −28 | gb105pln | *Saccharum officinarum* nucleoside diphosphate kinase (SoNDPK1) mRNA, complete cds. |
| 700612836H1 | g22528 | 87 | −13 | gb105pln | *Zea mays* mRNA encoding a zein (clone A20). |
| 700616936H1 | g16086 | 18 | 0 | gb105pln | *A. porrum* dnaJ mRNA for DNA J protein (partial). |
| 700612427H1 | g2190558 | 36 | 2 | gb105eukp | F5I14.14; FSI14.14 |
| 700612922H1 | g168797 | 12 | 14 | gb105pln | *Neurospora crassa* ribosomal protein (crp-5) gene, 5' end. |
| 700617004H1 | g1449179 | 16 | −5 | gb105eukp | NtNSF-1; N-ethylmaleimide sensitive fusion protein |
| 700613327H1 | g2842490 | 5 | 4 | gb105eukp | F21O9.160; heat-shock protein |
| 700617006H1 | g437878 | 11 | 0 | gb105allp | mrp S24 gene product |
| 700615109H1 | g20598 | 35 | 8 | gb105pln | *P. miliaceum* mRNA for aspartate aminotransferase (pcAAT2). |
| 700461157H1 | g968901 | 55 | −41 | gb105pln | Rice mRNA for ribosomal protein S8, complete cds. |
| 700615028H1 | g1155262 | 30 | −27 | gb105pln | *Arabidopsis thaliana* eukaryotic release factor 1 homolog (eRF1) mRNA, partial cds. |
| 700613325H1 | g2827513 | 13 | 13 | gb105pln | *Arabidopsis thaliana* DNA chromosome 4, BAC clone F8F16 (ESSAII project). |
| 700613391H1 | g2765836 | 13 | 3 | gb105pln | *Arabidopsis thaliana* mRNA for nitrilase associated protein NAP16kDa. |
| 700614491H1 | g5056 | 24 | −7 | gb105pln | Yeast (*Saccharomyces pombe*) rpgL29 gene for ribosomal protein L29. |
| 700612592H1 | g972261 | 17 | 6 | gb105allp | expressed sequence tag; human homolog |
| 700614274H1 | g387908 | 47 | 12 | gb105pln | *Brassica rapa* S-phase-specific (BIS289) mRNA, complete cds. |
| 700613039H1 | g2353172 | 21 | −8 | gb105pln | *Arabidopsis thaliana* sigma factor 2 (SIG2) mRNA, nuclear gene encoding chloroplast protein, complete cds. |
| 700614120H1 | g16072 | 60 | 2 | gb105pln | *A. mediterranea* zein gene. |
| 700612958H1 | g2511574 | 25 | −1 | gb105eukp | prc3; multicatalytic endopeptidase; EC 3.4.99.46 |
| 700613159H1 | g167535 | 24 | −35 | gb105pln | *Cucumis sativus* stearoyl-acyl-carrier protein (stearoyl-ACP) desaturase mRNA, complete cds. |
| 700614047H1 | g169976 | 14 | −9 | gb105pln | *Glycine max* glyoxysomal malate dehydrogenase mRNA, 3' end. |
| 700616601H1 | g22144 | 30 | −77 | gb105pln | Maize anaerobically regulated gene for fructose bisphosphate aldolase (EC 4.1.2.13). |
| 700613972H1 | g203490 | 23 | 2 | gb105allp | ATP citrate-lyase |
| 700617451H1 | g1321660 | 33 | −36 | gb105pln | Rice mRNA for ascorbate peroxidase, complete cds. |
| 700612444H1 | g2316016 | 36 | 1 | gb105eukp | MRP-like ABC transporter |
| 700615971H1 | g2213600 | 29 | 4 | gb105eukp | T7N9.20 |
| 700615775H1 | g1550740 | 73 | −0 | gb105eukp | rab-GDI; GDP-associated inhibitor |
| 700615220H1 | g304668 | 40 | −2 | gb105eukp | ben |
| 700612784H1 | g1841461 | 31 | −19 | gb105pln | *N. tabacum* mRNA for elongation factor 2. |
| 700616880H1 | g431212 | 17 | 4 | gb105eukp | GFA1; glutamine-fructose-6-phosphate aminotransferase; YKL457 |
| 700614129H1 | g168505 | 52 | −12 | gb105pln | *Zea mays* histone H3 gene, complete cds. |
| 700612921H1 | g575291 | 30 | −24 | gb105pln | *H. vulgare* mRNA for SNF1-related protein kinase. |
| 700614386H1 | g5270 | 15 | 5 | gb105allp | p68 protein |
| 700615894H1 | g2653284 | 30 | −25 | gb105pln | *Oryza sativa* mRNA for enoyl-ACP reductase. |
| 700616247H1 | g1154858 | 22 | −1 | gb105pln | *H. vulgare* mRNA for L24 ribosomal protein. |
| 700615886H1 | g1185553 | 31 | −68 | gb105pln | *Zea mays* glyceraldehyde-3-phosphate dehydrogenase (gpc2) gene, complete cds. |
| 700461290H1 | g21800 | 19 | 7 | gb105pln | *T. aestivum* L mRNA for histone H2B. |
| 700612958H1 | g2570504 | 16 | 1 | gb105pln | *Oryza sativa* proteasome component mRNA, complete cds. |
| 700613175H1 | g1542940 | 35 | −32 | gb105pln | *R. sativus* L. (Saxa knacker) AACT mRNA. |
| 700618648H1 | g1041674 | 86 | −53 | gb105pln | *Z. mays* mRNA for V-type H+-ATPase, clone 16-2. |
| 700461124H1 | g468055 | 84 | −72 | gb105pln | *Zea mays* B73 QM protein mRNA, |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | complete cds. |
| 700614281H1 | g2088643 | 9 | −2 | gb105eukp | T28M21.6; transcription factor SF3 isolog |
| 700614072H1 | g20283 | 39 | −33 | gb105pln | Rice (*O. sativa*) gene for proliferating cell nuclear antigen (PCNA). |
| 700613749H1 | g1019903 | 32 | −18 | gb105pln | *Arabidopsis thaliana* cell division cycle protein (CDC48) mRNA, complete cds. |
| 700612912H1 | g22537 | 90 | −30 | gb105pln | Maize mRNA for zein polypeptide (clone M6). |
| 700618219H1 | g1067202 | 13 | 5 | gb105pln | Yeast (*Saccharomyces pombe*) chromosome I cosmid c1F7. |
| 700613736H1 | g540534 | 27 | −16 | gb105pln | Rice mRNA for q group of receptor for activated C-kinase, complete cds. |
| 700612945H1 | g293890 | 68 | −24 | gb105pln | *Zea mays* alcohol dehydrogenase 1 (Adh1) gene, exons 4 through 10. |
| 700617228H1 | g529696 | 16 | 8 | gb105allp | cytosolic dioxin inducible aldehyde dehydrogenase-3 |
| 700616207H1 | g1946373 | 12 | −5 | gb105eukp | T06B20.20 |
| 700612836H1 | g168679 | 90 | −14 | gb105pln | Maize 19 kDa zein mRNA, clone cZ19C2, complete cds. |
| 700614294H1 | g22525 | 41 | −3 | gb105pln | *Zea mays* gene encoding a zein (clone zA1). |
| 700613285H1 | g644491 | 27 | −66 | gb105pln | Corn mRNA for elongation factor 1A. |
| 700616374H1 | g2656026 | 10 | 7 | gb105pln | *Arabidopsis thaliana* genomic DNA, chromosome 5, P1 clone: MDF20. |
| 700613965H1 | g2623783 | 21 | 6 | gb105eukp | glu1; glucanase |
| 700615525H1 | g2317728 | 16 | 9 | gb105pln | *Arabidopsis thaliana* reversibly glycosylated polypeptide-1 (AtRGP) mRNA, complete cds. |
| 700616426H1 | g168492 | 47 | −39 | gb105pln | Corn histone H3 (H3C3) gene, complete cds. |
| 700615056H1 | g1064931 | 10 | −4 | gb105eukp | cyclin A-like protein |
| 700613368H1 | g1171428 | 25 | 13 | gb105pln | *Arabidopsis thaliana* transcription factor CKC mRNA, complete cds. |
| 700617442H1 | g310932 | 24 | −4 | gb105pln | *Nicotiana tabacum* ribosomal protein L17 mRNA, complete cds. |
| 700616770H1 | g556171 | 71 | 3 | gb105eukp | triosephosphate isomerase |
| 700616013H1 | g2198852 | 13 | −14 | gb105pln | *Zea mays* cystathionine gamma-synthase (CGS1) gene, complete cds. |
| 700612865H1 | g2282583 | 59 | −8 | gb105pln | *Zea mays* elongation factor 1-alpha (EF1-A) mRNA, complete cds. |
| 700616225H1 | g1132482 | 47 | −7 | gb105pln | Rice mRNA for ADP-ribosylation factor, complete cds. |
| 700615473H1 | g984184 | 8 | −8 | gb105eukp | ARG1; argininosuccinate synthase; EC 6.3.4.5 |
| 700615339H1 | g1403024 | 16 | −4 | gb105eukp | hnRNP protein |
| 700614911H1 | g22144 | 48 | −57 | gb105pln | Maize anaerobically regulated gene for fructose bisphosphate aldolase (EC 4.1.2.13). |
| 700617962H1 | g169702 | 25 | −13 | gb105pln | *Ricinus communis* ATP: pyruvate phosphotransferase (PK-p-alpha) mRNA, complete cds. |
| 700612339H1 | g228 | 25 | 1 | gb105allp | NADH dehydrogenase (ubiquinone) 42 kDa subunit |
| 700615185H1 | g217973 | 26 | −59 | gb105pln | *Zea mays* gene for triosephosphate isomerase, complete cds. |
| 700461244H1 | g436782 | 26 | −19 | gb105pln | Rice mRNA for cyc07, complete cds. |
| 700615083H1 | g17645 | 19 | −3 | gb105allp | RIBOSOMAL PROTEIN L35a |
| 700617116H1 | g217845 | 33 | −2 | gb105eukp | ATS1; glycerol-3-phosphate acyltransferase; EC 2.3.1.15 |
| 700612461H1 | g433219 | 60 | −22 | gb105pln | Rice mRNA for mitochondrial processing peptidase (gene name SS656), partial cds. |
| 700617931H1 | g2599360 | 22 | 6 | gb105allp | RNA helicase p68 |
| 700617068H1 | g22748 | 14 | 0 | gb105eukp | actin depolymerization; actin depolymerizing factor |
| 700614034H1 | g2529229 | 74 | −4 | gb105eukp | gnd; 6-phosphogluconate dehydrogenase; EC 1.1.1.44 |
| 700612928H1 | g1638836 | 19 | 15 | gb105pln | *H. vulgare* mRNA for alpha-tubulin 2. |
| 700617322H1 | g2244898 | 37 | −0 | gb105eukp | strong similarity to protein phosphatase 2A regulatory chain, 74K |
| 700618652H1 | g218000 | 18 | 3 | gb105pln | Potato mRNA for UDP-glucose pyrophosphorylase (EC 2.7.7.9). |
| 700616380H1 | g20355 | 34 | −19 | gb105pln | Rice rgp1 mRNA for a ras-related GTP-binding protein. |
| 700615023H1 | g498739 | 59 | −24 | gb105pln | *H. vulgare* (pMaW22) mRNA for beta-ketoacyl-ACP synthase. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700614951H1 | g168698 | 18 | −83 | gb105pln | *Z. mays* zein mRNA, complete cds. |
| 700613212H1 | g577824 | 69 | −59 | gb105pln | *Z. mays* gene for H2B histone (gH2B3). |
| 700617159H1 | g10399 | 17 | 6 | gb105allp | ald orfU protein (AA 1-190) |
| 700614760H1 | g550444 | 10 | 6 | gb105eukp | 58 kDa phosphoprotein |
| 700614950H1 | g170463 | 28 | −5 | gb105pln | Tomato (*L. esculentum*) H+-ATPase (LHA1) mRNA, complete cds. |
| 700617475H1 | g170746 | 13 | −16 | gb105pln | Wheat histone H4 TH091 gene, complete cds. |
| 700617068H1 | g1408471 | 20 | −6 | gb105eukp | ADF1; actin depolymerizing factor 1 |
| 700614937H1 | g561663 | 58 | −21 | gb105pln | Rice mRNA, partial homologous to ribosomal protein coding sequence. |
| 700615114H1 | g2738749 | 36 | 11 | gb105pln | *Zea mays* ATP sulfurylase mRNA, complete cds. |
| 700615050H1 | g487286 | 46 | −1 | gb105pln | Rice mRNA EN053, partial sequence. |
| 700614707H1 | g37261 | 37 | −14 | gb105allp | precursor polypeptide (AA −21 to 782) |
| 700614984H1 | g2760167 | 11 | 12 | gb105pln | *Arabidopsis thaliana* genomic DNA, chromosome 5, P1 clone: MCO15, complete sequence. |
| 700613827H1 | g2642159 | 88 | −0 | gb105eukp | T5I7.7; putative mannose-1-phosphate guanyltransferase |
| 700617079H1 | g484241 | 21 | −15 | gb105eukp | rpL37B; ribosomal protein L37 |
| 700613251H1 | g440094 | 14 | −4 | gb105pln | *Arabidopsis thaliana* ribosomal protein S15a, complete cds. |
| 700615918H1 | g2570118 | 17 | 7 | gb105pln | *S. latifolia* mRNA, clone CCLS 17. |
| 700616839H1 | g168673 | 65 | −53 | gb105pln | Maize 19 kDa zein mRNA, clone cZ19B1, complete cds. |
| 700616427H1 | g1675393 | 29 | −51 | gb105pln | *Oryza sativa* class III ADH enzyme (AdhIII) gene, complete cds. |
| 700618353H1 | g169802 | 11 | 17 | gb105pln | Rice oryzacystatin-II mRNA, complete cds. |
| 700617474H1 | g1799607 | 8 | 0 | gb105allp | METHIONYL-TRNA FORMYLTRANSFERASE (EC 2.1.2.9). |
| 700614940H1 | g747914 | 64 | −84 | gb105pln | *Z. mays* CaM1 mRNA for calmodulin. |
| 700615850H1 | g1167810 | 9 | −6 | gb105eukp | T22B3.2 |
| 700616307H1 | g436032 | 21 | −3 | gb105eukp | 60S ribosomal protein L34 |
| 700615918H1 | g825783 | 17 | 7 | gb105pln | *Nicotiana tabacum* ribosomal protein L41 mRNA, complete cds. |
| 700614188H1 | g2431768 | 35 | 6 | gb105pln | *Zea mays* acidic ribosomal protein P1a (rpp1a) mRNA, complete cds. |
| 700461206H1 | g2829910 | 13 | 6 | gb105eukp | F22K20.5 |
| 700615110H1 | g293894 | 27 | 11 | gb105pln | *Zea mays* alcohol dehydrogenase 1 (Adh1) gene, exons 4 through 10. |
| 700614823H1 | g495021 | 26 | −7 | gb105eukp | DebB; membrane-associated protein |
| 700613214H1 | g312178 | 41 | −51 | gb105pln | *Z. mays* GapC2 gene. |
| 700461156H1 | g515376 | 61 | −47 | gb105pln | *L. temulentum* mRNA for histone H4. |
| 700616685H1 | g168679 | 49 | 1 | gb105pln | Maize 19 kDa zein mRNA, clone cZ19C2, complete cds. |
| 700616274H1 | g410509 | 23 | −18 | gb105pln | Yeast (*Saccharomyces cerevisiae*) CIM5 gene for putative ATPase. |
| 700613152H1 | g642133 | 17 | −6 | gb105pln | *Arabidopsis thaliana* AME3 mRNA for protein kinase, complete cds. |
| 700613723H1 | g168527 | 55 | −46 | gb105pln | Maize NADP-dependent malic enzyme (Me1) mRNA, complete cds. |
| 700617427H1 | g169537 | 22 | −7 | gb105pln | Potato pyrophosphate-fructose 6-phosphate 1-phosphotransferase (PFP) alpha-subunit mRNA, complete cds. |
| 700615046H1 | g168722 | 78 | −96 | gb105pln | *Z. mays* protein phosphatase-1 (ZmPP1) mRNA, complete cds. |
| 700614956H1 | g559557 | 4 | 7 | gb105eukp | AGP; arabinogalactan-protein |
| 700613192H1 | g2829927 | 13 | −2 | gb105eukp | F22K20.7 |
| 70a615834H1 | g168527 | 45 | −68 | gb105pln | Maize NADP-dependent malic enzyme (Me1) mRNA, complete cds. |
| 700617931H1 | g8444 | 24 | 5 | gb105eukp | Rm62 |
| 700616387H1 | g168683 | 30 | −29 | gb105pln | Maize 22 kd (Mw = 26.53 kd) zein protein 1, mRNA. |
| 700461113H1 | g960356 | 49 | −36 | gb105pln | Barley mRNA for S-adenosylmethionine synthetase, complete cds. |
| 700613432H1 | g2213602 | 22 | −5 | gb105eukp | T7N9.22 |
| 700614704H1 | g790507 | 81 | −80 | gb105pln | *Z. mays* mRNA for 60S acidic |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | ribosomal protein. |
| 700615879H1 | g22312 | 48 | −74 | gb105pln | Maize ABA-inducible gene for glycine-rich protein (ABA = abscisic acid). |
| 700614042H1 | gi209700 | 23 | −21 | gb105pln | *Zea mays* ribosomal protein L12 mRNA, complete cds. |
| 700613406H1 | g168425 | 12 | 10 | gb105pln | *Zea mays* brittle-1 protein (bt1) mRNA, complete cds. |
| 700461244H1 | g217902 | 18 | 8 | gb105pln | *C. roseus* (periwinkle) cyc07 gene. |
| 700617757H1 | g296203 | 63 | −51 | gb105pln | *P. miliaceum* mRNA for alanine aminotransferase. |
| 700615952H1 | g387908 | 43 | −1 | gb105pln | *Brassica rapa* S-phase-specific (BIS289) mRNA, complete cds. |
| 700617252H1 | g1711205 | 19 | −6 | gb105eukp | IAA23; IAA23 |
| 700614222H1 | g1052524 | 8 | 4 | gb105eukp | SPAC12G12.06c; unknown |
| 700615486H1 | g168512 | 92 | −1 | gb105pln | Maize major protein (L3) mRNA from the surface of lipid bodies, 3' end. |
| 700612837H1 | g1568635 | 69 | −1 | gb105eukp | host cell receptor involved in nuclear import of Agrobacterium VirD2 protein; AtKAP alpha |
| 700617787H1 | g2462745 | 14 | 0 | gb105allp | Hypothetical protein |
| 700612372H1 | g2351064 | 14 | 14 | gb105pln | *Arabidopsis thaliana* genomic DNA, chromosome 5, P1 clone: MDJ22. |
| 700612802H1 | g600764 | 45 | 2 | gb105pln | *Oryza sativa* cyclophilin 1 (Cyp1) mRNA, complete cds. |
| 700612336H1 | g1546918 | 74 | −21 | gb105pln | *Z. mays* mRNA for translation initiation factor 5A. |
| 700617191H1 | g1276933 | 55 | −13 | gb105pln | *Zea luxurians* Doebley M111 ITS1, 5.8S ribosomal RNA, ITS2. |
| 700617954H1 | g21802 | 10 | 6 | gb105pln | *T. aestivum* mRNA for high mobility group protein (HMGW). |
| 700616465H1 | g577824 | 51 | −19 | gb105pln | *Z. mays* gene for H2B histone (gH2B3). |
| 700612796H1 | g2196671 | 69 | 2 | gb105pln | *Z. mays* mRNA for HMG protein. |
| 700613639H1 | g493052 | 14 | 1 | gb105pln | *Brassica juncea* putative protein kinase C inhibitor mRNA, partial cds. |
| 700614813H1 | g1143499 | 60 | −26 | gb105pln | *H. vulgare* mRNA for ADP-glucose pyrophosphorylase small subunit. |
| 700612364H1 | g22149 | 100 | −15 | gb105pln | *Z. mays* mRNA for alpha-tubulin 3. |
| 700613783H1 | g2896 | 18 | 14 | gb105pln | Yeast (*Kluyveromyces lactis*) RP59 gene (CRY1) for ribosomal protein 59. |
| 700615059H1 | g644491 | 84 | −51 | gb105pln | Corn mRNA for elongation factor 1A. |
| 700616508H1 | g2408027 | 48 | −0 | gb105eukp | SPAC17G6.14c; atp-dependent rna helicase |
| 700616766H1 | g168700 | 85 | −24 | gb105pln | *Z. mays* zein mRNA, complete cds. |
| 700616222H1 | g388207 | 20 | 6 | gb105eukp | Ubc; ubiquitin carrier protein |
| 700612306H1 | g829147 | 100 | −34 | gb105pln | *Z. mays* gene for cyclophilin. |
| 700616696H1 | g289616 | 9 | 8 | gb105eukp | C02F5.9 protein |
| 700616407H1 | g804655 | 10 | 14 | gb105pln | *Hordeum vulgare* L. beta-glucosidase (BGQ60) gene, complete cds. |
| 700615445H1 | g1675393 | 24 | −36 | gb105pln | *Oryza sativa* class III ADH enzyme (AdhIII) gene, complete cds. |
| 700612745H1 | g695169 | 11 | −13 | gb105eukp | unknown |
| 700616444H1 | g2618688 | 27 | −41 | gb105eukp | T32G6.5; putative esterase D |
| 700615930H1 | g1019946 | 24 | 6 | gb105eukp | ascorbate peroxidase |
| 700615872H1 | g22526 | 96 | −27 | gb105pln | *Zea mays* mRNA encoding a zein (clone zA1). |
| 700613182H1 | g2626742 | 48 | −31 | gb105pln | Glycine max mRNA for phosphoenolpyruvate carboxylase, complete cds, clone: GmPEPC7. |
| 700614870H1 | g2244950 | 21 | −13 | gb105pln | *Arabidopsis thaliana* DNA chromosome 4, ESSA I contig fragment No. 5. |
| 700616951H1 | g433641 | 12 | 2 | gb105eukp | E167 |
| 700616014H1 | g536891 | 39 | −16 | gb105pln | Wheat mRNA for protein H2A, complete cds, clone wcH2A-4. |
| 700616442H1 | g1296954 | 17 | −18 | gb105pln | *O. sativa* mRNA for novel protein, osr40cl. |
| 700618434H2 | g2274990 | 46 | −71 | gb105pln | *Hordeum vulgare* mRNA for expressed sequence tag. |
| 700617202H1 | g168683 | 18 | −7 | gb105pln | Maize 22 kd (Mw = 26.53 kd) zein protein 1, mRNA. |
| 700615050H1 | g1132482 | 32 | −7 | gb105pln | Rice mRNA for ADP-ribosylation factor, complete cds. |
| 700616290H1 | g22528 | 73 | −73 | gb105pln | *Zea mays* mRNA encoding a zein (clone A20). |
| 700613245H1 | g1053058 | 18 | −22 | gb105pln | *Triticum aestivum* histone H3 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | gene, partial cds, clone W2. |
| 700614742H1 | g1699027 | 39 | −21 | gb105allp | nuclear corepressor KAP-1 |
| 700618636H1 | g1322467 | 17 | −5 | gb105eukp | SCL1 |
| 700616545H1 | g976256 | 65 | −9 | gb105pln | Rice mRNA stearyl-ACP desaturase, complete cds. |
| 700612520H1 | g871505 | 48 | −39 | gb105pln | *P. sativum* mRNA for small GTP-binding protein (clone pGTP11). |
| 700615505H1 | g1008297 | 19 | −9 | gb105eukp | CCT7 |
| 700615220H1 | g546724 | 40 | −2 | gb105eukp | ben |
| 700613760H1 | g602605 | 35 | −60 | gb105pln | *Zea mays* tandem genes for alpha1-tubulin and alpha2-tubulin. |
| 700615157H1 | g975887 | 39 | 12 | gb105pln | *Mesembryanthemum crystallinum* myo-inositol-1-phosphate synthase mRNA, complete cds. |
| 700614985H1 | g2262170 | 14 | 0 | gb105eukp | F5J6.15; predicted glycosyl hydrolase |
| 700614944H1 | g170205 | 48 | −61 | gb105pln | *N. plumbaginifolia* H+-translocating ATPase mRNA. |
| 700614856H1 | g428999 | 36 | −40 | gb105pln | Rice mRNA for ribosomal protein L18a (gene name SS128), partial cds. |
| 700615572H1 | g19280 | 31 | −12 | gb105pln | *L. escuientum* mRNA for enolase. |
| 700612457H1 | g483431 | 32 | 2 | gb105eukp | T151; cyc07 |
| 700618222H1 | g2293565 | 32 | −32 | gb105pln | *Oryza sativa* ADP-ribosylation factor 1 (Os-ARF1) mRNA, complete cds. |
| 700615950H1 | g303856 | 25 | 14 | gb105pln | Rice mRNA for ubiquitin protein fused to a ribosomal protein, complete cds. |
| 700614534H1 | g1553130 | 37 | −18 | gbi0spln | *Gossypium hirsutum* ribosomal protein L44 isoform b (RL44), complete cds. |
| 700612637H1 | g10399 | 28 | 3 | gb105eukp | ald orfU protein (AA 1-190) |
| 700617322H1 | g2160694 | 37 | −0 | gb105eukp | AtB 'gamma; B' regulatory subunit of PP2A |
| 700616392H1 | g22614 | 39 | −73 | gb105pln | *S. vulgare* pepC gene for PEP carboxylase. |
| 700615779H1 | g1419369 | 25 | −7 | gb105pln | *Z. mays* ZmABP3 mRNA for actin depolymerizing factor. |
| 700616939H1 | g22537 | 59 | −89 | gb105pln | Maize mRNA for zein polypeptide (clone M6). |
| 700612932H1 | g1360574 | 29 | 6 | gb105eukp | SMD3 |
| 700616539H1 | g313770 | 25 | 4 | gb105eukp | Uch; ubiquitin carboxyl terminal hydrolase |
| 700614321H1 | g313759 | 69 | −35 | gb105pln | *Z. mays* hsp 70-1 gene for heat shock protein 70. |
| 700612382H1 | g2583120 | 60 | 3 | gb105allp | putative receptor-like protein kinase |
| 700461290H1 | g577824 | 16 | 15 | gb105pln | *Z. mays* gene for H2B histone (gH2B3). |
| 700615374H1 | g1335198 | 55 | 6 | gb105allp | pot. ORF III |
| 700612378H1 | g168673 | 92 | −19 | gb105pln | Maize 19 kDa zein mRNA, clone cZ19B1, complete cds. |
| 700617175H1 | g168512 | 51 | −24 | gb105pln | Maize major protein (L3) mRNA from the surface of lipid bodies, 3' end. |
| 700617094H1 | g22485 | 75 | −22 | gb105pln | Maize mRNA for sucrose synthase (EC 2.4.1.13). |
| 700612711H1 | g19280 | 26 | −42 | gb105pln | *L. esculentum* mRNA for enolase. |
| 700613383H1 | g927239 | 5 | 5 | gb105allp | globulin1 |
| 700612837H1 | g2154717 | 66 | −0 | gb105eukp | Kap alpha protein |
| 700616172H1 | g1835728 | 28 | 2 | gb105pln | *Oryza sativa* ribosomal protein mRNA, complete cds. |
| 700612905H1 | g1208445 | 20 | −29 | gb105pln | Rice (YK426) mRNA, complete cds. |
| 700616886H1 | g530287 | 38 | −5 | gb105eukp | R74.6 |
| 700613790H1 | g2443401 | 23 | −31 | gb105pln | *Oryza sativa* mRNA for orthophosphate dikinase, complete cds. |
| 700618530H1 | g2443856 | 48 | −105 | gb105pln | *Zea mays* vacuolar sorting receptor homolog mRNA, partial cds. |
| 700618250H1 | g2388580 | 15 | −3 | gb105eukp | YUP8H12.22 |
| 700616105H1 | g218112 | 30 | −60 | gb105pln | Rice mRNA for ribosomal protein L41 (340 gene), partial sequence. |
| 700612731H1 | g297877 | 17 | −16 | gb105pln | *A. thaliana* UBC10 mRNA for ubiquitin conjugating enzyme homolog. |
| 700614010H1 | g1167963 | 32 | −8 | gb105eukp | 18-56 protein |
| 700616723H1 | g1149571 | 11 | −1 | gb105eukp | mitochondrial elongation factor Tu |
| 700614776H1 | g1518113 | 26 | −8 | gb105eukp | SLL2 |
| 700613746H1 | g1177347 | 22 | −8 | gb105pln | Yeast (*Saccharomyces pombe*) chromosome I cosmid 26A3. |
| 700613464H1 | g2827001 | 66 | −12 | gb105pln | *Triticum aestivum* 70 kDa heat |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | shock protein (TaHSP70d) mRNA, complete cds. |
| 700618089H1 | g968901 | 27 | 17 | gb105pln | Rice mRNA for ribosomal protein S8, complete cds. |
| 700617546H1 | g899609 | 14 | −40 | gb105pln | *Zea mays* acidic ribosomal protein P2 (RPA-2A1) mRNA, complete cds. |
| 700613116H1 | g1864000 | 41 | 10 | gb105pln | Maize DNA for Fd III, complete cds. |
| 700615361H1 | g396230 | 32 | −31 | gb105eukp | putative ATP synthase subunit |
| 700614144H1 | g1272684 | 54 | 4 | gb105pln | *Z. mays* mRNA for acetyl CoA carboxylase (partial). |
| 700617352H1 | g29507 | 19 | 7 | gb105allp | general transcription factor |
| 700612970H1 | g971284 | 8 | 3 | gb105allp | ribosomal protein S31 |
| 700615091H1 | g473986 | 14 | −18 | gb105pln | Rice mRNA, partial homologous to histone H2B gene. |
| 700616556H1 | g426441 | 42 | −1 | gb105pln | Rice mRNA for thioredoxin h, complete cds. |
| 700618252H1 | g435456 | 23 | 3 | gb105pln | Proso millet gene for aspartate aminotransferase, complete cds. |
| 700617611H1 | g463151 | 57 | −47 | gb105pln | *Zea mays* high sulfur zein gene, complete cds. |
| 700616412H1 | g1154953 | 13 | −11 | gb105pln | *T. aestivum* histone H2A gene. |
| 700614904H1 | g7353 | 31 | 7 | gb105eukp | rp1024 protein |
| 700612427H1 | g1022807 | 38 | 2 | gb105allp | cellulase |
| 700613059H1 | g2623247 | 15 | −3 | gb105pln | *Zea mays* SU1 isoamylase (sugary1) gene, complete cds. |
| 700615441H1 | g886679 | 16 | −19 | gb105eukp | LeUBC1; ubiquitin conjugating enzyme |
| 700615082H1 | g20355 | 28 | −2 | gb105pln | Rice rgp1 mRNA for a ras-related GTP-binding protein. |
| 700614547H1 | g488491 | 19 | 0 | gb105allp | protein 2 |
| 700613721H1 | g1245452 | 15 | 11 | gb105pln | *Medicago sativa* 3-deoxy-D-arabino-heptulosonate 7-phosphate synthase (MsDHS1) mRNA, partial cds. |
| 700617274H1 | g1655480 | 40 | −3 | gb105eukp | gamma subunit of mitochondrial F1-ATPase |
| 700616996H1 | g309670 | 41 | −5 | gb105pln | Pea chloroplast glyceraldehyde-3-phosphate dehydrogenase (Gpb1) gene, complete cds. |
| 700612460H1 | g868003 | 72 | −4 | gb105eukp | a member for glyoxylate cycle; aconitase; EC 4.2.1.3 |
| 700615971H1 | g2392895 | 51 | −2 | gb105eukp | BRI1; brassinosteroid insensitive 1 |
| 700613108H1 | g168527 | 69 | −78 | gb105pln | Maize NADP-dependent malic enzyme (Me1) mRNA, complete cds. |
| 700461278H1 | g575354 | 57 | −43 | gb105pln | *O. sativa* SC34 mRNA for tumor suppressor. |
| 700615215H1 | g1053056 | 13 | −27 | gb105pln | *Triticum aestivum* histone H3 gene, partial cds, clone W1. |
| 700613478H1 | g1136574 | 22 | −21 | gb105pln | Sorghum bicolor heat shock protein 70 (hsp70) pseudogene. |
| 700616915H1 | g1019691 | 6 | 3 | gb105eukp | CDC8 |
| 700615867H1 | g1166431 | 13 | −3 | gb105eukp | Acl1;C1-g1; acyl carrier protein |
| 700616722H1 | g473992 | 11 | −2 | gb105pln | Rice mRNA, sequence homologous to ADP-ribosylation factor gene. |
| 700613915H1 | g1665767 | 30 | 5 | gb105allp | Similar to Human KIAA0188 protein |
| 700616524H1 | g1573781 | 39 | 5 | gb105allp | acetyl coenzyme A acetyltransferase (thiolase) (fadA) |
| 700618673H1 | g1435156 | 28 | −18 | gb105pln | *L. esculentum* mRNA for histone H3 variant H3.3. |
| 700612557H1 | g2641637 | 34 | −19 | gb105pln | *Arabidopsis thaliana* DnaJ homolog AtJ3 (ATJ3) gene, complete cds. |
| 700616407H1 | g1143863 | 24 | −13 | gb105pln | *Oryza sativa* beta-glucosidase mRNA, nuclear gene encoding chloroplast protein, complete cds. |
| 700615505H1 | g2104461 | 30 | −15 | gb105eukp | cct7; Cct7p |
| 700613393H1 | g22469 | 23 | 14 | gb105pln | Maize mRNA for cytoplasmic ribosomal protein S11. |
| 700618372H1 | g1839582 | 20 | 9 | gb105pln | polyubiquitin homolog {clone CHEM 6} [*Zea mays* = maize, cv. INRA 258, mercuric chloride-treated, leaves, mRNA Partial, 199 nt, segment 1 of 2]. |
| 700617271H1 | g881615 | 52 | −15 | gb105eukp | Fae1; the condensing enzyme of the fatty acid elongase complex that converts C18 fatty acids to C20 and C22 fatty acids; substrates for the reaction are oleoyl-CoA and malonyl-CoA; fatty acid elongase 1 |
| 700616009H1 | g168677 | 89 | −107 | gb105pln | Maize 19 kDa zein mRNA, clone cZ19C1, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700613195H1 | g415314 | 30 | −16 | gb105pln | Rice mRNA for NADP dependent malic enzyme, complete cds. |
| 700614983H1 | g407800 | 29 | 10 | gb105pln | *G. hirsutum* mRNA for ribosomal protein 41, large subunit (RL41). |
| 700614467H1 | g2814379 | 24 | 0 | gb105eukp | B0513.3 |
| 700613749H1 | g1669659 | 32 | −18 | gb105pln | *C. annuum* mRNA for CDC48p-like protein. |
| 700614975H1 | g1129085 | 20 | −26 | gb105pln | Wheat mRNA for protein H2A, complete cds, clone wcH2A-9. |
| 700616541H1 | g2739216 | 40 | 4 | gb105pln | *Hordeum vulgare* L41 ribosomal protein. |
| 700614245H1 | g600709 | 13 | 7 | gb105pln | *Arabidopsis thaliana* synaptobrevin-related protein (SAR1) mRNA, complete cds. |
| 700616290H1 | g168677 | 72 | −78 | gb105pln | Maize 19 kDa zein mRNA, clone cZ19C1, complete cds. |
| 700615388H1 | g2687430 | 57 | −104 | gb105pln | *Acorus gramineus* large subunit 26S ribosomal RNA gene, partial sequence. |
| 700461205H1 | g1928865 | 44 | −32 | gb105pln | *Triticum aestivum* root abundant protein mRNA, complete cds. |
| 700614766H1 | g2739376 | 22 | 6 | gb105eukp | T9J22.18; putative permease |
| 700614067H1 | g886739 | 33 | 11 | gb105pln | *Z. mays* histone H4 gene. |
| 700614059H1 | g2760169 | 12 | 10 | gb105pln | *Arabidopsis thaliana* genomic DNA, chromosome 5, P1 clone: MFB13, complete sequence. |
| 700614014H1 | g289212 | 34 | −41 | gb105pln | *Atriplex nummularia* homologous sequence (ANJ1) mRNA. |
| 700613790H1 | g168579 | 29 | −44 | gb105pln | Maize pyruvate, orthophosphate dikinase mRNA, complete cds. |
| 700617339H1 | g168502 | 46 | −58 | gb105pln | Maize (*Zea mays*) histone H4 gene (H4C7), complete cds. |
| 700613009H1 | g1771158 | 6 | 5 | gb105eukp | MFP1; MFP1 protein |
| 700613145H1 | g736271 | 53 | −74 | gb105pln | *O. sativa* hsp70 gene for heat shock protein 70. |
| 700618259H1 | g1553130 | 24 | −8 | gb105pln | *Gossypium hirsutum* ribosomal protein L44 isoform b (RL44), complete cds. |
| 700614810H1 | g1419369 | 24 | −22 | gb105pln | *Z. mays* ZmABP3 mRNA for actin depolymerizing factor. |
| 700612741H1 | g168500 | 43 | −36 | gb105pln | Maize (*Zea mays*) histone H4 gene (H4C14), complete cds. |
| 700617881H1 | g288058 | 30 | −27 | gb105pln | *Z. mays* S13 mRNA for cytoplasmic ribosomal protein S13. |
| 700615389H1 | g167040 | 50 | −62 | gb105pln | Barley elongation factor 1 alpha, (EF-1A) mRNA sequence. |
| 700614157H1 | g1279512 | 54 | −49 | gb105pln | *H. vulgare* bep1 mRNA for ADP-glucose pyrophosphorylase. |
| 700617786H1 | g2463334 | 23 | −10 | gb105pln | *Oryza sativa* mRNA for ribosomal protein S4. |
| 700614743H1 | g2738247 | 39 | −40 | gb105pln | *Arabidopsis thaliana* cobalamin-independent methionine synthase (ATCIMS) mRNA, complete cds. |
| 700613863H1 | g1272634 | 18 | −7 | gb105eukp | K07C5.4 |
| 700614250H1 | g1147608 | 11 | 11 | gb105pln | Yeast (*Saccharomyces cerevisiae*) chromosome XVI, left arm, cosmid 8204. |
| 700616978H1 | g169036 | 16 | 6 | gb105pln | *P. sativum* L. aldolase gene, 3' end cds. |
| 700613972H1 | g1749596 | 23 | 2 | gb105allp | similar to Rat ATP citrate-lyase, SWISS-PROT Accession Number P16638 |
| 700615233H1 | g2213425 | 21 | 7 | gb105eukp | unknown; hypothetical protein |
| 700617421H1 | g456211 | 29 | −23 | gb105pln | *S. tuberosum* mRNA for 60S ribosomal protein L27. |
| 700618495H2 | g2505940 | 13 | 6 | gb105allp | 26S proteasome, non-ATPase subunit |
| 700617787H1 | g2194119 | 9 | 7 | gb105allp | No definition line found |
| 700616743H1 | g474001 | 24 | 5 | gb105pln | Rice mRNA, partial homologous to ribosomal protein L38 gene. |
| 700616962H1 | g2641198 | 19 | 3 | gb105pln | *Fritillaria agrestis* acyl-CoA-binding protein (acabp) mRNA, complete cds. |
| 700616390H1 | g450548 | 52 | −35 | gb105pln | *O. sativa* (pRSAM-1) gene for S-adenosyl methionine synthetase. |
| 700616418H1 | g172795 | 6 | 1 | gb105eukp | SUP46; 40S small subunit ribosomal protein; ribosomal protein S13 |
| 700616011H1 | g975887 | 52 | −60 | gb105pln | *Mesembryanthemum crystallinum* myo-inositol-1-phosphate synthase mRNA, complete cds. |
| 700614211H1 | g293885 | 34 | −13 | gb105pln | *Zea diploperennis* alcohol dehydrogenase 1 (Adh1) gene, exons 4 through 10. |
| 700613639H1 | g429001 | 17 | −15 | gb105pln | Rice mRNA for photosystem II D1 protein (gene name SS246), partial cds. |
| 700618214H1 | g1050430 | 4 | −0 | gb105eukp | snRNP protein; |

TABLE 1-continued

LIST OF INCYTE CLONES DERIVED FROM SATMON022023
COPYRIGHT 1998 INCYTE PHARMACEUTICALS, INC.

| | | | | |
|---|---|---|---|---|
| 700617618H1 | g22149 | 67 | −77 | gb105pln |
| 700616886H1 | g295608 | 14 | 6 | gb105eukp |
| 700614211H1 | g22121 | 35 | −14 | gb105pln |
| 700612828H1 | g1335965 | 68 | −6 | gb105pln |
| 700613036H1 | g899609 | 58 | −107 | gb105pln |
| 700616428H1 | g1143706 | 15 | −19 | gb105pln |
| 700612582H1 | g498904 | 25 | 4 | gb105eukp |
| 700617794H1 | g18053 | 33 | 1 | gb105pln |
| 700617474H1 | g1799612 | 8 | 0 | gb105allp |
| 700612577H1 | g974781 | 53 | −42 | gb105pln |
| 700613729H1 | g984524 | 70 | −63 | gb105pln |
| 700617057H1 | g166687 | 34 | −34 | gb105pln |
| 700613882H1 | g168683 | 100 | −17 | gb105pln |
| 700617383H1 | g168677 | 87 | −5 | gb105pln |
| 700613391H1 | g2765837 | 17 | 4 | gb105eukp |
| 700617108H1 | g290275 | 26 | −10 | gb105eukp |
| 700617438H1 | g387908 | 43 | −40 | gb105pln |
| 700614851H1 | g1052566 | 23 | −17 | gb105pln |
| 700612664H1 | gi272684 | 100 | −31 | gb105pln |
| 700613441H1 | g168679 | 52 | −95 | gb105pln |
| 700617439H1 | g536663 | 20 | −15 | gb105eukp |
| 700616087H1 | g1431310 | 16 | −2 | gb105eukp |
| 700615482H1 | g1001532 | 12 | 1 | gb105allp |
| 700614902H1 | g435469 | 17 | 1 | gb105pln |
| 700618627H1 | g288062 | 26 | −8 | gb105pln |
| 700614359H1 | g157038 | 13 | −0 | gb105eukp |
| 700616402H1 | g1542941 | 37 | −8 | gb105eukp |
| 700616714H1 | g168673 | 37 | −29 | gb105pln |
| 700616223H1 | g1053056 | 34 | −29 | gb105pln |
| 700617006H1 | g337506 | 11 | 0 | gb105allp |
| 700616094H1 | g2435559 | 6 | 1 | gb105eukp |
| 700614993H1 | g644492 | 30 | −40 | gb105pln |
| 700612888H1 | g22537 | 50 | −84 | gb105pln |
| 700613791H1 | g899115 | 20 | −2 | gb105eukp |
| 700617517H1 | g214754 | 28 | 5 | gb105allp |
| 700614919H1 | g415314 | 46 | −67 | gb105pln |
| 700461228H1 | g296204 | 15 | −3 | gb105eukp |
| 700615833H1 | g1143390 | 24 | −18 | gb105eukp |
| 700615242H1 | g2244855 | 9 | 4 | gb105eukp |
| 700614836H1 | g290056 | 34 | 1 | gb105pln |
| 700614715H1 | g456523 | 17 | 8 | gb105allp |
| 700612958H1 | g2570505 | 22 | 0 | gb105eukp |
| 700617764H1 | g2275007 | 28 | −33 | gb105pln |

U1snRNP-specific protein; U1A
Z. mays mRNA for alpha-tubulin 3.
DOM34
Maize alcohol dehydrogenase 1 gene (Adh1-1F).
Zea mays acetyl CoA carboxylase mRNA, partial cds.
Zea mays acidic ribosomal protein P2 (RPA-2A1) mRNA, complete cds.
Z. mays mRNA for homeobox 2b protein.
RPL27-4; ribosomal protein L27 homolog
C. lacryma-jobi L. mRNA for gamma-coixin (22 KDa).
METHIONYL-TRNA FORMYLTRANSFERASE (EC 2.1.2.9).
C. blumei kinetoplast met gene for cobalamine-independent methionine synthase.
Zea mays high-methionine zein DZS18 (dzs18) gene, complete cds.
A. thaliana 3-deoxy-D-arabino-heptulosonate y-phosphate synthase (DHS1) mRNA, complete cds.
Maize 22 kd (Mw = 26.53 kd) zein protein 1, mRNA.
Maize 19 kDa zein mRNA, clone cZ19C1, complete cds.
Nitrilase (EC 3.5.5.1) associated protein 16 kDa; NAP16kDa protein
M(3)95A; multifunctional activity and location; ribosomal protein S3/AP endonuclease DNA repair protein
Brassica rapa S-phase-specific (BIS289) mRNA, complete cds.
C. annuum mRNA for PFTF (plastid fusion and/or translation factor.
Z. mays mRNA for acetyl CoA carboxylase (partial).
Maize 19 kDa zein mRNA, clone cZ19C2, complete cds.
HIS7
UFD2
hypothetical protein
Yeast mRNA for ribosomal protein YS3, complete cds.
A. thaliana mRNA for ketol-acid reductoisomerase subunit
cact; cactus maternal/zygotic protein
AACT; Acetoacetyl-coenzyme A thiolase; EC 2.3.1.9
Maize 19 kDa zein mRNA, clone cZ19B1, complete cds.
Triticum aestivum histone H3 gene, partial cds, clone W1.
ribosomal protein S24
FS2D1.1
Corn elongation factor 1alpha gene, complete cds.
Maize mRNA for zein polypeptide (clone M6).
polyubiquitin
L5a ribosomal protein
Rice mRNA for NADP dependent malic enzyme, complete cds.
pA1aAT-2; alanine aminotransferase; EC 2.6.1.2
HMGS; hydroxymethylglutaryl-CoA synthase; EC 4.1.3.5
hypothetical protein
Dictyostelium discoideum HIV1 TAT-binding protein homologue (TBP1O) mRNA, 3' end.
prolyl endopeptidase
proteasome component
Hordeum vulgare mRNA for

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | expressed sequence tag. |
| 700616614H1 | g2154716 | 36 | −3 | gb105pln | *A. thaliana* mRNA for Kap alpha protein. |
| 700617773H1 | g5a9769 | 10 | 7 | gb105eukp | seed-specific low molecular weight sulfur-rich protein |
| 700614929H1 | g452712 | 13 | −12 | gb105eukp | beta-galactosidase; EC 3.2.1.23 |
| 700615709H1 | g1658312 | 21 | 7 | gb105pln | *O. sativa* osr40g2 gene. |
| 700615930H1 | g2444019 | 21 | 7 | gb105eukp | APX3; ascorbate peroxidase 3 |
| 700618480H2 | g899607 | 46 | −53 | gb105pln | *Zea mays* polyubiquitin (MubC5) mRNA, complete cds. |
| 700615472H1 | g22215 | 20 | 16 | gb105pln | *Z. mays* ZSF4C1 gene for zein. |
| 700613758H1 | g218169 | 21 | −21 | gb105pln | Rice mRNA for acyl carrier protein (KN33 gene), partial sequence. |
| 700615884H1 | g22215 | 50 | −73 | gb105pln | *Z. mays* ZSF4C1 gene for zein. |
| 700615853H1 | g414735 | 25 | 6 | gb105pln | Yeast (*Saccharomyces cerevisiae*) translation elongation factor 2 (EFT2) gene, complete cds. |
| 700614833H1 | g790969 | 27 | −24 | gb105pln | Rice mRNA for aldolase C-1, complete cds. |
| 700618380H1 | g644491 | 45 | −45 | gb105pln | Corn mRNA for elongation factor 1A. |
| 700612968H1 | g168498 | 32 | −62 | gb105pln | Corn histone H4 (H4C13) gene, complete cds. |
| 700618374H1 | g409074 | 15 | 3 | gb105allp | HBp15/L22 |
| 700617357H1 | g22222 | 83 | −14 | gb105pln | *Z. mays* ZSF4C4 gene for zein. |
| 700617194H1 | g2317907 | 54 | −10 | gb105eukp | T7I23.7; Mago Nashi-like protein |
| 700616562H1 | g2267596 | 39 | −50 | gb105pln | *Oryza sativa* 10 kDa chaperonin mRNA, complete cds. |
| 700612575H1 | g1132482 | 34 | −11 | gb105pln | Rice mRNA for ADP-ribosylation factor, complete cds. |
| 700616223H1 | g510910 | 54 | −31 | gb105pln | *L. temulentum* mRNA for histone H3. |
| 700615394H1 | g1154953 | 27 | −46 | gb105pln | *T. aestivum* histone H2A gene. |
| 700618510H1 | g2150130 | 32 | −6 | gb105eukp | cytoplasmic ribosomal protein S15a |
| 700617411H1 | g2150129 | 38 | −34 | gb105pln | *Arabidopsis thaliana* cytoplasmic ribosomal protein S15a mRNA, complete cds. |
| 700615092H1 | g727357 | 9 | −2 | gb105eukp | atj; molecular chaperone; DnaJ homolog |
| 700614676H1 | g1200282 | 14 | −8 | gb105eukp | F48F7.1 |
| 700618152H1 | g303852 | 21 | −48 | gb105pln | Rice mRNA for ribosomal protein L3, complete cds. |
| 700615809H1 | g1100771 | 38 | −5 | gb105allp | glucose-6-phosphate isomerase |
| 7Od616849H1 | g409477 | 7 | 7 | gb105eukp | RNA polymerase |
| 700617936H1 | g1553071 | 28 | 5 | gb105eukp | Damb\Gpdh; glycerolphosphate dehydrogenase; EC 1.1.1.8 |
| 700617007H1 | g218227 | 32 | −22 | gb105pln | Rice mRNA for ras-related GTP binding protein, complete cds. |
| 700613365H1 | g2828182 | 13 | 7 | gb105pln | *Arabidopsis thaliana* genomic DNA, chromosome 5, P1 clone: MOJ9, complete sequence. |
| 700616936H1 | g18259 | 22 | −7 | gb105pln | *C. sativus* mRNA for cs DnaJ-1. |
| 700612754H1 | g168663 | 63 | −2 | gb105pln | Maize sulfur-rich zein protein of Mr 15,000, complete cds. |
| 700612583H1 | g1841307 | 12 | 15 | gb105pln | Fission Yeast mRNA for ribosomal protein S16 homolog, partial cds. |
| 700613054H1 | g1395190 | 40 | −53 | gb105pln | *Spinacia oleracea* L. mRNA for 26S proteasome ATPase subunit, complete cds. |
| 700615071H1 | g2290681 | 9 | −7 | gb105eukp | acidic cellulase |
| 700614931H1 | g2190330 | 20 | −6 | gb105pln | *A. thaliana* EBP mRNA. |
| 700613285H1 | g644492 | 27 | −63 | gb105pln | Corn elongation factor 1alpha gene, complete cds. |
| 700613974H1 | g550021 | 15 | 4 | gb105allp | ribosomal protein S5 |
| 700615822H1 | g577531 | 22 | −5 | gb105eukp | proteasome subunit |
| 700612905H1 | g20726 | 10 | 16 | gb105pln | *P. sativum* GA mRNA (clone F). |
| 700612588H1 | g474009 | 39 | −49 | gb105pln | Rice mRNA, partial homologous to ribosomal protein S19 gene. |
| 700615958H1 | g21800 | 26 | −65 | gb105pln | *T. aestivum* L mRNA for histone H2B. |
| 700616545H1 | g21229 | 52 | −3 | gb105pln | *S. oleracea* mRNA for stearoyl-acyl carrier protein desaturase. |
| 700616479H1 | g482938 | 26 | −23 | gb105eukp | glycolytic enzyme; Pyruvate kinase; plastid isozyme |
| 700616072H1 | g587562 | 7 | 7 | gb105eukp | MPP; mitochondrial processing peptidase |
| 700617609H1 | g2326419 | 38 | −22 | gb105eukp | fzr; mitotic cyclin |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | destruction in postmitotic cells after the terminal mitosis; fizzy-related protein |
| 700617534H1 | g1778146 | 47 | −86 | gb105pln | Zea mays plastid phosphate/phosphoenolpyruvate translocator precursor (MZPPT1) mRNA, complete cds. |
| 700616113H1 | g415316 | 33 | −29 | gb105pln | Rice mRNA for acidic ribosomal protein P0, complete cds. |
| 700615863H1 | g22542 | 87 | −43 | gb105pln | Maize gene for Mr 19000 alpha zein and 5'-flanking region. |
| 700612577H1 | g1814402 | 51 | −39 | gb105pln | Mesembryanthemum crystallinum methionine synthase (MetE) mRNA, complete cds. |
| 700618054H1 | g493052 | 19 | −2 | gb105pln | Brassica juncea putative protein kinase C inhibitor mRNA, partial cds. |
| 700614821H1 | g1513227 | 21 | −24 | gb105pln | Brassica napus myo-inositol 1-phosphate synthase mRNA, complete cds. |
| 700614020H1 | g1335965 | 51 | −76 | gb105pln | Zea mays acetyl CoA carboxylase mRNA, partial cds. |
| 700617263H1 | g2271465 | 18 | 6 | gb105eukp | fae1; 3-ketoacyl-CoA synthase |
| 700616180H1 | g1568510 | 18 | −0 | gb105pln | N. tabacum mRNA for protein phosphatase 2A, 65kD regulatory subunit. |
| 700612623H1 | g1531671 | 20 | −3 | gb105pln | Striga asiatica actin (SA-ACT1) gene, complete cds. |
| 700612347H1 | g2429086 | 22 | −28 | gb105pln | Hordeum vulgare lipoxygenase 2 (LoxC) mRNA, complete cds. |
| 700614944H1 | g218178 | 58 | −74 | gb105pln | Rice OSA1 gene for H+-ATPase, complete cds. |
| 700618395H1 | g1469220 | 8 | 7 | gb105pln | B. oleracea mRNA (unknown) |
| 700461242H1 | g2832242 | 89 | −69 | gb105pln | Zea mays 22-kDa alpha zein gene cluster, complete sequence. |
| 700616696H1 | g577531 | 18 | −30 | gb105eukp | proteasome subunit |
| 700616291H1 | g2791686 | 13 | −6 | gb105allp | histone deacetylase-2; HD-2 |
| 700615987H1 | g2618599 | 23 | −10 | gb105pln | Arabidopsis thaliana genomic DNA, chromosome 5, P1 clone: MBD2, complete sequence. |
| 700612637H1 | g172795 | 24 | 5 | gb105eukp | SUP46; 40S small subunit ribosomal protein; ribosomal protein S13 |
| 700613457H1 | g537595 | 21 | −12 | gb105eukp | trifunctional enzyme; methylenetetrahydrofolate dehydrogenase; EC 1.5.1.5 |
| 700615810H1 | g168679 | 49 | −89 | gb105pln | Maize 19 kDa zein mRNA, clone cZ19C2, complete cds. |
| 700617192H1 | g2511530 | 24 | −45 | gb105pln | Eleusine undica alpha tubulin 1 (TUA1) mRNA, complete cds. |
| 700613103H1 | g549983 | 41 | −52 | gb105pln | Pennisetum ciliare possible apospory-associated mRNA clone pSUB C, complete cds. |
| 700616346H1 | g349212 | 57 | −52 | gb105pln | Arabidopsis thaliana ubiquitin conjugating enzyme mRNA, complete cds. |
| 700615054H1 | g2244950 | 20 | −5 | gb105pln | Arabidopsis thaliana DNA chromosome 4, ESSA I contig fragment No. 5. |
| 700618559H1 | g2244950 | 19 | −6 | gb105pln | Arabidopsis thaliana DNA chromosome 4, ESSA I contig fragment No. 5. |
| 700614027H1 | g804655 | 27 | −15 | gb105pln | Hordeum vulgare L. beta-glucosidase (BGQ60) gene, complete cds. |
| 700617508H1 | g1498385 | 38 | −87 | gb105pln | Zea mays actin (Maz87) gene, partial cds. |
| 700616724H1 | g172872 | 14 | −8 | gb105eukp | aspartyl-tRNA synthetase |
| 700616331H1 | g536090 | 8 | 3 | gb105eukp | SHP1 |
| 700614524H1 | g168679 | 76 | −15 | gb105pln | Maize 19 kDa zein mRNA, clone cZ19C2, complete cds. |
| 700613029H1 | g886739 | 23 | −42 | gb105pln | Z. mays histone H4 gene. |
| 700615028H1 | g1495248 | 30 | −26 | gb105pln | A. thaliana mRNA for unknown protein, eRF1-3 gene. |
| 700613126H1 | g18243 | 44 | −45 | gb105pln | C. reinhardtii UBI3 mRNA for ubiquitin-fusion protein (UbCEP52). |
| 700618692H1 | g2244786 | 28 | 6 | gb105allp | ribonucleoprotein homolog |
| 700615213H1 | g2570501 | 19 | −5 | gb105eukp | Ipp; inorganic pyrophosphatase |
| 700612370H1 | g2394227 | 55 | −1 | gb105eukp | LeMSI1; WD-40 repeat protein |
| 700615227H1 | g309071 | 8 | −0 | gb105eukp | RPS7; ribosomal protein S7 |
| 700613222H1 | g1947046 | 10 | 4 | gb105eukp | LjNOD16; late nodulin Nlj16 |
| 700615410H1 | g415314 | 42 | −61 | gb105pln | Rice mRNA for NADP dependent malic enzyme, complete cds. |
| 700617434H1 | g886739 | 45 | −67 | gb105pln | Z. mays histone H4 gene. |
| 700617529H1 | g163432 | 6 | 5 | gb105allp | 2-oxoglutarate/malate carrier protein |
| 700616980H1 | g2465127 | 13 | −3 | gb105eukp | Ole e 1.0102 protein |
| 700616964H1 | g303838 | 36 | −32 | gb105pln | Rice mRNA for 40S subunit ribosomal protein, complete cds. |
| 700616972H1 | g609656 | 29 | −18 | gb105eukp | osmoregulation and cell shape |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | control; protein phosphatase 2C (ptc2+) |
| 700615339H1 | g1044856 | 14 | −3 | gb105eukp | W02B12.3 |
| 700615394H1 | g1129083 | 30 | −30 | gb105pln | Wheat mRNA for protein H2A, complete cds, clone wcH2A-2. |
| 700461147H1 | g434902 | 46 | −21 | gb105eukp | Bap; beta-adaptin Drosophila 1 |
| 700614874H1 | g2218094 | 8 | 3 | gb105allp | sensor protein RssA |
| 700613790H1 | g168584 | 21 | −43 | gb105pln | Corn pyruvate, orthophosphate dikinase gene, exons 2–19. |
| 700613370H1 | g2464923 | 12 | −10 | gb105eukp | 26S proteosome regulatory subunit 8 homolog |
| 700616861H1 | g169296 | 29 | 7 | gb105allp | heat shock protein 83 |
| 700618091H1 | g2623295 | 5 | 7 | gb105allp | hypothetical protein |
| 700617445H1 | g2351064 | 11 | 13 | gb105pln | *Arabidopsis thaliana* genomic DNA, chromosome 5, P1 clone: MDJ22. |
| 700612442H1 | g2065530 | 18 | 15 | gb105pln | *Lycopersicon esculentum* endo-1,4-beta-glucanase (Ce13) mRNA, complete cds. |
| 700617467H1 | g167004 | 9 | 4 | gb105allp | embryo globulin |
| 700616673H1 | g168498 | 17 | 17 | gb105pln | Corn histone H4 (H4C13) gene, complete cds. |
| 700613769H1 | g393400 | 58 | −48 | gb105pln | *Z. mays* mRNA for alpha-tubulin. |
| 700618152H1 | g2315210 | 18 | −29 | gb105pln | *Lycopersicon esculentum* mRNA for proteasome, alpha subunit. |
| 700461132H1 | g1418506 | 37 | −4 | gb105eukp | F18E2.2 |
| 700616737H1 | g407800 | 40 | 8 | gb105pln | *G. hirsutum* mRNA for ribosomal protein 41, large subunit (RL41) |
| 700617427H1 | g483546 | 13 | −7 | gb105pln | *R. communis* gene for pyrophosphate-dependent phosphofructokinase alpha subunit. |
| 700613406H1 | g168426 | 18 | 5 | gb105allp | brittle-1 protein |
| 700617988H1 | g2827888 | 18 | −13 | gb105eukp | clpP; ATP-dependent Clp protease proteolytic subunit |
| 700616316H1 | g2662311 | 30 | −33 | gb105pln | *Hordeum vulgare* mRNA for bpw2, complete cds. |
| 700614060H1 | g1653646 | 31 | −14 | gb105allp | uridine monophosphate kinase |
| 700618149H1 | g168702 | 72 | −2 | gb105pln | Corn 22 kDa zein protein gene, complete cds. |
| 700613158H1 | g1132482 | 40 | −40 | gb105pln | Rice mRNA for ADP-ribosylation factor, complete cds. |
| 700618679H1 | g1498197 | 42 | −32 | gb105pln | *A. thaliana* mRNA for 2-Cys peroxiredoxin bas1. |
| 700615146H1 | g1117958 | 35 | 6 | gb105allp | dihydrolipoamide succinyltransferase |
| 700616205H1 | g2623679 | 43 | −69 | gb105pln | *Zea mays* calmodulin (Zmrcalm) mRNA, complete cds. |
| 700614704H1 | g899609 | 81 | −81 | gb105pln | *Zea mays* acidic ribosomal protein P2 (RPA-2A1) mRNA, complete cds. |
| 700614067H1 | g170746 | 32 | 11 | gb105pln | Wheat histone H4 TH091 gene, complete cds. |
| 700613938H1 | g32532 | 14 | 4 | gb105allp | ribosomal protein s3 |
| 700617750H1 | g168508 | 47 | −3 | gb105pln | Maize oleosin KD18 (KD18; L2) gene, complete cds. |
| 700614474H1 | g293901 | 34 | −28 | gb105pln | *Zea mays* Zea mI gene, complete cds. |
| 700614003H1 | g2113867 | 17 | −6 | gb105allp | rp1D |
| 700617757H1 | g487302 | 30 | −20 | gb105pln | Rice mRNA EN3, partial sequence. |
| 700617045H1 | g168652 | 85 | −62 | gb105pln | Maize amyioplast-specific transit protein (waxy; wx+ locus), complete cds. |
| 700615059H1 | g644492 | 84 | −51 | gb105pln | Corn elongation factor 1alpha gene, complete cds. |
| 700617072H1 | g393400 | 19 | 4 | gb105pln | *Z. mays* mRNA for alpha-tubulin. |
| 700616950H1 | g541748 | 8 | 5 | gb105eukp | AFG3; Afg3p |
| 700613620H1 | g218137 | 32 | 2 | gb105pln | Rice mRNA for S-adenosylmetionine synthetase (AK127 gene), partial sequence. |
| 700615230H1 | g2145476 | 26 | −30 | gb105pln | *T. usneoides* mRNA for phosphoenolpyruvate decarboxylase. |
| 700461295H1 | g1098977 | 10 | 7 | gb105eukp | IMP1; myo-inositol monophosphatase 1 |
| 700615082H1 | g1381675 | 23 | 4 | gb105pln | Glycine max small GTP-binding protein (sra1) mRNA, partial cds. |
| 700613864H1 | g504489 | 11 | −4 | gb105eukp | cleave terminal galactose residue; alpha-galactosidase; EC 3.2.1.22 |
| 700613147H1 | g602252 | 44 | −49 | gb105pln | *Zea mays* enolase (eno2) mRNA, complete cds. |
| 700613158H1 | g556685 | 38 | −39 | gb105pln | *Z. mays* mRNA for ADP-ribosylation factor. |
| 700613231H1 | g303854 | 26 | −17 | gb105pln | Rice mRNA for ribosomal |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | protein L7A, complete cds. |
| 700615778H1 | g21228 | 50 | −0 | gb105eukp | 37 kD inner envelope membrane polypeptide |
| 700612515H1 | g22324 | 40 | −43 | gb105pln | *Z. mays* mRNA for H2B histone (clone cH2B221). |
| 700615857H1 | g1835728 | 12 | 15 | gb105pln | *Oryza sativa* ribosomal protein mRNA, complete cds. |
| 700614833H1 | g168419 | 32 | −40 | gb105pln | Maize (*Z. mays*) aldolase mRNA, complete cds. |
| 700617693H1 | g65024 | 13 | 8 | gb105allp | proteasome beta subunit |
| 700614807H1 | g2760170 | 15 | −8 | gb105pln | *Arabidopsis thaliana* genomic DNA, chromosome 5, P1 clone: MIO24, complete sequence. |
| 700613863H1 | g544506 | 18 | −7 | gb105eukp | SIK1; Sik1p |
| 700612694H1 | g1334399 | 55 | −1 | gb105eukp | cytochrome b |
| 700461175H1 | g968901 | 54 | −38 | gb105pln | Rice mRNA for ribosomal protein S8, complete cds. |
| 700461116H1 | g21800 | 51 | −40 | gb105pln | *T. aestivum* L mRNA for histone H2B. |
| 700612811H1 | g1778148 | 30 | −1 | gb105pln | *Zea mays* plastid phosphate/phosphoenolpyruvate translocator precursor (MZPPT4) mRNA, complete cds. |
| 700612444H1 | g2316022 | 23 | 4 | gb105eukp | MRP-like ABC transporter |
| 700461170H1 | g303834 | 24 | −21 | gb105pln | Rice mRNA for 21 kd polypeptide, complete cds. |
| 700616772H1 | g666976 | 52 | −6 | gb105pln | *A. thaliana* TYKY mRNA for NADH: ubiquinone oxidoreductase. |
| 700616327H1 | g2443401 | 31 | −53 | gb105pln | *Oryza sativa* mRNA for orthophosphate dikinase, complete cds. |
| 700615871H1 | g22542 | 52 | −30 | gb105pln | Maize gene for Mr 19000 alpha zein and 5'-flanking region. |
| 700613957H1 | g450281 | 27 | 3 | gb105allp | isolog of yeast sui1 and rice gos2; putative |
| 700613134H1 | g22149 | 61 | −81 | gb105pln | *Z. mays* mRNA for alpha-tubulin 3. |
| 700461139H1 | g2104958 | 41 | −31 | gb105pln | *Vicia faba* immunophilin (FKBP12) mRNA, complete cds. |
| 700616796H1 | g22544 | 44 | −39 | gb105pln | Maize mRNA (clone A30) for zein (a plant storage protein). |
| 700612928H1 | g1136119 | 22 | 10 | gb105pln | *O. sativa* mRNA for alpha-tubulin (clone OSTA-111). |
| 700616217H1 | g2282583 | 55 | −86 | gb105pln | *Zea mays* elongation factor 1-alpha (EF1-A) mRNA, complete cds. |
| 700616350H1 | g218169 | 21 | −9 | gb105pln | Rice mRNA for acyl carrier protein (KN33 gene), partial sequence. |
| 700615804H1 | g22747 | 15 | −16 | gb105pln | *L. longiflorum* mRNA for actin depolymerizing factor. |
| 700613251H1 | g2150129 | 15 | −7 | gb105pln | *Arabidopsis thaliana* cytoplasmic ribosomal protein S15a mRNA, complete cds. |
| 700613376H1 | g463251 | 21 | −16 | gb105pln | *M. sativa* (Nagyszenasi) mRNA for ribosomal protein RL5. |
| 700612609H1 | g2618720 | 24 | −3 | gb105pln | *Arabidopsis thaliana* early auxin-induced (IAA16) mRNA, complete cds. |
| 700614709H1 | g2351071 | 13 | 6 | gb105pln | *Arabidopsis thaliana* genomic DNA, chromosome 5, P1 clone: MVA3. |
| 700617947H1 | g975887 | 18 | 2 | gb105pln | *Mesembryanthemum crystallinum* myo-inositol-1-phosphate synthase mRNA, complete cds. |
| 700614350H1 | g22302 | 53 | −26 | gb105pln | Maize Gpc1 gene for glyceraldehyde-3-phosphate dehydrogenase (GADPH) subunit C. |
| 700614312H1 | g1321660 | 51 | −37 | gb105pln | Rice mRNA for ascorbate peroxidase, complete cds. |
| 700461275H1 | g2274990 | 56 | −37 | gb105pln | *Hordeum vulgare* mRNA for expressed sequence tag. |
| 700613915H1 | g218488 | 28 | 7 | gb105eukp | Smp2 protein |
| 700615914H1 | g22292 | 44 | −19 | gb105pln | *Z. mays* mRNA for glycine-rich protein. |
| 700615216H1 | g602605 | 23 | −62 | gb105pln | *Zea mays* tandem genes for alpha1-tubulin and alpha2-tubulin. |
| 700613165H1 | g2293565 | 50 | −15 | gb105pln | *Oryza sativa* ADP-ribosylation factor 1 (Os-ARF1) mRNA, complete cds. |
| 700617037H1 | g595413 | 22 | −1 | gb105eukp | sec26; beta COP |
| 700616069H1 | g168679 | 94 | −5 | gb105pln | Maize 19 kDa zein mRNA, clone cZ19C2, complete cds. |
| 700617079H1 | g1244773 | 23 | −14 | gb105eukp | RPL37A; Rpl37ap: 60S ribosomal protein L37a |
| 700612622H1 | g17863 | 46 | −2 | gb105eukp | r-protein BnS15a |
| 700616676H1 | g515376 | 18 | 15 | gb105pln | *L. temulentum* mRNA for histone |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | H4. |
| 700614072H1 | g732989 | 86 | −50 | gb105pln | Z. mays PCNA mRNA for proliferating cell nuclear antigen. |
| 700613633H1 | g1244779 | 18 | 5 | gb105eukp | YPL135W; Yp1135wp |
| 700616360H1 | g2244603 | 21 | −42 | gb105pln | Oryza sativa gene for betaine aldehyde dehydrogenase, complete cds. |
| 700614483H1 | g556685 | 54 | −48 | gb105pln | Z. mays mRNA for ADP-ribosylation factor. |
| 700618054H1 | g429001 | 8 | 13 | gb105pln | Rice mRNA for photosystem II D1 protein (gene name SS246), partial cds. |
| 700616925H1 | g2351069 | 13 | 13 | gb105pln | Arabidopsis thaliana genomic DNA, chromosome 5, P1 clone: MSH12. |
| 700461236H1 | g1049252 | 88 | −71 | gb105pln | Zea mays vacuolar ATPase 69 kDa subunit mRNA, partial cds. |
| 700614906H1 | g1513227 | 42 | −54 | gb105pln | Brassica napus myo-inositol 1-phosphate synthase mRNA, complete cds. |
| 700614903H1 | g16210 | 46 | −26 | gb105pln | Arabidopsis thaliana calnexin homolog. |
| 700618295H1 | g1184773 | 16 | −22 | gb105pln | Zea mays glyceraldehyde-3-phosphate dehydrogenase GAPC3 (gpc3) mRNA, complete cds. |
| 700614277H1 | g22542 | 49 | 4 | gb105pln | Maize gene for Mr 19000 alpha zein and 5'-flanking region. |
| 700612468H1 | g540534 | 63 | −22 | gb105pln | Rice mRNA for q group of receptor for activated C-kinase, complete cds. |
| 700614869H1 | g2345100 | 17 | 1 | gb105allp | Pad1 homolog |
| 700612411H1 | g248336 | 57 | −16 | gb105pln | polyubiquitin [maize, Genomic, 3841 nt]. |
| 700616886H1 | g973224 | 30 | −2 | gb105eukp | pelo; pelota; pelota |
| 700613457H1 | g170145 | 28 | −23 | gb105eukp | sfs1; 10-formyltetrahydrofolate synthetase; EC 6.3.4.3 |
| 700616651H1 | g2262135 | 21 | 0 | gb105pln | Arabidopsis thaliana BAC T10P11, complete sequence. |
| 700614883H1 | g2827661 | 17 | 3 | gb105eukp | F18F4.170; hyuC-like protein |
| 700617020H1 | g20885 | 34 | −22 | gb105pln | P. sativum rDNA (RRNpss1) for 18S (partial) and 25S (partial) rRNAs. |
| 700616715H1 | g303856 | 34 | −21 | gb105pln | Rice mRNA for ubiquitin protein fused to a ribosomal protein, complete cds. |
| 700615542H1 | g168500 | 72 | −78 | gb105pln | Maize (Zea mays) histone H4 gene (H4C14), complete cds. |
| 700614724H1 | g303852 | 20 | −16 | gb105pln | Rice mRNA for ribosomal protein L3, complete cds. |
| 700613846H1 | g897799 | 7 | 5 | gb105allp | ribosomal protein S1 fragment (1135 is 1st base in codon) |
| 700617788H1 | g687244 | 38 | −58 | gb105pln | Zea mays oil body protein 16 kDa oleosin (ole16) gene, complete cds. |
| 700617526H1 | g1044912 | 34 | −30 | gb105eukp | ribonucleotide reductase R2 |
| 700616861H1 | g300083 | 29 | 7 | gb105eukp | hsp82; HSP82 |
| 700613262H1 | g1848212 | 36 | 3 | gb105eukp | PDI; protein disulfide-isomerase precursor |
| 700615047H1 | g1051108 | 34 | 2 | gb105pln | A. thaliana mRNA for adenine nucleotide translocase. |
| 700616023H1 | g7357 | 13 | −3 | gb105eukp | ribosomal protein L7 (AA 1-246) |
| 700612626H1 | g2257755 | 41 | −23 | gb105pln | Zea mays nucleolar histone deacetylase HD2-p39 mRNA, complete cds. |
| 700461234H1 | g1129084 | 35 | −14 | gb105pln | Wheat mRNA for protein H2A, complete cds, clone wcH2A-3. |
| 700618102H1 | g2645165 | 25 | 12 | gb105pln | Oryza sativa mRNA, similar to ribosomal protein 41. |
| 700613304H1 | g1143863 | 32 | −59 | gb105pln | Oryza sativa beta-glucosidase mRNA, nuclear gene encoding chloroplast protein, complete cds. |
| 700617244H1 | g22272 | 43 | −53 | gb105pln | Maize mRNA for enolase (2-phospho-D-glycerate hydrolase). |
| 700614776H1 | g1669600 | 17 | 4 | gb105pln | Arabidopsis thaliana mRNA for AR401, complete cds. |
| 700612457H1 | g515428 | 41 | 0 | gb105allp | S-phase-specific protein |
| 700615849H1 | g20673 | 11 | 3 | gb105allp | precursor peptide (AA −104 to 224) |
| 700618383H1 | g2224911 | 11 | 3 | gb105eukp | somatic embryogenesis receptor-like kinase |
| 700615405H1 | g972924 | 10 | 16 | gb105pln | Arabidopsis thaliana IAA11 (IAA11) gene, complete cds. |
| 700614696H1 | g2244870 | 17 | 6 | gb105pln | Arabidopsis thaliana DNA chromosome 4, ESSA I contig fragment No. 3. |
| 700616734H1 | g2345153 | 22 | −11 | gb105pln | Zea mays ribsomal protein S4 (rps4) mRNA, complete cds. |
| 700614213H1 | g2245020 | 16 | 0 | gb105eukp | growth regulator homolog |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700612336H1 | g2668737 | 52 | −6 | gb105pln | *Zea mays* translation initiation factor 5A (TIF5A) mRNA, complete cds. |
| 700617049H1 | g2245027 | 27 | −3 | gb105eukp | ribosomal protein |
| 700618573H1 | g2735007 | 47 | −25 | gb105pln | *Zea mays* kinase associated protein phosphatase (KAPP) mRNA, complete cds. |
| 700613028H1 | g2564237 | 29 | −10 | gb105eukp | omega-6 desaturase |
| 700614935H1 | g2331134 | 16 | 15 | gb105pln | *Oryza sativa* ribosomal protein L12 homolog mRNA, partial cds. |
| 700613947H1 | g168679 | 92 | −38 | gb105pln | Maize 19 kDa zein mRNA, clone cZ19C2, complete cds. |
| 700617209H1 | g169038 | 38 | −24 | gb105pln | *P. sativum* L. aldolase gene, 3′ end cds. |
| 700616492H1 | g296094 | 34 | −12 | gb105eukp | M(3)95A; ribosomal protein S3 |
| 700616209H1 | g1542941 | 10 | 2 | gb105eukp | AACT; Acetoacetyl-coenzyme A thiolase; EC 2.3.1.9 |
| 700616589H1 | g2738247 | 14 | −2 | gb105pln | *Arabidopsis thaliana* cobalamin-independent methionine synthase (ATCIMS) mRNA, complete cds. |
| 700617683H1 | g940843 | 8 | −17 | gb105eukp | orf 06116 |
| 700616978H1 | g169037 | 16 | 5 | gb105eukp | aldolase |
| 700613195H1 | g168527 | 32 | −28 | gb105pln | Maize NADP-dependent malic enzyme (Me1) mRNA, complete cds. |
| 700612636H1 | g2656028 | 32 | −17 | gb105pln | *Arabidopsis thaliana* genomic DNA, chromosome 5, P1 clone: MNF13. |
| 700613395H1 | g1658312 | 56 | 9 | gb105pln | *O. sativa* osr40g2 gene. |
| 700617158H1 | g2624327 | 19 | −12 | gb105pln | *Oryza sativa* mRNA for glycine rich RNA-binding protein 2 (OsGRP2). |
| 700617608H1 | g1835684 | 20 | 0 | gb105eukp | PIP2; Pip2p |
| 700612360H1 | g22272 | 95 | −43 | gb105pln | Maize mRNA for enolase (2-phospho-D-glycerate hydrolase). |
| 700616485H1 | g19789 | 5 | 6 | gb105allp | auxin-induced protein |
| 700614354H1 | g168669 | 86 | −30 | gb105pln | Maize 19 kDa zein mRNA, clone cZ19A2, partial cds. |
| 700618068H1 | g168502 | 26 | −48 | gb105pln | Maize (*Zea mays*) histone H4 gene (H4C7), complete cds. |
| 700616451H1 | g1621268 | 19 | −10 | gb105eukp | unknown |
| 700613938H1 | g555941 | 14 | 4 | gb105allp | ribosomal protein S3 |
| 700614955H1 | g18243 | 38 | −51 | gb105pln | *C. reinhardtii* UBI3 mRNA for ubiquitin-fusion protein (UbCEP52). |
| 700616716H1 | g170053 | 32 | −18 | gb105pln | Soybean ribosomal protein S11 mRNA, 3′ end. |
| 700616992H1 | g499294 | 16 | −6 | gb105eukp | asparaginyl endopeptidase (Legumaln) |
| 700612956H1 | g2522194 | 61 | −33 | gb105pln | *Triticum aestivum* ornithine/acetylornithine aminotransferase mRNA, partial cds. |
| 700616330H1 | g747914 | 54 | −51 | gb105pln | *Z. mays* CaM1 mRNA for calmodulin. |
| 700615110H1 | g22118 | 27 | 12 | gb105pln | *Z. mays* DNA for Adh1-Cm allele. |
| 700616307H1 | g498908 | 21 | −3 | gb105eukp | RPL34; ribosomal protein L34 homolog |
| 700614957H1 | g2293272 | 15 | −3 | gb105allp | DNA-polymerase I |
| 700612492H1 | g2653557 | 100 | −26 | gb105pln | *Zea mays* mRNA for ferredoxin-sulfite reductase precursor, complete cds. |
| 700613229H1 | g790969 | 32 | −43 | gb105pln | Rice mRNA for aldolase C-1, complete cds. |
| 700615403H1 | g992962 | 15 | −1 | gb105eukp | thioredoxin |
| 700616043H1 | g1841307 | 15 | 1 | gb105pln | Fission Yeast mRNA for ribosomal protein S16 homolog, partial cds. |
| 700613996H1 | g200381 | 92 | −11 | gb105allp | [Mouse protein kinase C delta mRNA, complete cds.], gene product |
| 700613652H1 | g2160162 | 50 | −3 | gb105eukp | F21M12.8 |
| 700616692H1 | g168498 | 19 | −34 | gb105pln | Corn histone H4 (H4C13) gene, complete cds. |
| 700615418H1 | g4799 | 11 | 12 | gb105pln | Yeast (*Saccharomyces cerevisiae*) YAP54 gene for medium chains of clathrin associated protein complex. |
| 700614890H1 | g248338 | 39 | −47 | gb105pln | polyubiquitin [maize, Genomic, 3439 nt]. |
| 700461140H1 | g2827140 | 31 | −19 | gb105pln | *Arabidopsis thaliana* cellulose synthase catalytic subunit (Ath-A) mRNA, complete cds. |
| 700616952H1 | g168500 | 33 | −14 | gb105pln | Maize (*Zea mays*) histone H4 gene (H4C14), complete cds. |
| 700616633H1 | g1785861 | 40 | −11 | gb105pln | *Elaeis guineensis* var. tenera stearoyl-Acyl-carrier protein desaturase mRNA, partial cds. |
| 700612952H1 | g2444419 | 40 | −43 | gb105pln | *Glycine max* ribosome-associated protein p40 mRNA, complete cds. |
| 700617957H1 | g558649 | 21 | −23 | gb105pln | *T. aestivum* VDAC2 mRNA for voltage dependent anion channel. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700617434H1 | g170746 | 45 | −66 | gb105pln | Wheat histone H4 TH091 gene, complete cds. |
| 700616314H1 | g436031 | 26 | −9 | gb105pln | Nicotiana tabacum (TSC40-4) 60S ribosomal protein L34 mRNA, complete cds. |
| 700616491H1 | g2257598 | 11 | 0 | gb105allp | phosphoglycerate kinase |
| 700615257H1 | g296703 | 23 | −8 | gb105pln | Yeast (Saccharomyces pombe) FIB gene encoding fibrillarin. |
| 700618258H1 | g1532072 | 19 | −42 | gb105pln | Z. mays mRNA for S-adenosylmethionine decarboxylase. |
| 700617556H1 | g20193 | 17 | −26 | gb105pln | O. sativa mRNA for cdc2+/CDC28-related protein kinase. |
| 700614908H1 | g22469 | 60 | −74 | gb105pln | Maize mRNA for cytoplasmic ribosomal protein S11. |
| 700612364H1 | g485376 | 97 | −14 | gb105pln | Zea mays alpha-3-tubulin gene, complete cds. |
| 700613030H1 | g577531 | 19 | −31 | gb105eukp | proteasome subunit |
| 700618126H1 | g1370177 | 22 | −10 | gb105pln | L. japonicus mRNA for small GTP-binding protein, RAB5A. |
| 700617018H1 | g1842114 | 11 | 14 | gb105pln | Nicotiana plumoaginifolia non-phosphorylating glyceraldehyde dehydrogenase (GapN) mRNA, complete cds. |
| 700612389H1 | g2662346 | 58 | 4 | gb105pln | Oryza sativa mRNA for EF-1 alpha, complete cds. |
| 700616073H1 | g168494 | 29 | −37 | gb105pln | Maize (Zea mays) histone H3 gene (H3C2), complete cds. |
| 70061S701H1 | g18045 | 22 | −7 | gb105pln | C. lanceoiata mRNA for beta-ketoacyl-ACP reductase. |
| 700615517H1 | g22614 | 53 | −45 | gb105pln | S. vulgare pepC gene for PEP carboxylase. |
| 700613958H1 | g902583 | 91 | −26 | gb105pln | Zea mays clone MubG1 ubiquitin gene, complete cds. |
| 700616461H1 | g16427 | 10 | 6 | gb105allp | protease inhibitor II |
| 700615808H1 | g471318 | 35 | −1 | gb105pln | H. vulgare (cv. Bomi) B12D mRNA. |
| 700614836H1 | g290057 | 31 | 3 | gb105eukp | TBP10; HIV1 TAT-binding protein |
| 700617514H1 | g790507 | 26 | −37 | gb105pln | Z. mays mRNA for 60S acidic ribosomal protein. |
| 700614695H1 | g2662340 | 16 | −31 | gb105pln | Oryza sativa mRNA for EF-1 alpha, complete cds. |
| 700613864H1 | g2204226 | 9 | −2 | gb105eukp | cleave terminal galactose residue; alpha-galactosidase; EC 3.2.1.22 |
| 700613865H1 | g790640 | 12 | −3 | gb105pln | Hordeum vulgare gamma-thionin (HTH3) mRNA, complete cds. |
| 700618247H1 | g22533 | 16 | −23 | gb105pln | Zea mays mRNA encoding a zein (clone ZG99). |
| 700616866H1 | g2344885 | 12 | 14 | gb105pln | Arabidopsis thaliana chromosome II BAC T13E15 genomic sequence, complete sequence. |
| 700618168H1 | g2244747 | 14 | 2 | gb105pln | Arabidopsis thaliana DNA chromosome 4, ESSA I contig fragment No. 0. |
| 700617703H1 | g22324 | 58 | 7 | gb105pln | Z. mays mRNA for H2B histone (clone cH2B221). |
| 700612859H1 | g22121 | 24 | 11 | gb105pln | Maize alcohol dehydrogenase 1 gene (Adh1-1F). |
| 700617484H1 | g1293719 | 17 | −7 | gb105eukp | similar to the mammalian snRNP-E involved in splicing, CAI: 0.12; snRNPE homolog |
| 700612422H1 | g514945 | 100 | −31 | gb105pln | Zea mays sucrose synthase (Sus1) mRNA, complete cds. |
| 700617390H1 | g2827081 | 52 | 8 | gb105pln | Medicago sativa cytosolic malate dehydrogenase (cmdh) mRNA, complete cds. |
| 700616445H1 | g22321 | 13 | −1 | gb105eukp | H1; H1 histone |
| 700617068H1 | g1408473 | 17 | −4 | gb105eukp | ADF2; actin depolymerizing factor 2 |
| 700615542H1 | g21794 | 67 | −74 | gb105pln | Wheat histone H4 gene. |
| 700614183H1 | g1167963 | 37 | −0 | gb105eukp | 18-56 protein |
| 700613112H1 | g2642434 | 8 | −1 | gb105eukp | T20D16.6; putative Rer1 protein |
| 700615374H1 | g2072948 | 55 | 6 | gb105allp | putative p150 |
| 700616724H1 | g1151223 | 14 | −8 | gb105eukp | MSD1; Msd1p: mitochondrial aspartyl-tRNA synthetase |
| 700615728H1 | g535771 | 19 | 6 | gb105eukp | dehydroquinate dehydratase/shikimate dehydrogenase; EC 1.1.1.25 |
| 700617404Hl | g2642161 | 10 | 2 | gb105eukp | T5I7.9 |
| 700616737H1 | g2739216 | 36 | 8 | gb105pln | Hordeum vulgare L41 ribosomal protein. |
| 700614046H1 | g886739 | 45 | −60 | gb105pln | Z. mays histone H4 gene. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700613103H1 | g531481 | 41 | −52 | gb105pln | *P. ciliare* (Higgins) apospory associated mRNA, 1398 bp. |
| 700613011H1 | g2529386 | 34 | −46 | gb105pln | *Zea mays* triosephosphate isomerase 1 gene, exon 2–9 and complete cds. |
| 700616368H1 | g474169 | 28 | −13 | gb105pln | *R. communis* mRNA for phosphoglyceromutase. |
| 700615669H1 | g786131 | 23 | −32 | gb105pln | *Oryza sativa* root-specific RCc3 mRNA, complete cds. |
| 700614919H1 | g168527 | 52 | −78 | gb105pln | Maize NADP-dependent malic enzyme (Me1) mRNA, complete cds. |
| 700613973H1 | g508544 | 69 | −41 | gb105pln | *Zea mays* 24-kD alpha-zein gene (floury2), complete cds. |
| 700614525H1 | g20250 | 52 | −66 | gb105pln | *Oryza sativa* H3 histone gene H3R-11. |
| 700616332H1 | g19216 | 8 | 16 | gb105pln | Tomato mRNA for a glycine-rich protein (clone w1-8). |
| 700612402H1 | g557673 | 25 | 3 | gb105allp | BM88 antigen |
| 700613059H1 | g22192 | 15 | −0 | gb105pln | *Z. mays* B-I gene for B transcriptional activator |
| 700615470H1 | g2351373 | 13 | 12 | gb105pln | *Arabidopsis thaliana* putative 26S proteasome subunit athMOV34 mRNA, complete cds. |
| 700613847H1 | g303743 | 28 | 17 | gb105pln | Pea mRNA for GTP-binding protein, complete cds. |
| 700618591H1 | g31062 | 7 | 8 | gb105allp | Epstein-Barr virus small RNA associated protein |
| 700613915H1 | g825570 | 28 | 7 | gb105allp | Smp2p |
| 700618556H1 | g2570118 | 15 | 10 | gb105pln | *S. latifoila* mRNA, clone CCLS 17. |
| 700617977H1 | g170772 | 27 | −10 | gb105pln | *Triticum aestivum* S-adenosyl-L-homocysteine hydrolase (SH6.2) mRNA, complete cds. |
| 700616930H1 | g170783 | 17 | −8 | gb105pln | *T. aestivum* ubiquitin carrier protein mRNA. |
| 700614929H1 | g971485 | 26 | −16 | gb105eukp | putative beta-galactosidase/galactanase; EC 3.2.1.23 |
| 700613360H1 | g4755 | 29 | 5 | gb105eukp | ORF1 |
| 700613960H1 | g398607 | 15 | 7 | gb105pln | *A. thaliana* mRNA for elongation factor 1 beta. |
| 700615775H1 | g2501850 | 72 | 0 | gb105eukp | GDI; inhibits dissociation of GDP from GTP binding proteins; GDP dissociation inhibitor |
| 700614989H1 | g2739139 | 9 | 5 | gb105allp | thermostable DNA polymerase |
| 700614227H1 | g602605 | 48 | −77 | gb105pln | *Zea mays* tandem genes for alpha1-tubulin and alpha2-tubulin. |
| 700617343H1 | g600709 | 21 | −13 | gb105pln | *Arabidopsis thaliana* synaptobrevin-related protein (SAR1) mRNA, complete cds. |
| 700616556H1 | g1930071 | 42 | −1 | gb105pln | *Oryza sativa* thioredoxin h mRNA, complete cds. |
| 700615070H1 | g1208744 | 11 | 6 | gb105allp | isopeptidase T |
| 700616378H1 | g168628 | 42 | −3i | gb105pln | maize sucrose synthetase gene (shrunken) 3' end. |
| 700612378H1 | g22544 | 95 | −28 | gb105pln | Maize mRNA (clone A30) for zein (a plant storage protein). |
| 700613747H1 | g736721 | 16 | 6 | gb105allp | stearoyl-acyl carrier protein desaturse |
| 700617244H1 | g602252 | 20 | −8 | gb105pln | *Zea mays* enolase (eno2) mRNA, complete cds. |
| 700616947H1 | g17738 | 16 | −11 | gb105eukp | beta-1,3-glucanase homologue |
| 700615487H1 | g2832242 | 38 | −51 | gb105pln | *Zea mays* 22-kDa alpha zein gene cluster, complete sequence. |
| 700614008H1 | g36088 | 12 | 5 | gb105allp | C6.1A gene product |
| 700613124H1 | g602605 | 54 | −79 | gb105pln | *Zea mays* tandem genes for alpha1-tubulin and alpha2-tubulin. |
| 700616415H1 | g20501 | 5 | 4 | gb105allp | vicilin-like storage protein |
| 700613676H1 | g458966 | 20 | −8 | gb105eukp | F37A4.8 |
| 700612370H1 | g2394228 | 44 | 3 | gb105pln | *Arabidopsis thaliana* WD-40 repeat protein (MSI1) mRNA, complete cds. |
| 700616018H1 | g466350 | 11 | −0 | gb105eukp | pyruvate kinase; EC 2.7.1.40 |
| 700612309H1 | g2656028 | 13 | −7 | gb105pln | *Arabidopsis thaliana* genomic DNA, chromosome 5, P1 clone: MNF13. |
| 700613030H1 | g600386 | 10 | 2 | gb105pln | *A. thaliana* mRNA for proteasome subunit. |
| 700613366H1 | g22284 | 9 | −1 | gb105eukp | Glb1-L; vicilin-like embryo storage protein |
| 700615509H1 | g1151244 | 18 | −15 | gb105eukp | OEP34; GTP-binding protein |
| 700617962H1 | g169704 | 25 | −13 | gb105pln | *Ricinus communis* ATP: pyruvate phosphotransferase (PK-p-beta) mRNA, complete cds. |
| 708613889H1 | g606970 | 29 | −7 | gb105eukp | cytoplasmic ribosomal protein |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | L18 |
| 700617116H1 | g217847 | 33 | −2 | gb105eukp | ATS1; glycerol-3-phosphate acyltransferase precursor; EC 2.3.1.15 |
| 700614483H1 | g1132482 | 61 | −61 | gb105pln | Rice mRNA for ADP-ribosylation factor, complete cds. |
| 700612953H1 | g398326 | 15 | 4 | gb105pln | *A. phyilitidis* PABP mRNA for poly (A)-binding protein |
| 700614570H1 | g887594 | 55 | −5 | gb105eukp | unknown |
| 700612647H1 | g1381153 | 11 | 16 | gb105pln | *Triticum aestivum* actin-binding protein WCOR719 (Wcor719) mRNA, complete cds. |
| 700618480H2 | g777757 | 40 | −45 | gb105pln | *Saccharum* hybrid (clone SCUBI561) polyubiquitin mRNA, complete cds. |
| 700618091H1 | g2315459 | 4 | 8 | gb105eukp | F41E6.13 |
| 700613325H1 | g1743355 | 13 | −2 | gb105pln | *N. tabacum* mRNA for delta proteasome subunit. |
| 700613709H1 | g2351373 | 37 | −14 | gb105pln | *Arabidopsis thaliana* putative 26S proteasome subunit athMOV34 mRNA, complete cds. |
| 700618207H1 | g1755008 | 30 | 8 | gb105pln | *Triticum aestivum* calmodulin TaCaM4-1 mRNA, complete cds. |
| 700616651H1 | g2262140 | 30 | −5 | gb105eukp | T10P11.7; putative protein trafficking component |
| 700618089H1 | g1498052 | 43 | 10 | gb105pln | *Zea mays* ribosomal protein S8 mRNA, complete cds. |
| 700614944H1 | g170293 | 48 | −61 | gb105pln | *Nicotiana piumbaginifolia* plasma-membrane H+ ATPase (pma3) mRNA, complete cds. |
| 700612346H1 | g536891 | 39 | −5 | gb105pln | Wheat mRNA for protein H2A, complete cds, clone wcH2A-4. |
| 700613161H1 | g840730 | 30 | −27 | gb105pln | *C. lanceolata* Gpdh mRNA for glycerol-3-phosphate dehydrogenase. |
| 700616715H1 | g347063 | 31 | −18 | gb105pln | *Brassica rapa* ubiquitin/ribosomal protein mRNA, complete cds. |
| 700615101H1 | g1653075 | 12 | −3 | gb105allp | sensory transduction histidine kinase |
| 700612510H1 | g1272684 | 60 | −63 | gb105pln | *Z. mays* mRNA for acetyl CoA carboxylase (partial). |
| 700617648H1 | g340933 | 88 | −48 | gb105pln | *Zea mays* 10-kDa zein gene, complete cds. |
| 700616543H1 | g2262135 | 41 | −4 | gb105pln | *Arabidopsis thaliana* BAC T10P11, complete sequence. |
| 700614277H1 | g535019 | 50 | 4 | gb105pln | *Z. mays* Zd1 tandem genes for zein Zd1 (19 kDa Zein). |
| 700612329H1 | g434787 | 50 | −5 | gb105eukp | ribosomal protein |
| 700612807H1 | g1651651 | 35 | 6 | gb105allp | geranylgeranyl pyrophosphate synthase |
| 700616089H1 | g1575439 | 19 | −0 | gb105pln | *Nicotiana tabacum* caffeoyl-CoA O-methyltransferase 4 (CCoAOMT-4) mRNA, complete cds. |
| 700614470H1 | g968901 | 32 | −14 | gb105pln | Rice mRNA for ribosomal protein S8, complete cds. |
| 700618244H1 | g288063 | 18 | −10 | gb105eukp | ketol-acid reductoisomerase; EC 1.1.1.86 |
| 700461276H1 | g1871173 | 32 | −16 | gb105pln | *Arabidopsis thaliana* chromosome II BAC T06D20 genomic sequence, complete sequence. |
| 700616380H1 | g1370141 | 33 | −16 | gb105pln | *L. japonicus* mRNA for small GTP-binding protein, RAB11A. |
| 700614805H1 | g171091 | 9 | −1 | gb105eukp | ASF1; derepression of silent loci when overexpressed |
| 700614219H1 | g1154953 | 23 | −41 | gb105pln | *T. aestivum* histone H2A gene. |
| 700461278H1 | g1293783 | 56 | −37 | gb105pln | *Oryza sativa* QM gene, complete cds. |
| 700615394H1 | g536895 | 35 | −30 | gb105pln | Wheat mRNA for protein H2A, complete cds, clone wcH2A-10. |
| 700618037H1 | g606751 | 8 | 4 | gb105eukp | Rox2; Single-strand nucleic acid binding protein; RNA binding protein |
| 700612483H1 | g1742965 | 13 | 8 | gb105eukp | HApp48,5 protein |
| 700612555H1 | g806807 | 44 | −33 | gb105pln | *Pisum sativum* chaperonin precursor mRNA, chloroplast gene encoding chloroplast protein, complete cds. |
| 700613664H1 | g531055 | 7 | 10 | gb105pln | Wheat mRNA for protein H2B-6, complete cds. |
| 700613229H1 | g168419 | 33 | −59 | gb105pln | Maize (*Z. mays*) aldolase mRNA, complete cds. |
| 700616869H1 | g2209383 | 34 | −3 | gb105pln | *Brassica rapa* glutathione reductase (BcGR1) mRNA, complete cds. |
| 700612313H1 | g167074 | 61 | −22 | gb105pln | Barley ubiquitin (mub2) gene, complete cds. |
| 700616456H1 | g169537 | 27 | −31 | gb105pln | Potato pyrophosphate-fructose 6-phosphate 1-phosphotransferase (PFP) alpha-subunit mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700616459H1 | g2832664 | 10 | −7 | gb105eukp | F28J12.250; pollen-specific protein - like |
| 700615464H1 | g20021 | 16 | −13 | gb105pln | *N. tabacum* mRNA for ribosomal protein S6. |
| 700613791H1 | g18247 | 20 | −2 | gb105eukp | ubiquitin |
| 700615822H1 | g600387 | 22 | −5 | gb105eukp | proteosome subunit |
| 700612460H1 | g2145473 | 74 | −4 | gb105eukp | aconitate hydratase; EC 4.2.1.3 |
| 700612494H1 | g21628 | 41 | 14 | gb105pln | *Sorghum vulgare* mRNA for phosphoenolpyruvate invoived in C4 photosynthesis (EC 4.1.1.31). |
| 700615410H1 | g168527 | 47 | −71 | gb105pln | Maize NADP-dependent malic enzyme (Me1) mRNA, complete cds. |
| 700616948H1 | g2077966 | 11 | 7 | gb105allp | K11D2.3 |
| 700616688H1 | g1929413 | 17 | −1 | gb105pln | *N. tabacum* mRNA for ribonucleotide reductase R2 protein. |
| 700616505H1 | g2341023 | 35 | −40 | gb105pln | Sequence of BAC F19P19 from *Arabidopsis thaliana* chromosome , complete sequence. |
| 700616084H1 | g510931 | 24 | −21 | gb105pln | *V. faba* mRNA for alpha 1,4-glucan phosphorylase type H. |
| 700612359H1 | g2462837 | 9 | 7 | gb105eukp | F19G10.17 |
| 700615558H1 | g606810 | 34 | −10 | gb105pln | *Zea mays* carbonic anhydrase mRNA, complete cds. |
| 700613267H1 | g22272 | 43 | −8 | gb105pln | Maize mRNA for enolase (2-phospho-D-glycerate hydrolase). |
| 700617478H1 | g2388951 | 27 | −18 | gb105pln | Yeast (*Saccharomyces pombe*) chromosome I cosmid c31G5. |
| 700618637H1 | g2624328 | 11 | 6 | gb105eukp | OsGRP2; OsGRP2 |
| 700616333H1 | g2618604 | 10 | 10 | gb105pln | *Arabidopsis thaliana* genomic DNA, chromosome 5, P1 clone: MTG13, complete sequence. |
| 700615001H1 | g1256204 | 32 | −24 | gb105eukp | phosphoserine aminotransferase |
| 700612556H1 | g2584827 | 25 | −28 | gb105pln | Sequence of BAC F12F1 from *Arabidopsis thaliana* chromosome 1, complete sequence. |
| 700461158H1 | g2108344 | 45 | −33 | gb105pln | *Brassica campestris* small GTP-binding protein Bsar1a (bsar1a) mRNA, complete cds. |
| 700618380H1 | g2282583 | 45 | −45 | gb105pln | *Zea mays* elongation factor 1-alpha (EF1-A) mRNA, complete cds. |
| 700616696H1 | g600387 | 18 | −30 | gb105eukp | proteosome subunit |
| 700616395H1 | g1493838 | 15 | 6 | gb105eukp | transfers ubiquitin to mitotic cyclins A and B; is required for mitotic cyclin destruction at the end of mitosis; cyclin-specific ubiquitin carrier protein E2-C |
| 700617436H1 | g469148 | 18 | −7 | gb105eukp | alanine aminotransferase |
| 700614719H1 | g463151 | 74 | −83 | gb105pln | *Zea mays* high sulfur zein gene, complete cds. |
| 700615918H1 | g2645165 | 54 | 2 | gb105pln | *Oryza sativa* mRNA, similar to ribosomal protein 41. |
| 700614225H1 | g1370185 | 36 | −33 | gb105pln | *L. japonicus* mRNA for small GTP-binding protein, RAB7C. |
| 700612358H1 | g451192 | 61 | −45 | gb105pln | *Triticum aestivum* (wali7) mRNA, 3' end, partial cds. |
| 700617352H1 | g395087 | 19 | 7 | gb105allp | transcription factor BTF3 |
| 700616315H1 | g22524 | 63 | 6 | gb105pln | *Zea mays* mRNA encoding a zein (clone ZG31A). |
| 700612713H1 | g2565340 | 47 | 2 | gb105eukp | rps14; ribosomal protein S14 |
| 700616724H1 | g173036 | 14 | −8 | gb105eukp | mitochondrial aspartyl-tRNA synthetase |
| 700614892H1 | g619732 | 41 | 0 | gb105allp | indole-3-glycerol phosphate synthase |
| 700616442H1 | g1658312 | 17 | 1 | gb105pln | *O. sativa* osr40g2 gene. |
| 700615640H1 | g22531 | 76 | −89 | gb105pln | *Zea mays* mRNA encoding a zein (clone pZ22.1). |
| 700612321H1 | g558364 | 82 | −22 | gb105pln | *Z. mays* mRNA for ADP-glucose pyrophosphorylase. |
| 700613171H1 | g1272405 | 26 | −15 | gb105pln | *Arabidopsis thaliana* immunophilin (FKBP15-1) mRNA, complete cds. |
| 700616611H1 | g22149 | 19 | −7 | gb105pln | *Z. mays* mRNA for alpha-tubulin 3. |
| 700614341H1 | g2828187 | 14 | 11 | gb105pln | *Arabidopsis thaliana* genomic DNA, chromosome 5, TAC clone: K21C13, complete sequence. |
| 700612639H1 | g22524 | 74 | −78 | gb105pln | *Zea mays* mRNA encoding a zein (clone ZG31A). |
| 700613745H1 | g296094 | 40 | −25 | gb105eukp | M(3)95A; ribosomal protein S3 |
| 700612615H1 | g1184187 | 64 | −30 | gb105pln | enolase [*Echinochloa phyllopogon*, shoots, mRNA Partial, 541 nt]. |
| 700617526H1 | g555613 | 25 | −19 | gb105eukp | RNR2; ribonucleotide reductase small subunit; EC 1.17.4.1 |
| 700616980H1 | g926885 | 12 | −3 | gb105eukp | Ole e I |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700615914H1 | g21622 | 18 | 14 | gb105pln | *S. vilgare* mRNA for glycine-rich RNA-binding protein (clone S1). |
| 700616828H1 | g577131 | 9 | 6 | gb105allp | YI9910.13c, unknown orf, len: 365, CAI: 0.17 |
| 700618614H1 | g2827551 | 8 | 4 | gb105eukp | T12H17.130; predicted protein |
| 700615601H1 | g166859 | 14 | −4 | gb105pln | *Arabidopsis thaliana* ribosomal protein gene, complete cds. |
| 700612432H1 | g22288 | 34 | 2 | gb105pln | Maize mRNA fragment for endosperm glutelin-2. |
| 700612684H1 | g250 | 49 | −17 | gb105allp | NADH dehydrogenase |
| 700613693H1 | g1519250 | 27 | −13 | gb105pln | *Oryza sativa* GF14-c protein mRNA, complete cds. |
| 700461182H1 | g1737491 | 30 | −36 | gb105pln | *Triticum aestivum* poly(A)-binding protein (wheatpab) mRNA, complete cds. |
| 700617335H1 | g2632966 | 30 | 6 | gb105allp | phosphoribosylaminoimidazole carboxy formyl formyltransferase |
| 700615388H1 | g2687432 | 56 | −106 | gb105pln | *Plumbago auriculata* large subunit 26S ribosomal RNA gene, partial sequence. |
| 700614003H1 | g1806170 | 17 | −6 | gb105allp | Rp1D |
| 700612548H1 | g168690 | 79 | −82 | gb105pln | Maize zein mRNA, complete cds, clone ZG124. |
| 700616715H1 | g1480011 | 32 | −19 | gb105pln | *Brassica rapa* mRNA for putative ubiquitin extension protein, partial cds. |
| 700615009H1 | g2244990 | 39 | −19 | gb105eukp | similarity to LIM homeobox protein - Caenorhabditis; Author-given protein sequence is in conflict with the conceptual translation |
| 700617119H1 | g1914682 | 23 | 12 | gb105pln | *D. carota* mRNA for RAD23 protein, isoform I. |
| 700614491H1 | g1107486 | 33 | −21 | gb105pln | *A. thaliana* mRNA for 60S ribosomal protein L27a. |
| 700612324H1 | g1480021 | 43 | 6 | gb105pln | *Brassica rapa* mRNA for putative ribosomal protein, partial cds. |
| 700613114H1 | g168685 | 56 | −71 | gb105pln | Maize 22 kd (Mw = 26.99 kd) zein protein 3, mRNA. |
| 700615047H1 | g1051109 | 66 | −4 | gb105eukp | adenine nucleotide translocase |
| 700618252H1 | g287297 | 15 | 14 | gb105pln | *Oryza sativa* mRNA for aspartate aminotransferase, complete cds. |
| 700617959H1 | g469247 | 22 | −43 | gb105pln | *Helianthus annuus* ribosomal protein S3a mRNA, complete cds. |
| 700614339H1 | g170784 | 60 | −10 | gb105pln | Wheat ubiquitin carrier protein (UBC1) mRNA, complete cds. |
| 700617396H1 | g2345100 | 3i | −37 | gb105eukp | SmPOH; transcriptional coactivator; Pad1 homolog |
| 700613690H1 | g168541 | 60 | −33 | gb105pln | *Zea mays* putative proteolipid subunit of vacuolar H+ ATPase mRNA, partial cds. |
| 700616626H1 | g2245027 | 50 | −6 | gb105eukp | ribosomal protein |
| 700617464H1 | g2160182 | 7 | 8 | gb105eukp | F21M12.12 |
| 700614144H1 | g1335965 | 56 | 3 | gb105pln | *Zea mays* acetyl CoA carboxylase mRNA, partial cds. |
| 700615775H1 | g1655424 | 73 | −0 | gb105eukp | GDP dissociation inhibitor |
| 700616357H1 | g736271 | 73 | −67 | gb105pln | *O. sativa* hsp70 gene for heat shock protein 70. |
| 700613215H1 | g19342 | 26 | −38 | gb105pln | *L. esculentum* mRNA for ribosomal protein L2. |
| 700614319H1 | g1519252 | 48 | 9 | gb105pln | *Oryza sativa* GF14-d protein mRNA, complete cds. |
| 700613086H1 | g1215986 | 22 | 2 | gb105allp | ribosomal protein L37 |
| 700616324H1 | g1755004 | 49 | −55 | gb105pln | *Triticum aestivum* calmodulin TaCaM3-2 mRNA, complete cds. |
| 700617335H1 | g396345 | 31 | 6 | gb105allp | phosphoribosylaminoimidazolecarboxamide formyltransferase and IMP cyclohydrolase (bifunctional enzyme) |
| 700618287H1 | g2827551 | 10 | 6 | gb105eukp | T12H17.130; predicted protein |
| 700617977H1 | g1220121 | 22 | −4 | gb105pln | Tobacco mRNA for S-adenosyl-L-homocysteine hydrolase, complete cds. |
| 700614776H1 | g1669601 | 28 | −7 | gb105eukp | AR401 |
| 700616346H1 | g297877 | 57 | −52 | gb105pln | *A. thaliana* UBC10 mRNA for ubiquitin conjugating enzyme homolog. |
| 700612347H1 | g532571 | 29 | −38 | gb105pln | Barley lipoxygenase 1 (LoxA) gene, complete cds. |
| 700613851H1 | g22272 | 98 | −17 | gb105pln | Maize mRNA for enolase (2-phospho-D-glycerate hydrolase). |
| 700613086H1 | g927770 | 15 | 8 | gb105eukp | RPL35B; Rp135bp |
| 700615166H1 | g533251 | 67 | −7 | gb105pln | *Zea mays* (clone pSM8) sucrose synthase 2 (Sus1) gene, complete cds. |
| 700618118H1 | g1039443 | 6 | 1 | gb105eukp | rap-1; putative ribosome-associated protein |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700616722H1 | g2293565 | 11 | 0 | gb105pln | *Oryza sativa* ADP-ribosylation factor 1 (Os-ARF1) mRNA, complete cds. |
| 700461122H1 | g22288 | 16 | −3 | gb105pln | Maize mRNA fragment for endosperm glutelin-2. |
| 700613003H1 | g556685 | 36 | −78 | gb105pln | *Z. mays* mRNA for ADP-ribosylation factor. |
| 700613723H1 | g1561773 | 35 | −23 | gb105pln | *Vitis vinifera* malate dehydrogenase (VVME2) mRNA, complete cds. |
| 700618506H1 | g940287 | 9 | 16 | gb105pln | *Pisum sativum* L. (clone na-481-5) mRNA, complete cds. |
| 700613214H1 | g293888 | 62 | −54 | gb105pln | *Zea mays*, glyceraldehyde-3-phosphate dehydrogenase mRNA, 3' end (clone GAPC2). |
| 700618537H1 | g2149640 | 9 | −11 | gb105eukp | AG01; leaf development; Argonaute protein |
| 700618416H2 | g2570119 | 24 | −4 | gb105pln | *S. latifoila* mRNA, clone CCLS 86.1. |
| 700613758H1 | g166970 | 14 | −12 | gb105pln | *Hordeum vulgare* acyl carrier protein III (Ac13) gene, complete cds. |
| 700618529H1 | g603365 | 8 | 6 | gb105eukp | YER126C; Yer126cp |
| 700615101H1 | g1652132 | 12 | −0 | gb105allp | sensory transduction histidine kinase |
| 700614890H1 | g902583 | 51 | −63 | gb105pln | *Zea mays* clone MubG1 ubiquitin gene, complete cds. |
| 700615879H1 | g21624 | 24 | −39 | gb105pln | *S. vulgare* mRNA for glycine-rich RNA-binding protein (clone S2). |
| 700616030H1 | g2276349 | 18 | −4 | gb105pln | Yeast (*Saccharomyces pombe*) chromosome II cosmid c30D10. |
| 700613395H1 | g1658313 | 58 | 7 | gb105eukp | osr40g2 |
| 700618481H2 | g312015 | 12 | 2 | gb105eukp | sof1; SOF1 |
| 700618271H1 | g559537 | 9 | 11 | gb105pln | *Z. mays* mRNA for pis7. |
| 700615816H1 | g2266661 | 44 | −15 | gb105pln | *Hordeum vulgare* mRNA for 14-3-3 protein (Hv1433c). |
| 700612453H1 | g167688 | 45 | 4 | gb105eukp | chcA; clathrin heavy chain |
| 700614476H1 | g2618578 | 10 | 6 | gb105allp | OTK27 |
| 700614183H1 | g2245467 | 37 | −0 | gb105eukp | DUG |
| 700614887H1 | g1143507 | 10 | 0 | gb105eukp | PO ribosomal protein |
| 700615834H1 | g1561773 | 25 | −38 | gb105pln | *Vitis vinifera* malate dehydrogenase (VVME2) mRNA, complete cds. |
| 700616009H1 | g168679 | 94 | −111 | gb105pln | Maize 19 kDa zein mRNA, clone cZ19C2, complete cds. |
| 700616223H1 | g1053058 | 32 | −27 | gb105pln | *Triticum aestivum* histone H3 gene, partial cds, clone W2. |
| 700616419H1 | g1553130 | 27 | −32 | gb105pln | *Gossypium hirsutum* ribosomal protein L44 isoform b (RL44), complete cds. |
| 700618383H1 | g1345132 | 12 | 3 | gb105allp | ERECTA |
| 700617584H1 | g2529702 | 22 | −1 | gb105pln | *Lycopersicon esculentum* class II knotted-like homeodomain protein (LeT12) mRNA, complete cds. |
| 700612581H1 | g409070 | 17 | 2 | gb105allp | HBp15/L22 |
| 700612713H1 | g458981 | 42 | 2 | gb105allp | highly similar to 40S ribosomal protein S14 (S11P family of ribosomal proteins) |
| 700615216H1 | g1638836 | 21 | −59 | gb105pln | *H. vulgare* mRNA for alpha-tubulin 2. |
| 700618637H1 | g829254 | 13 | 6 | gb105allp | glycine-rich RNA-binding protein |
| 700615064H1 | g218248 | 38 | −46 | gb105pln | Rice mRNA for cytochrome C, complete cds. |
| 700616962H1 | g509264 | 18 | −24 | gb105pln | *B. napus* mRNA for acyl-CoA binding protein. |
| 700612676H1 | g1532171 | 59 | −17 | gb105eukp | AT.I.24-9 |
| 700615055H1 | g747916 | 11 | −19 | gb105pln | *Z. mays* CaM2 mRNA for calmodulin. |
| 700612509H1 | g550546 | 36 | −32 | gb105pln | *A. thaliana* RPL16B gene. |
| 700613919H1 | g22119 | 98 | −99 | gb105pln | Maize Adh1-F mRNA for alcohol dehydrogenase. |
| 700614395H1 | g2651316 | 22 | −8 | gb105eukp | T2P4.5 |
| 700616528H1 | g2613142 | 30 | −33 | gb105pln | *Oryza sativa* tubulin (RiP3) mRNA, complete cds. |
| 700617094H1 | g22487 | 75 | −22 | gb105pln | Maize gene for sucrose synthase. |
| 700613447H1 | g168671 | 61 | −73 | gb105pln | Maize 19 kd zein protein, mRNA (incomplete). |
| 700613004H1 | g540534 | 21 | −19 | gb105pln | Rice mRNA for q group of receptor for activated C-kinase, complete cds. |
| 700615405H1 | g2618725 | 16 | 1 | gb105eukp | IAA18; IAA18 |
| 700615628H1 | g17738 | 9 | 6 | gb105eukp | beta-1,3-glucanase homologue |
| 700616225H1 | g2293565 | 41 | −6 | gb105pln | *Oryza sativa* ADP-ribosylation |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | factor 1 (Os-ARF1) mRNA, complete cds. |
| 700618295H1 | g312180 | 9 | −16 | gb105pln | *Z. mays* GapC4 gene. |
| 700614783H1 | g2209343 | 12 | 7 | gb105allp | copper transport protein Atox1 |
| 700461237H1 | g453188 | 48 | −23 | gb105pln | *Z. mays* acp mRNA for acyl |
| | | | | | carrier protein. |
| 700617984H1 | g1519252 | 13 | 6 | gb105pln | *Oryza sativa* GF14-d protein |
| | | | | | mRNA, complete cds. |
| 700617683H1 | g1420686 | 8 | −17 | gb105eukp | RPL18B |
| 700615851H1 | g603269 | 13 | −10 | gb105eukp | YER036C; Yer036cp |
| 700461184H1 | g2706451 | 27 | −7 | gb105pln | Yeast (*Saccharomyces pombe*) |
| | | | | | chromosome I cosmid c3G9. |
| 700613864H1 | g927575 | 9 | −2 | gb105eukp | alpha galactosidase |
| 700618695H1 | g1256258 | 18 | 15 | gb105pln | *Spinacia oleracea* |
| | | | | | voltage-dependent anion channel protein (SVDAC1) mRNA, complete cds. |
| 700618135H1 | g1330386 | 7 | −2 | gb105eukp | C27A2.2 |
| 700615077H1 | g1808684 | 14 | 6 | gb105allp | hypothetical protein |
| 700612408H1 | g2654088 | 34 | −15 | gb105eukp | KUP1; potassium transporter |
| 700612912H1 | g2828011 | 91 | −30 | gb105pln | *Zea mays* starch synthase I |
| | | | | | precursor (Ss1) mRNA, nuclear gene encoding plastid protein, complete cds. |
| 700612582H1 | g498906 | 26 | 4 | gb105allp | ribosomal protein L27 homolog |
| 700615058H1 | g2217940 | 27 | 6 | gb105allp | copper transporting ATPase |
| 700618362H1 | g1321992 | 27 | 15 | gb105pln | *S. tuberosum* mRNA for 14-3-3 |
| | | | | | protein. |
| 700615234H1 | g433051 | 13 | 10 | gb105pln | *Arabidopsis thaliana* protein |
| | | | | | kinase (TOUSLED) mRNA, required for leaf and flower |
| | | | | | development, complete cds. |
| 700618259H1 | g1553128 | 24 | −9 | gb105pln | *Gossypium hirsutum* ribosomal |
| | | | | | protein L44 isoform a (RL44), complete cds. |
| 700617489H1 | g22522 | 83 | −68 | gb105pln | *Zea mays* gene encoding a zein |
| | | | | | (clone Z4). |
| 700617790H1 | g1771850 | 7 | 6 | gb105eukp | sar1 |
| 700612633H1 | g1644322 | 22 | −2 | gb105eukp | SPAC6G9.10c; hypothetical |
| | | | | | protein |
| 700612784H1 | g2369713 | 36 | −35 | gb105pln | *Beta vulgaris* cDNA for |
| | | | | | elongation factor 2. |
| 700614394H1 | g2408071 | 13 | 0 | gb105eukp | SPAC31F12.02c; ubiquitin |
| | | | | | fusion degradation protein |
| 700461246H1 | g396209 | 38 | −20 | gb105pln | *S. polyrrhiza* mRNA for |
| | | | | | D-myo-inositol-3-phosphate synthase. |
| 708617383H1 | g168679 | 87 | −5 | gb105pln | Maize 19 kDa zein mRNA, clone |
| | | | | | cZ19C2, complete cds. |
| 700612664H1 | g1335965 | 42 | −0 | gb105pln | *Zea mays* acetyl CoA |
| | | | | | carboxylase mRNA, partial cds. |
| 700615543H1 | g2213424 | 23 | −18 | gb105pln | *Citrus paradisi* mRNA for |
| | | | | | hypothetical protein. |
| 700617274H1 | g2702263 | 40 | −3 | gb105eukp | T21L14.2; mitochondrial |
| | | | | | F1-ATPase, gamma subunit |
| 700617103H1 | g780371 | 45 | −16 | gb105pln | *Oryza sativa* enolase mRNA, |
| | | | | | complete cds. |
| 700612626H1 | g2264306 | 15 | 17 | gb105pln | *Arabidopsis thaliana* genomic |
| | | | | | DNA, chromosome 5, P1 clone: MBK5, complete sequence. |
| 700616831H1 | g288062 | 43 | −41 | gb105pln | *A. thaliana* mRNA for ketol-acid |
| | | | | | reductoisomerase subunit. |
| 700612766H1 | g533251 | 39 | −78 | gb105pln | *Zea mays* (clone PSM8) sucrose |
| | | | | | synthase 2 (Sus1) gene, complete cds. |
| 700615622H1 | g13001 | 13 | −7 | gb105allp | NADH dehydrogenase 4L |
| 700613759H1 | g2511567 | 39 | −35 | gb105pln | *Arabidopsis thaliana* mRNA for |
| | | | | | proteasome subunit prct. |
| 700614946H1 | g171784 | 21 | −11 | gb105pln | Yeast (*Saccharomyces* |
| | | | | | *cerevisiae*) alpha-ketoglutarate dehydrogenase gene, complete cds. |
| 700615777H1 | g804946 | 17 | 4 | gb105allp | acyl-(acyl carrier protein) |
| | | | | | thioesterase |
| 700616673H1 | g168500 | 42 | 0 | gb105pln | Maize (*Zea mays*) histone H4 |
| | | | | | gene (H4C14), complete cds. |
| 700614509H1 | g1944159 | 8 | 8 | gb105allp | dTDP-D-glucose-4,6-dehydratase |
| 700615058H1 | g2660670 | 25 | 6 | gb105allp | putative Cu2+-transporting |
| | | | | | ATPase |
| 700616105H1 | g1553130 | 36 | −58 | gb105pln | *Gossypium hirsutum* ribosomal |
| | | | | | protein L44 isoform b (RL44), complete cds. |
| 700612995H1 | g33985 | 19 | −4 | gb105allp | trypsin inhibitor |
| 700613185H1 | g2113845 | 26 | −50 | gb105pln | *Hordeum vulgare* mRNA for |
| | | | | | hypothetical protein, partial, clone WL3. |
| 700613475H1 | g975887 | 13 | 17 | gb105pln | *Mesembryanthemum crystallinum* |
| | | | | | myo-inositol-1-phosphate synthase mRNA, complete cds. |
| 700617534H1 | g1778148 | 45 | −84 | gb105pln | *Zea mays* plastid |
| | | | | | phosphate/phosphoenolpyruvate translocator precursor (MZPPT4) |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | mRNA, complete cds. |
| 700612569H1 | g2584827 | 23 | −19 | gb105pln | Sequence of BAC F12F1 from |
| | | | | | *Arabidopsis thaliana* chromosome 1, complete sequence. |
| 700616539H1 | g313768 | 25 | 4 | gb105allp | Ubiquitin carboxyl terminal |
| | | | | | hydrolase |
| 700615110H1 | g22119 | 27 | 11 | gb105pln | Maize Adh1-F mRNA for alcohol |
| | | | | | dehydrogenase. |
| 700612382H1 | g2827550 | 55 | 3 | gb105allp | leucine rich repeat receptor |
| | | | | | kinase-like protein |
| 700613430H1 | g456672 | 12 | 2 | gb105eukp | VDAC 1; voltage dependent |
| | | | | | anion channel (VDAC) |
| 700615563H1 | g22528 | 32 | 1 | gb105pln | *Zea mays* mRNA encoding a zein |
| | | | | | (clone A20). |
| 700612901H1 | g1136121 | 47 | −36 | gb105pln | *O. sativa* mRNA for |
| | | | | | alpha-tubulin (clone OSTA-136). |
| 700613005H1 | g2414432 | 3 | 7 | gb105eukp | ZC84.1 |
| 700461108H1 | g2673912 | 31 | −9 | gb105eukp | T24P15.12 |
| 700613464H1 | g313759 | 89 | −23 | gb105pln | *Z. mays* hsp 70-1 gene for heat |
| | | | | | shock protein 70. |
| 700616387H1 | g2832242 | 28 | −24 | gb105pln | *Zea mays* 22-kDa alpha zein |
| | | | | | gene cluster, complete sequence. |
| 700616447H1 | g179354 | 9 | 2 | gb105allp | branched chain acyltransferase |
| | | | | | precursor |
| 700615123H1 | g2459420 | 73 | −4 | gb105eukp | F4P9.14; putative ribosomal |
| | | | | | protein L17 |
| 700617514H1 | g899609 | 26 | −37 | gb105pln | *Zea mays* acidic ribosomal |
| | | | | | protein P2 (RPA-2A1) mRNA, complete cds. |
| 700615206H1 | g22270 | 31 | −32 | gb105pln | Maize mRNA from an embryogenic |
| | | | | | abscisic acid-inducible gene. |
| 700613721H1 | g2398680 | 17 | −10 | gb105pln | *Morinda citrifolia* mRNA for |
| | | | | | 3-deoxy-D-arabino-heptulosonate 7-phosphate synthase, DS2. |
| 700616679H1 | g2827544 | 22 | 7 | gb105eukp | T12H17.60; HSP associated |
| | | | | | protein like |
| 700612369H1 | g1864000 | 97 | −11 | gb105pln | Maize DNA for Fd III, complete |
| | | | | | cds. |
| 700615171H1 | g2570506 | 37 | 14 | gb105pln | *Oryza sativa* ribosomal protein |
| | | | | | mRNA, complete cds. |
| 700612667H1 | g1395191 | 33 | 7 | gb105eukp | 26S proteasome ATPase subunit |
| 700617408H1 | g168498 | 49 | −97 | gb105pln | Corn histone H4 (H4C13) gene, |
| | | | | | complete cds. |
| 700614254H1 | g476338 | 36 | −25 | gb105eukp | hel; putative RNA helicase |
| 700612370H1 | g2394229 | 66 | −3 | gb105eukp | MSI1; WD-40 repeat protein |
| 700612351H1 | g2431768 | 76 | −14 | gb105pln | *Zea mays* acidic ribosomal |
| | | | | | protein P1a (rpp1a) mRNA, complete cds. |
| 700615903H1 | g2760316 | 13 | 7 | gb105pln | The sequence of BAC F1N21 from |
| | | | | | *Arabidopsis thaliana* chromosome 1, complete sequence. |
| 700618578H1 | g218202 | 18 | 5 | gb105pln | Rice mRNA for Xenopus material |
| | | | | | G10 (RAK136 gene), partial sequence. |
| 700616980H1 | g2465129 | 13 | −3 | gb105eukp | Ole e 1.0103 protein |
| 700612369H1 | g168472 | 97 | −11 | gb105pln | Maize ferredoxin III (Fd) |
| | | | | | isoprotein mRNA, pFD3. |
| 700614050H1 | g642120 | 57 | −16 | gb105pln | *Oryza sativa* small GTP-binding |
| | | | | | protein (ORRab-2) mRNA, complete cds. |
| 700614467H1 | g1353644 | 28 | −3 | gb105eukp | L43 |
| 700616865H1 | g405130 | 11 | −9 | gb105pln | *Arabidopsis thaliana* |
| | | | | | nuclear-encoded chloroplast stromal cyclophilin (ROC4) mRNA, complete cds. |
| 700615022H1 | g22531 | 79 | −42 | gb105pln | *Zea mays* mRNA encoding a zein |
| | | | | | (clone pZ22.1). |
| 700618496H2 | g1006830 | 15 | −1 | gb105pln | *Gossypium hirsutum* |
| | | | | | acyl-CoA-binding protein mRNA, complete cds. |
| 700461290H1 | g22322 | 16 | 15 | gb105pln | *Z. mays* mRNA for H2B histone |
| | | | | | (clone cH2B214). |
| 700615050H1 | g2293565 | 31 | −6 | gb105pln | *Oryza sativa* ADP-ribosylation |
| | | | | | factor 1 (Os-ARF1) mRNA, complete cds. |
| 700614327H1 | g1771157 | 14 | 7 | gb105pln | *L. esculentum* mRNA for MFP1 |
| | | | | | protein. |
| 700616341H1 | g4755 | 25 | −13 | gb105eukp | ORF1 |
| 700613337H1 | g454881 | 16 | −18 | gb105pln | Rice gene for thioredoxin h, |
| | | | | | complete cds. |
| 700614490H1 | g602252 | 77 | −89 | gb105pln | *Zea mays* enolase (eno2) mRNA, |
| | | | | | complete cds. |
| 700616485H1 | g19795 | 5 | 6 | gb105allp | auxin-induced protein |
| 700461157H1 | g2274990 | 60 | −48 | gb105pln | *Hordeum vulgare* mRNA for |
| | | | | | expressed sequence tag. |
| 700616426H1 | g167060 | 16 | 16 | gb105pln | Barley histone H3 mRNA, 3' |
| | | | | | end. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700615322H1 | g22537 | 22 | −21 | gb105pln | Maize mRNA for zein polypeptide (clone M6). |
| 700615185H1 | g169820 | 23 | −34 | gb105pln | Oryza sativa triosephosphate isomerase (Rictpi) mRNA, complete cds. |
| 700615714H1 | g2290400 | 26 | −8 | gb105eukp | stearoyl-ACP desaturase |
| 700616316H1 | g2662313 | 27 | −27 | gb105pln | Hordeum vulgare mRNA for bpw3, complete cds. |
| 700617945H1 | g1167953 | 5 | −1 | gb105eukp | putative 32.6 kDa jasmonate-induced protein |
| 700617244H1 | g19280 | 23 | −11 | gb105pln | L. esculentum mRNA for enolase. |
| 700615872H1 | g1495231 | 96 | −27 | gb105pln | Z. mays mRNA for 22 kD zein protein. |
| 700613162H1 | g22507 | 28 | 14 | gb105pln | Maize (strain W64A) mRNA for cell wall glycoprotein. |
| 700613712H1 | g556685 | 36 | −24 | gb105pln | Z. mays mRNA for ADP-ribosylation factor. |
| 700614067H1 | g21794 | 31 | 12 | gb105pln | Wheat histone H4 gene. |
| 700615618H1 | g1321917 | 21 | 6 | gb105eukp | su12; cytoplasmic ribosomal protein S7 |
| 700613030H1 | g600387 | 19 | −31 | gb105eukp | proteosome subunit |
| 700615730H1 | g1542940 | 27 | 5 | gb105pln | R. sativus L. (Saxa knacker) AACT mRNA. |
| 700616330H1 | g310314 | 53 | −49 | gb105pln | Oryza sativa calmodulin gene, complete cds. |
| 700617191H1 | g1314385 | 55 | −13 | gb105pln | Tripsacum laxum de Wet 3766 [ITS1, 5.8S ribosomal RNA, ITS2. |
| 700612621H1 | g485376 | 73 | −46 | gb105pln | Zea mays alpha-3-tubulin gene, complete cds. |
| 700614017H1 | g451192 | 72 | −8 | gb105pln | Triticum aestivum (wali7) mRNA, 3' end, partial cds. |
| 700616350H1 | g166970 | 13 | −18 | gb105pln | Hordeum vulgare acyl carrier protein III (Acl3) gene, complete cds. |
| 700613217H1 | g2160158 | 17 | −9 | gb105eukp | F21M12.3 |
| 700615207H1 | g171704 | 10 | 1 | gb105allp | hexaprenyl pyrophosphate synthetase (COQ1) |
| 700615374H1 | g1196433 | 55 | 6 | gb105allp | unknown protein |
| 700618093H1 | g2511567 | 17 | 1 | gb105pln | Arabidopsis thaliana mRNA for proteasome subunit prct. |
| 700617517H1 | g20163 | 30 | 2 | gb105pln | O. sativa Rr15 mRNA for 5S ribosomal RNA. |
| 700615418H1 | 91370535 | 11 | 12 | gb105pln | Yeast (Saccharomyces cerevisiae) chromosome XVI reading frame ORF YPL259c. |
| 700615895H1 | g168512 | 34 | 8 | gb105pln | Maize major protein (L3) mRNA from the surface of lipid bodies, 3' end. |
| 700616211H1 | g22540 | 44 | −64 | gb105pln | Maize mRNA for 10 kDa zein. |
| 700617632H1 | g1008195 | 21 | −6 | gb105eukp | ORF YJL055w |
| 700617143H1 | g20252 | 25 | 3 | gb105pln | Oryza sativa H3 histone H3R-21 clone RH3-2. |
| 700615384H1 | g168677 | 60 | −106 | gb105pln | Maize 19 kDa zein mRNA, clone cZ19C1, complete cds. |
| 700461126H1 | g527680 | 63 | −36 | gb105eukp | ribosomal protein S3 |
| 700615307H1 | g2388937 | 40 | −35 | gb105eukp | SPAC23H4.18c; hypothetical protein |
| 700613847H1 | 9452360 | 25 | 17 | gb105pln | V. faba mRNA for guanine nucleotide regulatory protein (807bp). |
| 700613275H1 | g1841401 | 15 | −10 | gb105eukp | fae1; condensing enzyme involved in fatty acid chain elongation in developing seeds and podwall; fatty acid elongation 1 |
| 700461256H1 | g168500 | 58 | −39 | gb105pln | Maize (Zea mays) histone H4 gene (H4C14), complete cds. |
| 700612360H1 | g19280 | 46 | −13 | gb105pln | L. esculentum mRNA for enolase. |
| 700612812H1 | g1185553 | 38 | 10 | gb105pln | Zea mays glyceraldehyde-3-phosphate dehydrogenase (gpc2) gene, complete cds. |
| 700613135H1 | g2252863 | 13 | −11 | gb105eukp | A_TM018A10.14 |
| 700613936H1 | g1015315 | 20 | 7 | gb105pln | P. sativum (clone PsRCI35-2) ribosomal protein L41 mRNA, complete cds. |
| 700461126H1 | g1055070 | 57 | −34 | gb105eukp | C23G10.3 |
| 700616274H1 | g1395190 | 45 | −55 | gb105pln | Spinacia oleracea L. mRNA for 26S proteasome ATPase subunit, complete cds. |
| 700616931H1 | g1754992 | 59 | −78 | gb105pln | Triticum aestivum calmodulin TaCaM1-2 mRNA, complete cds. |
| 700612379H1 | g22288 | 100 | −13 | gb105pln | Maize mRNA fragment for endosperm glutelin-2. |
| 700614760H1 | g2814711 | 19 | −0 | gb105eukp | T12D8.8 |
| 700618244H1 | g402552 | 18 | −10 | gb105eukp | ketol-acid reductoisomerase; EC 1.1.1.86 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700616301H1 | g1066493 | 6 | 4 | gb105eukp | YPR144C; Ypr144cp |
| 700617478H1 | g1507664 | 27 | −18 | gb105pln | Yeast DNA for bfr2+ protein/pad1+ protein/sks1+ protein, ORF N313, ORF N150, complete cds, and for ORF N118, partial cds. |
| 700613795H1 | g2189964 | 71 | 4 | gb105allp | Phosphoglycerate dehydrogenase |
| 700617411H1 | g440094 | 20 | −30 | gb105pln | *Arabidopsis thaliana* ribosomal protein S15a, complete cds. |
| 700617313H1 | g167141 | 43 | −30 | gb105pln | Spring cabbage histidinol dehydrogenase mRNA, complete cds. |
| 700614524H1 | g22528 | 76 | −15 | gb105pln | *Zea mays* mRNA encoding a zein (clone A20). |
| 700615290H1 | g2231312 | 32 | 7 | gb105eukp | AtRAB18; AtRab18 |
| 700618395H1 | g1469218 | 16 | −24 | gb105pln | *B. oleracea* mRNA (unknown). |
| 700613145H1 | g425802 | 48 | −71 | gb105pln | Rice mRNA for heat shock protein 70 (gene name AD622), partial cds. |
| 700616225H1 | g487286 | 54 | −6 | gb105pln | Rice mRNA EN053, partial sequence. |
| 700461180H1 | g1167953 | 7 | 7 | gb105allp | putative 32.6 kDa jasmonate-induced protein |
| 700614530H1 | g1002532 | 39 | −17 | gb105pln | *Arabidopsis thaliana* actin-11 (ACT11) gene, complete cds. |
| 700617529H1 | g163434 | 6 | 5 | gb105allp | 2-oxoglutarate/malate carrier protein |
| 700615883H1 | g1906825 | 50 | −43 | gb105pln | *A. thaliana* hsp81.2 gene. |
| 700618540H1 | g2656031 | 11 | 15 | gb105pln | *Arabidopsis thaliana* genomic DNA, chromosome 5, P1 clone: MXC20. |
| 700616972H1 | g609658 | 18 | −15 | gb105eukp | osmoregulation and cell shape control; protein phosphatase 2C (ptc3+) |
| 700616570H1 | g2829865 | 38 | −20 | gb105eukp | F3I6.4 |
| 700613687H1 | g167244 | 20 | −36 | gb105pln | *Chlorella kessleri* elongation factor 2 mRNA, complete cds. |
| 700614780H1 | g1419369 | 96 | −1 | gb105pln | *Z. mays* ZmABP3 mRNA for actin depolymerizing factor. |
| 700613365H1 | g1432057 | 17 | −18 | gb105pln | *Petroselinum crispum* DNA-binding protein WRKY2 mRNA, partial cds. |
| 700615832H1 | g499011 | 60 | −34 | gb105pln | *S. vulgare* SoAc1 mRNA. |
| 700618005H1 | g1125690 | 32 | −37 | gb105pln | *S. tuberosum* mRNA for DnaJ protein. |
| 700615065H1 | g556672 | 18 | −15 | gb105pln | *S. cereale* (Halo) chloroplast mRNA for heat-shock protein. |
| 700617610H1 | g2204063 | 46 | 10 | gb105pln | Pea mRNA for F1 ATPase, complete cds. |
| 700614758H1 | g498906 | 21 | −9 | gb105eukp | RPL27-5; ribosomal protein L27 homolog |
| 700614993H1 | g473976 | 27 | −34 | gb105pln | Rice mRNA, partial homologous to elongation factor 1-alpha gene. |
| 700615092H1 | g1125691 | 8 | −1 | gb105eukp | dnaJ; DnaJ protein |
| 700615029H1 | g468055 | 44 | −72 | gb105pln | *Zea mays* B73 QM protein mRNA, complete cds. |
| 700618393H1 | g1321660 | 9 | 1 | gb105pln | Rice mRNA for ascorbate peroxidase, complete cds. |
| 700616456H1 | g483546 | 8 | 0 | gb105pln | *R. communis* gene for pyrophosphate-dependent phosphofructokinase alpha subunit. |
| 700614972H1 | g619928 | 6 | 5 | gb105eukp | hexokinase; EC 2.7.1.1 |
| 700616578H1 | g849195 | 10 | 5 | gb105eukp | YDR374C; Ydr374cp |
| 700612626H1 | g2392762 | 17 | 14 | gb105pln | *Arabidopsis thaliana* BAC T32N15 from chromsome V, complete sequence. |
| 700616505H1 | g218088 | 39 | −50 | gb105pln | Rice mRNA for ribosomal protein 117 (249 gene), partial sequence. |
| 700615201H1 | g1369978 | 13 | 5 | gb105eukp | C44B9.4 |
| 700618479H2 | g2341023 | 15 | −8 | gb105pln | Sequence of BAC F19P19 from *Arabidopsis thaliana* chromosome 1, complete sequence. |
| 700617073H1 | g168677 | 40 | −53 | gb105pln | Maize 19 kDa zein mRNA, clone cZ19C1, complete cds. |
| 700613947H1 | g22528 | 95 | −39 | gb105pln | *Zea mays* mRNA encoding a zein (clone A20). |
| 700616371H1 | g790498 | 17 | −2 | gb105eukp | ETF-beta; electron-transferring flavoprotein beta chain |
| 700614254H1 | g1749748 | 42 | −31 | gb105eukp | similar to *Saccharomyces cerevisiae* eukaryotic initiation factor 4A (EIF-4), SWISS-PROT Accession Number P10081 |
| 700612422H1 | g459894 | 100 | −31 | gb105pln | *Zea mays* sus1 gene, complete cds. |
| 700618295H1 | g1184775 | 14 | −18 | gb105pln | *Zea mays* glyceraldehyde-3-phosphate dehydrogenase GAPC4 (gpc4) mRNA, complete cds. |
| 700614046H1 | g21794 | 44 | −54 | gb105pln | Wheat histone H4 gene. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700614496H1 | g2662344 | 41 | −56 | gb105pln | *Oryza sativa* mRNA for EF-1 alpha, complete cds. |
| 700614696H1 | g1262145 | 23 | −17 | gb105pln | *S. oleracea* mRNA for proteasome 37 kD subunit. |
| 700617119H1 | g1914683 | 33 | −0 | gb105eukp | assembly factor of the complex for nucleotide excision repair of V-damaged DNA; RAD23, isoform I |
| 700461146H1 | g602564 | 39 | −24 | gb105pln | *C. paradisi* (Macf) INO1 gene. |
| 700617788H1 | g1171351 | 20 | 12 | gb105pln | *Oryza sativa* 16 kDa oleosin (ole16) mRNA, complete cds. |
| 700615715H1 | g1881692 | 47 | −24 | gb105pln | *Zea mays* phosphoglucomutase mRNA, partial cds. |
| 700613651H1 | g1200282 | 8 | 1 | gb105eukp | F48F7.1 |
| 700616895H1 | g520478 | 46 | 3 | gb105eukp | pyruvate dehydrogenase E1 beta subunit |
| 700614328H1 | g22592 | 48 | −44 | gb105pln | *S. vulgare* PEPC gene for phosphoenolpyruvate carboxylase. |
| 700613126H1 | g18245 | 45 | −45 | gb105pln | *Chlamydomonas reinhardtii* UBI1-ribosomal protein fusion mRNA. |
| 700612494H1 | g21629 | 41 | 15 | gb105pln | *Sorghum vulgare* mRNA for phosphoenolpyruvate carboxylase (PEPC). |
| 700615188H1 | g1395193 | 12 | −6 | gb105eukp | RNA-binding protein RZ-1 |
| 700461222H1 | g22514 | 82 | 0 | gb105pln | Maize Zc1 gene for Zein Zc1 (14 kD zein-2). |
| 700616692H1 | g168500 | 18 | −45 | gb105pln | Maize (*Zea mays*) histone H4 gene (H4C14), complete cds. |
| 700613962H1 | g600115 | 45 | −9 | gb105pln | *Z. mays* apx gene encoding cytosolic ascorbate peroxidase. |
| 700615493H1 | g398606 | 9 | 5 | gb105allp | eEF-1beta |
| 700615851H1 | g695169 | 12 | −17 | gb105eukp | unknown |
| 700613419H1 | g886739 | 21 | −2 | gb105pln | *Z. mays* histone H4 gene. |
| 700616330H1 | g20187 | 53 | −49 | gb105pln | *O. sativa* gene encoding calmodulin. |
| 700618395H1 | g2584827 | 11 | 13 | gb105pln | Sequence of BAC F12F1 from *Arabidopsis thaliana* chromosome 1, complete sequence. |
| 700616925H1 | g2633848 | 10 | 8 | gb105allp | similar to GTP-binding elongation factor |
| 700617283H1 | g22324 | 18 | −34 | gb105pln | *Z. mays* mRNA for H2B histone (clone cH2B221). |
| 700612742H1 | g1136297 | 13 | 5 | gb105pln | Tobacco mRNA for WIPK, complete cds. |
| 700616112H1 | g168505 | 29 | −42 | gb105pln | *Zea mays* histone H3 gene, complete cds. |
| 700616273H1 | g1403043 | 27 | 4 | gb105pln | *H. chilense* × *T. turgidum* conv. durum (Tritordeum) mRNA for S-adenosylmethionine decarboxylase. |
| 700613719H1 | g22514 | 98 | −41 | gb105pln | Maize Zc1 gene for Zein Zc1 (14 kD zein-2). |
| 700613911H1 | g2808637 | 56 | −55 | gb105pln | *Daucus carota* mRNA for Rab8-like small GTP-binding protein. |
| 700617170H1 | g1682950 | 17 | 3 | gb105allp | GroES |
| 700616443H1 | g2408068 | 9 | −16 | gb105eukp | SPAC2F3.16; hypothetical protein |
| 700616529H1 | g473602 | 92 | −9 | gb105pln | *Zea mays* W-22 histone H2A mRNA, complete cds. |
| 700613240H1 | g2352492 | 27 | 0 | gb105eukp | TIR1; transport inhibitor response 1 |
| 700614963H1 | g514945 | 51 | −90 | gb105pln | *Zea mays* sucrose synthase (Sus1) mRNA, complete cds. |
| 700615588H1 | g2827142 | 18 | 7 | gb105pln | *Arabidopsis thaliana* cellulose synthase catalytic subunit (Ath-B) mRNA, complete cds. |
| 700615612H1 | g643596 | 56 | −95 | gb105pln | Corn mRNA for cysteine proteinase, clone CCP, complete cds. |
| 700615916H1 | g457406 | 39 | −1 | gb105eukp | ATMPK7; MAP kinase |
| 700614476H1 | g602393 | 9 | 7 | gb105eukp | YEL026w; Ye1026wp |
| 700614951H1 | g168677 | 43 | −76 | gb105pln | Maize 19 kDa zein mRNA, clone cZ19C1, complete cds. |
| 700616552H1 | g2570223 | 12 | −7 | gb105pln | Sequence of BAC F20D22 from *Arabidopsis thaliana* chromosome 1, complete sequence. |
| 700616508H1 | g158313 | 38 | 3 | gb105eukp | He125E; DECD family putative RNA helicase |
| 700615951H1 | g398257 | 40 | −0 | gb105allp | Ribosomal protein L2 |
| 700614946H1 | g2827698 | 30 | −25 | gb105pln | *Arabidopsis thaliana* DNA chromosome 4, BAC clone F6H11 (ESSAII project). |
| 700618531H1 | g468504 | 18 | −0 | gb105allp | CCTeta, eta subunit of the chaperonin containing TCP-1 (CCT) |
| 700618357H1 | g20045 | 15 | 2 | gb105allp | ORF |
| 700612910H1 | g22537 | 63 | −66 | gb105pln | Maize mRNA for zein |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | polypeptide (clone M6). |
| 700615758H1 | g2766447 | 32 | −51 | gb105pln | Sorghum bicolor cytochrome P450 CYP98A1 (CYP98A1) mRNA, complete cds. |
| 700615089H1 | g544506 | 19 | 0 | gb105eukp | SIK1; Sik1p |
| 700615154H1 | g6959 | 10 | −9 | gb105eukp | ZK637.5 |
| 700614813H1 | g169758 | 62 | −27 | gb105pln | O. sativa ADP-glucose pyrophosphorylase 51 kD subunit mRNA, complete cds. |
| 700615618H1 | g7353 | 23 | 7 | gb105eukp | rp1024 protein |
| 700618595H1 | g22144 | 14 | −40 | gb105pln | Maize anaerobically regulated gene for fructose bisphosphate aldolase (EC 4.1.2.13). |
| 700616110H1 | g1086830 | 5 | 8 | gb105eukp | F10E7.8 |
| 700614705H1 | g1906830 | 13 | 6 | gb105allp | heat shock protein |
| 700616658H1 | g2262113 | 13 | 6 | gb105allp | unknown protein |
| 700616985H1 | g340933 | 46 | −51 | gb105pln | Zea mays 10-kDa zein gene, complete cds. |
| 700614002H1 | g1458245 | 17 | 7 | gb105eukp | F54D11.1 |
| 700461234H1 | g1322276 | 32 | −13 | gb105pln | Triticum aestivum histone H2A gene, complete cds. |
| 700612758H1 | g170746 | 48 | −75 | gb105pln | Wheat histone H4 TH091 gene, complete cds. |
| 700618553H1 | g2345150 | 13 | 0 | gb105eukp | AtDRG1; developmentally regulated GTP binding protein |
| 700616831H1 | g21233 | 43 | −40 | gb105pln | S. oleracea AHRI mRNA for acetohydroxy acid reductoisomerase. |
| 700614059H1 | g1070355 | 25 | −22 | gb105pln | H. vulgare mRNA for cytochrome c (Vc subunit). |
| 700615213H1 | g2706450 | 19 | −7 | gb105eukp | ppa2; magnesium dependent soluble inorganic pyrophosphatase |
| 700616392H1 | g21628 | 34 | −39 | gb105pln | Sorghum vulgare mRNA for phosphoenolpyruvate involved in C4 photosynthesis (EC 4.1.1.31). |
| 700618506H1 | g940288 | 7 | −8 | gb105eukp | protein localized in the nucleoli of pea nuclei; ORF; putative |
| 700617194H1 | g2814651 | 46 | −7 | gb105eukp | R09B3.5 |
| 700461124H1 | g1293783 | 75 | −65 | gb105pln | Oryza sativa QM gene, complete cds. |
| 700613877H1 | g1314103 | 12 | −0 | gb105eukp | YPR028C; unknown |
| 700615676H1 | g16951 | 32 | 6 | gb105allp | 60S ribosomal protein L12 |
| 700616341H1 | g1107903 | 33 | −29 | gb105eukp | SPAC11D3.14c, unknown |
| 700612347H1 | g20266 | 23 | −26 | gb105pln | O. sativa mRNA for lipoxygenase L-2. |
| 700613847H1 | g488699 | 28 | 17 | gb105pln | M. sativa Rab mRNA. |
| 700612575H1 | g2293565 | 44 | −20 | gb105pln | Oryza sativa ADP-ribosylation factor 1 (Os-ARF1) mRNA, complete cds. |
| 700616813H1 | g1015315 | 17 | 11 | gb105pln | P. sativum (clone PsRCI35-2) ribosomal protein L41 mRNA, complete cds. |
| 700616701H1 | g2208961 | 34 | −0 | gb105pln | O. sativa mRNA for signal recognition particle subunit 14. |
| 700617038H1 | g22520 | 45 | −87 | gb105pln | Zea mays mRNA fragment encoding a zein gene (clone PZ19.1) (homologous to <ZMZE01>). |
| 700461140H1 | g2827142 | 30 | −15 | gb105pln | Arabidopsis thaliana cellulose synthase catalytic subunit (Ath-B) mRNA, complete cds. |
| 700612810H1 | g2288886 | 32 | −38 | gb105pln | Arabidopsis thaliana mRNA for mevalonate diphosphate decarboxylase. |
| 700617127H1 | g2765139 | 44 | −17 | gb105pln | N. rustica mRNA for 1-phosphatidylinositol-4, 5-bisphosphate phosphodiesterase. |
| 700612746H1 | g22537 | 53 | −72 | gb105pln | Maize mRNA for zein polypeptide (clone M6). |
| 700613001H1 | g2150046 | 15 | 5 | gb105allp | 26S proteasome subunit 9 |
| 700613206H1 | g168679 | 50 | −54 | gb105pln | Maize 19 kDa zein mRNA, clone cZ19C2, complete cds. |
| 700613880H1 | g1508829 | 37 | 8 | gb105allp | seven in absentia homolog |
| 700615412H1 | g22314 | 28 | −47 | gb105pln | Maize mRNA for GSH gluthathione S-transferase I (GST; EC 2.5.1.18). |
| 700615412H1 | g168490 | 30 | −45 | gb105pln | Maize glutathione S-transferase (GST-I) mRNA, complete cds. |
| 700617984H1 | g1519253 | 13 | 6 | gb105allp | GF14-d protein |
| 700618207H1 | g747914 | 37 | 3 | gb105pln | Z. mays CaM1 mRNA for calmodulin. |
| 700614840H1 | g967984 | 26 | −38 | gb105pln | Oryza sativa (clone rma630) ribosomal protein-linked ubiquitin mRNA, complete cds. |
| 700613379H1 | g1620661 | 17 | −52 | gb105pln | Triticum aestivum 1,4-alpha-D-glucan 6-alpha-D-(1,4-alpha-D-glucanotransferase mRNA, complete cds. |
| 700617923H1 | g862479 | 34 | −29 | gb105pln | Glycine max valosin-containing protein mRNA, complete cds. |
| 700613304H1 | g804655 | 12 | −8 | gb105pln | Hordeum vulgare L. beta-glucosidase (BGQ60) gene, complete cds. |
| 700615522H1 | g695789 | 9 | 8 | gb105eukp | GST27; glutathione |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | transferase; EC 2.5.1.18 |
| 700613409H1 | g643073 | 9 | 9 | gb105pln | *Fragaria × ananassa* putative 40S ribosomal protein s12 mRNA, complete cds. |
| 700612621H1 | g22149 | 74 | −47 | gb105pln | *Z. mays* mRNA for alpha-tubulin 3. |
| 700618659H1 | g18818 | 26 | −1 | gb105pln | *H. annuus* SF3 gene for transcription factor SF3. |
| 700617039H1 | g2695678 | 26 | −23 | gb105pln | *Spinacia oieracea* heat shock 70 protein (HSC70-11) mRNA, nuclear gene encoding mitochondrial protein, complete cds. |
| 700616620H1 | g609289 | 65 | −6 | gb105pln | *Z. mays* cultivar (LG11) ROA mRNA for replication origin activator protein. |
| 700614345H1 | g508544 | 92 | −68 | gb105pln | *Zea mays* 24-kD alpha-zein gene (floury2), complete cds. |
| 700612533H1 | g1276828 | 15 | −8 | gb105eukp | trpG; anthranilate synthase component II |
| 700614936H1 | g2618677 | 18 | 15 | gb105pln | *Arabidopsis thaliana* BAC F21B7 chromosome 1, complete sequence. |
| 700614743H1 | g1814402 | 37 | −39 | gb105pln | *Mesembryanthemum crystallinum* methionine synthase (MetE) mRNA, complete cds. |
| 700616372H1 | g2641210 | 17 | −2 | gb105pln | *Fritillaria agrestis* histone-like protein mRNA, complete cds. |
| 700618247H1 | g168669 | 18 | −32 | gb105pln | Maize 19 kDa zein mRNA, clone cZ19A2, partial cds. |
| 700614213H1 | g559921 | 15 | 1 | gb105allp | axi 1 gene product |
| 700614988H1 | g2511591 | 25 | −15 | gb105pln | *Arabidopsis thaliana* mRNA for proteasome subunit prc8. |
| 700615617H1 | g2618599 | 9 | 14 | gb105pln | *Arabidopsis thaliana* genomic DNA, chromosome 5, P1 clone: MBD2, complete sequence. |
| 700617146H1 | g168700 | 87 | −26 | gb105pln | *Z. mays* zein mRNA, complete cds. |
| 700613313H1 | g995745 | 34 | −63 | gb105pln | *T. aestivum* AGP-L gene cDNA. |
| 700617287H1 | g854177 | 8 | 6 | gb105allp | RNA polymerase II subunit hRPB17 |
| 700613984H1 | g703066 | 51 | −12 | gb105eukp | ste13+; RNA helicase |
| 700615126H1 | g168512 | 57 | −7 | gb105pln | Maize major protein (L3) mRNA from the surface of lipid bodies, 3' end. |
| 700614010H1 | g290057 | 34 | −9 | gb105eukp | TBP10; HIV1 TAT-binding protein |
| 700614002H1 | g1787951 | 16 | 7 | gb105allp | cyclopropane-fatty-acyl-phospholipid synthase |
| 700617006H1 | g49652 | 11 | 0 | gb105allp | ribosomal protein S19 (AA 1 - 133) |
| 700615518H1 | g16968 | 26 | 6 | gb105allp | 60S ribosomal protein L27A |
| 700614711H1 | g1136121 | 37 | −40 | gb105pln | *O. sativa* mRNA for alpha-tubulin (clone OSTA-136). |
| 700614931H1 | g2281648 | 22 | −10 | gb105pln | *Arabidopsis thaliana* AP2 domain containing protein RAP2.12 mRNA, partial cds. |
| 700615612H1 | g559531 | 54 | −102 | gb105pln | *Z. mays* mRNA for cysteine proteinase. |
| 700615151H1 | g2564049 | 8 | 13 | gb105pln | *Arabidopsis thaliana* genomic DNA, chromosome 5, P1 clone: MLE2, complete sequence. |
| 700617507H1 | g2586122 | 18 | −7 | gb105pln | *Allium porrum* b-keto acyl reductase (glossy8) mRNA, partial cds. |
| 700612579H1 | g2245081 | 11 | 2 | gb105eukp | myosin II heavy chain homolog |
| 700612683H1 | g531030 | 75 | −61 | gb105pln | *Pennisetum ciliare* apomixis-associated mRNA. |
| 700614904H1 | g1321917 | 32 | 7 | gb105allp | cytoplasmic ribosomal protein S7 |
| 700615074H1 | g2529229 | 12 | −8 | gb105eukp | gnd; 6-phosphogluconate dehydrogenase; EC 1.1.1.44 |
| 700618161H1 | g303854 | 9 | 2 | gb105pln | Rice mRNA for ribosomal protein L7A, complete cds. |
| 700614268H1 | g16121 | 58 | 3 | gb105pln | Oat TUB1 mRNA for beta-tubulin (partial). |
| 700618222H1 | g556685 | 30 | −29 | gb105pln | *Z. mays* mRNA for ADP-ribosylation factor. |
| 700615016H1 | g536555 | 9 | 1 | gb105eukp | URP1A |
| 700612451H1 | g2443401 | 68 | −19 | gb105pln | *Oryza sativa* mRNA for orthophosphate dikinase, complete cds. |
| 700614215H1 | g2213932 | 8 | 7 | gb105allp | 26S proteasome regulatory subunit |
| 700616992H1 | g471162 | 15 | −5 | gb105eukp | post-translational processing of proprotein precursors to various vacuolar proteins; precursor of vacuolar processing enzyme |
| 700613423H1 | g167535 | 45 | −44 | gb105pln | *Cucumis sativus* stearoyl-acyl-carrier protein (stearoyl-ACP) desaturase mRNA, complete cds. |
| 700618695H1 | g1724099 | 13 | 16 | gb105pln | *Mesembryanthemum crystallinum* voltage-dependent anion-selective channel protein porin (VDAC) mRNA, complete |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700616766H1 | g22528 | 85 | −24 | gb105pln | cds.<br>*Zea mays* mRNA encoding a zein (clone A20). |
| 700616831H1 | g402551 | 33 | −38 | gb105pln | *A. thaliana* gene for acetohydroxy acid isomoreductase. |
| 700613226H1 | g2558668 | 10 | 1 | gb105allp | eukaryotic translation initiation factor |
| 700615588H1 | g2827138 | 21 | 4 | gb105pln | *Arabidopsis thaliana* cellulose synthase catalytic subunit (RSW1) gene, complete cds. |
| 700616930H1 | g2641618 | 23 | −39 | gb105pln | *Zea mays* ubiquitin-conjugating enzyme protein E2 (ubc7) mRNA, complete cds. |
| 700618271H1 | g475252 | 9 | 13 | gb105pln | *Z. mays* MPI gene. |
| 700615141H1 | g432367 | 74 | −6 | gb105pln | Rice mRNA for elongation factor 1 beta, complete cds. |
| 700613729H1 | g463151 | 69 | −66 | gb105pln | *Zea mays* high sulfur zein gene, complete cds. |
| 700615244H1 | g2264303 | 16 | 8 | gb105pln | *Arabidopsis thaliana* genomic DNA, chromosome 5, P1 clone: MBB18, complete sequence. |
| 700613341H1 | g2062155 | 22 | −13 | gb105eukp | T02O04.2; mitochondrial processing peptidase alpha subunit precusor isolog |
| 700615883H1 | g20255 | 54 | −47 | gb105pln | *O. sativa* gene for heat shock protein 82 HSP82. |
| 700616533H1 | g168460 | 43 | −15 | gb105pln | *Zea mays* cyclophilin (CyP) mRNA, complete cds. |
| 700614942H1 | g22326 | 27 | 5 | gb105pln | *Z. mays* gene for Hageman factor inhibitor. |
| 700617335H1 | g1790439 | 31 | 6 | gb105allp | phosphoribosylaminoimidazolecarboxamide formyltransferase and IMP cyclohydrolase (bifunctional enzyme) |
| 700613119H1 | g984964 | 13 | 3 | gb105eukp | SIK1; suppressor of toxicity of GAL4-IKB; Sik1p |
| 700616480H1 | g396230 | 16 | −9 | gb105eukp | putative ATP synthase subunit |
| 700615070H1 | g1732411 | 12 | 6 | gb105allp | isopeptidase T |
| 700615525H1 | g1895083 | 41 | −73 | gb105pln | *Zea mays* golgi associated protein se-wap41 mRNA, complete cds. |
| 700617823H1 | g1054843 | 6 | 8 | gb105eukp | D12 oleate desaturase |
| 700616908H1 | g515750 | 44 | −45 | gb105pln | Soybean phytochrome A (phyA) mRNA, complete cds. |
| 700614868H1 | g886739 | 79 | −7 | gb105pln | *Z. mays* histone H4 gene. |
| 700615649H1 | g437041 | 23 | −11 | gb105pln | *M. esculenta* mRNA for granule-bound starch synthase. |
| 700614247H1 | g391602 | 22 | 7 | gb105pln | *Arabidopsis thaliana* mRNA for casein kinase II catalytic subunit. |
| 700614813H1 | g18887 | 60 | −26 | gb105pln | *H. vulgare* agpp mRNA for ADP-glucose pyrophosphorylase small subunit. |
| 700615233H1 | g1469221 | 15 | 5 | gb105allp | protein similar to bacterial YRN1 and HEAHIO proteins |
| 700618578H1 | g391883 | 31 | −30 | gb105pln | Rice mRNA for maternal G10 like protein, complete cds. |
| 700617091H1 | g508544 | 52 | −64 | gb105pln | *Zea mays* 24-kD alpha-zein gene (floury2), complete cds. |
| 700613158H1 | g2293565 | 39 | −43 | gb105pln | *Oryza sativa* ADP-ribosylation factor 1 (Os-ARF1) mRNA, complete cds. |
| 700614211H1 | g22119 | 35 | −14 | gb105pln | Maize Adh1-F mRNA for alcohol dehydrogenase. |
| 700614327H1 | g1771158 | 18 | −3 | gb105eukp | MFP1; MFP1 protein |
| 700616088H1 | g20768 | 49 | 4 | gb105eukp | PSRPL27; ribosomal protein L27 |
| 700614728H1 | g18045 | 32 | −20 | gb105pln | *C. lanceolata* mRNA for beta-ketoacyl-ACP reductase. |
| 700461140H1 | g2827138 | 33 | −20 | gb105pln | *Arabidopsis thaliana* cellulose synthase catalytic subunit (RSW1) gene, complete cds. |
| 700615609H1 | g1737446 | 18 | −3 | gb105pln | *Eucalyptus globulus* auxin-induced protein (EgPar) mRNA, complete cds. |
| 700616641H1 | g571469 | 23 | 17 | gb105pln | *Chlamydomonas reinhardtii* histone H3 (ch3-II), histone H4 (ch4-II), histone H2B (ch2b-II) and histone H2A (ch2a-II) genes, complete cds. |
| 700612650H1 | g1370517 | 12 | 6 | gb105eukp | ORF YPL252c |
| 700614265H1 | g168690 | 51 | 6 | gb105pln | Maize zein mRNA, complete cds, clone ZG124. |
| 700612524H1 | g2331300 | 64 | −52 | gb105pln | *Zea mays* ribosomal protein S4 type I (rps4) mRNA, complete cds. |
| 700612301H1 | g2618720 | 24 | −1 | gb105pln | *Arabidopsis thaliana* early auxin-1nduced (IAA16) mRNA, complete cds. |
| 700612952H1 | g16379 | 34 | −35 | gb105pln | *A. thaliana* mRNA for laminin receptor homologue. |
| 700613804H1 | g1747293 | 32 | −29 | gb105pln | Rice mRNA for vacuolar H+-pyrophosphatase, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700616327H1 | g168579 | 35 | −57 | gb105pln | Maize pyruvate, orthophosphate dikinase mRNA, complete cds. |
| 700613114H1 | g2832242 | 61 | −75 | gb105pln | Zea mays 22-kDa alpha zein gene cluster, complete sequence. |
| 700613851H1 | g19280 | 47 | 3 | gb105pln | L. esculentum mRNA for enolase. |
| 700615730H1 | g1542941 | 43 | −1 | gb105eukp | AACT; Acetoacetyl-coenzyme A thiolase; EC 2.3.1.9 |
| 700616222H1 | g17586 | 19 | 4 | gb105allp | UBIQUITIN-CONJUGATING ENZYME |
| 700614773H1 | g560 | 39 | −23 | gb105allp | MLRQ subunit of the NADH: ubiquinone oxidoreductase complex |
| 700616968H1 | g577595 | 11 | −0 | gb105eukp | NUO-24 |
| 700616961H1 | g1781347 | 37 | −36 | gb105pln | S. tuberosum mRNA for protein homologous to plastidic aldolase, partial. |
| 700614955H1 | g18245 | 38 | −52 | gb105pln | Chlamydomonas reinhardtii UBI1-ribosomal protein fusion mRNA. |
| 700612520H1 | g871513 | 48 | −38 | gb105pln | P. sativum mRNA for small G protein. |
| 700613165H1 | g556685 | 46 | −12 | gb105pln | Z. mays mRNA for ADP-ribosylation factor. |
| 700613360H1 | g1732065 | 29 | 3 | gb105allp | 5-oxo-L-proilnase |
| 700615716H1 | g556673 | 21 | 0 | gb105eukp | heat-shock protein |
| 700612581H1 | g31062 | 17 | 2 | gb105allp | Epstein-Barr virus small RNA associated protein |
| 700461167H1 | g486267 | 5 | 8 | gb105allp | ORF YKL154w |
| 700612807H1 | g1016130 | 28 | 7 | gb105allp | prenyl transferase |
| 700614092H1 | g2244990 | 34 | 4 | gb105allp | similarity to LIM homeobox protein - Caenorhabditis |
| 700615188H1 | g1435062 | 12 | −6 | gb105eukp | RNA binding protein, RZ-1 |
| 700615671H1 | g2102692 | 16 | −1 | gb105pln | Lycopersicon esculentum fructokinase (Frk2) mRNA, complete cds. |
| 700618084H1 | g2104535 | 23 | −16 | gb105eukp | T10M13.13; T10M13.13 |
| 700618102H1 | g2739216 | 12 | 15 | gb105pln | Hordeum vulgare L41 ribosomal protein. |
| 700461170H1 | g587545 | 19 | −12 | gb105pln | S. tuberosum mRNA encoding homolog to Human P23 tumor protein. |
| 700613011H1 | g217973 | 34 | −77 | gb105pln | Zea mays gene for triosephosphate isomerase, complete cds. |
| 700612970H1 | g2651298 | 7 | 8 | gb105allp | putative ribosomal protein S26 |
| 700615239H1 | g2827513 | 7 | 16 | gb105pln | Arabidopsis thaliana DNA chromosome 4, BAC clone F8F16 (ESSAII project). |
| 700617584H1 | g2522483 | 11 | 15 | gb105pln | Hordeum vulgare knotted class 1 homeodomain protein (k) mRNA, complete cds. |
| 700613442H1 | g498737 | 60 | −66 | gb105pln | H. vulgare (pMaW21) pseudo mRNA for beta-ketoacyl-ACP synthase (partial). |
| 700617764H1 | g951335 | 28 | −28 | gb105pln | Oryza sativa protein phosphatase 1 mRNA, complete cds. |
| 700616505H1 | g310932 | 36 | −47 | gb105pln | Nicotiana tabacum ribosomal protein L17 mRNA, complete cds. |
| 700617508H1 | g1049306 | 31 | −44 | gb105pln | Arabidopsis thaliana actin-2 mRNA, complete cds. |
| 700616421H1 | g532822 | 18 | −14 | gb105eukp | F57B9.4 |
| 700617959H1 | g436782 | 27 | −45 | gb105pln | Rice mRNA for cyc07, complete cds. |
| 700616492H1 | g290275 | 34 | −13 | gb105eukp | M(3)95A; multifunctional activity and location; ribosomal protein S3/AP endonuclease DNA repair protein |
| 700615522H1 | g161172 | 13 | 1 | gb105eukp | elongation factor 1-gamma |
| 700615060H1 | g312180 | 20 | −61 | gb105pln | Z. mays GapC4 gene. |
| 700616970H1 | g168476 | 56 | −67 | gb105pln | Zea mays ferredoxin-dependent glutamate synthase mRNA, complete cds. |
| 700461167H1 | g600886 | 9 | 6 | gb105allp | signal recognition particle receptor beta subunit |
| 700613419H1 | g170746 | 22 | −4 | gb105pln | Wheat histone H4 TH091 gene, complete cds. |
| 700616631H1 | g1132506 | 19 | 8 | gb105eukp | F28C6.7 |
| 700613319H1 | g485388 | 6 | 5 | gb105allp | eukaryotic initiation factor 4AII |
| 700617618H1 | g485376 | 42 | −73 | gb105pln | Zea mays alpha-3-tubulin gene, complete cds. |
| 700461185H1 | g2393774 | 82 | −70 | gb105pln | Zea mays endosperm-specific prolamin box binding factor (PBF) mRNA, complete cds. |
| 700615958H1 | g22322 | 15 | −65 | gb105pln | Z. mays mRNA for H2B histone (clone cH2B214). |
| 700615815H1 | g2773225 | 10 | 2 | gb105eukp | w03G9.4 |
| 700613980H1 | g1814402 | 51 | −45 | gb105pln | Mesembryanthemum crystallinum methionine synthase (MetE) mRNA, complete cds. |
| 700613746H1 | g463251 | 16 | 1 | gb105pln | M. sativa (Nagyszenasi) mRNA |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | for ribosomal protein RL5. |
| 700612928H1 | g602605 | 53 | 1 | gb105pln | Zea mays tandem genes for alpha1-tubulin and alpha2-tubulin. |
| 700614874H1 | g1653075 | 8 | 3 | gb105allp | sensory transduction histidine kinase |
| 700617077H1 | g1432140 | 45 | −71 | gb105pln | Triticum aestivum ADP-glucose pyrophosphorylase (WAL1) mRNA, partial cds. |
| 700461158H1 | g2108346 | 40 | −28 | gb105pln | Brassica campestris small GTP-binding protein Bsar1b (bsar1b) mRNA, complete cds. |
| 700616869H1 | g529374 | 32 | −2 | gb105pln | Spinach mRNA for glutathione reductase, mature peptide. |
| 700461269H1 | g1173840 | 11 | 5 | gb105allp | malonyl-CoA: ACP transacylase |
| 700613961H1 | g1279588 | 19 | −4 | gb105eukp | glutathione S-transferase; EC 2.5.1.18 |
| 700616346H1 | g600390 | 56 | −50 | gb105pln | A. thaliana UbcAT4b mRNA for ubiquitin conjugating enzyme E2. |
| 700615028H1 | g16511 | 30 | −27 | gb105pln | A. thaliana mRNA for suppressor-like protein. |
| 700617773H1 | g18748 | 10 | 7 | gb105allp | a protein similar to potato tuber protein p322 homolgous to Bowman-Birk Proteinase Inhibitor |
| 700616442H1 | g1658314 | 18 | −1 | gb105pln | O. sativa osr40g3 gene. |
| 700613171H1 | g1272407 | 28 | −18 | gb105pln | Arabidopsis thaliana immunophilin (FKBP15-2) mRNA, complete cds. |
| 700615229H1 | g643479 | 12 | 2 | gb105eukp | GCN20; Gcn20p |
| 700612510H1 | g1335965 | 73 | −76 | gb105pln | Zea mays acetyl CoA carboxylase mRNA, partial cds. |
| 700618556H1 | g2645165 | 43 | 8 | gb105pln | Oryza sativa mRNA, similar to ribosomal protein 41. |
| 700618393H1 | g1321661 | 8 | 7 | gb105eukp | ascorbate peroxidase; EC 1.11.1.11 |
| 700612426H1 | g540534 | 33 | 6 | gb105pln | Rice mRNA for q group of receptor for activated C-kinase, complete cds. |
| 700461136H1 | g1051257 | 63 | −54 | gb105pln | Hordeum vulgare vacuolar ATPase catalytic subunit mRNA, partial cds. |
| 700613373H1 | g170746 | 28 | 14 | gb105pln | Wheat histone H4 TH091 gene, complete cds. |
| 700616858H1 | g557695 | 92 | −84 | gb105pln | Zea mays GTP binding protein beta subunit (ZGB1) mRNA, complete cds. |
| 700613223H1 | g2653284 | 13 | 1 | gb105pln | Oryza sativa mRNA for enoyl-ACP reductase. |
| 700614342H1 | g1209700 | 58 | −61 | gb105pln | Zea mays ribosomal protein L12 mRNA, complete cds. |
| 700616068H1 | g2462742 | 12 | −4 | gb105eukp | F8A5.25 |
| 700617873H1 | g473602 | 64 | −103 | gb105pln | Zea mays W-22 histone H2A mRNA, complete cds. |
| 700613632H1 | g295746 | 9 | 4 | gb105eukp | Gpdh |
| 700617347H1 | g1778146 | 78 | −90 | gb105pln | Zea mays plastid phosphate/phosphoenolpyruvate translocator precursor (MZPPT1) mRNA, complete cds. |
| 700616915H1 | g532095 | 16 | −10 | gb105eukp | ZC395.7 |
| 700616625H1 | g1293564 | 21 | −6 | gb105pln | Arabidopsis thaliana isopentenyl diphosphate: dimethylallyl diphosphate isomerase (IPP2) mRNA, complete cds. |
| 700461103H1 | g435456 | 30 | −57 | gb105pln | Proso millet gene for aspartate aminotransferase, complete cds. |
| 700616332H1 | g19218 | 8 | 16 | gb105pln | Tomato extensin mRNA (clone w1-8 L). |
| 700616372H1 | g21798 | 24 | −15 | gb105pln | T. aestivum L mRNA for histone H1. |
| 700616925H1 | g2695949 | 8 | 8 | gb105allp | hypothetical protein MTV005.01 |
| 700612339H1 | g3046 | 21 | 4 | gb105eukp | NUO-40; 40 kD subunit of NADH dehydrogenase |
| 700612329H1 | g158297 | 48 | −4 | gb105eukp | RPS14A |
| 700612324H1 | g1917018 | 65 | −18 | gb105pln | Zea mays ribosomal protein S6 RPS6-1 (rps6-1) mRNA, complete cds. |
| 700617713H1 | g2062153 | 18 | 1 | gb105pln | Arabidopsis thaliana chromosome III BAC T02O04 genomic sequence, complete sequence. |
| 700461284H1 | g2341023 | 23 | −10 | gb105pln | Sequence of BAC F19P19 from Arabidopsis thaliana chromosome 1, complete sequence. |
| 700616360H1 | g927642 | 33 | −42 | gb105pln | Hordeum vulgare mRNA for betaine aldehyde dehydrogenase, complete cds. |
| 700613444H1 | g1044912 | 18 | −5 | gb105eukp | ribonucleotide reductase R2 |
| 700614209H1 | g288058 | 46 | −9 | gb105pln | Z. mays S13 mRNA for cytoplasmic ribosomal protein S13. |
| 700616493H1 | g2635013 | 7 | 8 | gb105allp | similar to hypothetical proteins |
| 700618645H1 | g2351062 | 13 | 10 | gb105pln | Arabidopsis thaliana genomic |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | DNA, chromosome 5, P1 clone: MAH20. |
| 700616495H1 | g22176 | 12 | 12 | gb105pln | *Z. mays* P gene. |
| 700613170H1 | g1498381 | 30 | −33 | gb105pln | *Zea mays* actin (Maz95) gene, partial cds. |
| 700612411H1 | g1839582 | 50 | −4 | gb105pln | polyubiquitin homolog {clone CHEM 6} [*Zea mays* = maize, cv. INRA 258, mercuric chloride-treated, leaves, mRNA Partial, 199 nt, segment 1 of 2]. |
| 700616920H1 | g168500 | 45 | −32 | gb105pln | Maize (*Zea mays*) histone H4 gene (H4C14), complete cds. |
| 700612568H1 | g500850 | 80 | −77 | gb105pln | *Zea mays* (clone pAKHSDH1) aspartate kinase-homoserine dehydrogenase mRNA, complete cds. |
| 700613452H1 | g397400 | 19 | −10 | gb105pln | *B. rapa* mRNA for S phase specific gene. |
| 700616866H1 | g2344892 | 40 | −10 | gb105eukp | T13E15.7 |
| 700618123H1 | g293886 | 48 | −100 | gb105pln | *Zea mays* glyceraldehyde-3-phosphate dehydrogenase mRNA, 3′ end, (clone gAPC3). |
| 700617492H1 | g1553130 | 19 | −35 | gb105pln | *Gossypium hirsutum* ribosomal protein L44 isoform b (RL44), complete cds. |
| 700617222H1 | g602252 | 30 | −1 | gb105pln | *Zea mays* enolase (eno2) mRNA, complete cds. |
| 700614832H1 | g483431 | 42 | 0 | gb105eukp | T151; cyc07 |
| 700616743H1 | g2288979 | 26 | 5 | gb105pln | *Arabidopsis thaliana* chromosome II BAC T01O24 genomic sequence, complete sequence. |
| 700613275H1 | g1255207 | 14 | −9 | gb105eukp | FAE1; fatty acid elongase |
| 700616314H1 | g436029 | 25 | −7 | gb105pln | *Nicotiana tabacum* (TSC40-3) 60S ribosomal protein L34 mRNA, complete cds. |
| 700618546H1 | g1072187 | 8 | 6 | gb105eukp | F35C8.7 |
| 700615572H1 | g602252 | 66 | −45 | gb105pln | *Zea mays* enolase (eno2) mRNA, complete cds. |
| 700461257H1 | g968901 | 36 | −20 | gb105pln | Rice mRNA for ribosomal protein S8, complete cds. |
| 700618036H1 | g21796 | 36 | −52 | gb105pln | Wheat histone H3 gene. |
| 700615871H1 | g22445 | 52 | −31 | gb105pln | *Zea mays* ZMPMS1 gene for 19 kDa zein protein. |
| 700616526H1 | g168410 | 90 | −18 | gb105pln | Maize alcohol dehydrogenase gene (Adh1-1F allele), 5′ end. |
| 700618530H1 | g1737217 | 10 | 14 | gb105pln | *Arabidopsis thaliana* vacuolar sorting receptor homolog mRNA, complete cds. |
| 700612851H1 | g600768 | 36 | 13 | gb105pln | *Oryza sativa* cyclophilin 2 (Cyp2) mRNA, complete cds. |
| 700617049H1 | g1620984 | 27 | −5 | gb105eukp | 60S ribosomal protein L15 |
| 700614816H1 | g1498589 | 11 | −1 | gb105eukp | ProsMA5; 20S proteasome alpha subunit PSMA5 |
| 700615448H1 | g1161601 | 18 | −15 | gb105pln | *N. tabacum* mRNA for phosphoglycerate kinase (cytosolic isoenzyme). |
| 700616094H1 | g1613878 | 6 | −3 | gb105eukp | modA; ModA |
| 700616412H1 | g536891 | 18 | −37 | gb105pln | Wheat mRNA for protein H2A, complete cds, clone wcH2A-4. |
| 700618386H1 | g218088 | 43 | −62 | gb105pln | Rice mRNA for ribosomal protein 117 (249 gene), partial sequence. |
| 700613053H1 | g22469 | 54 | −64 | gb105pln | Maize mRNA for cytoplasmic ribosomal protein S11. |
| 700612411H1 | g902583 | 57 | −16 | gb105pln | *Zea mays* clone MubG1 ubiquitin gene, complete cds. |
| 700615029H1 | g1293783 | 41 | −63 | gb105pln | *Oryza sativa* QM gene, complete cds. |
| 700616239H1 | g474001 | 28 | −21 | gb105pln | Rice mRNA, partial homologous to ribosomal protein L38 gene. |
| 700614362H1 | g606969 | 32 | −23 | gb105pln | *Arabidopsis thaliana* cytoplasmic ribosomal protein L18 mRNA, complete cds. |
| 700616150H1 | g1107484 | 17 | 1 | gb105pln | *A. thaliana* mRNA for 40S ribosomal protein S15. |
| 700615920H1 | g2760830 | 44 | −2 | gb105eukp | F18A8.1; putative beta-ketoacyl-CoA synthase |
| 700616948H1 | g191986 | 12 | 7 | gb105allp | clathrin-associated protein |
| 700618495H2 | g1923256 | 13 | 6 | gb105allp | 26S proteasome-associated pad1 homolog |
| 700613840H1 | g168500 | 75 | −11 | gb105pln | Maize (*Zea mays*) histone H4 gene (H4C14), complete cds. |
| 700617006H1 | g311297 | 11 | 0 | gb105allp | ribosomal protein S24 |
| 700614983H1 | g1015315 | 28 | 12 | gb105pln | *Pisum sativum* (clone PsRCI35-2) ribosomal protein L41 mRNA, complete cds. |
| 700616485H1 | g2190992 | 9 | 2 | gb105allp | glutathione S-transferase TSI-1 |
| 700615640H1 | g508544 | 67 | −84 | gb105pln | *Zea mays* 24-kD alpha-zein gene (floury2), complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700616014H1 | g536895 | 39 | −16 | gb105pln | Wheat mRNA for protein H2A, complete cds, clone wcH2A-10. |
| 700617477H1 | g1491930 | 41 | −41 | gb105pln | *Nicotiana tabacum* kinesin-like protein (tck1) mRNA, complete cds. |
| 700616506H1 | g798817 | 54 | −28 | gb105pln | *A. thaliana* mRNA for ribosomal protein L2. |
| 700461224H1 | g468055 | 69 | −57 | gb105pln | *Zea mays* B73 QM protein mRNA, complete cds. |
| 700615669H1 | g786129 | 19 | −5 | gb105pln | *Oryza sativa* root-specific RCc2 mRNA, complete cds. |
| 700612451H1 | g168579 | 72 | −22 | gb105pln | Maize pyruvate, orthophosphate dikinase mRNA, complete cds. |
| 700614339H1 | g166923 | 51 | −5 | gb105pln | *Arabidopsis thaliana* ubiquitin carrier protein (UBC1) mRNA, complete cds. |
| 700613340H1 | g2330815 | 13 | −13 | gb105eukp | SPAC4D7.12c; hypothetical protein |
| 700616122H1 | g1183998 | 11 | 3 | gb105eukp | SPAC13F4.02c; unknown |
| 700613973H1 | g168683 | 72 | −44 | gb105pln | Maize 22 kd (Mw = 26.53 kd) zein protein 1, mRNA. |
| 700616475H1 | g1747293 | 34 | −53 | gb105pln | Rice mRNA for vacuolar H+-pyrophosphatase, complete cds. |
| 700616430H1 | g22144 | 24 | −69 | gb105pln | Maize anaerobically regulated gene for fructose bisphosphate aldolase (EC 4.1.2.13). |
| 700612937H1 | g2058279 | 32 | −18 | gb105pln | *A. thaliana* mRNA for AtRan3 protein. |
| 700615283H1 | g22657 | 24 | −3 | gb105pln | *A. thaliana* mRNA for ubiquitin-conjugating enzyme. |
| 700616584H1 | g22328 | 91 | −9 | gb105pln | Maize mRNA for a high mobility group protein. |
| 700616341H1 | g1107904 | 33 | −24 | gb105eukp | SPAC11D3.15; unknown |
| 700614943H1 | g458969 | 12 | −5 | gb105eukp | E37C12.7 |
| 700615933H1 | g2565340 | 30 | 8 | gb105allp | ribosomal protein S14 |
| 700614935H1 | g296886 | 15 | 15 | gb105pln | *S. cereale* L12-1 mRNA for ribosomal protein L12. |
| 700613135H1 | g171967 | 4 | 5 | gb105eukp | poly (A)-binding protein |
| 700614879H1 | g1389824 | 18 | 4 | gb105pln | *Venturia canescens* cytochrome oxidase I gene, mitochondrial gene encoding mitochondrial protein, partial cds. |
| 700613262H1 | g166380 | 38 | 1 | gb105eukp | glucose-regulated endoplasmic reticular protein precursor |
| 700615304H1 | g166866 | 35 | −45 | gb105pln | *A. thaliana* ribosomal protein S11 mRNA, 3' end. |
| 700616340H1 | g1107486 | 19 | −18 | gb105pln | *A. thaliana* mRNA for 60S ribosomal protein L27a. |
| 700613289H1 | g168460 | 30 | −63 | gb105pln | *Zea mays* cyclophilin (CyP) mRNA, complete cds. |
| 700614874H1 | g1652132 | 10 | 3 | gb105allp | sensory transduction histidine kinase |
| 700614862H1 | g520828 | 5 | 7 | gb105allp | beta adaptin protein |
| 700616211H1 | g847833 | 37 | −44 | gb105pln | *Zea mays* 10 kDa zein gene, complete cds. |
| 700612822H1 | g248338 | 60 | −79 | gb105pln | polyubiquitin [maize, Genomic, 3439 nt]. |
| 700612711H1 | g602252 | 46 | −82 | gb105pln | *Zea mays* enolase (eno2) mRNA, complete cds. |
| 700612521H1 | g1654143 | 57 | −50 | gb105pln | *Brassica campestris* small GTP-binding protein rab (BRAB-1) mRNA, complete cds. |
| 700614450H1 | g168275 | 37 | −34 | gb105pln | Sweet potato starch phosphorylase mRNA, complete cds. |
| 700616327H1 | g168584 | 32 | −39 | gb105pln | Corn pyruvate, orthophosphate dikinase gene, exons 2–19. |
| 700617295H1 | g1154953 | 50 | −22 | gb105pln | *T. aestivum* histone H2A gene. |
| 700612836H1 | g22537 | 90 | −14 | gb105pln | Maize mRNA for zein polypeptide (clone M6). |
| 700613028H1 | g2290404 | 26 | −9 | gb105eukp | desaturates oleic acid to linoleic acid; delta-12 oleate desaturase |
| 700617284H1 | g2641618 | 73 | −74 | gb105pln | *Zea mays* ubiquitin-conjugating enzyme protein E2 (ubc7) mRNA, complete cds. |
| 700616849H1 | g546863 | 7 | 4 | gb105allp | RNA polymerase common subunit RPB6 [hamsters, CHO cells, Peptide, 127 aa] |
| 700616658H1 | g2264367 | 12 | 15 | gb105pln | *Arabidopsis thaliana* BAC F6P23 from chromosome IV, top arm, complete sequence. |
| 700616490H1 | g167961 | 34 | −28 | gb105pln | *D. caryophyllus* S-adenosylmethionine synthetase (CARSAM2) mRNA, complete cds. |
| 700613407H1 | g1276652 | 19 | −2 | gb105pln | *Porphyra purpurea* chloroplast genome, complete sequence. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700461169H1 | g41364 | 10 | 7 | gb105allp | malonyl CoA-acyl carrier protein transacylase |
| 700615214H1 | g1296954 | 15 | −27 | gb105pln | *O. sativa* mRNA for novel protein, osr40c1. |
| 700613874H1 | g495263 | 66 | −0 | gb105eukp | sec61; sec61 protein |
| 700613960H1 | g1841869 | 17 | 4 | gb105pln | *Pimpinella brachycarpa* elongation factor 1-beta (EF-1-beta) mRNA, complete cds. |
| 700613319H1 | g50823 | 6 | 5 | gb105allp | initiation factor 4AII (AA 1 - 407) |
| 700617408H1 | g168500 | 38 | −57 | gb105pln | Maize (*Zea mays*) histone H4 gene (H4C14), complete cds. |
| 700614922H1 | g2827663 | 10 | −1 | gb105eukp | membrane-associated salt-inducible-like protein |
| 700617354H1 | g415314 | 57 | −62 | gb105pln | Rice mRNA for NADP dependent malic enzyme, complete cds. |
| 700614380H1 | g474832 | 31 | −32 | gb105pln | *S. commersonii* mRNA for stearoyl-acyl carrier protein desaturase. |
| 700612968H1 | g168502 | 32 | −62 | gb105pln | Maize (*Zea mays*) histone H4 gene (H4C7), complete cds. |
| 700614446H1 | g2842494 | 18 | 1 | gb105eukp | F21O9.200; prohibitin-like protein |
| 700612544H1 | g313026 | 27 | −21 | gb105pln | *L. esculentum* rpl38 mRNA for ribosomal protein L38. |
| 700614525H1 | g169792 | 50 | −66 | gb105pln | Rice histone 3 gene, complete cds. |
| 700618053H1 | g168500 | 65 | −41 | gb105pln | Maize (*Zea mays*) histone H4 gene (H4C14), complete cds. |
| 700614774H1 | g169930 | 27 | −10 | gb105pln | Glycine max calcium dependent protein kinase mRNA. |
| 700616395H1 | g2062373 | 14 | 7 | gb105allp | cyclin-selective ubiquitin carrier protein |
| 700613026H1 | g1224069 | 14 | −1 | gb105allp | amidase |
| 700617650H1 | g1403537 | 12 | 14 | gb105pln | Yeast (*Saccharomyces cerevisiae*) chromosome XVI, left arm DNA. |
| 700612855H1 | g540532 | 49 | −69 | gb105pln | Rice mRNA for G protein alpha subunit, complete cds. |
| 700461136H1 | g1041676 | 86 | −78 | gb105pln | *Z. mays* mRNA for V-type H+-ATPase, clone 70-3. |
| 700613666H1 | g2231312 | 10 | 1 | gb105eukp | AtRAB18; AtRab18 |
| 700614720H1 | g168490 | 78 | −80 | gb105pln | Maize glutathione S-transferase (GST-I) mRNA, complete cds. |
| 700615287H1 | g1622930 | 15 | −2 | gb105eukp | how; putative RNA-binding protein; held out wings |
| 700613240H1 | g2088647 | 12 | 4 | gb105eukp | T28M21.10 |
| 700615146H1 | g220659 | 30 | 7 | gb105allp | dihydrolipoamide succinyltransferase |
| 700618393H1 | g2274984 | 6 | 7 | gb105eukp | ascorbate peroxidase |
| 700613710H1 | g288062 | 38 | −31 | gb105pln | *A. thaliana* mRNA for ketol-acid reductoisomerase subunit. |
| 700612569H1 | g483535 | 26 | −29 | gb105pln | *R. communis* gene for pyrophosphate-dependent phosphofructokinase beta subunit. |
| 700461119H1 | g577824 | 93 | −81 | gb105pln | *Z. mays* gene for H2B histone (gH2B3). |
| 700613892H1 | g20255 | 44 | −42 | gb105pln | *O. sativa* gene for heat shock protein 82 HSP82. |
| 700461256H1 | g515376 | 56 | −37 | gb105pln | *L. temulentum* mRNA for histone H4. |
| 700613918H1 | g20163 | 70 | −29 | gb105pln | *O. sativa* Rr15 mRNA for 5S ribosomal RNA. |
| 700615885H1 | g168673 | 43 | −34 | gb105pln | Maize 19 kDa zein mRNA, clone cZ19B1, complete cds. |
| 700616432H1 | g2656031 | 11 | −4 | gb105pln | *Arabidopsis thaliana* genomic DNA, chromosome 5, P1 clone: MXC20. |
| 700612632H1 | g21832 | 28 | 2 | gb105pln | Wheat mRNA for chloroplast phosphoglycerate kinase (EC 2.7.2.3). |
| 700614147H1 | g22302 | 43 | 11 | gb105pln | Maize Gpc1 gene for glyceraldehyde-3-phosphate dehydrogenase (GADPH) subunit C. |
| 700616972H1 | g1019405 | 19 | −16 | gb105eukp | SPAC2G11.07c; unknown |
| 700614909H1 | g2558654 | 9 | 1 | gb105allp | No definition line found |
| 700614931H1 | g2443456 | 18 | −20 | gb105pln | *Oryza sativa* ethylene responsive element binding protein (Os-EREBP1) mRNA, complete cds. |
| 700615886H1 | g312178 | 31 | −67 | gb105pln | *Z. mays* GapC2 gene. |
| 700612476H1 | g2182286 | 14 | 14 | gb105pln | Sequence of BAC F20P5 from *Arabidopsis thaliana* chromosome 1, complete sequence. |
| 700617020H1 | g21981 | 41 | −21 | gb105pln | *V. angustifolia* 25S/18S rRNA intergenic spacer DNA. |
| 700617170H1 | g143026 | 12 | 5 | gb105allp | heat shock protein |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700612468H1 | g1256607 | 34 | −3 | gb105pln | Glycine max G protein beta subunit mRNA, complete cds. |
| 700613145H1 | g313759 | 69 | −110 | gb105pln | Z. mays hsp 70-1 gene for heat shock protein 70. |
| 700613226H1 | g172286 | 7 | 7 | gb105eukp | PRT1 |
| 700618152H1 | g166859 | 15 | −12 | gb105pln | Arabidopsis thaliana ribosomal protein gene, complete cds. |
| 700615302H1 | g1020001 | 37 | −29 | gb105pln | Hordeum vulgare signal recognition particle 54 kDa subunit (Srp54-2) mRNA, complete cds. |
| 700616392H1 | g21629 | 64 | −75 | gb105pln | Sorghum vulgare mRNA for phosphoenolpyruvate carboxylase (PEPC). |
| 700616947H1 | g170302 | 15 | −10 | gb105eukp | PR0 |
| 700614529H1 | g2264319 | 14 | 8 | gb105pln | Arabidopsis thaliana genomic DNA, chromosome 5, P1 clone: MXA21, complete sequence. |
| 700613447H1 | g168673 | 67 | −76 | gb105pln | Maize 19 kDa zein mRNA, clone cZ19B1, complete cds. |
| 700614027H1 | g1143863 | 57 | −50 | gb105pln | Oryza sativa beta-glucosidase mRNA, nuclear gene encoding chloroplast protein, complete cds. |
| 700617605H1 | g288062 | 22 | 4 | gb105pln | A. thaliana mRNA for ketol-acid reductoisomerase subunit. |
| 700616940H1 | g2814379 | 25 | −3 | gb105eukp | B0513.3 |
| 700461146H1 | g975887 | 39 | −24 | gb105pln | Mesembryanthemum crystallinum myo-inositol-1-phosphate synthase mRNA, complete cds. |
| 700613884H1 | g7353 | 14 | 7 | gb105eukp | rp1024 protein |
| 700614960H1 | g474006 | 11 | 14 | gb105pln | Rice mRNA, partial homologous to ribosomal protein S11 gene. |
| 700616288H1 | g391874 | 39 | −26 | gb105pln | Rice mRNA for 40S subunit ribosomal protein, complete cds. |
| 700618607H1 | g662367 | 36 | −54 | gb105pln | Zea mays farnesyl pyrophosphate synthetase (fps) mRNA, complete cds. |
| 700461219H1 | g22322 | 40 | −50 | gb105pln | Z. mays mRNA for H2B histone (clone cH2B214). |
| 700613217H1 | g695789 | 5 | 8 | gb105eukp | GST27; glutathione transferase; EC 2.5.1.18 |
| 700613314H1 | g511665 | 61 | −8 | gb105pln | Rice gene for aspartic protease, complete cds. |
| 700615918H1 | g2739216 | 18 | 5 | gb105pln | Hordeum vulgare L41 ribosomal protein. |
| 700613379H1 | g1885343 | 17 | −52 | gb105pln | T. aestivum mRNA for starch branching enzyme II. |
| 700615070H1 | g1732412 | 11 | 6 | gb105allp | isopeptidase T |
| 700613745H1 | g290275 | 44 | −29 | gb105eukp | M(3)95A; multifunctional activity and location; ribosomal protein S3/AP endonuclease DNA repair protein |
| 700615317H1 | g1785861 | 36 | −62 | gb105pln | Elaeis guineensis var. tenera stearoyl-Acyl-carrier protein desaturase mRNA, partial cds. |
| 700616849H1 | g415388 | 7 | 4 | gb105allp | RNA Polymerase II subunit 14.4 kD |
| 700613725H1 | g1432142 | 53 | −44 | gb105pln | Triticum aestivum ADP-glucose pyrophosphorylase (WAL2) mRNA, partial cds. |
| 700614252H1 | g600768 | 31 | −17 | gb105pln | Oryza sativa cyclophilin 2 (Cyp2) mRNA, complete cds. |
| 700616468H1 | g1100223 | 23 | 1 | gb105eukp | glyceraldehyde-3-phosphate dehydrogenase; EC 1.2.1.12 |
| 700618161H1 | g303855 | 8 | 7 | gb105eukp | ribosomal protein L7A |
| 700613804H1 | g285637 | 40 | −40 | gb105pln | Hordeum vulgare mRNA for vacuolar membrane proton-translocating inorganic pyrophosphat. |
| 700616082H1 | g1653646 | 41 | −9 | gb105allp | uridine monophosphate kinase |
| 700613213H1 | g441486 | 7 | 4 | gb105allp | coatomer |
| 700616084H1 | g1514638 | 22 | −23 | gb105pln | S. oleracea mRNA for alpha-glucan phosphorylase. |
| 700612951H1 | g1532072 | 25 | −46 | gb105pln | Z. mays mRNA for S-adenosylmethionine decarboxylase. |
| 700614815H1 | g2664241 | 14 | −4 | gb105eukp | smd1; small nuclear ribonucleoprotein |
| 700617450H1 | g2262144 | 15 | 5 | gb105eukp | T10P11.11; putative tryptophan synthase alpha 1-like protein |
| 700613933H1 | g1616673 | 12 | 4 | gb105allp | RNA binding protein TIA-1 |
| 700615274H1 | g218368 | 9 | 8 | gb105eukp | CTPACTB; acetoacetyl-CoA thiolase A; EC 2.3.1.9 |
| 700613996H1 | g206181 | 100 | −12 | gb105allp | protein kinase C delta subspecies |
| 700617682H1 | g2656031 | 20 | 14 | gb105pln | Arabidopsis thaliana genomic DNA, chromosome 5, P1 clone: MXC20. |
| 700613690H1 | g166548 | 15 | −6 | gb105pln | Avena sativa vacuolar H+-ATPase 16 kDa proteolipid subunit (vatp-P1) mRNA, complete cds. |
| 700613042H1 | g517221 | 12 | 0 | gb105allp | ribosomal protein S24 |
| 700618154H1 | g2760155 | 8 | 2 | gb105eukp | ribosomal protein L19 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700616633H1 | g533085 | 30 | −3 | gb105pln | Thunbergia alata clone pTAD3 delta-9-stearoyl-acyl carrier protein desaturase precursor mRNA, complete cds. |
| 700613012H1 | g168490 | 41 | −102 | gb105pln | Maize glutathione S-transferase (GST-I) mRNA, complete cds. |
| 700614779H1 | g21233 | 41 | 16 | gb105pln | *S. oleracea* AHRI mRNA for acetohydroxy acid reductoisomerase. |
| 700612508H1 | g22118 | 36 | 8 | gb105pln | *Z. mays* DNA for Adh1-Cm allele. |
| 700615312H1 | g2737972 | 55 | 7 | gb105pln | *Zea mays* protein kinase ZmMEK1 mRNA, complete cds. |
| 700618229H1 | g2642164 | 16 | −2 | gb105eukp | T5I7.12 |
| 700614991H1 | g22636 | 11 | 7 | gb105eukp | 70 kDa heat shock protein |
| 700615234H1 | g2326230 | 40 | −39 | gb105pln | *Zea mays* tousled-like kinase 4 (MTK-4) mRNA, partial cds. |
| 700618353H1 | g762784 | 12 | 16 | gb105pln | *Brassica campestris* (clone BCPI-1) cysteine proteinase inhibitor mRNA, complete cds. |
| 700615172H1 | g2331300 | 45 | 15 | gb105pln | *Zea mays* ribosomal protein S4 type I (rps4) mRNA, complete cds. |
| 700617231H1 | g22118 | 51 | −31 | gb105pln | *Z. mays* DNA for Adh1-Cm allele. |
| 700614689H1 | g929961 | 19 | −12 | gb105eukp | ribosomal protein |
| 700617167H1 | g22447 | 68 | −29 | gb105pln | *Zea mays* ZMPMS2 gene for 19 kDa zein protein. |
| 700616533H1 | g829147 | 54 | −21 | gb105pln | *Z. mays* gene for cyclophilin. |
| 700614991H1 | g20834 | 12 | 6 | gb105pln | *P. sativum* PHSP1 mRNA for HSP70. |
| 700612633H1 | g2340994 | 22 | −3 | gb105eukp | SEN1; Sen1p |
| 700613147H1 | g780371 | 55 | −63 | gb105pln | *Oryza sativa* enolase mRNA, complete cds. |
| 700614963H1 | g459894 | 36 | −87 | gb105pln | *Zea mays* sus1 gene, complete cds. |
| 700615188H1 | g18347 | 7 | 1 | gb105eukp | glycine-rich protein |
| 700616222H1 | g600391 | 20 | 6 | gb105eukp | ubiquitin conjugating enzyme E2 |
| 700616305H1 | g256163 | 6 | −1 | gb105eukp | TTR; thioltransferase |
| 700618362H1 | g1070353 | 26 | 16 | gb105pln | *H. vulgare* mRNA for Hv14-3-3b. |
| 700617081H1 | g666101 | 14 | −4 | gb105eukp | NHP2; high mobility group-like nuclear protein 2 |
| 700613716H1 | g2388578 | 25 | −14 | gb105eukp | YUP8H12.20 |
| 700613736H1 | g563334 | 14 | 13 | gb105pln | *B. napus* (Naehan) bgb1 mRNA for guanine nucleotide regulatory protein. |
| 700617484H1 | g1694906 | 17 | −7 | gb105eukp | SME1; core snRNP protein E |
| 700614311H1 | g886739 | 50 | −44 | gb105pln | *Z. mays* histone H4 gene. |
| 700615457H1 | g2244747 | 18 | −0 | gb105pln | *Arabidopsis thaliana* DNA chromosome 4, ESSA I contig fragment No. 0. |
| 700616716H1 | g166868 | 32 | −18 | gb105pln | *Arabidopsis thaliana* ribosomal protein S11 (RPS11-beta) mRNA, complete cds. |
| 700614379H1 | g968901 | 48 | −36 | gb105pln | Rice mRNA for ribosomal protein S8, complete cds. |
| 700614874H1 | g1262210 | 7 | 4 | gb105eukp | nik-1; Nik-1 |
| 700615837H1 | g2341026 | 17 | 6 | gb105allp | F19P19.3 |
| 700617436H1 | g296204 | 18 | −8 | gb105eukp | pA1aAT-2; alanine aminotransferase; EC 2.6.1.2 |
| 700614725H1 | g1049407 | 12 | −9 | gb105eukp | C46F4.2 |
| 700615910H1 | g22284 | 8 | 3 | gb105eukp | Glb1-L; vicilin-like embryo storage protein |
| 700612987H1 | g2190551 | 12 | −1 | gb105eukp | F5I14.19 |
| 700613460H1 | g2282583 | 49 | −45 | gb105pln | *Zea mays* elongation factor 1-alpha (EF1-A) mRNA, complete cds. |
| 700612808H1 | g348717 | 25 | −14 | gb105pln | *Medicago truncatula* protachlorophyllide reductase homolgue protein mRNA, complete cds. |
| 700616562H1 | g1519240 | 11 | 2 | gb105pln | *Brassica napus* 10 kDa chaperonin mRNA, complete cds. |
| 700618591H1 | g710295 | 7 | 8 | gb105allp | ribosomal protein L22 |
| 700618227H1 | g1045304 | 30 | −39 | gb105pln | *Zea mays* acetyl-coenzyme A carboxylase mRNA, complete cds. |
| 700616951H1 | g1217976 | 16 | −2 | gb105eukp | SPAC1F12.02c; unknown |
| 700612837H1 | g2104538 | 66 | −0 | gb105eukp | T10M13.16; T10M13.16 |
| 700616931H1 | g1754994 | 59 | −79 | gb105pln | *Triticum aestivum* calmodulin TaCaM1-3 mRNA, complete cds. |
| 700616528H1 | g1136119 | 33 | −35 | gb105pln | *O. sativa* mRNA for alpha-tubulin (clone OSTA-111). |
| 700613211H1 | g1737491 | 25 | −22 | gb105pln | *Triticum aestivum* poly(A)-binding protein (wheatpab) mRNA, complete cds. |
| 700616105H1 | g1553128 | 34 | −59 | gb105pln | *Gossypium hirsutum* ribosomal protein L44 isoform a (RL44), complete cds. |
| 700618457H2 | g218261 | 12 | 13 | gb105pln | Soybean mRNA for early nodulin. |
| 700617450H1 | g1217610 | 18 | 4 | gb105aiIp | tryptophan synthase |
| 700614696H1 | g2511583 | 24 | −18 | gb105pln | *Arabidopsis thaliana* mRNA for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700614386H1 | g439260 | 13 | 5 | gb105allp | proteasome subunit prc9. T26G10.1 |
| 700614837H1 | g303854 | 33 | −63 | gb105pln | Rice mRNA for ribosomal protein L7A, complete cds. |
| 700613936H1 | g825783 | 20 | 7 | gb105pln | *Nicotiana tabacum* ribosomal protein L41 mRNA, complete cds. |
| 700615773H1 | g1296954 | 44 | 6 | gb105pln | *O. sativa* mRNA for novel protein, osr40c1. |
| 700461180H1 | g1167955 | 8 | 7 | gb105eukp | putative 32.7 kDa jasmonate-induced protein |
| 700614992H1 | g2695678 | 41 | −49 | gb105pln | *Spinacia oleracea* heat shock 70 protein (HSC70-11) mRNA, nuclear gene encoding mitochondrial protein, complete cds. |
| 700461130H1 | g1144535 | 51 | −74 | gb105pln | *Zea mays* opaque-2 heterodimerizing protein 1b (ohp1b) mRNA, complete cds. |
| 700615883H1 | g1906827 | 49 | −42 | gb105pln | *A. thaliana* hsp81.4 gene. |
| 700612518H1 | g498737 | 72 | −65 | gb105pln | *H. vulgare* (pMaW21) pseudo mRNA for beta-ketoacyl-ACP synthase (partial). |
| 700614738H1 | g940812 | 27 | −4 | gb105pln | *P. sativum* mRNA for actin protein. |
| 700616658H1 | g2558664 | 15 | 4 | gb105allp | hypothetical protein |
| 700461173H1 | g169792 | 68 | −58 | gb105pln | Rice histone 3 gene, complete cds. |
| 700617048H1 | g602252 | 26 | −16 | gb105pln | *Zea mays* enolase (eno2) mRNA, complete cds. |
| 700612901H1 | g1136119 | 46 | −35 | gb105pln | *O. sativa* mRNA for alpha-tubulin (clone OSTA-111). |
| 700614739H1 | g397395 | 38 | −19 | gb105pln | *Z. mays* MNB1b mRNA for DNA-binding protein. |
| 700461195H1 | g1098971 | 19 | 3 | gb105eukp | myo-inositol monophosphatase 3 |
| 700461261H1 | g22447 | 73 | −54 | gb105pln | *Zea mays* ZMPMS2 gene for 19 kDa zein protein. |
| 700613442H1 | g498738 | 51 | −53 | gb105pln | *H. vulgare* (pMaW20) pseudo mRNA for beta-ketoacyl-ACP synthase (partial). |
| 700615716H1 | g161028 | 12 | 8 | gb105allp | heat shock protein 86 |
| 700612494H1 | g169843 | 39 | 14 | gb105pln | *Saccharum* hybrid phosphoenolpyruvate carboxylase (SCPEPCD1) gene, complete cds. |
| 700613967H1 | g2244992 | 25 | −15 | gb105eukp | similarity to frequenin (neuronal calcium sensor) |
| 700612522H1 | g2695944 | 43 | −32 | gb105pln | *Hordeum vulgare* mRNA for H(+)-transporting ATPase-like protein, clone RG135. |
| 700614720H1 | g168486 | 54 | −35 | gb105pln | Maize glutathione S-transferase gene (GST-I), exon 1. |
| 700614737H1 | g1345503 | 67 | 2 | gb105eukp | p40, 40 kD protein |
| 700616071H1 | g398327 | 12 | 6 | gb105eukp | Binding to the poly(A)-tail of eukaryotic mRNAs; poly(A)-mRNA binding protein; PABP |
| 700616290H1 | g22537 | 74 | −73 | gb105pln | Maize mRNA for zein polypeptide (clone M6). |
| 700613326H1 | g600115 | 57 | −7 | gb105pln | *Z. mays* apx gene encoding cytosolic ascorbate peroxidase. |
| 700613430H1 | g516166 | 14 | 7 | gb105allp | 34 kDA porin |
| 700614248H1 | g19500 | 40 | 11 | gb105pln | *Lupinus polyphyllus* lupln-specific pPLZ12 mRNA. |
| 700615289H1 | g395078 | 27 | −28 | gb105pln | *B. rapa* ubiquitin and ribosomal protein mRNA, complete CDS's. |
| 700615412H1 | g168487 | 20 | −3 | gb105pln | Maize glutathione S-transferase gene (GST-I), exons 2 and 3. |
| 700613223H1 | g2653285 | 14 | 7 | gb105eukp | enoyl-ACP reductase; EC 1.3.1.9 |
| 700618386H1 | g310932 | 28 | −18 | gb105pln | *Nicotiana tabacum* ribosomal protein L17 mRNA, complete cds. |
| 700614970H1 | g2267596 | 18 | 1 | gb105pln | *Oryza sativa* 10 kDa chaperonin mRNA, complete cds. |
| 700614273H1 | g20163 | 43 | −42 | gb105pln | *O. sativa* Rr15 mRNA for 5S ribosomal RNA. |
| 700616839H1 | g22544 | 66 | −55 | gb105pln | Maize mRNA (clone A30) for zein (a plant storage protein). |
| 700612859H1 | g22119 | 24 | 10 | gb105pln | Maize Adh1-F mRNA for alcohol dehydrogenase. |
| 700617187H1 | g1147631 | 44 | 1 | gb105pln | *Oryza sativa* GBF type bZIP protein OSBZ8 mRNA, complete cds. |
| 700615304H1 | g474006 | 56 | −65 | gb105pln | Rice mRNA, partial homologous to ribosomal protein S11 gene. |
| 700616122H1 | g606970 | 9 | −3 | gb105eukp | cytoplasmic ribosomal protein L18 |
| 700613246H1 | g1397243 | 6 | 6 | gb105eukp | T12E12.4 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700617295H1 | g536891 | 45 | −17 | gb105pln | Wheat mRNA for protein H2A, complete cds, clone wcH2A-4. |
| 700614496H1 | g2662346 | 41 | −55 | gb105pln | *Oryza sativa* mRNA for EF-1 alpha, complete cds. |
| 700618553H1 | g2058456 | 13 | 0 | gb105eukp | ATDRG1; GTP-binding protein |
| 700616490H1 | g450548 | 42 | −39 | gb105pln | *O. sativa* (pRSAM-1) gene for S-adenosyl methionine synthetase. |
| 700612354H1 | g1550813 | 78 | −14 | gb105pln | *Z. mays* mRNA for acidic ribosomal protein P0. |
| 700614581H1 | g435456 | 34 | −18 | gb105pln | Proso millet gene for aspartate aminotransferase, complete cds. |
| 700615854H1 | g2654107 | 21 | −7 | gb105pln | *Pisum sativum* cytosine-5 DNA methyltransferase mRNA, complete cds. |
| 700615672H1 | g168704 | 98 | −108 | gb105pln | *Zea mays* zein protein gene, complete cds. |
| 700612988H1 | g2522194 | 20 | 0 | gb105pln | *Triticum aestivum* ornithine/acetylornithine aminotransferase mRNA, partial cds. |
| 700613217H1 | g161172 | 14 | 3 | gb105eukp | elongation factor 1-gamma |
| 700613687H1 | g2369713 | 34 | −57 | gb105pln | *Beta vulgaris* cDNA for elongation factor 2. |
| 700613341H1 | g587562 | 20 | −9 | gb105eukp | MPP; mitochondrial processing peptidase |
| 700618387H1 | g533251 | 43 | −59 | gb105pln | *Zea mays* (clone pSM8) sucrose synthase 2 (Sus1) gene, complete cds. |
| 700614030H1 | g577818 | 13 | 2 | gb105pln | *Z. mays* gene for H2B histone (gH2B4). |
| 700615715H1 | g1881694 | 44 | −15 | gb105pln | *Zea mays* phosphoglucomutase mRNA, partial cds. |
| 700614836H1 | g2661071 | 30 | 3 | gb105allp | similar to 26S proteasome subunit p45 |
| 700616985H1 | g22540 | 46 | −58 | gb105pln | Maize mRNA for 10 kDa zein. |
| 700618357H1 | g1167523 | 13 | 2 | gb105eukp | ORF (AA 1-1338) |
| 700618380H1 | g2662340 | 47 | −45 | gb105pln | *Oryza sativa* mRNA for EF-1 alpha, complete cds. |
| 700612426H1 | g540535 | 34 | 8 | gb105eukp | RWD |
| 700614048H1 | g577548 | 16 | −0 | gb105eukp | C16C10.7 |
| 700615246H1 | g168505 | 23 | −36 | gb105pln | *Zea mays* histone H3 gene, complete cds. |
| 700613106H1 | g1220280 | 8 | −3 | gb105eukp | SPAC22E12.05c; unknown |
| 700613051H1 | g2232255 | 16 | −5 | gb105pln | *Catharanthus roseus* ADP-ribosylation factor 1 (ARF1) mRNA, complete cds. |
| 700617143H1 | g168494 | 27 | 2 | gb105pln | Maize (*Zea mays*) histone H3 gene (H3C2), complete cds. |
| 700614913H1 | g1480670 | 69 | 4 | gb105allp | delta 1-pyrroline-5-carboxylate synthetase |
| 700612526H1 | g2827079 | 27 | −26 | gb105pln | *Medicago sativa* mitochondrial malate dehydrogenase precursor (mmdh) mRNA, nuclear gene encoding mitochondrial protein, complete cds. |
| 700613974H1 | g972243 | 19 | 2 | gb105allp | ribosomal protein S5 |
| 700618688H1 | g2244760 | 6 | 6 | gb105allp | selenium-binding protein |
| 700613984H1 | g157594 | 46 | −10 | gb105eukp | RNA helicase |
| 700616332H1 | g17820 | 6 | 16 | gb105pln | *B. napus* GRP22 gene encoding glycine rich protein (aa1-291). |
| 700617606H1 | g1276967 | 19 | −15 | gb105eukp | putative ribosomal protein |
| 700617594H1 | g473602 | 19 | 8 | gb105pln | *Zea mays* W-22 histone H2A mRNA, complete cds. |
| 700614228H1 | g21598 | 35 | −34 | gb105pln | *S. tuberosum* mRNA for UDP-glucose pyrophosphorylase. |
| 700614227H1 | g1638836 | 35 | −61 | gb105pln | *H. vulgare* mRNA for alpha-tubulin 2. |
| 700612346H1 | g1154953 | 41 | −9 | gb105pln | *T. aestivum* histone H2A gene. |
| 700616887H1 | g476103 | 22 | 5 | gb105allp | mago nashi protein |
| 700617708H1 | g1143387 | 28 | −4 | gb105pln | *A. thaliana* mRNA for Class III ADH. |
| 700461190H1 | g22322 | 21 | −29 | gb105pln | *Z. mays* mRNA for H2B histone (clone cH2B214). |
| 700618678H1 | g57078 | 31 | 6 | gb105allp | ribosomal protein L38 |
| 700613012H1 | g168486 | 30 | −38 | gb105pln | Maize glutathione S-transferase gene (GST-I), exon 1. |
| 700461290H1 | g22324 | 28 | 1 | gb105pln | *Z. mays* mRNA for H2B histone (clone cH2B221). |
| 700613240H1 | g2352494 | 27 | 0 | gb105eukp | TIR1; transport inhibitor response 1 |
| 700616122H1 | g2529670 | 11 | 7 | gb105eukp | T30B22.13; ribosomal protein L18-like |
| 700612554H1 | g687244 | 85 | −75 | gb105pln | *Zea mays* oil body protein 16 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | kDa oleosin (ole16) gene, complete cds. |
| 700461224H1 | g575354 | 61 | −51 | gb105pln | O. sativa SC34 mRNA for tumor suppressor. |
| 700612648H1 | g168500 | 53 | −41 | gb105pln | Maize (Zea mays) histone H4 gene (H4C14), complete cds. |
| 700615476H1 | q600115 | 55 | −51 | gb105pln | Z. mays apx gene encoding cytosolic ascorbate peroxidase. |
| 700614120H1 | g535019 | 53 | 5 | gb105pln | Z. mays Zd1 tandem genes for zein Zd1 (19 kDa Zein). |
| 700615894H1 | g237649 | 22 | −4 | gb105pln | enoyl-acyl carrier protein reductase [Brassica napus, mRNA, 1358 nt]. |
| 700617281H1 | g1498383 | 65 | −18 | gb105pln | Zea mays actin (Maz89) gene, partial cds. |
| 700613938H1 | g439522 | 14 | 4 | gb105allp | ribosomal protein S3 |
| 700614491H1 | g2992 | 25 | −8 | gb105pln | Neurospora crassa crp-1 mRNA for ribosomal protein homologous to Yeast cyH2 gene encoding L29. |
| 700618556H1 | g407800 | 16 | 9 | gb105pln | G. hirsutum mRNA for ribosomal protein 41, large subunit (RL41). |
| 700616832H1 | g2160155 | 19 | −3 | gb105pln | Sequence of BAC F21M12 from Arabidopsis thaliana chromosome 1, complete sequence. |
| 700616414H1 | g2827081 | 25 | −15 | gb105pln | Medicago sativa cytosolic malate dehydrogenase (cmdh) mRNA, complete cds. |
| 700615716H1 | g1906830 | 22 | 0 | gb105eukp | hsp88.1; heat shock protein |
| 700614703H1 | g1066282 | 27 | −7 | gb105pln | Phaseolus vulgaris 1L-myo-inositol 1-phosphate synthase mRNA, complete cds. |
| 700617116H1 | g167519 | 32 | −2 | gb105eukp | glycerol-3-phosphate acyltransferase |
| 700617073H1 | g168679 | 43 | −57 | gb105pln | Maize 19 kDa zein mRNA, clone cZ19C2, complete cds. |
| 700613968H1 | g710307 | 52 | −20 | gb105pln | Avena sativa victorin binding protein mRNA, complete cds. |
| 700614547H1 | g13840 | 19 | 0 | gb105allp | unidentified reading frame 2 |
| 700615173H1 | g22525 | 60 | −8 | gb105pln | Zea mays gene encoding a zein (clone zA1). |
| 700612713H1 | g2897 | 40 | 2 | gb105allp | ribosomal protein 59 |
| 700613685H1 | g218340 | 17 | 7 | gb105pln | Triticum aestivum mRNA for elongation factor 1 beta'. |
| 700461183H1 | g168484 | 89 | −76 | gb105pln | Maize endosperm glutelin-2 gene, complete cds. |
| 700614919H1 | g2150026 | 30 | −34 | gb105pln | Lycopersicon esculentum NADP-malic enzyme (LeME1) mRNA, nuclear gene encoding chloroplast protein, complete cds. |
| 700616074H1 | g1276933 | 97 | −27 | gb105pln | Zea luxurians Doebley M111 ITS1, 5.8S ribosomal RNA, ITS2. |
| 700614345H1 | g22531 | 98 | −73 | gb105pln | Zea mays mRNA encoding a zein (clone pZ22.1). |
| 700612792H1 | g2462831 | 8 | 8 | gb105eukp | F19G10.6 |
| 700617192H1 | g393400 | 26 | −57 | gb105pln | Z. mays mRNA for alpha-tubulin. |
| 700615628H1 | g924953 | 15 | −1 | gb105eukp | Glc1; beta 1,3-glucanase; EC 3.2.1.39 |
| 700615601H1 | g2315210 | 19 | 1 | gb105pln | Lycopersicon esculentum mRNA for proteasome, alpha subunit. |
| 700618656H1 | g536891 | 43 | −31 | gb105pln | Wheat mRNA for protein H2A, complete cds, clone wcH2A-4. |
| 700612474H1 | g1296954 | 70 | −15 | gb105pln | O. sativa mRNA for novel protein, osr40c1. |
| 700613109H1 | g1262146 | 20 | −1 | gb105eukp | proteasome subunit |
| 700613652H1 | g536555 | 20 | 8 | gb105eukp | URP1A |
| 700617819H1 | g2353172 | 31 | −22 | gb105pln | Arabidopsis thaliana sigma factor 2 (SIG2) mRNA, nuclear gene encoding chloroplast protein, complete cds. |
| 700617606H1 | g1669623 | 18 | −9 | gb105eukp | ribosomal protein L39 |
| 700617477H1 | g1237101 | 34 | −31 | gb105pln | Arabidopsis thaliana calmodulin-binding protein mRNA, complete cds. |
| 700612408H1 | g2384669 | 34 | −15 | gb105eukp | AtKT1; putative potassium transporter AtKT1p |
| 700614786H1 | g971893 | 66 | −24 | gb105allp | chlorine channel protein P64 |
| 700615437H1 | g168648 | 15 | 11 | gb105pln | Zea mays transposon Bs1. |
| 700615970H1 | g2645198 | 21 | 16 | gb105pln | Arabidopsis thaliana chromosome I BAC T26J12 genomic sequence, complete sequence. |
| 700616796H1 | g22524 | 44 | −39 | gb105pln | Zea mays mRNA encoding a zein (clone ZG31A). |
| 700617324H1 | g535019 | 35 | 6 | gb105pln | Z. mays Zd1 tandem genes for zein Zd1 (19 kDa Zein). |
| 700616964H1 | g487313 | 23 | −29 | gb105pln | Rice mRNA EN509, partial sequence. |
| 700614346H1 | g401854 | 48 | −44 | gb105pln | Arabidopsis thaliana |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700615074H1 | g1749530 | 8 | 4 | gb105eukp | serine/threonine kinase mRNA, complete cds. similar to *Saccharomyces cerevisiae* 6-phosphogluconate dehydrogenase (decarboxylating), SWISS-PROT Accession Number P38720 |
| 700616074H1 | g1314382 | 97 | −27 | gb105pln | *Tripsacum laxum* de Wet 3766 ITS1, 5.8S ribosomal RNA, ITS2. |
| 700612808H1 | g957250 | 13 | 6 | gb105pln | FEY = forever young gene [*Arabidopsis thaliana*, Genomic/mRNA, 1450 nt]. |
| 700618118H1 | g476090 | 7 | 1 | gb105eukp | unknown; 34/67 kD laminin binding protein |
| 700613130H1 | g22118 | 24 | −1 | gb105pln | *Z. mays* DNA for Adh1-Cm allele. |
| 700613483H1 | g2370548 | 14 | 4 | gb105eukp | SPAC4A8.16c; hypothetical protein |
| 700614695H1 | g2662344 | 16 | −31 | gb105pln | *Oryza sativa* mRNA for EF-1 alpha, complete cds. |
| 700614783H1 | g1945365 | 10 | 8 | gb105allp | copper transport protein HAH1 |
| 700616084H1 | g169472 | 25 | −26 | gb105pln | Potato alpha-glucan phosphorylase type H isozyme mRNA, complete cds. |
| 700613162H1 | g168454 | 28 | 14 | gb105pln | *Z. mays* cell wall protein mRNA, complete cds. |
| 700615856H1 | g170047 | 33 | −1 | gb105eukp | PK6; protein kinase |
| 700613994H1 | g2564051 | 28 | −6 | gb105pln | *Arabidopsis thaliana* genomic DNA, chromosome 5, P1 clone: MWD9, complete sequence. |
| 700618214H1 | g2529669 | 4 | 2 | gb105eukp | T30B22.12; U1snRNP-specific protein, U1A |
| 700614560H1 | g1060888 | 22 | 6 | gb105allp | human 26S proteasome subunit p97 |
| 700615867H1 | g166971 | 18 | −4 | gb105eukp | Acl3; acyl carrier protein III |
| 700613211H1 | g2213870 | 15 | 5 | gb105pln | *Mesembryanthemum crystallinum* poly(A)-binding protein mRNA, partial cds. |
| 700615730H1 | g1749576 | 21 | 5 | gb105eukp | similar to *Saccharomyces cerevisiae* acetyl-CoA acetyltransferase, SWISS-PROT Accession Number P41338 |
| 700613133H1 | g1145808 | 16 | 8 | gb105allp | (3R)-hydroxymyristoyl acyl carrier protein dehydrase |
| 700615041H1 | g1370141 | 14 | 0 | gb105pln | *L. japonicus* mRNA for small GTP-binding protein, RAB11A. |
| 700615920H1 | g881615 | 30 | 3 | gb105eukp | Fae1; the condensing enzyme of the fatty acid elongase complex that converts C18 fatty acids to C20 and C22 fatty acids; substrates for the reaction are oleoyl-CoA and malonyl-CoA; fatty acid elongase 1 |
| 700617714H1 | g168704 | 89 | −68 | gb105pln | *Zea mays* zein protein gene, complete cds. |
| 700616390H1 | g166871 | 47 | −30 | gb105pln | *A. thaliana* S-adenosylmethionine synthetase gene, complete cds. |
| 700617077H1 | g558364 | 61 | −90 | gb105pln | *Z. mays* mRNA for ADP-glucose pyrophosphorylase. |
| 700616506H1 | g20000 | 50 | −24 | gb105pln | *N. tabacum* RL2 mRNA for 60S ribosomal protein L2. |
| 700614311H1 | g170746 | 50 | −44 | gb105pln | Wheat histone H4 TH091 gene, complete cds. |
| 700616867H1 | g2326371 | 16 | 3 | gb105pln | *Arabidopsis thaliana* ISA1 gene. |
| 700613289H1 | g829147 | 30 | −64 | gb105pln | *Z. mays* gene for cyclophilin. |
| 700613326H1 | g1321660 | 61 | −9 | gb105pln | Rice mRNA for ascorbate peroxidase, complete cds. |
| 700616892H1 | g469247 | 29 | 11 | gb105pln | *Helianthus annuus* ribosomal protein S3a mRNA, complete cds. |
| 700614474H1 | g1911581 | 22 | −8 | gb105pln | Cyn d 1 = major allergen {clone 14c1 and CD1} [*Cynodon dactylon* = Bermuda grass, pollen, mRNA Partial, 759 nt]. |
| 700461224H1 | g1305524 | 62 | −52 | gb105pln | *Oryza sativa* Wilms' tumor-related protein QM mRNA, partial cds. |
| 700615618H1 | g10399 | 20 | 5 | gb105eukp | ald orfU protein (AA 1-190) |
| 700618093H1 | g565647 | 12 | −2 | gb105allp | proteasome subunit HsC10-II |
| 700615227H1 | g1419464 | 6 | 2 | gb105eukp | ZC434.2 |
| 700613889H1 | g606969 | 18 | 1 | gb105pln | *Arabidopsis thaliana* cytoplasmic ribosomal protein L18 mRNA, complete cds. |
| 700616989H1 | g22447 | 61 | −20 | gb105pln | *Zea mays* ZMPMS2 gene for 19 kDa zein protein. |
| 700614738H1 | g2244733 | 28 | −7 | gb105pln | Cotton mRNA for actin, clone CF456, partial cds. |
| 700614022H1 | g1514643 | 23 | −13 | gb105eukp | multidrug resistance protein; PDR5-like ABC transporter |
| 700612321H1 | g2627057 | 53 | −6 | gb105pln | *Oryza sativa* mRNA for ADP glucose pyrophosphorylase large subunit, complete cds. |

TABLE 1-continued

LIST OF INCYTE CLONES DERIVED FROM SATMON022023
COPYRIGHT 1998 INCYTE PHARMACEUTICALS, INC.

| | | | | |
|---|---|---|---|---|
| 700613727H1 | g1655678 | 32 | −22gb105pln | *P. sylvestris* mRNA for 3-hydroxy-3-methylglutaryl-CoA synthase. |
| 700613178H1 | g886739 | 38 | −38gb105pln | *Z. mays* histone H4 gene. |
| 700617429H1 | g20250 | 42 | −53gb105pln | *Oryza sativa* H3 histone gene H3R-11. |
| 700613431H1 | g416265 | 21 | −49b105pln | Rice mRNA for ribosomal protein A2, partial sequence. |
| 700613768H1 | g576632 | 15 | −3gb105pln | *Chlamydomonas reinhardtii* histone H3 (ch3-I) and histone H4 (ch4-I) genes, complete cds. |
| 700617073H1 | g22537 | 43 | −55gb105pln | Maize mRNA for zein polypeptide (clone M6). |
| 700461145H1 | g1657948 | 14 | 6gb105eukp | water channel protein; MipC |
| 700461257H1 | g1498052 | 61 | −39gb105pln | *Zea mays* ribosomal protein S8 mRNA, complete cds. |
| 700618648H1 | g166548 | 65 | −58gb105pln | *Avena sativa* vacuolar H+-ATPase 16 kDa proteolipid subunit (vatp-P1) mRNA, complete cds. |
| 700616920H1 | g21794 | 45 | −32gb105pln | Wheat histone H4 gene. |
| 700613710H1 | g402551 | 19 | −18gb105pln | *A. thaliana* gene for acetohydroxy acid isomeroreductase. |
| 700618477H2 | g396209 | 31 | −41gb105pln | *S. polyrrhiza* mRNA for D-myo-inositol-3-phosphate synthase. |
| 700618294H1 | g2511530 | 18 | −3gb105pln | *Eleusine undica* alpha tubulin 1 (TUA1) mRNA, complete cds. |
| 700613408H1 | g2832242 | 20 | −61gb105pln | *Zea mays* 22-kDa alpha zein gene cluster, complete sequence. |
| 700613448H1 | g1060912 | 5 | 3gb105allp | RPB5 |
| 700615901H1 | g1930075 | 17 | 7gb105allp | C4-sterol methyl oxidase homolog |
| 700613687H1 | g2641945 | 19 | −23gb105pln | Yeast (*Schizosaccharomyces pombe*) DNA for elongation factor 2, complete cds. |
| 700612531H1 | g2541876 | 10 | 6gb105eukp | cnd41; CND41, chloroplast nucleoid DNA binding protein |
| 700461132H1 | g603269 | 34 | −2gb105eukp | YER036C; Yer036cp |
| 700615777H1 | g435013 | 16 | 5gb105eukp | fatty acid chain termination; acyl ACP thioesterase; EC 3.1.2.14 |
| 700461122H1 | g22514 | 53 | −57gb105pln | Maize Zc1 gene for Zein Zc1 (14 kD zein-2). |
| 700615880H1 | g2749918 | 25 | 13gb105pln | *Arabidopsis thaliana* chromosome I BAC F3I6 genomic sequence, complete sequence. |
| 700618207H1 | g747916 | 32 | 8gb105pln | *Z. mays* CaM2 mRNA for calmodulin. |
| 700461203H1 920598 | 66 | −57 | gb105pln | *P. miliaceum* mRNA for aspartate aminotransferase (pcAAT2). |
| 700615146H1 | g643589 | 30 | 8gb105allp | dihydrolipoamide succinyltransferase |
| 700612921H1 | g1742968 | 17 | 0gb105pln | *A. thaliana* mRNA for SNF1-related ser/thr protein kinase (1869 bp). |
| 700615335H1 | g22322 | 27 | −62gb105pln | *Z. mays* mRNA for H2B histone (clone cH2B214). |
| 700614131H1 | g558364 | 63 | −14gb105pln | *Z. mays* mRNA for ADP-glucose pyrophosphorylase. |
| 700617354H1 | g168527 | 72 | −78gb105pln | Maize NADP-dependent malic enzyme (Me1) mRNA, complete cds. |
| 700614739H1 | g459267 | 29 | −14gb105pln | *Z. mays* gene for HMG protein. |
| 700618613H1 | g1272405 | 20 | −14gb105pln | *Arabidopsis thaliana* immunophilin (FKBP15-1) mRNA, complete cds. |
| 700615715H1 | g2645198 | 12 | 17gb105pln | *Arabidopsis thaliana* chromosome I BAC T26J12 genomic sequence, complete sequence. |
| 700614050H1 | g722325 | 72 | −32gb105pln | *Zea mays* clone Zm-Rab2-A GTP binding protein (rab2) mRNA, complete cds. |
| 700614560H1 | g2842489 | 27 | 3gb105allp | putative protein |
| 700614735H1 | g438279 | 22 | −8gb105allp | Ribosomal protein L7 |
| 700616425H1 | g2511530 | 26 | 7gb105pln | *Eleusine undica* alpha tubulin 1 (TUA1) mRNA, complete cds. |
| 700613014H1 | g2444159 | 20 | −8gb105pln | *Bambusa glaucescens* alcohol dehydrogenase (Adh1), partial cds. |
| 700617946H1 | g6656 | 18 | −1gb105eukp | C40H1.6 |
| 700617494H1 | g2564951 | 8 | 7gb105allp | unknown |
| 700617608H1 | g927323 | 20 | 0gb105eukp | UBA2; uba2p |
| 700617325H1 | g1724101 | 58 | −18gb105pln | *Mesembryanthemum crystallinum* S-adenosyl-L-homocystein hydrolase mRNA, complete cds. |
| 700616205H1 | g435542 | 47 | −71gb105pln | *Z. mays* mRNA for calmodulin. |
| 700613792H1 | g1778148 | 74 | 1gb105pln | *Zea mays* plastid phosphate/phosphoenolpyruvate translocator precursor (MZPPT4) mRNA, |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | complete cds. |
| 700613889H1 | g2529670 | 25 | −5 | gb105eukp | T30B22.13; ribosomal protein L18-like |
| 700612581H1 | g161631 | 14 | 1 | gb105eukp | 217 g protein |
| 700613159H1 | g169716 | 23 | −35 | gb105pln | *Ricinus communis* stearoyl-acyl-carrier protein desaturase mRNA, 3' end of cds. |
| 700614530H1 | g1145692 | 38 | −16 | gb105pln | *Arabidopsis thaliana* actin (ACT1) gene, complete cds. |
| 700616008H1 | g168579 | 98 | −111 | gb105pln | Maize pyruvate, orthophosphate dikinase mRNA, complete cds. |
| 700615872H1 | g2832242 | 100 | −28 | gb105pln | *Zea mays* 22-kDa alpha zein gene cluster, complete sequence. |
| 700616043H1 | g2351061 | 14 | −27 | gb105pln | *Arabidopsis thaliana* genomic DNA, chromosome 5, P1 clone: MAF19. |
| 700618502H1 | g2827081 | 9 | 17 | gb105pln | *Medicago sativa* cytosolic malate dehydrogenase (cmdh) mRNA, complete cds. |
| 700617791H1 | g2130984 | 39 | −16 | gb105pln | *B. napus* mRNA for ribosomal protein S15a (pA813). |
| 700617489H1 | g168692 | 83 | −69 | gb105pln | Maize zein mRNA, complete cds, clone ZG7. |
| 700613804H1 | g1747295 | 35 | −32 | gb105pln | Rice mRNA for vacuolar H+-pyrophosphatase, complete cds. |
| 700616429H1 | g1666813 | 8 | −7 | gb105eukp | PMK1; pathogenicity MAP kinase 1 |
| 700613980H1 | g886470 | 51 | −45 | gb105pln | *C. roseus* MetE mRNA for methionine synthase. |
| 700612583H1 | g474009 | 50 | −31 | gb105pln | Rice mRNA, partial homologous to ribosomal protein S19 gene. |
| 700613364H1 | g622980 | 20 | −2 | gb105pln | *Arabidopsis thaliana* indole-3-glycerol phosphate synthase mRNA, complete cds. |
| 700615426H1 | g622980 | 11 | −12 | gb105pln | *Arabidopsis thaliana* indole-3-glycerol phosphate synthase mRNA, complete cds. |
| 700615804H1 | g1419369 | 50 | −92 | gb105pln | *Z. mays* ZmABP3 mRNA for actin depolymerizing factor. |
| 700613472H1 | g168490 | 49 | −88 | gb105pln | Maize glutathione S-transferase (GST-I) mRNA, complete cds. |
| 700618656H1 | g1154953 | 46 | −49 | gb105pln | *T. aestivum* histone H2A gene. |
| 700615353H1 | g1132482 | 46 | −46 | gb105pln | Rice mRNA for ADP-ribosylation factor, complete cds. |
| 700617433H1 | g312083 | 13 | −6 | gb105eukp | NUO-10.5 |
| 700618213H1 | g168405 | 22 | −20 | gb105pln | maize alcohol dehydrogenase (adh1) mrna 3' end and flank. |
| 700612819H1 | g301829 | 43 | 2 | gb105allp | 40S ribosomal small subunit protein S10 |
| 700614250H1 | g2160155 | 20 | −36 | gb105pln | Sequence of BAC F21M12 from *Arabidopsis thaliana* chromosome 1, complete sequence. |
| 700614525H1 | g168505 | 49 | −67 | gb105pln | *Zea mays* histone H3 gene, complete cds. |
| 700612649H1 | g2058279 | 23 | 7 | gb105pln | *A. thaliana* mRNA for AtRan3 protein. |
| 700617609H1 | g620069 | 28 | −18 | gb105eukp | ZK1307.6 |
| 700461174H1 | g289192 | 23 | −1 | gb105pln | *Arabidopsis thaliana* dihydrofolate reductase-thymidylate synthase (THY-1) mRNA, exons 1 through 9 and complete cds. |
| 700614225H1 | g1155264 | 53 | −53 | gb105pln | *Pennisetum ciliare* possible apospory-associated protein mRNA, complete cds. |
| 700617490H1 | g168675 | 17 | −7 | gb105pln | Maize mutant zein (zE19) gene, complete cds. |
| 700615189H1 | g20598 | 43 | 0 | gb105pln | *P. miliaceum* mRNA for aspartate aminotransferase (pcAAT2). |
| 700618146H1 | g396209 | 35 | −48 | gb105pln | *S. polyrrhiza* mRNA for D-myo-inositol-3-phosphate synthase. |
| 700614375H1 | g22322 | 63 | −55 | gb105pln | *Z. mays* mRNA for H2B histone (clone cH2B214). |
| 700615815H1 | g2464904 | 39 | −20 | gb105eukp | X-Pro aminopeptidase homolog |
| 700618660H1 | g454913 | 16 | 5 | gb105pln | *A. porrum* LDJ2 mRNA. |
| 700612377H1 | g2708736 | 15 | 15 | gb105pln | *Arabidopsis thaliana* BAC T13L16 from chromosome IV, top arm, complete sequence. |
| 700461147H1 | g1015628 | 10 | 2 | gb105eukp | APL1 |
| 700616596H1 | g2814799 | 18 | −8 | gb105eukp | ZN858.6 |
| 700616368H1 | g551289 | 33 | −60 | gb105pln | *Z. mays* (W22) phosphoglycerate mutase gene exons 2–8. |
| 700616368H1 | g168587 | 62 | −62 | gb105pln | *Zea mays* cofactor-independent phosphoglycerate mutase mRNA, complete cds. |
| 700617271H1 | g1255207 | 55 | −14 | gb105eukp | FAE1; fatty acid elongase |
| 700616378H1 | g22485 | 62 | −31 | gb105pln | Maize mRNA for sucrose |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | synthase (EC 2.4.1.13). |
| 700461116H1 | g577818 | 35 | −32 | gb105pln | *Z. mays* gene for H2B histone (gH2B4). |
| 700613920H1 | g22222 | 92 | −41 | gb105pln | *Z. mays* ZSF4C4 gene for zein. |
| 700615283H1 | g487311 | 25 | 2 | gb105pln | Rice mRNA EN448, partial sequence. |
| 700612857H1 | g303852 | 40 | 3 | gb105pln | Rice mRNA for ribosomal protein L3, complete cds. |
| 700614340H1 | g166421 | 46 | −3 | gb105pln | *Medicago sativa* ubiquitin carrier protein mRNA, complete cds. |
| 700615109H1 | g693691 | 32 | 14 | gb105pln | *Arabidopsis thaliana* aspartate aminotransferase (Asp3) mRNA, complete cds. |
| 700616737H1 | g825783 | 36 | 10 | gb105pln | *Nicotiana tabacum* ribosomal protein L41 mRNA, complete cds. |
| 700612533H1 | g1016209 | 24 | −17 | gb105eukp | trpG; glutamine amidotransferase associated with anthranilate synthase for tryptophan biosynthesis |
| 700617794H1 | g22514 | 88 | −36 | gb105pln | Maize Zc1 gene for Zein Zc1 (14 kD zein-2). |
| 700616956H1 | g440094 | 21 | −23 | gb105pln | *Arabidopsis thaliana* ribosomal protein S15a, complete cds. |
| 700614135H1 | g1402896 | 13 | −6 | gb105eukp | cyclin delta-2 |
| 700617077H1 | g1432142 | 45 | −70 | gb105pln | *Triticum aestivum* ADP-glucose pyrophosphorylase (WAL2) mRNA, partial cds. |
| 700612748H1 | g700196 | 22 | −13 | gb105eukp | K01C8.10 |
| 700614247H1 | g391604 | 29 | −2 | gb105pln | *Arabidopsis thaliana* mRNA for casein kinase II catalytic subunit. |
| 700461164H1 | g2245073 | 45 | −11 | gb105pln | *Arabidopsis thaliana* DNA chromosome 4, ESSA I contig fragment No. 8. |
| 700612544H1 | g1835728 | 24 | −24 | gb105pln | *Oryza sativa* ribosomal protein mRNA, complete cds. |
| 700616305H1 | g1732424 | 7 | −3 | gb105eukp | glutaredoxin |
| 700617885H1 | g1707867 | 81 | −87 | gb105pln | *Z. mays* mRNA for 40S ribosomal subunit protein S21. |
| 700618283H1 | g303854 | 34 | −1 | gb105pln | Rice mRNA for ribosomal protein L7A, complete cds. |
| 700615018H1 | g2459421 | 26 | −1 | gb105eukp | F4P9.15; similar to calcium-binding EF-hand protein |
| 700617347H1 | g1143712 | 30 | −26 | gb105pln | *Brassica oleracea* var. *botrytis* non-green plastid phosphate/triose-phosphate translocator TPT precursor (BONGTPT) mRNA, complete cds. |
| 700617421H1 | g18266 | 27 | −20 | gb105pln | *C. stellata* mRNA for ribosomal protein L27. |
| 700614329H1 | g1435156 | 61 | −60 | gb105pln | *L. esculentum* mRNA for histone H3 variant H3.3. |
| 700615778H1 | g1419090 | 50 | −0 | gb105eukp | 37 kDa chloroplast inner envelope membrane polypeptide precursor |
| 700618229H1 | g887594 | 25 | −1 | gb105eukp | unknown |
| 700614350H1 | g968995 | 72 | −25 | gb105pln | *Oryza sativa* clone glyceraldehyde-3-phosphate dehydrogenase (Gpc) mRNA, complete cds. |
| 700614688H1 | g218112 | 50 | −32 | gb105pln | Rice mRNA for ribosomal protein L41 (340 gene), partial sequence. |
| 700613171H1 | g1272409 | 25 | −13 | gb105pln | *Vicia faba* immunophilin precursor (FKBP15) mRNA, complete cds. |
| 700615257H1 | g4038 | 17 | −0 | gb105pln | Yeast (*Saccharomyces cerevisiae*) DNA for 38 kd nukleolar protein NOP1. |
| 700618504H1 | g436782 | 28 | −40 | gb105pln | Rice mRNA for cyc07, complete cds. |
| 700613674H1 | g166606 | 11 | 0 | gb105eukp | anthranilate synthase alpha subunit |
| 700615446H1 | g168681 | 35 | −62 | gb105pln | Maize 19 kDa zein mRNA, clone cZ19D1, complete cds. |
| 700617231H1 | g22119 | 50 | −33 | gb105pln | Maize Adh1-F mRNA for alcohol dehydrogenase. |
| 700612712H1 | g1762930 | 31 | −24 | gb105pln | *Nicotiana tabacum* ribosomal protein S14 mRNA, partial cds. |
| 700614970H1 | g2267597 | 19 | 6 | gb105eukp | 10 kDa chaperonin |
| 700618457H2 | g218262 | 7 | 8 | gb105allp | early nodulin |
| 700613656H1 | g2190419 | 9 | 3 | gb105eukp | dem |
| 700618036H1 | g169792 | 35 | −52 | gb105pln | Rice histone 3 gene, complete cds. |
| 700617959H1 | g387908 | 21 | −41 | gb105pln | *Brassica rapa* S-phase-specific (BIS289) mRNA, complete cds. |
| 700615250H1 | g1370455 | 20 | 8 | gb105pln | Yeast (*Saccharomyces cerevisiae*) chromosome XVI reading frame ORF YPL220w. |
| 700617347H1 | g1778148 | 76 | −88 | gb105pln | *Zea mays* plastid |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | phosphate/phosphoenolpyruvate translocator precursor (MZPPT4) mRNA, complete cds. |
| 700614188H1 | g1209700 | 34 | −1 | gb105pln | Zea mays ribosomal protein L12 mRNA, complete cds. |
| 700615053H1 | g218099 | 26 | 13 | gb105pln | Rice mRNA for ribosomal protein S12 (320 gene), partial sequence. |
| 700612378H1 | g22524 | 95 | −20 | gb105pln | Zea mays mRNA encoding a zein (clone ZG31A). |
| 700613388H1 | g602605 | 45 | −110 | gb105pln | Zea mays tandem genes for alpha1-tubulin and alpha2-tubulin. |
| 700616315H1 | g168690 | 66 | 5 | gb105pln | Maize zein mRNA, complete cds, clone ZG124. |
| 700612518H1 | g498738 | 72 | −65 | gb105pln | H. vulgare (pMaW20) pseudo mRNA for beta-ketoacyl-ACP synthase (partial). |
| 700614750H1 | g1419369 | 48 | 11 | gb105pln | Z. mays ZmABP3 mRNA for actin depolymerizing factor. |
| 700618679H1 | g1783180 | 48 | −38 | gb105pln | Wheat mRNA for Thiol-specific antioxidant protein, partial cds. |
| 700618673H1 | g473987 | 30 | −18 | gb105pln | Rice mRNA, partial homologous to histone H3 gene. |
| 700613488H1 | g289767 | 23 | 0 | gb105eukp | ZK652.1 protein |
| 700615588H1 | g1706956 | 10 | 7 | gb105allp | cellulose synthase |
| 700612988H1 | g2522195 | 23 | −23 | gb105eukp | ornithine/acetylornithine aminotransferase |
| 700614144H1 | g1247310 | 40 | 8 | gb105allp | A3 ACCase |
| 700613442H1 | g498739 | 60 | −66 | gb105pln | H. vulgare (pMaW22) mRNA for beta-ketoacyl-ACP synthase. |
| 700614213H1 | g1778376 | 13 | 3 | gb105eukp | PsRT17-1 |
| 700615901H1 | g2605606 | 17 | 8 | gb105allp | RANP-1 |
| 700613212H1 | g22322 | 34 | −42 | gb105pln | Z. mays mRNA for H2B histone (clone cH2B214). |
| 700613463H1 | g1483562 | 43 | −43 | gb105pln | P. crispum mRNA for leucine aminopeptidase. |
| 700617475H1 | g168500 | 30 | −40 | gb105pln | Maize (Zea mays) histone H4 gene (H4C14), complete cds. |
| 700615418H1 | g2252639 | 24 | −17 | gb105pln | Genomic sequence of Arabidopsis BAC F8A5, complete sequence. |
| 700617488H1 | g166410 | 23 | −4 | gb105eukp | nucleic acid binding protein; Alfin-1 |
| 700613632H1 | g157561 | 9 | 4 | gb105eukp | Gpdh; sn-glycerol-3-phosphate dehydrogenase; EC 1.1.1.8 |
| 700615071H1 | g20415 | 7 | −15 | gb105eukp | ce12; cellulase |
| 700615339H1 | g8497 | 15 | −3 | gb105eukp | E(Dfd); SRp55 |
| 700614957H1 | g1205984 | 15 | −3 | gb105allp | DNA polymerase I |
| 700618530H1 | g1737219 | 13 | 11 | gb105pln | Arabidopsis thaliana vacuolar sorting receptor homolog mRNA, complete cds. |
| 700617241H1 | g426441 | 23 | 17 | gb105pln | Rice mRNA for thioredoxin h, complete cds. |
| 700617094H1 | g168628 | 50 | −21 | gb105pln | maize sucrose synthetase gene (shrunken) 3′ end. |
| 700612665H1 | g1546918 | 65 | −46 | gb105pln | Z. mays mRNA for translation initiation factor 5A. |
| 700612506H1 | g455157 | 11 | 3 | gb105eukp | acpC; acyl carrier protein |
| 700615123H1 | g310933 | 78 | −5 | gb105eukp | r117; a subunit of 60S ribosomal protein; 60S ribosomal protein subunit L17 |
| 700615448H1 | g21834 | 25 | −28 | gb105pln | Wheat mRNA for cytosolic phosphoglycerate kinase (EC 2.7.2.3). |
| 700615322H1 | g168677 | 23 | −20 | gb105pln | Maize 19 kDa zein mRNA, clone cZ19C1, complete cds. |
| 700616030H1 | g732950 | 15 | 3 | gb105pln | Yeast (Saccharomyces cerevisiae) SSM1b gene. |
| 700612691H1 | g9731 | 19 | −4 | gb105eukp | vacuolar ATPase 16 kD proteolipid subunit |
| 700613741H1 | g2431768 | 50 | −48 | gb105pln | Zea mays acidic ribosomal protein P1a (rpp1a) mRNA, complete cds. |
| 700616630H1 | g168704 | 55 | −21 | gb105pln | Zea mays zein protein gene, complete cds. |
| 700613486H1 | g21686 | 22 | −35 | gb105pln | T. aestivum AGP-S mRNA. |
| 700461239H1 | g2104956 | 34 | −20 | gb105pln | Arabidopsis thaliana immunophilin (FKBP12) mRNA, complete cds. |
| 700614345H1 | g168683 | 98 | −73 | gb105pln | Maize 22 kd (Mw = 26.53 kd) zein protein 1, mRNA. |
| 700614706H1 | g763281 | 6 | 6 | gb105eukp | unknown |
| 700615676H1 | g2677830 | 19 | 7 | gb105allp | ribosomal protein L12 |
| 700616488H1 | g577531 | 31 | −46 | gb105eukp | proteasome subunit |
| 700615517H1 | g21629 | 70 | −48 | gb105pln | Sorghum vulgare mRNA for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | phosphoenolpyruvate carboxylase (PEPC). |
| 700613214H1 | g1184771 | 62 | −54 | gb105pln | *Zea mays* |
| | | | | | glyceraldehyde-3-phosphate dehydrogenase GAPC2 (gpc2) mRNA, complete cds. |
| 700612636H1 | g840730 | 40 | −30 | gb105pln | *C. lanceolata* Gpdh mRNA for |
| | | | | | glycerol-3-phosphate dehydrogenase. |
| 700613752H1 | g2736147 | 8 | 7 | gb105eukp | FAH1; fatty acid hydroxylase |
| | | | | | Fah1p |
| 700616751H1 | g452469 | 28 | −3 | gb105pln | *Arabidopsis thaliana* ATP |
| | | | | | sulfurylase mRNA, complete cds. |
| 700616520H1 | g2688094 | 11 | −0 | gb105allp | |
| | | | | | guanosine-3′, 5′-bis(diphosphate) 3′-pyrophosphohydrolase (spoT) |
| 700461103H1 | g287297 | 64 | −57 | gb105pln | *Oryza sativa* mRNA for |
| | | | | | aspartate aminotransferase, complete cds. |
| 700614248H1 | g19501 | 50 | 7 | gb105allp | pPLZ12 gene product (AA 1-184) |
| 700614842H1 | g2288886 | 25 | −4 | gb105pln | *Arabidopsis thaliana* mRNA for |
| | | | | | mevalonate diphosphate decarboxylase. |
| 700615075H1 | g1132482 | 52 | −35 | gb105pln | Rice mRNA for ADP-ribosylation |
| | | | | | factor, complete cds. |
| 700612346H1 | g536895 | 41 | −6 | gb105pln | Wheat mRNA for protein H2A, |
| | | | | | complete cds, clone wcH2A-10. |
| 700614010H1 | g2815905 | 32 | −8 | gb105eukp | sug-1; Sug-1 proteosome |
| | | | | | subunit homolog |
| 700616386H1 | g2656027 | 20 | 16 | gb105pln | *Arabidopsis thaliana* genomic |
| | | | | | DNA, chromosome 5, P1 clone: MJH22. |
| 700614450H1 | g534971 | 38 | −39 | gb105pln | *V. faba* (var. minor) mRNA for |
| | | | | | alpha 1,4-glucan phosphorylase L isoform. |
| 700614904H1 | g10399 | 26 | 7 | gb105eukp | ald orfU protein (AA 1-190) |
| 700614567H1 | g168508 | 43 | −10 | gb105pln | Maize oleosin KD18 (KD18; L2) |
| | | | | | gene, complete cds. |
| 700616288H1 | g168539 | 76 | −27 | gb105pln | *Zea mays* putative ribosomal |
| | | | | | protein S22 homolog mRNA, partial cds. |
| 700617477H1 | g2224924 | 17 | −21 | gb105pln | *Arabidopsis thaliana* |
| | | | | | kinesin-like protein (ZWICHEL) gene, complete cds. |
| 700614862H1 | g2398720 | 5 | 7 | gb105allp | beta-prime-adaptin protein |
| 700612508H1 | g22176 | 24 | 16 | gb105pln | *Z. mays* P gene. |
| 700614534H1 | g218112 | 54 | −35 | gb105pln | Rice mRNA for ribosomal |
| | | | | | protein L41 (340 gene), partial sequence. |
| 700613178H1 | g170746 | 40 | −38 | gb105pln | Wheat histone H4 TH091 gene, |
| | | | | | complete cds. |
| 700615260H1 | g2688821 | 17 | −8 | gb105pln | *Prunus armeniaca* |
| | | | | | pyrophosphate-dependent phosphofructo-1-kinase mRNA, partial cds. |
| 700612526H1 | g18296 | 30 | −10 | gb105pln | Water melon mMDH mRNA for |
| | | | | | mitochondrial malate dehydrogenase (EC 1.1.1.37). |
| 700613805H1 | g496311 | 12 | 2 | gb105eukp | supressor protein |
| 700612309H1 | g840730 | 38 | −23 | gb105pln | *C. lanceoiata* Gpdh mRNA for |
| | | | | | glycerol-3-phosphate dehydrogenase. |
| 700461184H1 | g310932 | 34 | −18 | gb105pln | *Nicotiana tabacum* ribosomal |
| | | | | | protein L17 mRNA, complete cds. |
| 700616475H1 | g1747295 | 33 | −51 | gb105pln | Rice mRNA for vacuolar |
| | | | | | H+-pyrophosphatase, complete cds. |
| 700613001H1 | g532821 | 12 | 8 | gb105eukp | F57B9.10 |
| 700613958H1 | g777757 | 75 | −19 | gb105pln | *Saccharum* hybrid (clone |
| | | | | | SCUBI561) polyubiquitin mRNA, complete cds. |
| 700614922H1 | g2160173 | 9 | −1 | gb105eukp | F21M12.21 |
| 700618294H1 | g393400 | 23 | −12 | gb105pln | *Z. mays* mRNA for alpha-tubulin. |
| 700614222H1 | g1419779 | 13 | −0 | gb105eukp | ORF YOL010w |
| 700618619H1 | g1899026 | 32 | −6 | gb105pln | *Zea mays* superoxide dismutase |
| | | | | | 4A (sod4A) gene, complete cds. |
| 700617885H1 | g1419371 | 63 | −65 | gb105pln | *Z. mays* mRNA for 40S subunit |
| | | | | | ribosomal protein S21. |
| 700615508H1 | g2994 | 34 | −14 | gb105pln | *Neurospora crassa* crp-2 gene for |
| | | | | | ribosomal protein crp-2. |
| 700612568H1 | g500852 | 53 | −39 | gb105pln | *Zea mays* (clone pAKHSDH2) |
| | | | | | aspartate kinase-homoserine dehydrogenase mRNA, complete cds. |
| 700613768H1 | g21794 | 21 | −15 | gb105pln | Wheat histone H4 gene. |
| 700616593H1 | g2664199 | 18 | 3 | gb105pln | *Arabidopsis thaliana* GTL2 |
| | | | | | gene. |
| 700616541H1 | g1015315 | 33 | 9 | gb105pln | *Pisum sativum* (clone |
| | | | | | PsRCI35-2) ribosomal protein L41 mRNA, complete cds. |
| 700614929H1 | g2464945 | 34 | −27 | gb105eukp | beta-galactosidase |
| 700613376H1 | g550543 | 25 | −30 | gb105pln | *A. thaliana* mRNA for ribosomal |
| | | | | | protein L16. |
| 700613685H1 | g218161 | 19 | −1 | gb105eukp | elongation factor 1 beta′ |
| 700461132H1 | g695169 | 45 | −7 | gb105eukp | unknown |
| 700616008H1 | g168584 | 40 | −108 | gb105pln | Corn pyruvate, orthophosphate |
| | | | | | dikinase gene, exons 2–19. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700612627H1 | g168704 | 31 | 14 | gb105pln | *Zea mays* zein protein gene, complete cds. |
| 700618627H1 | g21233 | 27 | −32 | gb105pln | *S. oleracea* AHRI mRNA for acetohydroxy acid reductoisomerase. |
| 700617287H1 | g1017823 | 8 | 7 | gb105allp | RNA polymerase II subunit |
| 700612692H1 | g18644 | 21 | 12 | gb105pln | Soybean mRNA for HMG-1 like protein. |
| 700616610H1 | g22144 | 30 | −6 | gb105pln | Maize anaerobically regulated gene for fructose bisphosphate aldolase (EC 4.1.2.13). |
| 700613693H1 | g998429 | 20 | −10 | gb105pln | GRF1 = general regulatory factor [*Zea mays*, XL80, Genomic, 5348 nt]. |
| 700612662H1 | g556672 | 17 | −4 | gb105pln | *S. cereale* (Halo) chloroplast mRNA for heat-shock protein. |
| 700614274H1 | g483431 | 62 | 8 | gb105allp | cyc07 |
| 700616908H1 | g515748 | 44 | −45 | gb105pln | Soybean chloroplast phytochrome A (phyA) gene, complete cds. |
| 700616526H1 | g168412 | 93 | −19 | gb105pln | Maize alcohol dehydrogenase gene (Adh1-PrF allele), 5' end. |
| 700616386H1 | g2114206 | 32 | −11 | gb105pln | Rice DNA for glutaredoxin, complete cds. |
| 700615958H1 | g22324 | 27 | −59 | gb105pln | *Z. mays* mRNA for H2B histone (clone cH2B221). |
| 700613685H1 | g218341 | 22 | −2 | gb105eukp | elongation factor 1 beta' |
| 700618072H1 | g2462827 | 32 | −24 | gb105eukp | F19G10.10; probable thiamin biosynthetic enzyme |
| 700613007H1 | g2852447 | 10 | −0 | gb105eukp | APK2a; protein kinase |
| 700615558H1 | g606814 | 35 | −5 | gb105pln | *Zea mays* Golden Bantam carbonic anhydrase mRNA, complete cds. |
| 700612863H1 | g551263 | 31 | 3 | gb105allp | pyruvate decarboxylase |
| 700612388H1 | g514945 | 100 | −18 | gb105pln | *Zea mays* sucrose synthase (Sus1) mRNA, complete cds. |
| 700613046H1 | g486248 | 7 | 17 | gb105pln | Yeast (*Saccharomyces cerevisiae*) chromosome XI reading frame ORF YKL145w. |
| 700615250H1 | g2276349 | 32 | −5 | gb105pln | Yeast (*Saccharomyces pombe*) chromosome II cosmid c30D10. |
| 700617001H1 | g1755004 | 14 | −4 | gb105pln | *Triticum aestivum* calmodulin TaCaM3-2 mRNA, complete cds. |
| 700613340H1 | g1420591 | 6 | 1 | gb105eukp | ORF YOR262w |
| 700615482H1 | g1256595 | 12 | 1 | gb105allp | LytB |
| 700617609H1 | g2381494 | 26 | −14 | gb105eukp | Srw1 |
| 700613487H1 | g2735841 | 13 | −1 | gb105eukp | transcriptional regulator |
| 700616208H1 | g487296 | 31 | −14 | gb105pln | Rice mRNA EN251, partial sequence. |
| 700616069H1 | g22528 | 94 | −5 | gb105pln | *Zea mays* mRNA encoding a zein (clone A20). |
| 700617091H1 | g168683 | 51 | −63 | gb105pln | Maize 22 kd (Mw = 26.53 kd) zein protein 1, mRNA. |
| 700613911H1 | g974775 | 53 | −53 | gb105pln | *B. vulgaris* mRNA for small G protein (clone 1S3). |
| 700461169H1 | g1787334 | 10 | 7 | gb105allp | malonyl CoA-acyl carrier protein transacylase |
| 700614592H1 | g2765817 | 16 | 4 | gb105allp | AtM1o-h1 |
| 700617492H1 | g1553128 | 17 | −23 | gb105pln | *Gossypium hirsutum* ribosomal protein L44 isoform a (RL44), complete cds. |
| 700614266H1 | g2392023 | 25 | 8 | gb105allp | Acyl-CoA synthetase |
| 700616575H1 | g218248 | 18 | −42 | gb105pln | Rice mRNA for cytochrome C, complete cds. |
| 700614923H1 | g2583071 | 50 | −60 | gb105pln | *Triticum aestivum* ADP-glucose-pyrophosphorylase large subunit (AGP-L) mRNA, partial cds. |
| 700612567H1 | g21798 | 12 | −1 | gb105pln | *T. aestivum* L mRNA for histone H1. |
| 700616743H1 | g1835728 | 20 | −4 | gb105pln | *Oryza sativa* ribosomal protein mRNA, complete cds. |
| 700614131H1 | g2627057 | 37 | 6 | gb105pln | *Oryza sativa* mRNA for ADP glucose pyrophosphorylase large subunit, complete cds. |
| 700613840H1 | g168502 | 29 | 13 | gb105pln | Maize (*Zea mays*) histone H4 gene (H4C7), complete cds. |
| 700617431H1 | g460988 | 51 | −62 | gb105pln | *O. sativa* (Arborio) Beta Tubulin mRNA, clone OSTB-34. |
| 700615694H1 | g508502 | 15 | −5 | gb105allp | sulfite oxidase |
| 700614902H1 | g561664 | 30 | −33 | gb105pln | Rice mRNA, partial homologous to ribosomal protein S3 coding sequence. |
| 700616867H1 | g2326372 | 14 | −0 | gb105eukp | ISA1; putative arabinose kinase |
| 700616992H1 | g511938 | 16 | −5 | gb105eukp | cysteine proteinase |
| 700613965H1 | g17738 | 22 | 5 | gb105allp | beta-1,3-glucanase homologue |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700614728H1 | g17779 | 20 | 5 | gb105pln | *B. napus* mRNA for beta-oxoacyl-(acyl carrier protein) reductase. |
| 700616976H1 | g2735839 | 25 | −24 | gb105pln | Sorghum bicolor ADP-glucose pyrophosphorylase subunit SH2, transcriptional regulator, NADPH-dependent reductase A1-a and NADPH-dependent reductase A1-b genes, complete cds. |
| 700615173H1 | g22526 | 61 | −8 | gb105pln | *Zea mays* mRNA encoding a zein (clone zA1). |
| 700616761H1 | g1149494 | 26 | 3 | gb105allp | T24B8.1 |
| 700612539H1 | g20548 | 30 | −10 | gb105pln | *P. hortense* GADPH mRNA for glycolytic glyceraldehyde-3-phosphate dehydrogenase. |
| 700613246H1 | g2576411 | 12 | −0 | gb105eukp | ADL2 |
| 700618378H1 | g406750 | 16 | 9 | gb105pln | *N. tabacum* NTF3 mRNA. |
| 700615851H1 | g643479 | 8 | −3 | gb105eukp | GCN20; Gcn20p |
| 700617490H1 | g22445 | 21 | −11 | gb105pln | *Zea mays* ZMPMS1 gene for 19 kDa zein protein. |
| 700616380H1 | g1381675 | 29 | −13 | gb105pln | Glycine max small GTP-binding protein (sra1) mRNA, partial cds. |
| 700613431H1 | g790507 | 67 | −87 | gb105pln | *Z. mays* mRNA for 60S acidic ribosomal protein. |
| 700612534H1 | g2316015 | 22 | −6 | gb105pln | *Arabidopsis thaliana* MRP-like ABC transporter mRNA, complete cds. |
| 700616940H1 | g2804269 | 11 | 15 | gb105pln | Yeast (*Saccharomyces cerevisiae*) chromosome VI complete DNA sequence. |
| 700615302H1 | g1020003 | 24 | −7 | gb105pln | *Hordeum vulgare* signal recognition particle 54 kDa subunit (Srp 54-3) mRNA, complete cds. |
| 700613746H1 | g2570506 | 16 | 4 | gb105pln | *Oryza sativa* ribosomal protein mRNA, complete cds. |
| 700614727H1 | g22144 | 39 | 7 | gb105pln | Maize anaerobically regulated gene for fructose bisphosphate aldolase (EC 4.1.2.13). |
| 700618146H1 | g1513227 | 29 | −42 | gb105pln | *Brassica napus* myo-inositol 1-phosphate synthase mRNA, complete cds. |
| 700615650H1 | g1098976 | 19 | −1 | gb105pln | *Lycopersicon esculentum* myo-inositol monophosphatase 1 (IMP1) mRNA, complete cds. |
| 700613262H1 | g2529680 | 37 | 4 | gb105allp | putative protein disulfide-isomerase precursor |
| 700616114H1 | g510876 | 11 | 0 | gb105eukp | ME1; NADP dependent malic enzyme; EC 1.1.1.40 |
| 700617937H1 | g303856 | 50 | −14 | gb105pln | Rice mRNA for ubiquitin protein fused to a ribosomal protein, complete cds. |
| 700617031H1 | g1143508 | 37 | −36 | gb105pln | *M. crystallinum* mRNA for vacuolar proton ATPase subunit E. |
| 700613075H1 | g1045304 | 60 | −59 | gb105pln | *Zea mays* acetyl-coenzyme A carboxylase mRNA, complete cds. |
| 700612363H1 | g166548 | 41 | −10 | gb105pln | *Avena sativa* vacuolar H+-ATPase 16 kDa proteolipid subunit (vatp-P1) mRNA, complete cds. |
| 700614765H1 | g21794 | 26 | 11 | gb105pln | Wheat histone H4 gene. |
| 700617088H1 | g2341032 | 15 | −5 | gb105eukp | F19P19.11 |
| 700613624H1 | g2245378 | 18 | −4 | gb105eukp | ARF1; auxin response factor 1 |
| 700613858H1 | g1212995 | 40 | −34 | gb105pln | *H. vulgare* mRNA for UDP-glucose pyrophosphorylase. |
| 700613747H1 | g1354933 | 16 | 7 | gb105allp | stearoyl-ACP desaturase |
| 700616345H1 | g2196547 | 24 | −4 | gb105pln | *Nicotiana tabacum* DNA-binding protein (T231) mRNA, complete cds. |
| 700617229H1 | g508544 | 77 | −35 | gb105pln | *Zea mays* 24-kD alpha-zein gene (floury2), complete cds. |
| 700461203H1 | g218229 | 56 | −53 | gb105pln | Rice mRNA for Aspartate aminotransferase. |
| 700614490H1 | g780371 | 46 | −35 | gb105pln | *Oryza sativa* enolase mRNA, complete cds. |
| 700615905H1 | g2511540 | 49 | −6 | gb105pln | *Oryza sativa* DNA-binding protein GBP16 (Rgbp16) mRNA, complete cds. |
| 700614002H1 | g145514 | 16 | 7 | gb105allp | cyclopropane fatty acid synthase |
| 700612584H1 | g1272410 | 10 | 5 | gb105eukp | FKBP15; immunophilin precursor |
| 700612364H1 | g1136121 | 71 | −5 | gb105pln | *O. sativa* mRNA for alpha-tubulin (clone OSTA-136). |
| 700616255H1 | g1946375 | 29 | 1 | gb105eukp | T06B20.22 |
| 700615214H1 | g1658312 | 8 | 15 | gb105pln | *O. sativa* osr40g2 gene. |
| 700618135H1 | g161631 | 12 | −11 | gb105eukp | 217 g protein |
| 700617431H1 | g416146 | 59 | −72 | gb105pln | *Zea mays* beta-6 tubulin (tub6) gene and mRNA, complete cds. |
| 700616468H1 | g1100225 | 24 | 1 | gb105eukp | glyceraldehyde-3-phosphate dehydrogenase; EC 1.2.1.12 |
| 700613186H1 | g1419369 | 74 | 1 | gb105pln | *Z. mays* ZmABP3 mRNA for actin depolymerizing factor. |
| 700612863H1 | g1009710 | 48 | 5 | gb105allp | pyruvate decarboxylase 2 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700614227H1 | g1136119 | 38 | −67 | gb105pln | *O. sativa* mRNA for alpha-tubulin (clone OSTA-111). |
| 700618556H1 | g2739216 | 20 | 4 | gb105pln | *Hordeum vulgare* L41 ribosomal protein. |
| 700615476H1 | g1321660 | 33 | −17 | gb105pln | Rice mRNA for ascorbate peroxidase, complete cds. |
| 700613624H1 | g2262117 | 19 | −2 | gb105eukp | T19F06.20; auxin inducible protein isolog |
| 700615061H1 | g2104950 | 8 | 16 | gb105pln | *Selaginella lepidophylla* MAP kinase-like protein (SDhn-6f) mRNA, partial cds. |
| 700615259H1 | g388052 | 31 | −78 | gb105pln | *Zea mays* alcohol dehydrogenase (Adh1-S) mRNA, complete cds. |
| 700617408H1 | g168502 | 48 | −96 | gb105pln | Maize (*Zea mays*) histone H4 gene (H4C7), complete cds. |
| 700615414H1 | g2829911 | 6 | 7 | gb105eukp | F22K20.10 |
| 700615905H1 | g1657616 | 36 | 2 | gb105pln | *Arabidopsis thaliana* putative nuclear DNA-binding protein G2p (AtG2) mRNA, complete cds. |
| 700616224H1 | g1272410 | 32 | 2 | gb105allp | immunophilin precursor |
| 700612432H1 | g168484 | 34 | 2 | gb105pln | Maize endosperm glutelin-2 gene, complete cds. |
| 700614225H1 | g1842068 | 36 | −33 | gb105pln | *Mesembryanthemum crystallinum* Nt-rab7a homolog mRNA, complete cds. |
| 700614031H1 | g22531 | 41 | −82 | gb105pln | *Zea mays* mRNA encoding a zein (clone pZ22.1). |
| 700616357H1 | g1181672 | 77 | −72 | gb105pln | *Sorghum bicolor* heat shock protein 70 cognate (hsc70) mRNA, partial cds. |
| 700612589H1 | g2305013 | 32 | −11 | gb105pln | *Musa acuminata* S-adenosyl-L-methionine synthetase homolog mRNA, complete cds. |
| 700615620H1 | g166634 | 39 | 1 | gb105allp | vacuolar H+-phosphatase |
| 700616348H1 | g1323513 | 10 | 4 | gb105eukp | YOR1 |
| 700616372H1 | g22320 | 49 | −83 | gb105pln | Maize H1 mRNA for H1 histone. |
| 700618053H1 | g168502 | 59 | −37 | gb105pln | Maize (*Zea mays*) histone H4 gene (H4C7), complete cds. |
| 700616913H1 | g984307 | 24 | 2 | gb105pln | *Glycine max* ribosomal protein S16 (rps16) gene, partial cds, beta-carboxyltransferase (accD), photosystem I component (psaI), ORF 202 protein (ORF 203), ORF 151 protein (ORF 151), ORF 103 protein (ORF 103), ORF 229 precursor protein (ORF 229), and cytochrome f precursor (petA) genes, chloroplast genes encoding chloroplast proteins, complete cds. |
| 700613666H1 | g1370174 | 9 | 2 | gb105allp | RAB1Y |
| 700461175H1 | g1498052 | 92 | −73 | gb105pln | *Zea mays* ribosomal protein S8 mRNA, complete cds. |
| 700614821H1 | g602564 | 19 | −26 | gb105pln | *C. paradisi* (Macf) INO1 gene. |
| 700617383H1 | g22528 | 87 | −5 | gb105pln | *Zea mays* mRNA encoding a zein (clone A20). |
| 700461201H1 | g485130 | 16 | −3 | gb105eukp | K02F3.1 |
| 700615389H1 | g2662344 | 51 | −61 | gb105pln | *Oryza sativa* mRNA for EF-1 alpha, complete cds. |
| 700613409H1 | g218099 | 10 | −7 | gb105pln | Rice mRNA for ribosomal protein S12 (320 gene), partial sequence. |
| 700612859H1 | g293885 | 23 | 11 | gb105pln | *Zea diploperennis* alcohol dehydrogenase 1 (Adh1) gene, exons 4 through 10. |
| 700618571H1 | g2370511 | 15 | −1 | gb105eukp | SPAC2C6.14c; putative 40s ribosomal protein |
| 700616760H1 | g2618602 | 20 | 17 | gb105pln | *Arabidopsis thaliana* genomic DNA, chromosome 5, P1 clone: MSJ1, complete sequence. |
| 700614294H1 | g22441 | 41 | −2 | gb105pln | Maize pML2 gene for zein. |
| 700612747H1 | g2583120 | 20 | −12 | gb105eukp | F4L23.15; putative receptor-like protein kinase |
| 700617049H1 | g2245098 | 27 | −3 | gb105eukp | ribosomal protein |
| 700612581H1 | g409074 | 17 | 2 | gb105allp | HBp15/L22 |
| 700615215H1 | g168505 | 12 | −27 | gb105pln | *Zea mays* histone H3 gene, complete cds. |
| 700614277H1 | g22447 | 50 | 4 | gb105pln | *Zea mays* ZMPMS2 gene for 19 kDa zein protein. |
| 700613418H1 | g2258465 | 30 | 4 | gb105allp | succinyl-CoA synthetase alpha subunit |
| 700615230H1 | g22614 | 48 | −61 | gb105pln | *S. vulgare* pepC gene for PEP carboxylase. |
| 700613938H1 | g233042 | 14 | 4 | gb105allp | S3 ribosomal protein [human, colon, Peptide, 243 aa] |
| 700618627H1 | g416251 | 22 | −30 | gb105pln | Rice mRNA for acetohydroxy acid reductoisomerase, partial sequence. |
| 700461113H1 | g790977 | 43 | −28 | gb105pln | *B. juncea* msams mRNA. |
| 700612870H1 | g22119 | 93 | −105 | gb105pln | Maize Adh1-F mRNA for alcohol dehydrogenase. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700615207H1 | g536190 | 10 | 1 | gb105eukp | COQ1 |
| 700617503H1 | g303854 | 12 | 15 | gb105pln | Rice mRNA for ribosomal protein L7A, complete cds. |
| 700613933H1 | g437057 | 12 | 4 | gb105allp | TIA |
| 700614760H1 | g2827544 | 38 | −21 | gb105eukp | T12H17.60; HSP associated protein like |
| 700613892H1 | g170455 | 42 | −40 | gb105pln | Tomato heat shock cognate protein 80 gene, 3' end. |
| 700615228H1 | g2621088 | 11 | 0 | gb105allp | aspartate aminotransferase related protein |
| 700615685H1 | g2331300 | 37 | −88 | gb105pln | *Zea mays* ribosomal protein S4 type I (rps4) mRNA, complete cds. |
| 700615845H1 | g2286150 | 71 | −32 | gb105pln | *Zea mays* translation initiation factor (eIF-4A) mRNA, complete cds. |
| 700617476H1 | g168579 | 34 | −74 | gb105pln | Maize pyruvate, orthophosphate dikinase mRNA, complete cds. |
| 700613006H1 | g286001 | 5 | 3 | gb105allp | KIAA0005 |
| 700614709H1 | g2113845 | 27 | −51 | gb105pln | *Hordeum vulgare* mRNA for hypothetical protein, partial, clone WL3. |
| 700617170H1 | g1326190 | 17 | 2 | gb105allp | chaperonin 10 |
| 700612863H1 | g1777455 | 48 | 5 | gb105allp | pyruvate decarboxylase 2 |
| 700615609H1 | g2288968 | 18 | −2 | gb105pln | *Zea mays* mRNA for glutathione transferase. |
| 700614705H1 | g556673 | 12 | 5 | gb105eukp | heat-shock protein |
| 700616632H1 | g1161312 | 61 | −1 | gb105eukp | myo-inositol-1-phosphate synthase |
| 700616596H1 | g2435604 | 26 | −13 | gb105eukp | F08F1.7 |
| 700616526H1 | g168408 | 69 | −18 | gb105pln | Maize alcohol dehydrogenase gene mutant (Adh1-Fm335 allele) with Ds insertion element, 5' end. |
| 700613124H1 | g1136119 | 56 | −66 | gb105pln | *O. sativa* mRNA for alpha-tubulin (clone OSTA-111). |
| 700614765H1 | g576632 | 30 | 9 | gb105pln | *Chlamydomonas reinhardtii* histone H3 (ch3-I) and histone H4 (ch4-I) genes, complete cds. |
| 700616996H1 | g20732 | 41 | −5 | gb105pln | Pea chloroplast GAPB mRNA encoding glyceraldehyde-3-phosphate dehydrogenase (GAPDH) subunit B (EC 1.2.1.13.) |
| 700616641H1 | g515376 | 27 | 17 | gb105pln | *L. temulentum* mRNA for histone H4. |
| 700613379H1 | g168482 | 32 | −69 | gb105pln | Corn starch branching enzyme II mRNA, complete cds. |
| 700615672H1 | g168661 | 84 | −106 | gb105pln | Maize 15 kDa zein mRNA, clone cZ15A3, complete cds. |
| 700618258H1 | g1532047 | 14 | 2 | gb105pln | *O. sativa* mRNA for S-adenosylmethionine decarboxylase. |
| 700617184H1 | g22144 | 88 | −23 | gb105pln | Maize anaerobically regulated gene for fructose bisphosphate aldolase (EC 4.1.2.13). |
| 700618376H1 | g1931644 | 3 | 7 | gb105eukp | T19D16.10; membrane protein PTM1 precursor isolog |
| 700615403H1 | g1388082 | 15 | −1 | gb105eukp | TRX4; thioredoxin h |
| 700616026H1 | g2464909 | 9 | 0 | gb105eukp | SCARECROW homolog |
| 700616206H1 | g471089 | 14 | −8 | gb105eukp | ACA1; chloroplast envelope Ca2+-ATPase precursor |
| 700612524H1 | g2345153 | 98 | −83 | gb105pln | *Zea mays* ribsomal protein S4 (rps4) mRNA, complete cds. |
| 700617167H1 | g16072 | 68 | −29 | gb105pln | *A. mediterranea* zein gene. |
| 700613874H1 | g2414402 | 62 | 1 | gb105eukp | Y57G11C.15 |
| 700614009H1 | g1212993 | 68 | −76 | gb105pln | *H. vulgare* mRNA for coproporphyrinogen oxidase. |
| 700614351H1 | g482937 | 36 | −14 | gb105pln | *N. tabacum* mRNA for pyruvate kinase (plastid isozyme). |
| 700618168H1 | g758246 | 14 | −0 | gb105pln | *Phalaenopsis* sp. mRNA for S-adenosyhomocysteine hydrolase. |
| 700616421H1 | g1302547 | 13 | −3 | gb105eukp | COQ2 |
| 700461137H1 | g218169 | 17 | −4 | gb105pln | Rice mRNA for acyl carrier protein (KN33 gene), partial sequence. |
| 700614395H1 | g1350539 | 17 | 5 | gb105pln | *Picea glauca* EMB4 mRNA. |
| 700616545H1 | g169716 | 50 | −2 | gb105pln | *Ricinus communis* stearoyl-acyl-carrier protein desaturase mRNA, 3' end of cds. |
| 700613993H1 | g2656029 | 20 | −25 | gb105pln | *Arabidopsis thaliana* genomic DNA, chromosome 5, P1 clone: MQB2. |
| 700613274H1 | g1546918 | 67 | −0 | gb105pln | *Z. mays* mRNA for translation initiation factor 5A. |
| 700615091H1 | g473604 | 19 | −41 | gb105pln | *Zea mays* W-22 histone H2B mRNA, complete cds. |
| 700616785H1 | g1218054 | 89 | −0 | gb105eukp | protein phosphatase 2A |
| 700616601H1 | g790969 | 23 | −40 | gb105pln | Rice mRNA for aldolase C-1, |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | complete cds. |
| 700615885H1 | g22542 | 43 | −31 | gb105pln | Maize gene for Mr 19000 alpha zein and 5′-flanking region. |
| 700616865H1 | g289117 | 7 | 3 | gb105pln | *Allium cepa* cyclophilin mRNA, complete cds. |
| 700615640H1 | g168683 | 76 | −89 | gb105pln | Maize 22 kd (Mw = 26.53 kd) zein protein 1, mRNA. |
| 700614129H1 | g168496 | 55 | −13 | gb105pln | Maize (*Zea mays*) histone H3 gene (H3C4), complete cds. |
| 700613920H1 | g168702 | 87 | −38 | gb105pln | Corn 22 kDa zein protein gene, complete cds. |
| 700614689H1 | g1015931 | 19 | −11 | gb105eukp | ribosomal protein L1 |
| 700616459H1 | g557832 | 5 | 7 | gb105eukp | yvh1, len: 364, CAI: 0.17, PVH1_YEAST Q02256 PROTEIN-TYROSINE PHOSPHATASE YVH1 |
| 700613768H1 | g571474 | 16 | −3 | gb105pln | *Chlamydomonas reinhardtii* histone H3 (ch3-III), histone H4 (ch4-III), histone H2B (ch2b-III) and histone H2A (ch2a-III) genes, complete cds. |
| 700612857H1 | g303853 | 51 | 2 | gb105eukp | ribosomal protein L3 |
| 700617088H1 | g2244792 | 16 | −4 | gb105eukp | ankyrin homolog |
| 700461105H1 | g1711035 | 33 | −17 | gb105pln | *Pisum sativum* hydroxyproilne rich glycoprotein PsHRGP1 mRNA, partial cds. |
| 700616322H1 | g1272410 | 16 | 3 | gb105eukp | FKBP15; immunophilin precursor |
| 700617396H1 | g1507667 | 30 | −36 | gb105eukp | bfr2+ protein/pad1+ protein/sks1+ protein |
| 700612509H1 | g2570506 | 53 | −41 | gb105pln | *Oryza sativa* ribosomal protein mRNA, complete cds. |
| 700615863H1 | g168673 | 89 | −45 | gb105pln | Maize 19 kDa zein mRNA, clone cZ19B1, complete cds. |
| 700616224H1 | g1272406 | 38 | 0 | gb105eukp | FKBP15-1; immunophilin |
| 700612632H1 | g21834 | 51 | −20 | gb105pln | Wheat mRNA for cytosolic phosphoglycerate kinase (EC 2.7.2.3). |
| 700615190H1 | g1236616 | 33 | 6 | gb105pln | *Zea mays* ubiquitin-conjugating enzyme mRNA, partial cds. |
| 700613135H1 | g172092 | 4 | 5 | gb105eukp | polyadenylate-binding protein |
| 700612803H1 | g2288887 | 22 | −21 | gb105eukp | MVD1; mevalonate diphosphate decarboxylase; EC 4.1.1.33 |
| 700616332H1 | g16292 | 9 | 16 | gb105pln | *A. thaliana* gene encoding a glycine-rich protein. |
| 700613926H1 | g432367 | 40 | −30 | gb105pln | Rice mRNA for elongation factor 1 beta, complete cds. |
| 700613961H1 | g676880 | 19 | −4 | gb105eukp | api2 |
| 700615234H1 | g2326228 | 50 | −66 | gb105pln | *Zea mays* tousled-like kinase 1 (MTK-1) mRNA, partial cds. |
| 700615867H1 | g1838961 | 18 | −4 | gb105eukp | acyl carrier protein |
| 700613408H1 | g22215 | 20 | −59 | gb105pln | *Z. mays* ZSF4C1 gene for zein. |
| 700614232H1 | g533085 | 27 | −6 | gb105pln | *Thunbergia alata* clone pTAD3 delta-9-stearoyl-acyl carrier protein desaturase precursor mRNA, complete cds. |
| 700614693H1 | g633094 | 29 | −29 | gb105pln | *Panicum miliaceum* mRNA for plastidic aspartate aminotransferase, complete cds. |
| 700613288H1 | g2760172 | 15 | 1 | gb105pln | *Arabidopsis thaliana* genomic DNA, chromosome 5, P1 clone: MUB3, complete sequence. |
| 700612808H1 | g348719 | 25 | −14 | gb105pln | MtN *Medicago truncatula* protochlorophyllide reductase homolgue mRNA, complete cds. |
| 700617472H1 | g1788589 | 6 | 6 | gb105allp | o660; This 660 aa ORF is 30 pct identical (9 gaps) to 301 residues of an approx. 320 aa protein FMT_ECOLI SW: P23882 |
| 700612728H1 | g22144 | 23 | 13 | gb105pln | Maize anaerobically regulated gene for fructose bisphosphate aldolase (EC 4.1.2.13). |
| 700461119H1 | g22322 | 41 | −59 | gb105pln | *Z. mays* mRNA for H2B histone (clone cH2B214). |
| 700613327H1 | g2689720 | 14 | −9 | gb105eukp | AtJ6; DnaJ homologue |
| 700615142H1 | g312180 | 25 | −81 | gb105pln | *Z. mays* GapC4 gene. |
| 700616915H1 | g1015749 | 6 | 3 | gb105eukp | HAM1 |
| 700613012H1 | g22314 | 40 | −101 | gb105pln | Maize mRNA for GSH gluthathione S-transferase I (GST; EC 2.5.1.18). |
| 700614030H1 | g168406 | 16 | −5 | gb105pln | *Z. mays* alcohol dehydrogenase (ADH-1 C-m allele) gene, complete cds. |
| 700614557H1 | g218169 | 18 | −32 | gb105pln | Rice mRNA for acyl carrier protein (KN33 gene), partial sequence. |
| 700614711H1 | g22151 | 71 | −43 | gb105pln | *Z. mays* (A188) mRNA for alpha-tubulin 4. |
| 700618491H2 | g21834 | 31 | −14 | gb105pln | Wheat mRNA for cytosolic phosphoglycerate kinase (EC 2.7.2.3). |
| 700461201H1 | g2276199 | 13 | 0 | gb105eukp | T04A11.6 |
| 700461219H1 | g22324 | 37 | −37 | gb105pln | *Z. mays* mRNA for H2B histone (clone cH2B221). |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700612517H1 | g2282583 | 79 | −69 | gb105pln | *Zea mays* elongation factor 1-alpha (EF1-A) mRNA, complete cds. |
| 700612323H1 | g170775 | 45 | −0 | gb105pln | Wheat translation elongation factor 1 alpha-subunit (TEF1) mRNA, complete cds. |
| 700615012H1 | g21794 | 17 | 16 | gb105pln | Wheat histone H4 gene. |
| 700613271H1 | g22540 | 29 | −18 | gb105pln | Maize mRNA for 10 kDa zein. |
| 700613852H1 | g2431768 | 24 | 14 | gb105pln | *Zea mays* acidic ribosomal protein P1a (rpp1a) mRNA, complete cds. |
| 700613808H1 | g295925 | 16 | −7 | gb105eukp | RPG19; ribosomal protein |
| 700461261H1 | g16072 | 73 | −54 | gb105pln | *A. mediterranea* zein gene. |
| 700615773H1 | g1658312 | 32 | 11 | gb105pln | *O. sativa* osr40g2 gene. |
| 700612428H1 | g2661395 | 31 | 14 | gb105pln | *Ginkgo biloba* coxI gene, partial. |
| 700615470H1 | g2264309 | 13 | 12 | gb105pln | *Arabidopsis thaliana* genomic DNA, chromosome 5, P1 clone: MJJ3, complete sequence. |
| 700615879H1 | g2668741 | 20 | −27 | gb105pln | *Zea mays* glycine-rich RNA binding protein (GRP) mRNA, complete cds. |
| 700615476H1 | g2274983 | 35 | −20 | gb105pln | *Hordeum vulgare* mRNA for expressed sequence tag. |
| 700615714H1 | g1354933 | 28 | −6 | gb105eukp | stearoyl-ACP desaturase |
| 700612518H1 | g498739 | 72 | −65 | gb105pln | *H. vulgare* (pMaW22) mRNA for beta-ketoacyl-ACP synthase. |
| 700613109H1 | g2511584 | 18 | −0 | gb105eukp | prc9; multicatalytic endopeptidase; EC 3.4.99.46 |
| 700617334H1 | g169894 | 49 | −12 | gb105pln | *Simmondsia chinensis* stearoyl-acyl carrier protein desaturase mRNA, complete cds. |
| 700612679H1 | g507844 | 56 | −22 | gb105pln | *Zea mays* A188 retrotransposon gag gene, complete cds. |
| 700615473H1 | g1419871 | 8 | −8 | gb105eukp | ARG1 |
| 700613970H1 | g1430978 | 12 | −2 | gb105pln | Yeast (*Saccharomyces cerevisiae*) chrompsome IV reading frame ORF YDL014w. |
| 700617996H1 | g556672 | 34 | 1 | gb105pln | *S. cereale* (Halo) chloroplast mRNA for heat-shock protein. |
| 700617526H1 | g558095 | 29 | −24 | gb105eukp | ribonucleotide reductase small subunit |
| 700616315H1 | g22533 | 60 | 7 | gb105pln | *Zea mays* mRNA encoding a zein (clone ZG99). |
| 700617451H1 | g600115 | 24 | −21 | gb105pln | *Z. mays* apx gene encoding cytosolic ascorbate peroxidase. |
| 700616576H1 | g1568480 | 84 | 1 | gb105eukp | cdc2-like protein kinase |
| 700614972H1 | g1899025 | 8 | 8 | gb105eukp | AtHXK2; hexokinase 2; EC 2.7.1.1 |
| 700616569H1 | g22681 | 43 | −40 | gb105pln | *L. usitatissimum* mRNA for Stearoyl-(acyl-carrier-protein) desaturase. |
| 700613904H1 | g1463121 | 18 | −9 | gb105eukp | RPS3; ribosomal protein S3 |
| 700612457H1 | g469248 | 60 | 1 | gb105allp | ribosomal protein S3a |
| 700617281H1 | g1498385 | 82 | −27 | gb105pln | *Zea mays* actin (Maz87) gene, partial cds. |
| 700614281H1 | g18819 | 17 | −28 | gb105eukp | SF3; Transcription factor SF3 |
| 700617031H1 | g1263910 | 32 | −34 | gb105pln | *S. oleracea* mRNA for vacuolar H(+)-ATPase. |
| 700616988H1 | g2814711 | 13 | 3 | gb105eukp | T12D8.8 |
| 700613720H1 | g506470 | 18 | 2 | gb105pln | *N. tabacum* mRNA pNLA-35. |
| 700618038H1 | g392943 | 13 | 10 | gb105pln | *Lophopyrum elongatum* salt-stress induced ESI3 gene, complete cds. |
| 700614581H1 | g287297 | 65 | −22 | gb105pln | *Oryza sativa* mRNA for aspartate aminotransferase, complete cds. |
| 700616255H1 | g2347204 | 29 | 1 | gb105eukp | T09D09.22; TCP1-chaperonin cofactor A isolog |
| 700612665H1 | g218082 | 33 | −4 | gb105pln | Rice mRNA for initiation factor eIF-4D (225 gene), partial sequence. |
| 700616892H1 | g436782 | 50 | −1 | gb105pln | Rice mRNA for cyc07, complete cds. |
| 700615041H1 | g20355 | 15 | −13 | gb105pln | Rice rgp1 mRNA for a ras-related GTP-binding protein. |
| 700615384H1 | g22528 | 63 | −112 | gb105pln | *Zea mays* mRNA encoding a zein (clone A20). |
| 700461244H1 | g2661421 | 19 | 6 | gb105pln | *Arabidopsis thaliana* mRNA for S-phase-specific ribosomal protein. |
| 700615233H1 | g1808684 | 15 | 2 | gb105allp | hypothetical protein |
| 700617937H1 | g347063 | 34 | −3 | gb105pln | *Brassica rapa* ubiquitin/ribosomal protein mRNA, complete cds. |
| 700614274H1 | g397400 | 47 | 12 | gb105pln | *B. rapa* mRNA for S phase specific gene. |
| 700616180H1 | g683503 | 15 | 3 | gb105pln | *A. thaliana* mRNA for 65 kDa regulatory subunit of protein phosphatase 2A. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700612533H1 | g403434 | 45 | −24 | gb105eukp | ASB1; anthranilate synthase beta subunit; EC 4.1.3.27 |
| 700617539H1 | g2586122 | 8 | 13 | gb105pln | *Allium porrum* b-keto acyl reductase (glossy8) mRNA, partial cds. |
| 700613709H1 | g2264309 | 21 | 8 | gb105pln | *Arabidopsis thaliana* genomic DNA, chromosome 5, P1 clone: MJJ3, complete sequence. |
| 700617714H1 | g168661 | 78 | −66 | gb105pln | Maize 15 kDa zein mRNA, clone cZ15A3, complete cds. |
| 700613923H1 | g602605 | 82 | −26 | gb105pln | *Zea mays* tandem genes for alpha1-tubulin and alpha2-tubulin. |
| 700616687H1 | g536891 | 21 | 15 | gb105pln | Wheat mRNA for protein H2A, complete cds, clone wcH2A-4. |
| 700616006H1 | g2281090 | 16 | −9 | gb105eukp | F18O19.9 |
| 700616956H1 | g2130984 | 35 | −27 | gb105pln | *B. napus* mRNA for ribosomal protein S15a (pA813). |
| 700612712H1 | g2414643 | 20 | −23 | gb105pln | Yeast (*Saccharomyces pombe*) chromosome I cosmid c3H5. |
| 700617016H1 | g166410 | 11 | −3 | gb105eukp | nucleic acid binding protein; Alfin-1 |
| 700615406H1 | g296493 | 39 | −36 | gb105pln | *A. pyhllitidis* mRNA for alpha-tubulin 1. |
| 700614042H1 | g474003 | 22 | 12 | gb105pln | Rice mRNA, partial homologous to ribosomal protein rp21c gene. |
| 700613760H1 | g2511530 | 52 | −54 | gb105pln | *Eleusine undica* alpha tubulin 1 (TUA1) mRNA, complete cds. |
| 700612570H1 | g456671 | 38 | −26 | gb105pln | *T. aestivum* VDAC 1 mRNA. |
| 700614844H1 | g474389 | 49 | −13 | gb105pln | *H. vulgare* L. (Alexis) Serine carboxypeptidase II-1 mRNA. |
| 700613407H1 | g2454181 | 33 | −22 | gb105pln | *Arabidopsis thaliana* pyruvate dehydrogenase E1 alpha subunit mRNA, nuclear gene encoding plastid protein, complete cds. |
| 700614067H1 | g168500 | 40 | 7 | gb105pln | Maize (*Zea mays*) histone H4 gene (H4C14), complete cds. |
| 700615289H1 | g303856 | 30 | −35 | gb105pln | Rice mRNA for ubiquitin protein fused to a ribosomal protein, complete cds. |
| 700616322H1 | g1272406 | 17 | −9 | gb105eukp | FKBP15-1; immunophilin |
| 700613472H1 | g168487 | 31 | −48 | gb105pln | Maize glutathione S-transferase gene (GST-I), exons 2 and 3. |
| 700461173H1 | g21796 | 72 | −58 | gb105pln | Wheat histone H3 gene. |
| 700614072H1 | g18361 | 44 | −18 | gb105pln | *D. carota* mRNA for proliferating cell nuclear antigen (PCNA). |
| 700615014H1 | g2244798 | 11 | −0 | gb105eukp | hypothetical protein |
| 700612744H1 | g295925 | 11 | −3 | gb105eukp | RPG19; ribosomal protein |
| 700615484H1 | g1399512 | 21 | −7 | gb105eukp | repE; repE |
| 700616074H1 | g1314384 | 97 | −27 | gb105pln | *Tripsacum maizar* de Wet 3721 ITS1, 5.8S ribosomal RNA, ITS2. |
| 700618481H2 | g2842487 | 13 | 0 | gb105eukp | F21O9.130; SOF1 protein-like protein |
| 700617081H1 | g1429348 | 14 | −4 | gb105eukp | NHP2; high-mobility-group-like protein |
| 700615003H1 | g2708715 | 30 | 2 | gb105allp | small nuclear ribonucleoprotein Sm D3 |
| 700618214H1 | g169589 | 8 | 2 | gb105eukp | U2B; U2snRNP-specific protein; spliceosomal protein |
| 700616885H1 | g347527 | 33 | 1 | gb105allp | ribosomal protein S3 |
| 700613418H1 | g16510 | 42 | 1 | gb105eukp | succinate--CoA ligase (GDP-forming); EC 6.2.1.4; succinyl-CoA synthetase alpha chain |
| 700614695H1 | g2662346 | 16 | −31 | gb105pln | *Oryza sativa* mRNA for EF-1 alpha, complete cds. |
| 700613744H1 | g2065173 | 11 | 6 | gb105allp | similarities with RP1 and EB1 |
| 700612506H1 | g1184022 | 11 | 3 | gb105eukp | SPAC4H3.09; unknown |
| 700615650H1 | g2708321 | 17 | −6 | gb105pln | *Mesembryanthemum crystallinum* inositol monophosphatase (IMP1) mRNA, complete cds. |
| 700617517H1 | g62983 | 28 | 5 | gb105allp | ribosomal protein L5 |
| 700615510H1 | g2196547 | 23 | −12 | gb105pln | *Nicotiana tabacum* DNA-binding protein (T231) mRNA, complete cds. |
| 700617039H1 | g2654209 | 26 | −18 | gb105pln | *Spinacia oleracea* heat shock 70 protein (HSC70-10) mRNA, nuclear gene encoding mitochondrial protein, complete cds. |
| 700461161H1 | g22447 | 90 | −75 | gb105pln | *Zea mays* ZMPMS2 gene for 19 kDa zein protein. |
| 700614226H1 | g1019404 | 12 | −18 | gb105eukp | SPAC2G11.06; unknown |
| 700617823H1 | g904152 | 4 | 7 | gb105eukp | microsomal omega-6 desaturase |
| 700614786H1 | g2073569 | 65 | −24 | gb105allp | cDNA encoding nuclear chloride ion channel |
| 700616601H1 | g168419 | 31 | −62 | gb105pln | Maize (*Z. mays*) aldolase mRNA, |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | complete cds. |
| 700612505H1 | g2160155 | 23 | −21 | gb105pln | Sequence of BAC F21M12 from *Arabidopsis thaliana* chromosome 1, complete sequence. |
| 700616858H1 | g1143524 | 63 | −57 | gb105pln | *O. sativa* mRNA for g protein b subunit. |
| 700617476H1 | g168584 | 29 | −71 | gb105pln | Corn pyruvate, orthophosphate dikinase gene, exons 2–19. |
| 700613620H1 | g1778820 | 48 | −5 | gb105pln | *Oryza sativa* S-adenosyl-L-methionine synthetase (pOS-SAMS2) mRNA, complete cds. |
| 700614950H1 | g633109 | 39 | −11 | gb105pln | Rice mRNA for plasma membrane H+-ATPase, complete cds. |
| 700616424H1 | g167107 | 24 | −13 | gb105pln | *Hordeum vulgare* vacuolar ATPase B subunit isoform mRNA, complete cds. |
| 700616869H1 | g1304213 | 44 | −10 | gb105pln | Rice mRNA for cytosolic glutathione reductase, complete cds. |
| 700612491H1 | g180937 | 66 | −2 | gb105allp | COX5B |
| 700617507H1 | g2586126 | 32 | −33 | gb105pln | *Hordeum vulgare* b-keto acyl reductase (glossy8) mRNA, complete cds. |
| 700613984H1 | g4353 | 39 | −6 | gb105eukp | DHH1; RNA-helicase of the DEAD-BOX family |
| 700617424H1 | g397395 | 31 | −16 | gb105pln | *Z. mays* MNB1b mRNA for DNA-binding protein. |
| 700613003H1 | g1132482 | 22 | −17 | gb105pln | Rice mRNA for ADP-ribosylation factor, complete cds. |
| 700615856H1 | g2168137 | 35 | −3 | gb105eukp | PKF1 |
| 700615655H1 | g2335104 | 20 | −7 | gb105eukp | T11A07.16; villin isolog |
| 700615441H1 | g1359614 | 10 | −6 | gb105eukp | UbcD4; ubiquitin conjugating enzyme |
| 700616734H1 | g2463334 | 20 | 5 | gb105pln | *Oryza sativa* mRNA for ribosomal protein S4. |
| 700613655H1 | g1296954 | 14 | −9 | gb105pln | *O. sativa* mRNA for novel protein, osr40cl. |
| 700613975H1 | g499011 | 44 | −24 | gb105pln | *S. vulgare* SoAc1 mRNA. |
| 700614312H1 | g600115 | 34 | −20 | gb105pln | *Z. mays* apx gene encoding cytosolic ascorbate peroxidase. |
| 700613321H1 | g511665 | 30 | −57 | gb105pln | Rice gene for aspartic protease, complete cds. |
| 700616488H1 | g600387 | 31 | −46 | gb105eukp | proteosome subunit |
| 700615919H1 | g473602 | 33 | −7 | gb105pln | *Zea mays* W-22 histone H2A mRNA, complete cds. |
| 700613882H1 | g22531 | 100 | −17 | gb105pln | *Zea mays* mRNA encoding a zein (clone pZ22.1). |
| 700615201H1 | g1228953 | 14 | 7 | gb105eukp | F17A2.3 |
| 700615449H1 | g2224910 | 16 | −9 | gb105pln | *Daucus carota* somatic embryogenesis receptor-like kinase mRNA, complete cds. |
| 700615849H1 | g170105 | 11 | 3 | gb105eukp | carbonic anhydrase (EC 4.2.1.1) |
| 700612474H1 | g1658312 | 69 | −13 | gb105pln | *O. sativa* osr40g2 gene. |
| 700614937H1 | g303852 | 59 | −22 | gb105pln | Rice mRNA for ribosomal protein L3, complete cds. |
| 700615518H1 | g1107487 | 26 | 8 | gb105allp | 60S ribosomal protein L27a |
| 700618671H1 | g928936 | 31 | −20 | gb105eukp | D3; putative chaperone; J-domain protein |
| 700615987H1 | g2564047 | 20 | −4 | gb105pln | *Arabidopsis thaliana* genomic DNA, chromosome 5, P1 clone: MJB21, complete sequence. |
| 700615055H1 | g2623679 | 13 | −24 | gb105pln | *Zea mays* calmodulin (Zmrcalm) mRNA, complete cds. |
| 700613009H1 | g1850913 | 4 | 7 | gb105eukp | mhcA; myosin heavy chain |
| 700614366H1 | g415314 | 70 | −19 | gb105pln | Rice mRNA for NADP dependent malic enzyme, complete cds. |
| 700612459H1 | g2586332 | 33 | −16 | gb105pln | *Lycopersicon esculentum* importin alpha (LeKAP alpha) mRNA, partial cds. |
| 700618659H1 | g1890351 | 20 | 3 | gb105pln | *A. thaliana* mRNA for transcription factor L2. |
| 700616445H1 | g1809305 | 10 | 2 | gb105eukp | His1-3; histone H1-3 |
| 700616291H1 | g1667394 | 13 | −8 | gb105allp | transcriptional regulator homolog RPD3 |
| 700612794H1 | g22144 | 62 | −80 | gb105pln | Maize anaerobicaliy regulated gene for fructose bisphosphate aldolase (EC 4.1.2.13). |
| 700615064H1 | g2394299 | 35 | −43 | gb105pln | *Oryza sativa* cytochrome C mRNA, complete cds |
| 700618613H1 | g1272407 | 24 | −6 | gb105pln | *Arabidopsis thaliana* immunophilin (FKBP15-2) mRNA, complete cds. |
| 700616961H1 | g169036 | 40 | −41 | gb105pln | *Pisum sativum* L. aldolase gene, 3' end cds. |
| 700612691H1 | g8812 | 18 | −3 | gb105eukp | H(+)-ATPase |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700614204H1 | g665584 | 43 | −18 | gb105allp | ATP synthase gamma-subunit |
| 700615061H1 | g2104951 | 15 | 0 | gb105allp | MAP kinase-like protein |
| 700612330H1 | g2388994 | 22 | −10 | gb105eukp | SPAC6F6.03c; hypothetical protein |
| 700618537H1 | g1200282 | 9 | −10 | gb105eukp | F48F7.1 |
| 700617146H1 | g168679 | 85 | −24 | gb105pln | Maize 19 kDa zein mRNA, clone cZ19C2, complete cds. |
| 700614707H1 | g309220 | 33 | −11 | gb105allp | endoplasmic reticuium transmembrane protein precursor |
| 700612665H1 | g2668737 | 52 | −23 | gb105pln | *Zea mays* translation initiation factor 5A (TIF5A) mRNA, complete cds. |
| 700612301H1 | g972930 | 24 | −1 | gb105pln | *Arabidopsis thaliana* IAA14 (IAA14) gene, partial cds. |
| 700614809H1 | g1486286 | 25 | −6 | gb105pln | *C. sativus* mRNA for T-complex polypeptide 1. |
| 700461190H1 | g22324 | 64 | −46 | gb105pln | *Z. mays* mRNA for H2B histone (clone cH2B221). |
| 700618386H1 | g2341023 | 28 | −15 | gb105pln | Sequence of BAC F19P19 from *Arabidopsis thaliana* chromosome 1, complete sequence. |
| 700618244H1 | g21234 | 17 | −9 | gb105eukp | AHRI; acetohydroxy acid reductoisomerase; EC 1.1.1.86 |
| 700615933H1 | g2565339 | 21 | 17 | gb105pln | *Lupinus luteus* ribosomal protein S14 (rps14) mRNA, complete cds. |
| 700614008H1 | g461033 | 11 | 3 | gb105allp | c6.1A [human, Peptide, 324 aa] |
| 700616556H1 | g454881 | 38 | 3 | gb105pln | Rice gene for thioredoxin h, complete cds. |
| 700612803H1 | g553123 | 13 | −4 | gb105eukp | ORF |
| 700617543H1 | g2252866 | 23 | 3 | gb105allp | contains region of similarity to SYT |
| 700616989H1 | g16072 | 61 | −21 | gb105pln | *A. mediterranea* zein gene. |
| 700616626H1 | g2245098 | 40 | −5 | gb105eukp | ribosomal protein |
| 700613868H1 | g1881692 | 100 | −17 | gb105pln | *Zea mays* phosphoglucomutase mRNA, partial cds. |
| 700614157H1 | g2627057 | 65 | −60 | gb105pln | *Oryza sativa* mRNA for ADP glucose pyrophosphorylase large subunit, complete cds. |
| 700615448H1 | g21271 | 20 | −19 | gb105pln | *S. oleracea* mRNA for phosphoglycerate kinase (chloroplast isoenzyme) |
| 700613769H1 | g602605 | 68 | −59 | gb105pln | *Zea mays* tandem genes for alpha1-tubulin and alpha2-tubulin. |
| 700613431H1 | g899609 | 68 | −88 | gb105pln | *Zea mays* acidic ribosomal protein P2 (RPA-2A1) mRNA, complete cds. |
| 700613134H1 | g485376 | 43 | −77 | gb105pln | *Zea mays* alpha-3-tubulin gene, complete cds. |
| 700614245H1 | g2494115 | 12 | −0 | gb105eukp | T1G11.1 |
| 700612592H1 | g2529662 | 23 | 6 | gb105allp | putative small nuclear ribonucleoprotein, Sm D2 |
| 700615106H1 | g2827001 | 25 | −36 | gb105pln | *Triticum aestivum* 70 kDa heat shock protein (TaHSP70d) mRNA, complete cds. |
| 700613778H1 | g2654088 | 20 | −12 | gb105eukp | KUP1; potassium transporter |
| 700614263H1 | g20755 | 33 | −8 | gb105pln | *P. sativum* mRNA rab for ras-related GTP-binding protein. |
| 700615508H1 | g2565339 | 44 | −14 | gb105pln | *Lupinus luteus* ribosomal protein S14 (rps14) mRNA, complete cds. |
| 700618636H1 | g2665672 | 30 | −27 | gb105eukp | IOTA; proteasome IOTA subunit |
| 700617324H1 | g22544 | 36 | 15 | gb105pln | Maize mRNA (clone A30) for zein (a plant storage protein). |
| 700613113H1 | g1321660 | 34 | −35 | gb105pln | Rice mRNA for ascorbate peroxidase, complete cds. |
| 700615022H1 | g508544 | 66 | −38 | gb105pln | *Zea mays* 24-kD alpha-zein gene (floury2), complete cds. |
| 700616586H1 | g1667306 | 14 | 5 | gb105eukp | F15C11.2 |
| 700617487H1 | g22324 | 10 | 12 | gb105pln | *Z. mays* mRNA for H2B histone (clone cH2B221). |
| 700613004H1 | g563334 | 10 | 12 | gb105pln | *B. napus* (Naehan) bgb1 mRNA for guanine nucleotide regulatory protein. |
| 700614768H1 | g2565339 | 23 | −2 | gb105pln | *Lupinus luteus* ribosomal protein S14 (rps14) mRNA, complete cds. |
| 700617461H1 | g1216483 | 24 | −8 | gb105pln | *Arabidopsis thaliana* dual specificity kinase 1 (ADK1) mRNA, complete cds. |
| 700615563H1 | g22537 | 33 | 1 | gb105pln | Maize mRNA for zein polypeptide (clone M6). |
| 700618531H1 | g2104461 | 17 | 2 | gb105eukp | cct7; Cct7p |
| 700617313H1 | g2564046 | 30 | −31 | gb105pln | *Arabidopsis thaliana* genomic DNA, chromosome 5, P1 clone: MGI19, complete sequence. |
| 700612313H1 | g168650 | 82 | −43 | gb105pln | *Zea mays* ubiquitin fusion protein (UBF9) gene, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700613453H1 | g21800 | 35 | −26 | gb105pln | *T. aestivum* L mRNA for histone H2B. |
| 700614135H1 | g1770190 | 16 | −9 | gb105eukp | cycD1; cyclin-D like protein |
| 700615967H1 | g886739 | 66 | −11 | gb105pln | *Z. mays* histone H4 gene. |
| 700616610H1 | g790969 | 23 | 4 | gb105pln | Rice mRNA for aldolase C-1, complete cds. |
| 700615809H1 | g1653253 | 38 | −5 | gb105allp | glucose-6-phosphate isomerase |
| 700613980H1 | g974781 | 50 | −43 | gb105pln | *C. blumei* kinetoplast met gene for cobalamine-independent methionine synthase. |
| 700617072H1 | g602605 | 67 | −61 | gb105pln | *Zea mays* tandem genes for alpha1-tubulin and alpha2-tubulin. |
| 700614911H1 | g790969 | 46 | −46 | gb105pln | Rice mRNA for aldolase C-1, complete cds. |
| 700615257H1 | g1430978 | 17 | −0 | gb105pln | Yeast (*Saccharomyces cerevisiae*) chromosome IV reading frame ORF YDL014w. |
| 700617914H1 | g2832242 | 56 | −24 | gb105pln | *Zea mays* 22-kDa alpha zein gene cluster, complete sequence. |
| 700616948H1 | g2462748 | 16 | 0 | gb105allp | putative Clathrin Coat Assembly protein |
| 700613254H1 | g2529707 | 8 | −2 | gb105allp | Hpast |
| 700461169H1 | g1651535 | 10 | 7 | gb105allp | [acyl-carrier-protein] S-malonyltransferase |
| 700616737H1 | g1015315 | 38 | 8 | gb105pln | *Pisum sativum* (clone PsRCI35-2) ribosomal protein L41 mRNA, complete cds. |
| 700616987H1 | g1378455 | 10 | 17 | gb105pln | Yeast (*Saccharomyces cerevisiae*) chromosome XVI reading frame ORF YPL220w. |
| 700618422H2 | g1707365 | 17 | −8 | gb105pln | *A. thaliana* mRNA for arginine/serine-rich splicing factor, RSp31. |
| 700616858H1 | g1143813 | 38 | −29 | gb105pln | *Nicotiana tabacum* heterotrimeric GTP-binding protein beta subunit mRNA, partial cds. |
| 700612377H1 | g2708738 | 42 | −17 | gb105eukp | T13L16.2; hypothetical protein |
| 700612556H1 | g483535 | 22 | −27 | gb105pln | *R. communis* gene for pyrophosphate-dependent phosphofructokinase beta subunit. |
| 700615249H1 | g168650 | 43 | 4 | gb105pln | *Zea mays* ubiquitin fusion protein (UBF9) gene, complete cds. |
| 700615893H1 | g293886 | 40 | −8 | gb105pln | *Zea mays* glyceraldehyde-3-phosphate dehydrogenase mRNA, 3' end, (clone GAPC3). |
| 700614183H1 | g2815905 | 37 | 0 | gb105eukp | sug-1; Sug-1 proteosome subunit homolog |
| 700613393H1 | g474006 | 24 | 15 | gb105pln | Rice mRNA, partial homologous to ribosomal protein S11 gene. |
| 700616421H1 | g171254 | 13 | −3 | gb105eukp | COQ2; p-hydroxybenzoate: polyprenyl transferase |
| 700613734H1 | g557796 | 10 | 17 | gb105pln | Yeast (*Saccharomyces cerevisiae*) chromosome IX sequence derived from lambda clones 5610-5004. |
| 700613448H1 | g678549 | 5 | 3 | gb105allp | RNA polymerase II 23 kD subunit |
| 700615271H1 | g432367 | 28 | 11 | gb105pln | Rice mRNA for elongation factor 1 beta, complete cds |
| 700612564H1 | g2618602 | 23 | −14 | gb105pln | *Arabidopsis thaliana* genomic DNA, chromosome 5, P1 clone: MSJ1, complete sequence. |
| 700617908H1 | g2605615 | 12 | 5 | gb105allp | prolyl aminopeptidase |
| 700617168H1 | g535019 | 80 | −45 | gb105pln | *Z. mays* Zd1 tandem genes for zein Zd1 (19 kDa Zein). |
| 700612689H1 | g288062 | 21 | −36 | gb105pln | *A. thaliana* mRNA for ketol-acid reductoisomerase subunit. |
| 700614816H1 | g1523914 | 10 | 1 | gb105eukp | F25H2.9 |
| 700612743H1 | g2662340 | 70 | −81 | gb105pln | *Oryza sativa* mRNA for EF-1 alpha, complete cds. |
| 700613313H1 | g2583071 | 34 | −64 | gb105pln | *Triticum aestivum* ADP-glucose-pyrophosphorylase large subunit (AGP-L) mRNA, partial cds. |
| 700615172H1 | g2345153 | 71 | 8 | gb105pln | *Zea mays* ribsomal protein S4 (rps4) mRNA, complete cds. |
| 700614050H1 | g722327 | 67 | −23 | gb105pln | *Zea mays* clone Zm-Rab2-B GTP binding protein (rab2) mRNA, complete cds. |
| 700616194H1 | g609289 | 62 | −95 | gb105pln | *Z. mays* cultivar (LG11) ROA mRNA for replication origin activator protein. |
| 700612464H1 | g1808578 | 19 | 7 | gb105allp | proteasome subunit p112 |
| 700615955H1 | g303848 | 20 | 1 | gb105pln | Rice mRNA for nucleoside diphosphate kinase, complete cds. |
| 700614394H1 | g460711 | 15 | −4 | gb105allp | KIAA0045 |
| 700618571H1 | g902622 | 13 | 2 | gb105eukp | 40S ribosomal protein S12 |
| 700615832H1 | g20321 | 56 | −30 | gb105pln | *Oryza sativa* RAc1 mRNA for actin. |
| 700616540H1 | g168490 | 63 | −78 | gb105pln | Maize glutathione S-transferase (GST-I) mRNA, complete cds. |
| 700617786H1 | g2331300 | 40 | −42 | gb105pln | *Zea mays* ribosomal protein S4 |

TABLE 1-continued

LIST OF INCYTE CLONES DERIVED FROM SATMON022023
COPYRIGHT 1998 INCYTE PHARMACEUTICALS, INC.

| Clone | GI | | | Library | Description |
|---|---|---|---|---|---|
| | | | | | type I (rps4) mRNA, complete cds. |
| 700613159H1 | g21092 | 23 | −35 | gb105pln | *R. communis* stearoyl-acyl carrier protein desaturase. |
| 700613029H1 | g168500 | 24 | −44 | gb105pln | Maize (*Zea mays*) histone H4 gene (H4C14), complete cds. |
| 700612432H1 | g22516 | 34 | 2 | gb105pln | Maize Zc2 gene for zein Zc2 (28 kD glutelin-2). |
| 700613904H1 | g1302158 | 18 | −9 | gb105eukp | RPS3 |
| 700613077H1 | g2828188 | 18 | 3 | gb105pln | *Arabidopsis thaliana* genomic DNA, chromosome 5, TAC clone: K3I3, complete sequence. |
| 700618072H1 | g473357 | 12 | −7 | gb105eukp | thi4 |
| 700612388H1 | g459894 | 95 | −16 | gb105pln | *Zea mays* sus1 gene, complete cds. |
| 700614913H1 | g2081611 | 55 | 3 | gb105pln | Rice mRNA for delta1-pyrroline-5-carboxylate synthetase, complete cds. |
| 700615351H1 | g2431766 | 58 | −78 | gb105pln | *Zea mays* acidic ribosomal protein P3a (rpp3a) mRNA, complete cds. |
| 700617848H1 | g473978 | 37 | −13 | gb105pln | Rice mRNA, partial homologous to GAmRNA (cloneF). |
| 700614758H1 | g20768 | 21 | −9 | gb105eukp | PSRPL27; ribosomal protein L27 |
| 700618496H2 | g509264 | 14 | 0 | gb105pln | *B. napus* mRNA for acyl-CoA binding protein. |
| 700617434H1 | g168500 | 47 | −70 | gb105pln | Maize (*Zea mays*) histone H4 gene (H4C14), complete cds. |
| 700615457H1 | g2274987 | 43 | −36 | gb105pln | *Hordeum vulgare* mRNA for expressed sequence tag. |
| 700616630H1 | g168661 | 37 | −19 | gb105pln | Maize 15 kDa zein mRNA, clone cZ15A3, complete cds. |
| 700617708H1 | g1841501 | 54 | −60 | gb105pln | *Z. mays* mRNA for glutathione-dependent formaldehyde dehydrogenase. |
| 700615853H1 | g2369713 | 64 | −20 | gb105pln | *Beta vulgaris* cDNA for elongation factor 2. |
| 700617431H1 | g1743276 | 54 | −66 | gb105pln | *H. vulgare* mRNA for beta tubulin. |
| 700613725H1 | g2583071 | 56 | −45 | gb105pln | *Triticum aestivum* ADP-glucose-pyrophosphorylase large subunit (AGP-L) mRNA, partial cds. |
| 700618049H1 | g303854 | 26 | −3 | gb105pln | Rice mRNA for ribosomal protein L7A, complete cds. |
| 700614219H1 | g536891 | 22 | −44 | gb105pln | Wheat mRNA for protein H2A, complete cds, clone wcH2A-4. |
| 700617461H1 | g1103321 | 23 | −8 | gb105pln | *A. thaliana* CKI3 mRNA for casein kinase I. |
| 700461246H1 | g602564 | 31 | −13 | gb105pln | *C. paradisi* (Macf) INO1 gene. |
| 700614068H1 | g2696018 | 27 | 8 | gb105pln | *Arabidopsis thaliana* genomic DNA, chromosome 5, P1 clone: MXC9. |
| 700617222H1 | g780371 | 37 | −7 | gb105pln | *Oryza sativa* enolase mRNA, complete cds. |
| 700617954H1 | g22328 | 16 | −56 | gb105pln | Maize mRNA for a high mobility group protein. |
| 700617463H1 | g416514 | 12 | −20 | gb105allp | NEDD-6 |
| 700613892H1 | g1906825 | 41 | −39 | gb105pln | *A. thaliana* hsp81.2 gene. |
| 700612561H1 | g602425 | 51 | −40 | gb105pln | *Mesembryanthemum crystallinum* phosphoglyceromutase (pgm) gene, complete cds. |
| 700614087H1 | g474009 | 61 | −64 | gb105pln | Rice mRNA, partial homologous to ribosomal protein S19 gene. |
| 700615541H1 | g4755 | 13 | −14 | gb105eukp | ORF1 |
| 700613182H1 | g169843 | 63 | −51 | gb105pln | *Saccarum* hybrid phosphoenolpyruvate carboxylase (SCPEPCD1) gene, complete cds. |
| 700615572H1 | g780371 | 46 | −28 | gb105pln | *Oryza sativa* enolase mRNA, complete cds. |
| 700613879H1 | g600115 | 42 | 3 | gb105pln | *Z. mays* apx gene encoding cytosolic ascorbate peroxidase. |
| 700614570H1 | g1314090 | 55 | −5 | gb105eukp | YPR015C; unknown |
| 700613341H1 | g21493 | 18 | −8 | gb105eukp | mpp; mitochondrial processing peptidase |
| 700615588H1 | g1706958 | 12 | 8 | gb105allp | cellulose synthase |
| 700613490H1 | g485376 | 35 | −76 | gb105pln | *Zea mays* alpha-3-tubulin gene, complete cds. |
| 700615289H1 | g347063 | 27 | −28 | gb105pln | *Brassica rapa* ubiquitin/ribosomal protein mRNA, complete cds. |
| 700614844H1 | g1731989 | 26 | 5 | gb105pln | *H. vulgare* gene encoding serine carboxypeptidase II, CP-MII. |
| 700615201H1 | g2244849 | 32 | −1 | gb105eukp | hypothetical protein |
| 700616208H1 | g4821 | 23 | −5 | gb105pln | Yeast (*Saccharomyces cerevisiae*) YL8A gene for ribosomal protein YL8. |
| 700616023H1 | g295935 | 10 | 0 | gb105eukp | ribosomal protein L7 |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700614356H1 | g22483 | 81 | −12 | gb105pln | *Z. mays* RNA for superoxide dismutase Sod4. |
| 700616007H1 | g218241 | 30 | −35 | gb105pln | Rice mRNA for ribosomal protein L3 (T82 gene), partial seguence. |
| 700614755H1 | g468055 | 69 | −70 | gb105pln | *Zea mays* B73 QM protein mRNA, complete cds. |
| 700618493H2 | g2266661 | 33 | −25 | gb105pln | *Hordeum vulgare* mRNA for 14-3-3 protein (Hv1433c). |
| 700618149H1 | g22222 | 75 | −3 | gb105pln | *Z. mays* ZSF4C4 gene for zein. |
| 700614524H1 | g22537 | 76 | −15 | gb105pln | Maize mRNA for zein polypeptide (clone M6). |
| 700616508H1 | g1749748 | 48 | −0 | gb105eukp | similar to *Saccharomyces cerevisiae* eukaryotic initiation factor 4A (EIF-4), SWISS-PROT Accession Number P10081 |
| 700612932H1 | g1262307 | 29 | 6 | gb105eukp | SMD3; Smd3p: Small nuclear ribonucleoprotein D3 homolog |
| 700612589H1 | g1778820 | 41 | −19 | gb105pln | *Oryza sativa* S-adenosyl-L-methionine synthetase (pOS-SAMS2) mRNA, complete cds. |
| 700613848H1 | g1917018 | 50 | 2 | gb105pln | *Zea mays* ribosomal protein S6 RPS6-1 (rps6-1) mRNA, complete cds. |
| 700461103H1 | g20598 | 74 | −65 | gb105pln | *P. miliaceum* mRNA for aspartate aminotransferase (pcAAT2). |
| 700612432H1 | g168694 | 34 | 1 | gb105pln | Maize gamma zein mRNA, partial cds. |
| 700613170H1 | g499011 | 14 | −24 | gb105pln | *S. vulgare* SoAc1 mRNA. |
| 700618504H1 | g387908 | 20 | −37 | gb105pln | *Brassica rapa* S-phase-specific (BIS289) mRNA, complete cds. |
| 700613028H1 | g1054843 | 28 | −10 | gb105eukp | D12 oleate desaturase |
| 700615606H1 | g1051257 | 59 | −72 | gb105pln | *Hordeum vulgare* vacuolar ATPase catalytic subunit mRNA, partial cds. |
| 700615335H1 | g22324 | 48 | −79 | gb105pln | *Z. mays* mRNA for H2B histone (clone cH2B221). |
| 700615647H1 | g303852 | 35 | −61 | gb105pln | Rice mRNA for ribosomal protein L3, complete cds. |
| 700616040H1 | g2832699 | 7 | 4 | gb105allp | receptor serine/threonine kinase-like protein |
| 700616625H1 | g572634 | 22 | −9 | gb105pln | *C. breweri* mRNA for isopentenyl pyrophosphate isomerase. |
| 700615916H1 | g533280 | 33 | −0 | gb105eukp | ATMPK1 |
| 700612647H1 | g1408470 | 16 | 11 | gb105pln | *Arabidopsis thaliana* actin depolymerizing factor 1 (AtADF1) mRNA, complete cds. |
| 700615048H1 | g429006 | 25 | −13 | gb105pln | Rice mRNA for MCM3 (gene name SS300), partial cds. |
| 700618118H1 | g476088 | 13 | −1 | gb105eukp | unknown; 34/67 kD laminin binding protein |
| 700616049H1 | g429013 | 17 | 8 | gb105pln | Rice mRNA for pyrophosphate-fructose 6-phosphate 1-phosphotransferase (gene name SS420), partial cds. |
| 700612559H1 | g168406 | 46 | −65 | gb105pln | *Z. mays* alcohol dehydrogenase (ADH-1 C-m allele) gene, complete cds. |
| 700615990H1 | g1045304 | 50 | −21 | gb105pln | *Zea mays* acetyl-coenzyme A carboxylase mRNA, complete cds. |
| 700613968H1 | g20740 | 39 | −11 | gb105pln | *Pisum sativum* mRNA for P protein, a part of glycine cleavage complex. |
| 700612627H1 | g168661 | 31 | 15 | gb105pln | Maize 15 kDa zein mRNA, clone cZ15A3, complete cds. |
| 700461239H1 | g2104958 | 43 | −30 | gb105pln | *Vicia faba* immunophilin (FKBP12) mRNA, complete cds. |
| 700615092H1 | g535588 | 8 | −2 | gb105eukp | atj; molecular chaperone |
| 700617237H1 | g1166424 | 5 | −2 | gb105eukp | T14G10.5 |
| 700612534H1 | g2316021 | 16 | 3 | gb105pln | *Arabidopsis thaliana* MRP-like ABC transporter mRNA, partial cds. |
| 700614062H1 | g296385 | 23 | −23 | gb105pln | *N. tabacum* mRNA for cytochrome b5. |
| 700614273H1 | g1206016 | 12 | 9 | gb105pln | Yeast (*Schizosaccharomyces pombe*) ribosomal protein L5 gene, complete cds. |
| 700612443H1 | g21800 | 60 | −17 | gb105pln | *T. aestivum* L mRNA for histone H2B. |
| 700615620H1 | g1747294 | 43 | 0 | gb105eukp | vacuolar H+-pyrophosphatase; EC 3.6.1.1 |
| 700617820H1 | g463251 | 35 | −1 | gb105pln | *M. sativa* (Nagyszenasi) mRNA for ribosomal protein RL5. |
| 700617424H1 | g459267 | 20 | −18 | gb105pln | *Z. mays* gene for HMG protein. |
| 700613275H1 | g2271465 | 14 | −9 | gb105eukp | fae1; 3-ketoacyl-CoA synthase. |
| 700616222H1 | g2645166 | 22 | 3 | gb105pln | *Oryza sativa* mRNA, similar to ubiquitin conjugating enzyme. |
| 700615033H1 | g2443401 | 45 | −48 | gb105pln | *Oryza sativa* mRNA for |

TABLE 1-continued

LIST OF INCYTE CLONES DERIVED FROM SATMON022023
COPYRIGHT 1998 INCYTE PHARMACEUTICALS, INC.

| Clone | GenBank | | | Database | Description |
|---|---|---|---|---|---|
| | | | | | orthophosphate dikinase, complete cds. |
| 700615816H1 | g1519250 | 54 | −22 | gb105pln | *Oryza sativa* GF14-c protein mRNA, complete cds. |
| 700613618H1 | g500850 | 55 | −56 | gb105pln | *Zea mays* (clone pAKHSDH1) aspartate kinase-homoserine dehydrogenase mRNA, complete cds. |
| 700612937H1 | g2149050 | 33 | −21 | gb105pln | *Arabidopsis thaliana* small Ras-like GTP-binding protein (Ran3) mRNA, complete cds. |
| 700613947H1 | g22537 | 93 | −38 | gb105pln | Maize mRNA for zein polypeptide (clone M6). |
| 700614727H1 | g786177 | 29 | 17 | gb105pln | Rice DNA for aldolase C-1, complete cds. |
| 700618692H1 | g2459445 | 28 | 6 | gb105eukp | F4P9.18; putative ribonucleoprotein |
| 700617170H1 | g289299 | 15 | 3 | gb105allp | groESL operon |
| 700461113H1 | g1778820 | 57 | −46 | gb105pln | *Oryza sativa* S-adenosyl-L-methionine synthetase (pOS-SAMS2) mRNA, complete cds. |
| 700616490H1 | g1724103 | 34 | −28 | gb105pln | *Mesembryanthemum crystallinum* methionine adenosyltransferase mRNA, complete cds. |
| 700613758H1 | g453188 | 58 | −41 | gb105pln | *Z. mays* acp mRNA for acyl carrier protein. |
| 700616946H1 | g473602 | 60 | −89 | gb105pln | *Zea mays* W-22 histone H2A mRNA, complete cds. |
| 700616901H1 | g2765837 | 23 | −1 | gb105eukp | Nitrilase (EC 3.5.5.1) associated protein 16 kDa; NAP16kDa protein |
| 700613784H1 | g1345504 | 21 | −3 | gb105eukp | ATAF2 |
| 700615668H1 | g22469 | 45 | −61 | gb105pln | Maize mRNA for cytoplasmic ribosomal protein S11. |
| 700615986H1 | g391874 | 20 | 14 | gb105pln | Rice mRNA for 40S subunit ribosomal protein, complete cds. |
| 700613113H1 | g2274983 | 31 | −27 | gb105pln | *Hordeum vulgare* mRNA for expressed sequence tag. |
| 700613966H1 | g2827001 | 62 | −4 | gb105pln | *Triticum aestivum* 70 kDa heat shock protein (TaHSP70d) mRNA, complete cds. |
| 700617438H1 | g397400 | 43 | −40 | gb105pln | *B. rapa* mRNA for S phase specific gene. |
| 700616578H1 | g2160172 | 23 | −10 | gb105eukp | F21M12.20 |
| 700614862H1 | g171042 | 4 | 7 | gb105eukp | unidentified open reading frame I |
| 700612929H1 | g575291 | 27 | −7 | gb105pln | *H. vulgare* mRNA for SNF1-related protein kinase. |
| 700618213H1 | g388052 | 20 | −14 | gb105pln | *Zea mays* alcohol dehydrogenase (Adh1-S) mRNA, complete cds. |
| 700613054H1 | g486248 | 24 | −26 | gb105pln | Yeast (*Saccromyces cerevisiae*) chromosome XI reading frame ORF YKL145w. |
| 700612711H1 | g700371 | 33 | −60 | gb105pln | *Oryza sativa* enolase mRNA, complete cds. |
| 700616610H1 | g168419 | 25 | −7 | gb105pln | Maize (*Z. mays*) aldolase mRNA, complete cds. |
| 700612609H1 | g972916 | 22 | −3 | gb105pln | *Arabidopsis thaliana* IAA7 (IAA7) gene, complete cds. |
| 700614911H1 | g168419 | 57 | −61 | gb105pln | Maize (*Z. mays*) aldolase mRNA, complete cds. |
| 700617996H1 | g556673 | 46 | −5 | gb105eukp | heat-shock protein |
| 700616114H1 | g2150027 | 11 | 0 | gb105eukp | LeME1; NADP-malic enzyme; EC 1.1.1.40 |
| 700618553H1 | g311343 | 14 | −4 | gb105eukp | 128up; GTP-binding protein |
| 700614581H1 | g20598 | 73 | −26 | gb105pln | *P. miliaceum* mRNA for aspartate aminotransferase (pcAAT2). |
| 700616325H1 | g527680 | 19 | −13 | gb105eukp | ribosomal protein S3 |
| 700617533H1 | g16204 | 24 | −9 | gb105pln | *A. thaliana* mRNA for beta-oxoacyl-(acyl carrier protein) reductase. |
| 700618477H2 | g1066282 | 27 | −36 | gb105pln | *Phaseolus vulgaris* 1L-myo-inositol 1-phosphate synthase mRNA, complete cds. |
| 700614592H1 | g2262145 | 16 | 4 | gb105allp | putative Mlo-like protein/T10P11.12A |
| 700614765H1 | g571474 | 30 | 9 | gb105pln | *Chlamydomonas reinhardtii* histone H3 (ch3-III), histone H4 (ch4-III), histone H2B (ch2b-III) and histone H2A (ch2a-III) genes, complete cds. |
| 700614913H1 | g1928960 | 64 | 5 | gb105eukp | pyrroline-5-carboxylate synthetase |
| 700615120H1 | g5300 | 28 | 3 | gb105eukp | KRR1 |
| 700612505H1 | g1019914 | 31 | −21 | gb105pln | *A. thaliana* PUR2 mRNA for phosphoribosylamineglycine ligase. |
| 700614972H1 | g881521 | 6 | 5 | gb105allp | hexokinase 1 |
| 700612694H1 | g456978 | 38 | 4 | gb105eukp | cytochrome b; cytochrome b |
| 700614375H1 | g22324 | 17 | −31 | gb105pln | *Z. mays* mRNA for H2B histone |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | (clone cH2B221). |
| 700614812H1 | g29710 | 36 | −10 | gb105allp | preprocathepsin H (AA −22 to 314) |
| 700617421H1 | g2244829 | 34 | −28 | gb105pln | *Arabidopsis thaliana* DNA chromosome 4, ESSA I contig fragment No. 2. |
| 700614906H1 | g975887 | 45 | −57 | gb105pln | *Mesembryanthemum crystallinum* myo-inositol-1-phosphate synthase mRNA, complete cds. |
| 700615146H1 | g499719 | 30 | 8 | gb105allp | dihydrolipoamide succinyltransferase |
| 700615403H1 | g1403711 | 14 | −6 | gb105eukp | THL-2; thioredoxin-h-like-2 |
| 700613975H1 | g1049306 | 46 | −26 | gb105pln | *Arabidopsis thaliana* actin-2 mRNA, complete cds. |
| 700614833H1 | g22144 | 26 | −48 | gb105pln | Maize anaerobically regulated gene for fructose bisphosphate aldolase (EC 4.1.2.13). |
| 700618693H1 | g602262 | 18 | 7 | gb105allp | proton pump homolog; similar to rat synaptic vesicle proton pump, Swiss-Prot Accession Number P25286 |
| 700613720H1 | g506471 | 18 | −4 | gb105eukp | unnamed protein product |
| 700614847H1 | g2792204 | 13 | 6 | gb105eukp | b2; NBS-LRR type resistance protein |
| 700614805H1 | g1008304 | 9 | −1 | gb105eukp | ASF1 |
| 700615259H1 | g22121 | 31 | −80 | gb105pln | Maize alcohol dehydrogenase 1 gene (Adh1-1F). |
| 700617958H1 | g2765836 | 14 | 7 | gb105pln | *Arabidopsis thaliana* mRNA for nitrilase associated protein NAP16kDa. |
| 700615543H1 | g1469218 | 22 | −31 | gb105pln | *B. oleracea* mRNA (unknown). |
| 700615848H1 | g179283 | 51 | −0 | gb105allp | PM-Scl autoantigen |
| 700616378H1 | g22487 | 62 | −31 | gb105pln | Maize gene for sucrose synthase. |
| 700617238H1 | g22528 | 88 | −45 | gb105pln | *Zea mays* mRNA encoding a zein (clone A20). |
| 700618666H1 | g531395 | 11 | 6 | gb105allp | PC4 |
| 700617988H1 | g602758 | 18 | −15 | gb105eukp | clp-like energy-dependent protease |
| 700613007H1 | g2852449 | 12 | 0 | gb105eukp | APK2b; protein kinase |
| 700617676H1 | g473602 | 32 | 11 | gb105pln | *Zea mays* W-22 histone H2A mRNA, complete cds. |
| 700612618H1 | g2827140 | 42 | −0 | gb105pln | *Arabidopsis thaliana* cellulose synthase catalytic subunit (Ath-A) mRNA, complete cds. |
| 700614288H1 | g432606 | 26 | 17 | gb105pln | ric1 = ras-related GTP binding protein possessing GTPase activity [*Oryza sativa* = rice, Yamahoushi, callus, mRNA, 955 nt]. |
| 700614923H1 | g558364 | 63 | −90 | gb105pln | *Z. mays* mRNA for ADP-glucose pyrophosphorylase. |
| 700615322H1 | g168679 | 23 | −22 | gb105pln | Maize 19 kDa zein mRNA, clone cZ19C2, complete cds. |
| 700617984H1 | g1888463 | 12 | 6 | gb105allp | 14-3-3 protein |
| 700617810H1 | g473602 | 53 | −103 | gb105pln | *Zea mays* W-22 histone H2A mRNA, complete cds. |
| 700613014H1 | g22119 | 28 | −7 | gb105pln | Maize Adh1-F mRNA for alcohol dehydrogenase. |
| 700617001H1 | g1755006 | 14 | −4 | gb105pln | *Triticum aestivum* calmodulin TaCaM3-3 mRNA, complete cds. |
| 700618266H1 | g2160692 | 7 | 6 | gb105eukp | AtB 'beta; B' regulatory subunit of PP2A |
| 700616540H1 | g168486 | 54 | −46 | gb105pln | Maize glutathione S-transferase gene (GST-I), exon 1. |
| 700613874H1 | g506860 | 58 | 2 | gb105eukp | HRSec61 |
| 700613046H1 | g1395190 | 18 | −12 | gb105pln | *Spinacia oleracea* L. mRNA for 26S proteasome ATPase subunit, complete cds. |
| 700614014H1 | g535587 | 35 | −34 | gb105pln | *Arabidopsis thaliana* chaperone protein (atj) mRNA, complete cds. |
| 700617238H1 | g168677 | 85 | −43 | gb105pln | Maize 19 kDa zein mRNA, clone cZ19C1, complete cds. |
| 700617018H1 | g474407 | 53 | −87 | gb105pln | *Z. mais* (KW5330) mRNA for nonphosphorylating glyceraldehyde-3-phosphate dehydrogenase. |
| 700614742H1 | g951332 | 39 | −23 | gb105allp | unknown |
| 700615070H1 | g1008542 | 12 | 6 | gb105allp | ubiquitin isopeptidase T |
| 700613365H1 | g927024 | 13 | −1 | gb105pln | *Cucumis sativus* SPF1-like DNA-binding protein mRNA, complete cds. |
| 700613213H1 | g1752953 | 6 | 6 | gb105allp | F59E10.3 |
| 700614935H1 | g288583 | 15 | 15 | gb105pln | *S. cereale* L12-2 mRNA for ribosomal protein L12. |
| 700615183H1 | g2570506 | 35 | 8 | gb105pln | *Oryza sativa* ribosomal protein mRNA, complete cds. |
| 700615605H1 | g19101 | 30 | −24 | gb105pln | *H. vulgare* mRNA for ribosomal protein L17-1. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700618591H1 | g409070 | 7 | 8 | gb105allp | HBp15/L22 |
| 700617324H1 | g22445 | 48 | 8 | gb105pln | *Zea mays* ZMPMS1 gene for 19 kDa zein protein. |
| 700616207H1 | g2769566 | 12 | −4 | gb105eukp | chloroplast thylakoidal processing peptidase |
| 700613274H1 | g2668737 | 41 | 11 | gb105pln | *Zea mays* translation initiation factor 5A (TIF5A) mRNA, complete cds. |
| 700618688H1 | g2245038 | 7 | 6 | gb105allp | hypothetical protein |
| 700616785H1 | g166823 | 86 | −0 | gb105eukp | dephosphorylation of Ser-P and Thr-P residues; protein phosphatase |
| 700613807H1 | g168698 | 63 | −72 | gb105pln | *Z. mays* zein mRNA, complete cds. |
| 700612690H1 | g457399 | 48 | −36 | gb105pln | *Arabidopsis thaliana* mRNA for MAP kinase, complete cds. |
| 700612555H1 | g1167857 | 68 | −56 | gb105pln | *S. cereale* cv. Petkus 'Halo' encoding cpn60. |
| 700616952H1 | g21794 | 33 | −16 | gb105pln | Wheat histone H4 gene. |
| 700613966H1 | g498772 | 72 | −11 | gb105pln | *Z. mays* (cv DH5xDH7) hsp70-4 mRNA for heat shock protein 70. |
| 700613077H1 | g1518539 | 23 | −44 | gb105pln | *Glycine max* UDP-glucose dehydrogenase mRNA, complete cds. |
| 700614676H1 | g2702284 | 24 | −13 | gb105eukp | T21L14.12; Argonaute (AGO1)-like protein |
| 700616234H1 | g2326402 | 8 | 6 | gb105eukp | 87B1.c |
| 700618106H1 | g1162980 | 9 | −9 | gb105eukp | ribulose-5-phosphate 3-epimerase; EC 5.1.3.1 |
| 700616186H1 | g871992 | 8 | −1 | gb105eukp | TGG2; thioglucosidase; EC 3.2.3.1 |
| 700615060H1 | g1184773 | 25 | −48 | gb105pln | *Zea mays* glyceraldehyde-3-phosphate dehydrogenase GAPC3 (gpc3) mRNA, complete cds. |
| 700612819H1 | g1561642 | 45 | 1 | gb105allp | plectin |
| 700613413H1 | g1184771 | 26 | −63 | gb105pln | *Zea mays* glyceraldehyde-3-phosphate dehydrogenase GAPC2 (gpc2) mRNA, complete cds. |
| 700616976H1 | g260041 | 48 | −59 | gb105pln | Sh2 = shrunken-2 locus [maize, mRNA Partial, 1867 nt]. |
| 700613340H1 | g2529429 | 13 | −13 | gb105eukp | fet5+; ATP(GTP)-binding protein Fet5 |
| 700614937H1 | g429015 | 59 | −24 | gb105pln | Rice mRNA for ribosomal protein (gene name SS498), partial cds. |
| 700615910H1 | g22287 | 8 | 3 | gb105allp | vicilin-like embryo storage protein |
| 700617494H1 | g1841551 | 8 | 6 | gb105allp | unknown |
| 700617429H1 | g168505 | 41 | −55 | gb105pln | *Zea mays* histone H3 gene, complete cds. |
| 700615307H1 | g1628443 | 22 | −25 | gb105eukp | ORF |
| 700616345H1 | g473985 | 45 | −34 | gb105pln | Rice mRNA, partial homologous to high mobility group protein gene. |
| 700617339H1 | g170746 | 48 | −60 | gb105pln | Wheat histone H4 THO91 gene, complete cds. |
| 700614226H1 | g1054845 | 13 | −19 | gb105eukp | END13 |
| 700613863H1 | g984964 | 18 | −7 | gb105eukp | SIK1; suppressor of toxicity of GAL4-IKB; Sik1p |
| 700613827H1 | g1749464 | 70 | 2 | gb105eukp | similar to *Saccharomyces cerevisiae* putative NDP-hexose pyrophosphopylase, SWISS-PROT Accession Number P41940 |
| 700615808H1 | g2293567 | 38 | −3 | gb105pln | *Oryza sativa* HvB12D homolog mRNA, complete cds. |
| 700615487H1 | g168685 | 34 | −50 | gb105pln | Maize 22 kd (Mw = 26.99 kd) zein protein 3, mRNA. |
| 700616936H1 | g1125690 | 22 | −9 | gb105pln | *S. tuberosum* mRNA for DnaJ protein. |
| 700613271H1 | g847833 | 24 | −11 | gb105pln | *Zea mays* 10 kDa zein gene, complete cds. |
| 700614823H1 | g786316 | 19 | 1 | gb105eukp | SMX3; Smx3p: Sm or Sm-like snRNP protein |
| 700617237H1 | g2104445 | 8 | 3 | gb105eukp | SPAC57A7.10c; unknown |
| 700615543H1 | g2584827 | 14 | −9 | gb105pln | Sequence of BAC F12F1 from *Arabidopsis thaliana* chromosome 1, complete sequence. |
| 700613722H1 | g2558668 | 11 | −0 | gb105allp | eukaryotic translation initiation factor |
| 700616112H1 | g168494 | 29 | −64 | gb105pln | Maize (*Zea mays*) histone H3 gene (H3C2), complete cds. |
| 700617263H1 | g1045614 | 18 | 6 | gb105allp | beta-ketoacyl-CoA synthase |
| 700613187H1 | g2244813 | 11 | −0 | gb105eukp | acylaminoacyl-peptidase homolog |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700612905H1 | g473978 | 33 | −6 | gb105pln | Rice mRNA, partial homologous to GAmRNA (cloneF). |
| 700615558H1 | g606816 | 30 | −2 | gb105pln | *Oryza sativa* chloroplast carbonic anhydrase mRNA, complete cds. |
| 700461283H1 | g22516 | 63 | −41 | gb105pln | Maize Zc2 gene for zein Zc2 (28 kD glutelin-2). |
| 700617788H1 | g168512 | 59 | −63 | gb105pln | Maize major protein (L3) mRNA from the surface of lipid bodies, 3' end. |
| 700616412H1 | g536895 | 18 | −38 | gb105pln | Wheat mRNA for protein H2A, complete cds, clone wcH2A-10. |
| 700614830H1 | g2454181 | 31 | −12 | gb105pln | *Arabidopsis thaliana* pyruvate dehydrogenase E1 alpha subunit mRNA, nuclear gene encoding plastid protein, complete cds. |
| 700461111H1 | g600855 | 12 | 2 | gb105eukp | bZIP protein |
| 700618491H2 | g21271 | 21 | −6 | gb105pln | *S. oleracea* mRNA for phosphoglycerate kinase (chloroplast isoenzyme). |
| 700618513H1 | g217961 | 59 | −72 | gb105pln | Corn cystatin I mRNA, complete cds. |
| 700461183H1 | g1037129 | 89 | −76 | gb105pln | (gamma-zeinA) = opaque2 modifier {5' region} [*Zea mays* = maize, Tuxpeno CMS 450, mRNA Partial, 1889 nt]. |
| 700615968H1 | g1899174 | 32 | 4 | gb105pln | *Cucurbita pepo* calcium-dependent calmodulin-independent protein kinase CDPK (cpCPK1) mRNA, complete cds. |
| 700617463H1 | gs31171 | 15 | 1 | gb105allp | Csa-19 |
| 700461156H1 | g170746 | 63 | −47 | gb105pln | Wheat histone H4 TH091 gene, complete cds. |
| 700614160H1 | g31958 | 10 | 6 | gb105allp | glutaminyl-tRNA synthetase |
| 700617787H1 | g2191135 | 8 | 8 | gb105eukp | A_IG002N01.14 |
| 700614129H1 | g20254 | 53 | −12 | gb105pln | *Oryza sativa* H3 histone pseudogene H3R-12. |
| 700618665H1 | g2358139 | 13 | −12 | gb105pln | *Arabidopsis thaliana* chromosome 1 YAC yUP8H12 complete sequence. |
| 700615608H1 | g2642152 | 18 | −4 | gb105pln | *Arabidopsis thaliana* chromosome II BAC T5I7 genomic sequence, complete sequence. |
| 700617529H1 | g1814078 | 7 | 5 | gb105allp | 2-oxoglutarate carrier |
| 700615353H1 | g2293565 | 47 | −50 | gb105pln | *Oryza sativa* ADP-ribosylation factor 1 (Os-ARF1) mRNA, complete cds. |
| 700614350H1 | g22237 | 91 | −38 | gb105pln | Maize mRNA for cytosolic GAPDH (GapC) glyceraldehyde-3-phosphate dehydrogenase. |
| 700613423H1 | g22681 | 46 | −45 | gb105pln | *L. usitatissimum* mRNA for Stearoyl-(acyl-carrier-protein)desaturase. |
| 700461122H1 | g168665 | 53 | −59 | gb105pln | Maize 16-kDa zein-2 mRNA, complete cds. |
| 700616468H1 | g1912310 | 21 | 3 | gb105eukp | GapC; glycolytic glyceraldehyde-3-phosphate dehydrogenase; EC 1.2.1.12 |
| 700615510H1 | g473985 | 39 | −26 | gb105pln | Rice mRNA, partial homologous to high mobility group protein gene. |
| 700461128H1 | g469147 | 22 | −6 | gb105pln | *H. vulgare* mRNA for alanine aminotransferase. |
| 700618038H1 | g439273 | 31 | 3 | gb105eukp | blt101; not known; 54 amino acids |
| 700612528H1 | g13462 | 57 | −24 | gb105allp | ATPase subunit 6 |
| 700618652H1 | g21598 | 17 | 4 | gb105pln | *S. tuberosum* mRNA for UDP-glucose pyrophosphorylase. |
| 700613073H1 | g296385 | 16 | 1 | gb105pln | *N. tabacum* mRNA for cytochrome b5. |
| 700612570H1 | g1256258 | 23 | −5 | gb105pln | *Spinacia oleracea* voltage-dependent anion channel protein (SVDAC1) mRNA, complete cds. |
| 700615053H1 | g474007 | 25 | 10 | gb105pln | Rice mRNA, partial homologous to ribosomal protein S12 gene. |
| 700616620H1 | g2828183 | 31 | 10 | gb105pln | *Arabidopsis thaliana* genomic DNA, chromosome 5, P1 clone: MPL12, complete sequence. |
| 700613418H1 | g2258467 | 30 | 4 | gb105allp | succinyl-CoA synthetase alpha subunit |
| 700612822H1 | g899607 | 67 | −89 | gb105pln | *Zea mays* polyubiquitin (MubC5) mRNA, complete cds. |
| 700461137H1 | g166970 | 13 | −11 | gb105pln | *Hordeum vulgare* acyl carrier protein III (Ac13) gene, complete cds. |
| 700617479H1 | g1183936 | 13 | 2 | gb105pln | *P. sativum* 5S rRNA gene. |
| 700613373H1 | g168498 | 28 | 15 | gb105pln | Corn histone H4 (H4C13) gene, complete cds. |
| 700617625H1 | g971699 | 8 | −1 | gb105allp | ribosomal protein S7 |
| 700615655H1 | g2335089 | 12 | 11 | gb105pln | *Arabidopsis thaliana* chromosome II BAC T11A07 genomic sequence, complete sequence. |
| 700616350H1 | g453188 | 49 | −37 | gb105pln | *Z. mays* acp mRNA for acyl |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | carrier protein. |
| 700612839H1 | g166966 | 17 | −2 | gb105pln | *Hordeum vulgare* acyl carrier protein I (Acl1) gene, complete cds. |
| 700614366H1 | g168527 | 68 | −19 | gb105pln | Maize NADP-dependent malic enzyme (Me1) mRNA, complete cds. |
| 700616364H1 | g22322 | 17 | −46 | gb105pln | *Z. mays* mRNA for H2B histone (clone cH2B214). |
| 700613936H1 | g2570118 | 20 | 7 | gb105pln | *S. latifolia* mRNA, clone CCLS 17. |
| 700614367H1 | g1419369 | 70 | −1 | gb105pln | *Z. mays* ZmABP3 mRNA for actin depolymerizing factor. |
| 700613162H1 | g257040 | 28 | 14 | gb105pln | hydroxyproline-rich glycoprotein [maize, Genomic, 1703 nt]. |
| 700612529H1 | g4790 | 12 | −2 | gb105eukp | YKL253 |
| 700614046H1 | g168500 | 48 | −59 | gb105pln | Maize (*Zea mays*) histone H4 gene (H4C14), complete cds. |
| 700614727H1 | g790969 | 40 | 14 | gb105pln | Rice mRNA for aldolase C-1, complete cds. |
| 700617048H1 | g700371 | 24 | −13 | gb105pln | *Oryza sativa* enolase mRNA, complete cds. |
| 700616476H1 | g499655 | 8 | 4 | gb105eukp | gamma-thionin homolog |
| 700616006H1 | g2244878 | 8 | 5 | gb105eukp | hypothetical protein; Author-given protein sequence is in conflict with the conceptual translation |
| 700615847H1 | g488712 | 16 | −8 | gb105eukp | cr7; ubiquinol--cytochrome c reductase; EC 1.10.2.2 |
| 700612607H1 | g415314 | 32 | −41 | gb105pln | Rice mRNA for NADP dependent malic enzyme, complete cds. |
| 700618172H1 | g2826884 | 9 | 5 | gb105eukp | TFIIA-L; transcription factor IIA large subunit |
| 700617463H1 | g1217609 | 18 | −3 | gb105allp | Csa-19 homologue |
| 700613944H1 | g2832667 | 18 | 16 | gb105pln | *Arabidopsis thaliana* DNA chromosome 4, BAC clone T10I14 (ESSAII project). |
| 700613744H1 | g1256434 | 11 | 6 | gb105allp | APC-binding protein EB1 homolog |
| 700615183H1 | g463252 | 39 | 8 | gb105allp | RL5 ribosomal protein |
| 700614977H1 | g1066282 | 16 | 5 | gb105pln | *Phaseolus vulgaris* 1L-myo-inositol 1-phosphate synthase mRNA, complete cds. |
| 700616055H1 | g790640 | 14 | 16 | gb105pln | *Hordeum vulgare* gamma-thionin (HTH3) mRNA, complete cds |
| 700617125H1 | g1930069 | 43 | −21 | gb105pln | *Oryza sativa* proteasome alpha subunit mRNA, complete cds. |
| 700612912H1 | g168679 | 91 | −31 | gb105pln | Maize 19 kDa zein mRNA, clone cZ19C2, complete cds. |
| 700613633H1 | g1420521 | 18 | 5 | gb105eukp | ORF YOR226c |
| 700612857H1 | g166858 | 33 | 6 | gb105allp | ribosomal protein |
| 700612549H1 | g450548 | 69 | −60 | gb105pln | *O. sativa* (pRSAM-1) gene for S-adenosyl methionine synthetase. |
| 700615374H1 | g2197085 | 55 | 6 | gb105allp | ORF2-like protein |
| 700616134H1 | g1419370 | 11 | 4 | gb105eukp | ZmABP3; depolymerizes polymerized actin; binds both G and F actin; actin depolymerizing factor |
| 700615871H1 | g168673 | 52 | −32 | gb105pln | Maize 19 kDa zein mRNA, clone cZ19B1, complete cds. |
| 700618172H1 | g1429226 | 9 | 4 | gb105eukp | TFIIA |
| 700617848H1 | g1107488 | 12 | 10 | gb105pln | *A. thaliana* mRNA for 60S ribosomal protein L9. |
| 700614060H1 | g2251187 | 23 | −9 | gb105allp | uridylate kinase |
| 700614992H1 | g2654209 | 43 | −51 | gb105pln | *Spinacia oleracea* heat shock 70 protein (HSC70-10) mRNA, nuclear gene encoding mitochondrial protein, complete cds. |
| 700615919H1 | g1129083 | 29 | 1 | gb105pln | Wheat mRNA for protein H2A, complete cds, clone wcH2A-2. |
| 700617167H1 | g535019 | 66 | −27 | gb105pln | *Z. mays* Zd1 tandem genes for zein Zd1 (19 kDa Zein). |
| 700615894H1 | g1769965 | 21 | −2 | gb105pln | *B. napus* mRNA for enoyl reductase. |
| 700461195H1 | g1098975 | 17 | 4 | gb105eukp | IMP2; myo-inositol monophosphatase 2 |
| 700614379H1 | g1498052 | 69 | −71 | gb105pln | *Zea mays* ribosomal protein S8 mRNA, complete cds. |
| 700617650H1 | g1370335 | 12 | 14 | gb105pln | Yeast (*Saccharomyces cerevisiae*) chromosome XVI reading frame ORF YPL158c. |
| 700614534H1 | g170919 | 39 | −19 | gb105pln | Yeast (*Candida maltose*) ribosomal protein L41 (LEL41) gene, complete cds. |
| 700616939H1 | g168677 | 54 | −86 | gb105pln | Maize 19 kDa zein mRNA, clone cZ19C1, complete cds. |
| 700614277H1 | g16072 | 50 | 3 | gb105pln | *A. mediterranea* zein gene. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700613170H1 | g20321 | 15 | −24 | gb105pln | *Oryza sativa* RAc1 mRNA for actin. |
| 700613027H1 | g2584787 | 10 | 5 | gb105allp | Aminopeptidase P-like |
| 700615464H1 | g2224750 | 32 | −44 | gb105pln | *Arabidopsis thaliana* mRNA for ribosomal protein S6. |
| 700612689H1 | g402551 | 21 | −24 | gb105pln | *A. thaliana* gene for acetohydroxy acid isomoreoreductase. |
| 700614556H1 | g1532162 | 11 | 15 | gb105pln | *Arabidopsis thaliana* AT.I.24-1, AT.I.24-2, AT.I.24-3, AT.I.24-4, AT.I.24-5, AT.I.24-6, AT.I.24-9 and AT.I.24-14 genes, partial cds, AT.I.24-7, ascorbate peroxidase (ATHAPX1), EF-1alpha-A1, -A2 and -A3 (EF-1alpha) and AT.I.24-13 genes, complete cds. |
| 700617708H1 | g1675393 | 35 | −27 | gb105pln | *Oryza sativa* class III ADH enzyme (AdhIII) gene, complete cds. |
| 700612871H1 | g758354 | 69 | −99 | gb105pln | *Z. mays* mRNA for plasma membrane H+ ATPase. |
| 700615246H1 | g1053056 | 25 | −39 | gb105pln | *Triticum aestivum* histone H3 gene, partial cds, clone W1. |
| 700617159H1 | g7353 | 16 | 5 | gb105allp | rp1024 protein |
| 700615349H1 | g441475 | 13 | −8 | gb105eukp | SPT14; trans-acting transcription factor |
| 700616313H1 | g1149569 | 56 | −33 | gb105eukp | athb-8; HD-zip |
| 700614474H1 | g2224914 | 36 | −28 | gb105pln | *Oryza sativa* beta-expansin mRNA, complete cds. |
| 700616224H1 | g1272408 | 34 | 2 | gb105eukp | FKBP15-2, immunophilin |
| 700618607H1 | g2073374 | 38 | −57 | gb105pln | Rice mRNA for farnesyl pyrophosphate synthase, complete cds. |
| 700614970H1 | g2829901 | 12 | 7 | gb105eukp | T26J12.12; putative 10 kd chaperonin |
| 700614067H1 | g515376 | 31 | 11 | gb105pln | *L. temulentum* mRNA for histone H4. |
| 700614755H1 | g575354 | 61 | −63 | gb105pln | *O. sativa* SC34 mRNA for tumor suppressor. |
| 700616962H1 | g1006830 | 14 | −16 | gb105pln | *Gossypium hirsutum* acyl-CoA-binding protein mRNA, complete cds. |
| 700616273H1 | g1532072 | 41 | −13 | gb105pln | *Z. mays* mRNA for S-adenosylmethionine decarboxylase. |
| 700615191H1 | g971929 | 29 | 6 | gb105allp | 60S ribosomal protein L17 |
| 700616089H1 | g857577 | 17 | 2 | gb105pln | *Populus tremuloides* caffeoyl-CoA 3-O-methyltransferase mRNA, complete cds. |
| 700618227H1 | g1272684 | 30 | −40 | gb105pln | *Z. mays* mRNA for acetyl CoA carboxylase (partial). |
| 700614930H1 | g872079 | 5 | 5 | gb105eukp | M28.5 |
| 700617007H1 | g452360 | 23 | −20 | gb105pln | *V. faba* mRNA for guanine nucleotide regulatory protein (807bp). |
| 700613996H1 | g53437 | 92 | −11 | gb105allp | protein kinase |
| 700613674H1 | g960291 | 9 | 1 | gb105eukp | anthranilate synthase alpha subunit |
| 70065S070H1 | g1122278 | 11 | 6 | gb105allp | de-ubiquitinase |
| 700615264H1 | g1045304 | 31 | −78 | gb105pln | *Zea mays* acetyl-coenzyme A carboxylase mRNA, complete cds. |
| 700613711H1 | g2257755 | 9 | 5 | gb105pln | *Zea mays* nucleolar histone deacetylase HD2-p39 mRNA, complete cds. |
| 700612351H1 | g1209700 | 94 | −26 | gb105pln | *Zea mays* ribosomal protein L12 mRNA, complete cds. |
| 700612382H1 | g2191149 | 31 | 7 | gb105allp | Similar to protein kinase |
| 700617079H1 | g1420537 | 21 | −15 | gb105eukp | RPL37B |
| 700613366H1 | g168481 | 9 | −0 | gb105eukp | globulin precursor |
| 700461126H1 | g290275 | 57 | −34 | gb105eukp | M(3)95A; multifunctional activity and location; ribosomal protein S3/AP endonuclease DNA repair protein |
| 700618124H1 | g453188 | 13 | 16 | gb105pln | *Z. mays* acp mRNA for acyl carrier protein. |
| 700612774H1 | g639683 | 37 | −32 | gb105pln | Rice mRNA for phosphoglucose isomerase (Pgi-a), complete cds. |
| 700615773H1 | g1658314 | 36 | 9 | gb105pln | *O. sativa* osr40g3 gene. |
| 700612567H1 | g22320 | 38 | −69 | gb105pln | Maize H1 mRNA for H1 histone. |
| 700614743H1 | g886470 | 41 | −39 | gb105pln | *C. roseus* MetE mRNA for methionine synthase. |
| 700615375H1 | g1419369 | 11 | 16 | gb105pln | *Z. mays* ZmABP3 mRNA for actin depolymerizing factor. |
| 700615647H1 | g429015 | 44 | −50 | gb105pln | Rice mRNA for ribosomal protein (gene name SS498), partial cds. |
| 700615672H1 | g168663 | 96 | −107 | gb105pln | Maize sulfur-rich zein protein of Mr 15,000, complete cds. |
| 700612455H1 | g473602 | 94 | −18 | gb105pln | *Zea mays* W-22 histone H2A mRNA, complete cds. |
| 700612358H1 | g2624219 | 25 | −6 | gb105pln | *M. acuminata* mRNA; clone pBAN |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | UD75. |
| 700612855H1 | g606418 | 18 | −55 | gb105pln | *Oryza Sativa* (clone RGAE8) G protein alpha subunit (RGA1) gene, complete cds. |
| 700618396H1 | g22528 | 36 | −67 | gb105pln | *Zea mays* mRNA encoding a zein (clone A20). |
| 700615075H1 | g2293565 | 52 | −37 | gb105pln | *Oryza sativa* ADP-ribosylation factor 1 (Os-ARF1) mRNA, complete cds. |
| 700614725H1 | g1617274 | 14 | −4 | gb105eukp | AMP-binding protein |
| 700614795H1 | g2160183 | 67 | 8 | gb105allp | Identical to *A. thaliana* U2 SnRNP-specific A' protein (gb\|X69137). ESTs gb\|ATTS0705, gb\|ATTS0339 come from this gene. |
| 700614805H1 | g2814985 | 8 | 3 | gb105eukp | C03D6.5 |
| 700614868H1 | g168498 | 30 | 15 | gb105pln | Corn histone H4 (H4C13) gene, complete cds. |
| 700616517H1 | g1519248 | 31 | −11 | gb105pln | *Oryza sativa* GF14-b protein mRNA, complete cds. |
| 700614765H1 | g168500 | 29 | 10 | gb105pln | Maize (*Zea mays*) histone H4 gene (H4C14), complete cds. |
| 700613376H1 | g2570506 | 33 | −19 | gb105pln | *Oryza sativa* ribosomal protein mRNA, complete cds. |
| 700612742H1 | g464137 | 13 | 5 | gb105pln | *Arabidopsis thaliana* mRNA for ATMPK2, complete cds. |
| 700616476H1 | g1620753 | 8 | 4 | gb105allp | proteinase inhibitor |
| 700612459H1 | g1568634 | 40 | −24 | gb105pln | *Arabidopsis thaliana* AtKAP alpha mRNA, complete cds. |
| 700614228H1 | g1212995 | 49 | −62 | gb105pln | *H. vulgare* mRNA for UDP-glucose pyrophosphorylase. |
| 700615157H1 | g973312 | 27 | 12 | gb105pln | *Arabidopsis thaliana* myo-inositol 1-phosphate synthase isozyme-2 mRNA, complete cds. |
| 700618411H2 | g1276652 | 14 | 10 | gb105pln | *Porphyra purpurea* chloroplast genome, complete sequence. |
| 700613919H1 | g2828176 | 30 | −88 | gb105pln | *Zea mays* PM063A alcohol dehydrogenase 1 (adh1) gene, partial cds. |
| 700615109H1 | g218229 | 32 | 15 | gb105pln | Rice mRNA for Aspartate aminotransferase. |
| 700618250H1 | g2827626 | 25 | −3 | gb105eukp | F10N7.80; putative protein |
| 700616211H1 | g340933 | 44 | −55 | gb105pln | *Zea mays* 10-kDa zein gene, complete cds. |
| 700617038H1 | g168671 | 45 | −89 | gb105pln | Maize 19 kd zein protein, mRNA (incomplete). |
| 700612494H1 | g429148 | 36 | 14 | gb105pln | *Z. mays* pep gene for (C3 type) phosphoenodopyruvate carboxylase. |
| 700612645H1 | g2264314 | 21 | 11 | gb105pln | *Arabidopsis thaliana* genomic DNA, chromosome 5, P1 clone. MQK4, complete sequence. |
| 700615930H1 | g1332439 | 21 | 7 | gb105eukp | APX; ascorbate peroxidase; EC 1.11.1.11 |
| 700618677H1 | g1546918 | 84 | −14 | gb105pln | *Z. mays* mRNA for translation initiation factor 5A. |
| 700616978H1 | g22633 | 13 | −1 | gb105eukp | fructose-bisphosphate aldolase; EC 4.1.2.13 |
| 700613321H1 | g18903 | 29 | −70 | gb105pln | Barley mRNA for aspartic proteinase. |
| 700612526H1 | g473205 | 30 | −25 | gb105pln | *E. gunnii* mRNA for mitochondrial malate dehydrogenase. |
| 700615842H1 | g2213602 | 42 | −3 | gb105eukp | T7N9.22 |
| 700461282H1 | g1737491 | 31 | −32 | gb105pln | *Triticum aestivum* poly(A)-binding protein (wheatpab) mRNA, complete cds. |
| 700615649H1 | g21470 | 20 | −2 | gb105pln | Potato gene for granule-bound starch synthase. |
| 700612525H1 | g22272 | 73 | −78 | gb105pln | Maize mRNA for enolase (2-phospho-D-glycerate hydrolase). |
| 700616777H1 | g498772 | 63 | −30 | gb105pln | *Z. mays* (cv DH5xDH7) hsp70-4 mRNA for heat shock protein 70. |
| 700612748H1 | g993037 | 22 | −13 | gb105eukp | cct-4; CCT-4 |
| 700617001H1 | g167007 | 13 | −4 | gb105pln | Barley cam gene encoding calmodulin, complete cds. |
| 700612646H1 | g218129 | 38 | −7 | gb105pln | Rice mRNA for F1-ATPase (480 gene), partial sequence. |
| 700612315H1 | g2459429 | 34 | −15 | gb105eukp | F4P9.24 |
| 700614715H1 | g1572681 | 28 | 4 | gb105eukp | oligopeptidase B |
| 700615042H1 | g1710151 | 30 | −9 | gb105eukp | proline iminopeptidase |
| 700617031H1 | g747848 | 44 | −59 | gb105pln | *H. vulgare* (Gerbe1) mRNA for adenosine triphosphatase. |
| 700614592H1 | g2262146 | 16 | 4 | gb105allp | predicted Mlo-like protein/T10P11.12B |
| 700615434H1 | g1045304 | 43 | −15 | gb105pln | *Zea mays* acetyl-coenzyme A |

TABLE 1-continued

LIST OF INCYTE CLONES DERIVED FROM SATMON022023
COPYRIGHT 1998 INCYTE PHARMACEUTICALS, INC.

| | | | | |
|---|---|---|---|---|
| | | | | carboxylase mRNA, complete cds. |
| 700616813H1 | g2570118 | 16 | 11 | gb105pln | *S. latifolia* mRNA, clone CCLS 17. |
| 700614356H1 | g22484 | 83 | −13 | gb105pln | *Z. mays* RNA for superoxide dismutase Sod4A. |
| 700616239H1 | g1835728 | 30 | −23 | gb105pln | *Oryza sativa* ribosomal protein mRNA, complete cds. |
| 700614727H1 | g168419 | 69 | 8 | gb105pln | Maize (*Z. mays*) aldolase mRNA, complete cds. |
| 700612955H1 | g558364 | 100 | −11 | gb105pln | *Z. mays* mRNA for ADP-glucose pyrophosphorylase. |
| 700617037H1 | g472343 | 34 | −4 | gb105eukp | <beta>Cop |
| 700613319H1 | g1195610 | 6 | 5 | gb105allp | protein synthesis initiation factor 4A-II homolog = EIF4A2 [human, fetal lung tissue, Peptide, 407 aa] |
| 7000612746H1 | g168677 | 52 | −70 | gb105pln | Maize 19 kDa zein mRNA, clone cZ19C1, complete cds. |
| 700617958H1 | g2765837 | 19 | 0 | gb105allp | NAP16kDa protein |
| 700617229H1 | g168683 | 68 | −35 | gb105pln | Maize 22 kd (Mw = 26.53 kd) zein protein 1, mRNA. |
| 700614232H1 | g976256 | 33 | −12 | gb105pln | Rice mRNA stearyl-ACP desaturase, complete cds. |
| 700616094H1 | g2648032 | 16 | −13 | gb105eukp | alpha-glucosidase; EC 3.2.1.20 |
| 700618496H2 | g1938235 | 18 | 3 | gb105pln | *R. communis* mRNA for acyl-CoA-binding protein. |
| 700612903H1 | g1314948 | 34 | −24 | gb105pln | *O. sativa* mRNA for archain/delta-COP. |
| 700616322H1 | g1272408 | 12 | −1 | gb105eukp | FKBP15-2; immunophilin |
| 700617151H1 | g218099 | 51 | −6 | gb105pln | Rice mRNA for ribosomal protein S12 (320 gene), partial sequence. |
| 700615142H1 | g1184775 | 63 | −94 | gb105pln | *Zea mays* glyceraldehyde-3-phosphate dehydrogenase GAPC4 (gpc4) mRNA, complete cds. |
| 700616043H1 | g474009 | 68 | −67 | gb105pln | Rice mRNA, partial homologous to ribosomal protein S19 gene. |
| 700616714H1 | g168690 | 35 | −27 | gb105pln | Maize zein mRNA, complete cds, clone ZG124. |
| 700615806H1 | g2832242 | 77 | −38 | gb105pln | *Zea mays* 22-kDa alpha zein gene cluster, complete sequence. |
| 700616371H1 | g1323371 | 17 | −2 | gb105eukp | ETF-BETA |
| 700616892H1 | g387908 | 33 | 11 | gb105pln | *Brassica rapa* S-phase-specific (BIS289) mRNA, complete cds. |
| 700613038H1 | g18292 | 10 | −7 | gb105eukp | alpha-galactosidase preproprotein |
| 700612459H1 | g2154716 | 33 | −17 | gb105pln | *A. thaliana* mRNA for Kap alpha protein. |
| 700461219H1 | g577824 | 88 | −72 | gb105pln | *Z. mays* gene for H2B histone (gH2B3). |
| 700612311H1 | g2245027 | 32 | −1 | gb105eukp | ribosomal protein |
| 700612336H1 | g218082 | 41 | 6 | gb105pln | Rice mRNA for initiation factor eIF-4D (225 gene), partial sequence. |
| 700615486H1 | g687244 | 89 | −1 | gb105pln | *Zea mays* oil body protein 16 kDa oleosin (ole16) gene, complete cds. |
| 700616839H1 | g22524 | 66 | −55 | gb105pln | *Zea mays* mRNA encoding a zein (clone ZG31A). |
| 700612970H1 | g17361 | 6 | 2 | gb105allp | 40S ribosomal protein S26 |
| 700617988H1 | g780224 | 8 | 1 | gb105eukp | ZK970.2 |
| 700616030H1 | g2564051 | 22 | −23 | gb105pln | *Arabidopsis thaliana* genomic DNA, chromosome 5, P1 clone: MWD9, complete sequence. |
| 700613787H1 | g2264309 | 12 | 16 | gb105pln | *Arabidopsis thaliana* genomic DNA, chromosome 5, P1 clone: MJJ3, complete sequence. |
| 700612326H1 | g2760542 | 28 | −9 | gb105pln | *Brassica oleracea* mRNA for L-galactono-1, 4-lactone dehydrogenase. |
| 700617517H1 | g391647 | 28 | 5 | gb105allp | ribosomal protein L5 |
| 700617442H1 | g425798 | 22 | −0 | gb105pln | Rice mRNA for ribosomal protein L17a (gene name AD484), partial cds. |
| 700612360H1 | g19205 | 51 | −16 | gb105pln | *L. esculentum* enolase gene. |
| 700612443H1 | g577824 | 70 | −17 | gb105pln | *Z. mays* gene for H2B histone (gH2B3). |
| 700615527H1 | g2632998 | 6 | 7 | gb105allp | similar to hypothetical proteins |
| 700615605H1 | g2668747 | 62 | −104 | gb105pln | *Zea mays* ribosomal protein L17 (rp117) mRNA, complete cds. |
| 700615154H1 | g1431138 | 8 | −8 | gb105eukp | ORF YDL100c |
| 700617507H1 | g2586128 | 51 | −91 | gb105pln | *Zea mays* b-keto acyl reductase (glossy8) mRNA, complete cds. |
| 700617352H1 | g457436 | 19 | 7 | gb105allp | basic transcription factor 3a |
| 700613716H1 | g2358139 | 15 | 7 | gb105pln | *Arabidopsis thaliana* |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | chromosome 1 YAC yUP8H12 complete sequence. |
| 700613409H1 | g474007 | 18 | −2 | gb105pln | Rice mRNA, partial homologous to ribosomal protein S12 gene. |
| 700615018H1 | g1177320 | 29 | −5 | gb105eukp | efa27; EFA27 for EF hand, abscisic acid, 27 kD |
| 700617334H1 | g22681 | 45 | −10 | gb105pln | *L. usitatissimum* mRNA for Stearoyl-(acyl-carrier-protein) desaturase. |
| 700617120H1 | g169537 | 17 | 3 | gb105pln | Potato pyrophosphate-fructose 6-phosphate 1-phosphotransferase (PFP) alpha-subunit mRNA, complete cds. |
| 700461246H1 | g975887 | 27 | −10 | gb105pln | *Mesembryanthemum crystallinum* myo-inositol-1-phosphate synthase mRNA, complete cds. |
| 700614693H1 | g169914 | 19 | −5 | gb105pln | Glycine max (clone pSAT17) aspartate aminotransferase mRNA, complete cds. |
| 700615812H1 | g2789433 | 13 | −3 | gb105pln | *Lycopersicon esculentum* mRNA for CLB1, complete cds. |
| 700612747H1 | g2827550 | 17 | −7 | gb105eukp | T12H17.120; leucine rich repeat receptor kinase-like protein |
| 700614386H1 | g1573394 | 15 | 5 | gb105allp | ATP-dependent RNA helicase (srmB) |
| 700616885H1 | g32532 | 33 | 3 | gb105allp | ribosomal protein s3 |
| 700617741H1 | g1161601 | 24 | −23 | gb105pln | *N. tabacum* mRNA for phosphoglycerate kinase (cytosolic isoenzyme). |
| 700615676H1 | g2677829 | 14 | 14 | gb105pln | *Prunus armeniaca* ribosomal protein L12 mRNA, complete cds. |
| 700616150H1 | g313151 | 18 | −1 | gb105pln | *A. thaliana* ribosomal protein S15 mRNA, complete CDS. |
| 700618263H1 | g2443401 | 39 | −3 | gb105pln | *Oryza sativa* mRNA for orthophosphate dikinase, complete cds. |
| 700617295H1 | g536895 | 43 | −16 | gb105pln | Wheat mRNA for protein H2A, complete cds, clone wcH2A-10. |
| 700613483H1 | g1749488 | 15 | 5 | gb105eukp | similar to *Saccharomyces cerevisiae* nuclear transport protein NIP 1, SWISS-PROT Accession Number P32497 |
| 700616988H1 | g2827538 | 14 | 8 | gb105pln | *Arabidopsis thaliana* DNA chromosome 4, BAC clone T12H17 (ESSAII project). |
| 700461194H1 | g2230878 | 9 | 8 | gb105allp | hNop56 |
| 700617714H1 | g168663 | 88 | −68 | gb105pln | Maize sulfur-rich zein protein of Mr 15,000, complete cds. |
| 700613968H1 | g2565304 | 52 | −21 | gb105pln | *Hordeum* sp. × *Triticum* sp. glycine decarboxylase P subunit mRNA, complete cds. |
| 700612474H1 | g1658314 | 67 | −13 | gb105pln | *O. sativa* osr40g3 gene. |
| 700612874H1 | g474000 | 39 | 13 | gb105pln | Rice mRNA, partial homologous to ribosomal protein L37a gene. |
| 700617873H1 | g1129084 | 22 | −32 | gb105pln | Wheat mRNA for protein H2A, complete cds, clone wcH2A-3. |
| 700613747H1 | g533084 | 16 | 7 | gb105eukp | delta-9 stearoyl-acyl carrier protein desaturase precursor; EC 1.14.99.6 |
| 700618619H1 | g1574937 | 31 | −30 | gb105pln | *Zea mays* superoxide dismutase 4 (sod4) gene, partial cds. |
| 700615041H1 | g218227 | 12 | −1 | gb105pln | Rice mRNA for ras-related GTP binding protein, complete cds. |
| 700613029H1 | g515376 | 23 | −36 | gb105pln | *L. temulentum* mRNA for histone H4. |
| 700461267H1 | g2264309 | 14 | 13 | gb105pln | *Arabidopsis thaliana* genomic DNA, chromosome 5, P1 clone: MJJ3, complete sequence. |
| 700618592H1 | g600709 | 49 | −9 | gb105pln | *Arabidopsis thaliana* synaptobrevin-related protein (SAR1) mRNA, complete cds. |
| 700461119H1 | g22324 | 41 | −44 | gb105pln | *Z. mays* mRNA for H2B histone (clone cH2B221). |
| 700615541H1 | g1107903 | 18 | −24 | gb105eukp | SPAC11D3.14c; unknown |
| 700614048H1 | g1871181 | 14 | 1 | gb105eukp | T06D20.8 |
| 700615807H1 | g2369713 | 26 | −25 | gb105pln | *Beta vulgaris* cDNA for elongation factor 2. |
| 700617764H1 | g166800 | 26 | −25 | gb105pln | *Arabidopsis thaliana* phosphoprotein phosphatase-type 1 catalytic subunit mRNA, complete cds. |
| 700461161H1 | g16072 | 90 | −76 | gb105pln | *A. mediterranea* zein gene. |
| 700615287H1 | g2160160 | 35 | −19 | gb105eukp | F21M12.5 |
| 700616291H1 | g1667396 | 13 | −8 | gb105allp | transcriptional regulator homolog RPD3 |
| 700616685H1 | g22528 | 52 | −2 | gb105pln | *Zea mays* mRNA encoding a zein (clone A20). |
| 700615016H1 | g2160162 | 21 | −1 | gb105eukp | F21M12.8 |
| 700618613H1 | g1272409 | 23 | −4 | gb105pln | *Vicia faba* immunophilin precursor (FKBP15) mRNA, complete cds. |
| 700617514H1 | g2431770 | 12 | 12 | gb105pln | *Zea mays* acidic ribosomal protein P2b (rpp2b) mRNA, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700617175H1 | g687244 | 39 | −3 | gb105pln | *Zea mays* oil body protein 16 kDa oleosin (ole16) gene, complete cds. |
| 700461284H1 | g2706451 | 25 | −4 | gb105pln | Yeast (*Saccharomyces pombe*) chromosome I cosmid c3G9. |
| 700618374H1 | g710295 | 15 | 3 | gb105allp | ribosomal protein L22 |
| 700612859H1 | g293892 | 23 | 11 | gb105pln | *Zea luxurians* alcohol dehydrogenase 1 (Adh1) gene, exons 4 through 10. |
| 700614277H1 | g168673 | 49 | 3 | gb105pln | Maize 19 kDa zein mRNA, clone cZ19B1, complete cds. |
| 700615822H1 | g392868 | 11 | 7 | gb105eukp | 1(3)73Ai; proteasome subunit |
| 700617411H1 | g2130984 | 38 | −34 | gb105pln | *B. napus* mRNA for ribosomal protein S15a (pA813). |
| 700614739H1 | g22328 | 32 | −15 | gb105pln | Maize mRNA for a high mobility group protein. |
| 700618595H1 | g790969 | 11 | −33 | gb105pln | Rice mRNA for aldolase C-1, complete cds. |
| 700617109H1 | g1854385 | 27 | −8 | gb105pln | *Vitis vinifera* mRNA for soluble NSF attachment protein homolog, complete cds. |
| 700613632H1 | g840731 | 23 | −5 | gb105eukp | Gpdh; glycerol-3-phosphate dehydrogenase (NAD+); EC 1.1.1.8 |
| 700614354H1 | g22524 | 85 | −30 | gb105pln | *Zea mays* mRNA encoding a zein (clone ZG31A). |
| 700461106H1 | g2829910 | 13 | 6 | gb105eukp | F22K20.5 |
| 700617823H1 | g904154 | 6 | 8 | gb105allp | microsomal omega-6 desaturase |
| 700613868H1 | g1881694 | 95 | −15 | gb105pln | *Zea mays* phosphoglucomutase mRNA, partial cds. |
| 700612649H1 | g2149050 | 27 | 3 | gb105pln | *Arabidopsis thaliana* small Ras-like GTP-binding protein (Ran3) mRNA, complete cds. |
| 700618692H1 | g2582639 | 24 | 3 | gb105allp | hnRNP-like protein |
| 700617258H1 | g2191144 | 16 | −6 | gb105eukp | A_IG002N01.24 |
| 700616465H1 | g21800 | 43 | −17 | gb105pln | *T. aestivum* L mRNA for histone H2B. |
| 700612622H1 | g440824 | 46 | −2 | gb105eukp | ribosomal protein S15 |
| 700617611H1 | g340933 | 32 | −26 | gb105pln | *Zea mays* 10-kDa zein gene, complete cds. |
| 700615227H1 | g1164943 | 7 | 2 | gb105eukp | YOR3177w |
| 700612592H1 | g600748 | 14 | 5 | gb105allp | Sm D2 |
| 700614201H1 | g633606 | 26 | 1 | gb105pln | *P. sativum* mRNA for chloroplastic outer envelope membrane protein (OEP75). |
| 700614134H1 | g1154858 | 27 | 13 | gb105pln | *H. vulgare* mRNA for L24 ribosomal protein. |
| 700616424H1 | g167109 | 24 | −18 | gb105pln | *Hordeum vulgare* vacuolar ATPase B subunit mRNA, complete cds. |
| 700612527H1 | g2058282 | 21 | 6 | gb105allp | atranbp1a |
| 700617152H1 | g2662340 | 68 | −17 | gb105pln | *Oryza sativa* mRNA for EF-1 alpha, complete cds. |
| 700613655H1 | g1658312 | 9 | 10 | gb105pln | *O. sativa* osr40g2 gene. |
| 700618068H1 | g170746 | 27 | −54 | gb105pln | Wheat histone H4 TH091 gene, complete cds. |
| 700617618H1 | g20412 | 43 | −41 | gb105pln | *P. amygdalus* mRNA for alpha-tubulin. |
| 700617103H1 | g433608 | 23 | 8 | gb105pln | *R. communis* mRNA for enolase. |
| 700618688H1 | g2244842 | 6 | 7 | gb105allp | hypothetical protein |
| 700617381H1 | g1469087 | 28 | −3 | gb105eukp | F53F4.10 |
| 700617318H1 | g2624416 | 37 | 4 | gb105pln | *Zea mays* mRNA for ubiquitin carrier protein UBC7. |
| 700613218H1 | g1916290 | 11 | 5 | gb105allp | ALY |
| 700618656H1 | g536895 | 43 | −31 | gb105pln | Wheat mRNA for protein H2A, complete cds, clone wcH2A-10. |
| 700617885H1 | g303838 | 47 | −49 | gb105pln | Rice mRNA for 40S subunit ribosomal protein, complete cds. |
| 700616071H1 | g1737492 | 13 | 2 | gb105eukp | wheatpab; poly(A)-binding protein |
| 700618513H1 | g1498132 | 25 | −29 | gb105pln | Maize; corn DNA for cysteine proteinase inhibitor, complete cds. |
| 700617741H1 | g21834 | 35 | −9 | gb105pln | Wheat mRNA for cytosolic phosphoglycerate kinase (EC 2.7.2.3). |
| 700615810H1 | g22528 | 52 | −95 | gb105pln | *Zea mays* mRNA encoding a zein (clone A20). |
| 700461208H1 | g2673912 | 10 | 5 | gb105eukp | T24P15.12 |
| 700614466H1 | g2244950 | 18 | −18 | gb105pln | *Arabidopsis thaliana* DNA chromosome 4, ESSA I contig fragment No. 5. |
| 700618156H1 | g2827001 | 55 | −72 | gb105pln | *Triticum aestivum* 70 kDa heat shock protein (TaHSP70d) mRNA, complete cds. |
| 700614319H1 | g1070353 | 41 | 14 | gb105pln | *H. vulgare* mRNA for Hv14-3-3b. |
| 700616425H1 | g602605 | 36 | −20 | gb105pln | *Zea mays* tandem genes for |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | alpha1-tubulin and alpha2-tubulin. |
| 700617945H1 | g2465430 | 5 | −1 | gb105eukp | JRG1.3; 32 kDa protein |
| 700615304H1 | g22469 | 60 | −89 | gb105pln | Maize mRNA for cytoplasmic ribosomal protein S11. |
| 700613042H1 | g437878 | 12 | 0 | gb105allp | mrp S24 gene product |
| 700615146H1 | g736677 | 30 | 8 | gb105allp | dihydrolipoamide succinyltransferase |
| 700613620H1 | g960356 | 41 | −1 | gb105pln | Barley mRNA for S-adenosylmethionine synthetase, complete cds. |
| 700461130H1 | g168529 | 97 | −82 | gb105pln | *Zea mays* opaque2 heterodimerizing protein 1 (OHP1) mRNA, complete cds. |
| 700617325H1 | g170772 | 76 | −28 | gb105pln | *Triticum aestivum* S-adenosyl-L-homocysteine hydrolase (SH6.2) mRNA, complete cds. |
| 700612743H1 | g2662342 | 71 | −82 | gb105pln | *Oryza sativa* mRNA for EF-1 alpha, complete cds. |
| 700613990H1 | g1666172 | 16 | −3 | gb105pln | *N. plumbaginfolia* mRNA for BTF3-like transcription factor. |
| 700614376H1 | g296704 | 28 | −8 | gb105eukp | FIB; snoRNP protein; fibrillarin |
| 700616961H1 | g169038 | 39 | −39 | gb105pln | *Pisum sativum* L. aldolase gene, 3' end cds. |
| 700617346H1 | g1627712 | 15 | −9 | gb105eukp | D2023.1 |
| 700615189H1 | g435456 | 43 | 1 | gb105pln | Proso millet gene for aspartate aminotransferase, complete cds. |
| 700615341H1 | g21679 | 47 | 6 | gb105pln | Wheat endosperm mRNA for ADP-glucose pyrophosophorylase (WE: AGA.7) (EC 2.7.7.27). |
| 700614022H1 | g2244881 | 18 | −6 | gb105eukp | PDR5-like ABC transporter |
| 700615001H1 | g2804260 | 32 | −23 | gb105eukp | phosphoserine aminotransferase |
| 700461169H1 | g145887 | 10 | 7 | gb105allp | malonyl coenzyme A-acyl carrier protein transacylase |
| 700612758H1 | g168500 | 46 | −74 | gb105pln | Maize (*Zea mays*) histone H4 gene (H4C14), complete cds. |
| 700612812H1 | g22430 | 36 | 12 | gb105pln | Maize pseudo-Gpa2 pseudogene for glyceraldehyde-3-phosphate dehydrogenase subunit A. |
| 700615919H1 | g1129084 | 29 | 14 | gb105pln | Wheat mRNA for protein H2A, complete cds, clone wcH2A-3. |
| 700613847H1 | g455506 | 27 | 12 | gb105pln | Rice mRNA for ras-related GTP-binding protein, partial sequence. |
| 700615806H1 | g168702 | 80 | −39 | gb105pln | Corn 22 kDa zein protein gene, complete cds. |
| 700614773H1 | g1401252 | 39 | −19 | gb105allp | mlrq-like protein |
| 700614008H1 | g461035 | 12 | 5 | gb105allp | c6.1A [mice, Peptide, 292 aa] |
| 700614738H1 | g20636 | 27 | −4 | gb105pln | *P. sativum* mRNA for actin. |
| 700615806H1 | g22222 | 84 | −42 | gb105pln | *Z. mays* ZSF4C4 gene for zein. |
| 700614048H1 | g1773040 | 15 | −1 | gb105eukp | A-RZF; unknown; RING zinc finger protein |
| 700613933H1 | g1592563 | 10 | 5 | gb105allp | RNA binding protein TIAR |
| 700613741H1 | g474003 | 27 | 7 | gb105pln | Rice mRNA, partial homologous to ribosomal protein rp21c gene. |
| 700612953H1 | g304108 | 32 | −27 | gb105pln | *Arabidopsis thaliana* poly(A)-binding protein mRNA, complete cds. |
| 700615517H1 | g2145351 | 40 | −22 | gb105pln | *A. ebumeum* mRNA for phosphoenolpyruvate carboxylase (leaf). |
| 700461257H1 | g2274990 | 46 | −28 | gb105pln | *Hordeum vulgare* mRNA for expressed sequence tag. |
| 700615421H1 | g2369713 | 13 | −3 | gb105pln | *Beta vulgaris* cDNA for elongation factor 2. |
| 700616208H1 | g3606 | 23 | −6 | gb105pln | Yeast (*Saccharomyces cerevisiae*) upstream region of CTR/HNM1 gene. |
| 700617045H1 | g1255713 | 24 | −5 | gb105pln | Sorghum bicolor granule-bound starch synthase precursor (Wx) mRNA, nuclear gene encoding chloroplast protein, complete cds. |
| 700613488H1 | g495021 | 19 | −0 | gb105eukp | DebB; membrane-associated protein |
| 700612627H1 | g22548 | 32 | 13 | gb105pln | Maize chimeric zein/beta-phaseolin gene 3' end region. |
| 700612735H1 | g600115 | 30 | −28 | gb105pln | *Z. mays* apx gene encoding cytosolic ascorbate peroxidase. |
| 700617488H1 | g166409 | 12 | 14 | gb105pln | Alfalfa nucleic acid binding protein (alfin-1) mRNA, partial cds. |
| 700617271H1 | g2271465 | 52 | −15 | gb105eukp | fae1; 3-ketoacyl-CoA synthase |
| 700613119H1 | g1272634 | 17 | −2 | gb105eukp | K07C5.4 |
| 700612802H1 | g168460 | 59 | −5 | gb105pln | *Zea mays* cyclophilin (CyP) mRNA, complete cds. |
| 700613121H1 | g540534 | 34 | −41 | gb105pln | Rice mRNA for q group of receptor for activated C-kinase, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700461261H1 | g535019 | 74 | −55 | gb105pln | *Z. mays* Zd1 tandem genes for zein Zd1 (19 kDa Zein). |
| 700615141H1 | g398607 | 52 | 3 | gb105pln | *A. thaliana* mRNA for elongation factor 1 beta. |
| 700612851H1 | g168460 | 69 | −6 | gb105pln | *Zea mays* cyclophilin (CyP) mRNA, complete cds. |
| 700615215H1 | g168492 | 12 | −27 | gb105pln | Corn histone H3 (H3C3) gene, complete cds. |
| 700618154H1 | g2076889 | 7 | 1 | gb105eukp | C09D4.5 |
| 700617372H1 | g158334 | 30 | 7 | gb105eukp | M(3)67C |
| 700615524H1 | g1488646 | 18 | 4 | gb105pln | *S. oleraceae* mRNA for RNA helicase, PRH75. |
| 700613226H1 | g1770051 | 10 | 1 | gb105allp | Prt1 homolog |
| 700615878H1 | g1181672 | 31 | 14 | gb105pln | Sorghum bicolor heat shock protein 70 cognate (hsc70) mRNA, partial cds. |
| 700615971H1 | g2852449 | 25 | 5 | gb105eukp | APK2b; protein kinase |
| 700615685H1 | g2345153 | 29 | −71 | gb105pln | *Zea mays* ribsomal protein S4 (rps4) mRNA, complete cds. |
| 700615935H1 | g1100738 | 23 | 11 | gb105pln | *Panicum miliaceum* mRNA for 2-oxoglutarate/malate translocator, complete cds. |
| 700617472H1 | g1799607 | 6 | 6 | gb105allp | METHIONYL-TRNA FORMYLTPANSFERASE (EC 2.1.2.9). |
| 700617228H1 | g202833 | 16 | 8 | gb105allp | aldehyde dehydrogenase |
| 700615647H1 | g166857 | 24 | −47 | gb105pln | *Arabidopsis thaliana* cytoplasmic ribosomal protein mRNA, complete cds. |
| 700461130H1 | g168427 | 29 | −19 | gb105pln | *Zea mays* opaque2 heterodimerizing protein 2 mRNA, complete cds. |
| 700612646H1 | g168269 | 22 | 5 | gb105pln | Sweet potato F-1-ATPase (mitochondrial type) delta subunit mRNA, complete cds. |
| 700616895H1 | g1336097 | 44 | 4 | gb105allp | pyruvate dehydrogenase E1beta |
| 700618255H1 | g1215982 | 17 | 7 | gb105allp | ribosomal protein L21 |
| 700618003H1 | g1431396 | 13 | −4 | gb105eukp | GYP7 |
| 700615157H1 | g396209 | 40 | 12 | gb105pln | *S. polyrrhiza* mRNA for D-myo-inositol-3-phosphate synthase. |
| 700613904H1 | g527680 | 22 | −10 | gb105eukp | ribosomal protein S3 |
| 700612306H1 | g600768 | 46 | −3 | gb105pln | *Oryza sativa* cyclophilin 2 (Cyp2) mRNA, complete cds. |
| 700614950H1 | g507770 | 29 | −9 | gb105pln | *Zea mays* D3L H(+)-transporting ATPase (Mha1) gene, complete cds. |
| 700618266H1 | g2244898 | 12 | 0 | gb105eukp | strong similarity to protein phosphatase 2A regulatory chain, 74K |
| 700613683H1 | g22272 | 62 | −82 | gb105pln | Maize mRNA for enolase (2-phospho-D-glycerate hydrolase). |
| 700613630H1 | g2586332 | 22 | −16 | gb105pln | *Lycopersicon esculentum* importin alpha (LeKAP alpha) mRNA, partial cds. |
| 700614535H1 | g1276967 | 46 | −17 | gb105eukp | putative ribosomal protein |
| 700612607H1 | g168527 | 40 | −61 | gb105pln | Maize NADP-dependent malic enzyme (Me1) mRNA, complete cds. |
| 700612422H1 | g533251 | 100 | −31 | gb105pln | *Zea mays* (clone pSM8) sucrose synthase 2 (Sus1) gene, complete cds. |
| 700617125H1 | g16444 | 34 | −12 | gb105pln | *A. thaliana* mRNA for proteasome alpha subunit. |
| 700616491H1 | g1161602 | 11 | 0 | gb105eukp | phosphoglycerate kinase (PGK); EC 2.7.2.3 |
| 700612428H1 | g1177374 | 31 | 14 | gb105pln | Cabomba sp. mitochondrial cox1 gene. |
| 700461226H1 | g1055070 | 22 | −16 | gb105eukp | C23G10.3 |
| 700612822H1 | g777757 | 57 | −66 | gb105pln | Saccharum hybrid (clone SCUBI561) polyubiquitin mRNA, complete cds. |
| 700617962H1 | g482935 | 22 | −10 | gb105pln | *N. tabacum* mRNA for pyruvate kinase (plastid isozyme). |
| 700612308H1 | g169090 | 46 | −0 | gb105pln | Pea glyceraldehyde-3-phosphate dehydrogenase (GapC1) mRNA, complete cds. |
| 700617057H1 | g170224 | 35 | −35 | gb105pln | *Nicotiana tabacum* 3-deoxy-D-arabino-heptulosonate 7-phosphate synthase, complete cds. |
| 700616414H1 | g168553 | 54 | −37 | gb105pln | *Zea mays* putative cytoplasmic malate dehydrogenase homolog mRNA, partial cds. |
| 700613846H1 | g1574150 | 6 | 5 | gb105allp | ribosomal protein S1 (rpS1) |
| 700615631H1 | g2078349 | 24 | −15 | gb105pln | *Solanum tuberosum* transaldolase (PotTal1) mRNA, complete cds. |
| 700617794H1 | g168665 | 88 | −37 | gb105pln | Maize 16-kDa zein-2 mRNA, complete cds. |
| 700612921H1 | g1935915 | 20 | 1 | gb105pln | *Solanum tuberosum* StubSNF1 protein (StubSNF1cDNA) mRNA, complete cds. |
| 700613846H1 | g1279215 | 5 | 4 | gb105allp | Heme uptake protein A |
| 700617489H1 | g22533 | 80 | −66 | gb105pln | *Zea mays* mRNA encoding a zein |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| | | | | | (clone ZG99). |
| 700612923H1 | g2814379 | 34 | −2 | gb105eukp | B0513.3 |
| 700614737H1 | g2102657 | 67 | 2 | gb105eukp | unnamed protein product |
| 700612951H1 | g1532047 | 17 | −27 | gb105pln | *O. sativa* mRNA for S-adenosylmethionine decarboxylase. |
| 700461105H1 | g1928865 | 46 | −36 | gb105pln | *Triticum aestivum* root abundant protein mRNA, complete cds. |
| 700612645H1 | g2702272 | 18 | 6 | gb105allp | hypothetical protein |
| 700618479H2 | g218088 | 20 | −3 | gb105pln | Rice mRNA for ribosomal protein 117 (249 gene), partial sequence. |
| 700616867H1 | g2244971 | 14 | −0 | gb105eukp | hypothetical protein |
| 700614725H1 | g458969 | 10 | −4 | gb105eukp | F37C12.7 |
| 700614821H1 | g1161311 | 22 | −28 | gb105pln | *Arabidopsis thaliana* Columbia myo-inositol-1-phosphate synthase mRNA, complete cds. |
| 700618595H1 | g168419 | 14 | −50 | gb105pln | Maize (*Z. mays*) aldolase mRNA, complete cds. |
| 700613307H1 | g1864000 | 46 | −13 | gb105pln | Maize DNA for Fd III, complete cds. |
| 700615622H1 | g13012 | 13 | −7 | gb105allp | URF 4L (NADH dehydrogenase subunit) |
| 700616626H1 | g572608 | 27 | −1 | gb105eukp | ribosomal protein homologue |
| 700613251H1 | g2130984 | 13 | −6 | gb105pln | *B. napus* mRNA for ribosomal protein S15a (pA813). |
| 700461283H1 | g168484 | 63 | −41 | gb105pln | Maize endosperm glutelin-2 gene, complete cds. |
| 7000618372H1 | g166929 | 18 | 10 | gb105pln | *A. thaliana* ubiquitin extension protein (UBQ1) gene, complete cds. |
| 700614946H1 | g2760171 | 30 | −25 | gb105pln | *Arabidopsis thaliana* genomic DNA, chromosome 5, P1 clone: MPA24, complete sequence. |
| 700616621H1 | g22614 | 23 | −55 | gb105pln | *S. vulgare* pepC gene for PEP carboxylase. |
| 700614983H1 | g2570118 | 27 | 12 | gb105pln | *S. latifolia* mRNA, clone CCLS 17. |
| 700617945H1 | g2465426 | 5 | −1 | gb105eukp | JRG1.1; 32 kDa protein |
| 700614991H1 | g300264 | 11 | 7 | gb105eukp | HSP68; HSP68 |
| 7000615142H1 | g293886 | 57 | −73 | gb105pln | *Zea mays* glyceraldehyde-3-phosphate dehydrogenase mRNA, 3' end, (clone GAPC3). |
| 700615849H1 | g169057 | 11 | 3 | gb105eukp | carbonic anhydrase |
| 700616390H1 | g16508 | 47 | −30 | gb105pln | *A. thaliana* DNA for S-adenosylmethionine synthetase gene sam-1. |
| 700618126H1 | g547477 | 22 | −12 | gb105pln | *V. faba* mRNA for guanine nucleotide regulatory protein. |
| 700614376H1 | g683683 | 20 | −2 | gb105eukp | NOP1; nucleolar protein NOP1 (J05230); D2870 |
| 700616630H1 | g168663 | 55 | −21 | gb105pln | Maize sulfur-rich zein protein of Mr 15,000, complete cds. |
| 700616419H1 | g218112 | 38 | −42 | gb105pln | Rice mRNA for ribosomal protein L41 (340 gene), partial sequence. |
| 700618121H1 | g2814851 | 6 | 4 | gb105eukp | W01A6.c |
| 700614354H1 | g535019 | 86 | −31 | gb105pln | *Z. mays* Zd1 tandem genes for zein Zd1 (19 kDa Zein). |
| 700613784H1 | g1345506 | 21 | −3 | gb105eukp | ATAF1 |
| 700612683H1 | g549985 | 75 | −61 | gb105pln | *Pennisetum ciliare* possible apospory-associated mRNA clone pSUB 3-1a, partial cds. |
| 700612508H1 | g168406 | 36 | 8 | gb105pln | *Z. mays* alcohol dehydrogenase (ADH-1 C-m allele) gene, complete cds. |
| 700616180H1 | g1262170 | 14 | 3 | gb105pln | *Arabidopsis thaliana* phosphoprotein phosphatase 2A regulatory subunit A (RCN1) mRNA, complete cds. |
| 700616813H1 | g407800 | 17 | 10 | gb105pln | *G. hirsutum* mRNA for ribosomal protein 41, large subunit (RL41). |
| 700612521H1 | g313028 | 58 | −51 | gb105pln | *L. esculentum* ypt2 mRNA for GTP-binding protein. |
| 700618285H1 | g1785859 | 38 | 7 | gb105pln | *Flaveria linearis* NADP-malic enzyme mRNA, partial cds. |
| 700613868H1 | g2645198 | 26 | 15 | gb105pln | *Arabidopsis thaliana* chromosome I BAC T26J12 genomic sequence, complete sequence. |
| 700614002H1 | g1742735 | 16 | 7 | gb105allp | Cyclopropane fatty acid synthase |
| 700614535H1 | g1669623 | 25 | −5 | gb105eukp | ribosomal protein L39 |
| 700461242H1 | g22535 | 49 | −63 | gb105pln | *Zea mays* mRNA encoding a zein (clone pZ22.3). |
| 700615480H1 | g2440031 | 21 | 2 | gb105eukp | dal1; DAL1 protein |
| 700613726H1 | g2052364 | 40 | −16 | gb105allp | ATPase 6 |
| 700612945H1 | g22121 | 70 | −25 | gb105pln | Maize alcohol dehydrogenase 1 gene (Adh1-1F). |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700612548H1 | g168673 | 82 | −80 | gb105pln | Maize 19 kDa zein mRNA, clone cZ19B1, complete cds. |
| 700612690H1 | g457401 | 48 | −35 | gb105pln | *Arabidopsis thaliana* mRNA for MAP kinase, complete cds. |
| 700612461H1 | g587561 | 41 | −8 | gb105pln | *S. tuberosum* mRNA for alpha-II MPP. |
| 700615134H1 | g469148 | 37 | 6 | gb105eukp | alanine aminotransferase |
| 700612541H1 | g2760173 | 31 | −12 | gb105pln | *Arabidopsis thaliana* genomic DNA, chromosome 5, P1 clone: MYH19, complete sequence. |
| 700613923H1 | g2511530 | 83 | −25 | gb105pln | *Eleusine undica* alpha tubulin 1 (TUA1) mRNA, complete cds. |
| 700615865H1 | g1835728 | 16 | 15 | gb105pln | *Oryza sativa* ribosomal protein mRNA, complete cds. |
| 700613368H1 | g1209098 | 25 | 13 | gb105pln | *Arabidopsis thaliana* ovule development protein (AINTEGUMENTA) mRNA, complete cds. |
| 700612615H1 | g22272 | 97 | −51 | gb105pln | Maize mRNA for enolase (2-phospho-D-glycerate hydrolase). |
| 700615525H1 | g2218151 | 20 | −3 | gb105pln | *Vigna unguiculata* type IIIa membrane protein cp-wap13 mRNA, complete cds. |
| 700616885H1 | g555941 | 33 | 3 | gb105allp | ribosomal protein S3 |
| 700613712H1 | g1132482 | 38 | −26 | gb105pln | Rice mRNA for ADP-ribosylation factor, complete cds. |
| 700612414H1 | g1184600 | 19 | −13 | gb105eukp | ZK593.6 |
| 700614943H1 | g1049407 | 10 | −9 | gb105eukp | C46F4.2 |
| 700614869H1 | g2505940 | 16 | −2 | gb105allp | 26S proteasome, non-ATPase subunit |
| 700617461H1 | g1103319 | 26 | −12 | gb105pln | *A. thaliana* CKI2 mRNA for casein kinase I. |
| 700612694H1 | g1167527 | 40 | 4 | gb105eukp | Cytb; cytochrome b |
| 700612408H1 | g2688979 | 34 | −15 | gb105eukp | AtKUP1; high-affinity potassium transporter |
| 700614712H1 | g2459421 | 31 | −0 | gb105eukp | F4P9.15; similar to calcium-binding EF-hand protein |
| 700613851H1 | g19205 | 53 | 0 | gb105pln | *L. esculentum* enolase gene. |
| 700613206H1 | g22528 | 51 | −56 | gb105pln | *Zea mays* mRNA encoding a zein (clone A20). |
| 700612505H1 | g1321819 | 35 | −25 | gb105pln | *G. max* mRNA for glycinamide ribonucleotide synthetase. |
| 700617625H1 | g297172 | 8 | 2 | gb105Sallp | ribosomal protein S7 |
| 700613418H1 | g780694 | 32 | 4 | gb105eukp | SCS-alpha; succinyl coenzyme A synthetase alpha subunit; EC 6.2.1.4 |
| 700616332H1 | g395146 | 9 | 17 | gb105pln | *N. tabacum* gene for glycine-rich protein. |
| 700613129H1 | g2392895 | 10 | −10 | gb105eukp | BRI1; brassinosteroid insensitive 1 |
| 700615441H1 | g1850816 | 10 | −6 | gb105eukp | UbcD4; ubiquitin conjugating enzyme |
| 700614172H1 | g5056 | 13 | 13 | gb105pln | Yeast (*Saccharomyces pombe*) rpgL29 gene for ribosomal protein L29. |
| 700618266H1 | g2160694 | 12 | −0 | gb105eukp | AtB 'gamma; B' regulatory subunit of PP2A |
| 700617343H1 | g2494110 | 18 | 2 | gb105pln | Sequence of BAC T1G11 from *Arabidopsis thaliana* chromosome 1, complete sequence. |
| 700613303H1 | g1419369 | 32 | −7 | gb105pln | *Z. mays* ZmABP3 mRNA for actin depolymerizing factor. |
| 700616950H1 | g531750 | 8 | 5 | gb105allp | probable mitochondrial protein |
| 700612627H1 | g168663 | 31 | 13 | gb105pln | Maize sulfur-rich zein protein of Mr 15,000, complete cds. |
| 700617381H1 | g2262148 | 66 | −11 | gb105eukp | T10P11.14; predicted NADH dehydrogenase 24 kDa subunit |
| 700617231H1 | g168406 | 51 | −31 | gb105pln | *Z. mays* alcohol dehydrogenase (ADH-1 C-m allele) gene, complete cds. |
| 700612952H1 | g402903 | 34 | −35 | gb105pln | *Arabidopsis thaliana* Columbia laminin receptor-like protein mRNA, complete cds. |
| 700614031H1 | g508544 | 35 | −77 | gb105pln | *Zea mays* 24-kD alpha-zein gene (floury2), complete cds. |
| 700616071H1 | g2213871 | 18 | −1 | gb105eukp | poly(A)-binding protein |
| 700615832H1 | g20323 | 56 | −30 | gb105pln | *O. sativa* RAc1 gene for actin. |
| 700612690H1 | g1204128 | 50 | −38 | gb105pln | *M. sativa* MMK2 mRNA for protein kinase. |
| 700613195H1 | g1561773 | 17 | 2 | gb105pln | *Vitis vinifera* malate dehydrogenase (VVME2) mRNA, complete cds. |
| 700618396H1 | g168700 | 38 | −70 | gb105pln | *Z. mays* zein mRNA, complete cds. |
| 700617184H1 | g790969 | 65 | −12 | gb105pln | Rice mRNA for aldolase C-1, complete cds. |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700613003H1 | g2293565 | 23 | −28 | gb105pln | *Oryza sativa* ADP-ribosylation factor 1 (Os-ARF1) mRNA, complete cds. |
| 700616632H1 | g602565 | 58 | −1 | gb105eukp | INO1 |
| 700613618H1 | g500852 | 29 | −22 | gb105pln | *Zea mays* (clone pAKHSDH2) aspartate kinase-homoserine dehydrogenase mRNA, complete cds. |
| 700613808H1 | g2408019 | 14 | −7 | gb105eukp | SPAC17G6.06; 40s ribosomal protein |
| 700613419H1 | g168500 | 23 | −5 | gb105pln | Maize (*Zea mays*) histone H4 gene (H4C14), complete cds. |
| 700613639H1 | g473186 | 40 | −91 | gb105pln | *Z. mays* (A619) PKCI mRNA for protein kinase C Inhibitor. |
| 700616968H1 | g1469087 | 12 | −2 | gb105eukp | F53F4.10 |
| 700614252H1 | g168460 | 52 | −49 | gb105pln | *Zea mays* cyclophilin (CyP) mRNA, complete cds. |
| 700613126H1 | g303856 | 54 | −57 | gb105pln | Rice mRNA for ubiquitin protein fused to a ribosomal protein, complete cds. |
| 700613027H1 | g1517942 | 7 | 7 | gb105allp | aminopeptidase P |
| 700615022H1 | g168683 | 79 | −42 | gb105pln | Maize 22 kd (Mw = 26.53 kd) zein protein 1, mRNA. |
| 700617996H1 | g1906830 | 49 | −6 | gb105eukp | hsp88.1; heat shock protein |
| 700616570H1 | g2749918 | 16 | 3 | gb105pln | *Arabidopsis thaliana* chromosome I BAC F316 genomic sequence, complete sequence. |
| 700614042H1 | g2431768 | 23 | −22 | gb105pln | *Zea mays* acidic ribosomal protein P1a (rpp1a) mRNA, complete cds. |
| 700615060H1 | g1184775 | 20 | −42 | gb105pln | *Zea mays* glyceraldehyde-3-phosphate dehydrogenase GAPC4 (gpc4) mRNA, complete cds. |
| 700614720H1 | g22314 | 75 | −78 | gb105pln | Maize mRNA for GSH gluthathione S-transferase I (GST; EC 2.5.1.18). |
| 700617037H1 | g1432173 | 21 | −2 | gb105eukp | copB; CopB |
| 700612904H1 | g1067202 | 23 | −9 | gb105pln | Yeast (*Saccharomyces pombe*) chromosome I cosmid c1F7. |
| 700612712H1 | g2565339 | 33 | −46 | gb105pln | *Lupinus luteus* ribosomal protein S14 (rps14) mRNA, complete cds. |
| 700612932H1 | g60C750 | 35 | 4 | gb105allp | Sm D3 |
| 700615628H1 | g2795803 | 9 | 3 | gb105eukp | F17A14.1; putative beta-1, 3-endoglucanase |
| 700613734H1 | g603309 | 11 | 16 | gb105pln | Yeast (*Saccharomyces cerevisiae*) chromosome V lambda clone 3612 and cosmid 9747. |
| 700615816H1 | g1519248 | 46 | −16 | gb105pln | *Oryza sativa* GF14-b protein mRNA, complete cds. |
| 700618124H1 | g1870198 | 17 | 9 | gb105pln | *Z. mays* mRNA for acyl carrier protein. |
| 700615136H1 | g710330 | 35 | 7 | gb105allp | 55 kDa B regulatory subunit of phosphatase 2A |
| 700613463H1 | g16393 | 38 | −36 | gb105pln | *A. thaliana* mRNA for leucine aminopeptidase. |
| 700614488H1 | g633606 | 18 | −0 | gb105pln | *P. sativum* mRNA for chloroplastic outer envelope membrane protein (OEP75). |
| 700617873H1 | g1129085 | 22 | −31 | gb105pln | Wheat mRNA for protein H2A, complete cds, clone wcH2A-9. |
| 700612839H1 | g166972 | 17 | −2 | gb105pln | Barley acyl carrier protein I (ACP I) mRNA, complete cds. |
| 700612323H1 | g644492 | 48 | −1 | gb105pln | Corn elongation factor 1alpha gene, complete cds. |
| 700612539H1 | g1100222 | 32 | −13 | gb105pln | *Pinus sylvestris* chloroplast NAD+-dependent glyceraldehyde-3-phosphate dehydrogenase mRNA, complete cds. |
| 700616887H1 | g2306969 | 22 | 4 | gb105allp | x1-Mago |
| 700613453H1 | g531055 | 21 | −13 | gb105pln | Wheat mRNA for protein H2B-6, complete cds. |
| 700615541H1 | g1107904 | 16 | −20 | gb105eukp | SPAC11D3.15; unknown |
| 700613483H1 | g2789660 | 32 | −6 | gb105eukp | p105 |
| 700614737H1 | g2444420 | 77 | 1 | gb105aiIp | ribosome-associated protein p40 |
| 700613053H1 | g166866 | 32 | −32 | gb105pln | *A. thaliana* ribosomal protein S11 mRNA, 3' end. |
| 700614215H1 | g1526426 | 8 | 7 | gb105allp | proteasome subunit p42 |
| 700616217H1 | g644491 | 54 | −62 | gb105pln | Corn mRNA for elongation factor 1A. |
| 700616409H1 | g2511567 | 14 | −12 | gb105pln | *Arabidopsis thaliana* mRNA for proteasome subunit prct. |
| 700617908H1 | g1710150 | 8 | 16 | gb105pln | *Arabidopsis thaliana* proilne iminopeptidase mRNA, complete cds. |
| 700615254H1 | g2245035 | 12 | 7 | gb105eukp | hypothetical protein |
| 700617081H1 | g1431346 | 14 | −4 | gb105eukp | NHP2 |
| 700612928H1 | g2511530 | 27 | 4 | gb105pln | *Eleusine undica* alpha tubulin |

TABLE 1-continued

LIST OF INCYTE CLONES DERIVED FROM SATMON022023
COPYRIGHT 1998 INCYTE PHARMACEUTICALS, INC.

| | | | | | |
|---|---|---|---|---|---|
| 700616031H1 | g168500 | 23 | −5 | gb105pln | 1 (TUA1) mRNA, complete cds. Maize (*Zea mays*) histone H4 gene (H4C14), complete cds. |
| 700612575H1 | g473992 | 37 | −30 | gb105pln | Rice mRNA, sequence homologous to ADP-ribosylation factor gene. |
| 700613717H1 | g2511530 | 49 | −40 | gb105pln | *Eleusine undica* alpha tubulin 1 (TUA1) mRNA, complete cds. |
| 700617120H1 | g169538 | 26 | 3 | gb105eukp | pyrophosphate-fructose 6-phosphate 1-phosphotransferase alpha-subunit; EC 2.7.1.90 |
| 700614774H1 | g2501763 | 25 | −8 | gb105pln | *Glycine max* calmodulin-like domain protein kinase isoenzyme beta mRNA, complete cds. |
| 700617472H1 | g1799612 | 6 | 6 | gb105allp | METHIONYL-TRNA FORMYLTRANSFEPASE (EC 2..2.9). |
| 700616723H1 | g2815519 | 13 | 16 | gb105pln | *Arabidopsis thaliana* BAC T5J8 from chromosome IV, top arm, complete sequence. |
| 700614003H1 | g2113890 | 15 | −4 | gb105allp | ribosomal protein L4 |
| 700616921H1 | g2656025 | 8 | 9 | gb105pln | *Arabidopsis thaliana* genomic DNA, chromosome 5, P1 clone: MCD7. |
| 700613326H1 | g2754859 | 58 | −8 | gb105pln | *Fragaria x ananassa* cytosolic ascorbate peroxidase (ApXSC) mRNA, complete cds. |
| 700616751H1 | g2738749 | 55 | −24 | gb105pln | *Zea mays* ATP sulfurylase mRNA, complete cds. |
| 700615920H1 | g1045614 | 40 | −1 | gb105eukp | catalyzes the first step of microsomal fatty acid elongation; condenses malonyl-CoA with long chain acyl-CoA in the formation of very long chain fatty acids; beta-ketoacyl-CoA synthase |
| 700461142H1 | g2832242 | 98 | −87 | gb105pln | *Zea mays* 22-kDa alpha zein gene cluster, complete sequence. |
| 700614478H1 | g2564051 | 27 | −12 | gb105pln | *Arabidopsis thaliana* genomic DNA, chromosome 5, P1 clone: MWD9, complete sequence. |
| 700615182H1 | g1532171 | 42 | 8 | gb105eukp | AT.I.24-9 |
| 700613828H1 | g2281090 | 14 | −4 | gb105eukp | F18O19.9 |
| 700617771H1 | g758246 | 51 | −32 | gb105pln | *Phalaenopsis sp.* mRNA for S-adenosyhomocysteine hydrolase. |
| 700613778H1 | g2384669 | 20 | −13 | gb105eukp | AtKT1; putative potassium transporter AtKT1p |
| 700614906H1 | g1161311 | 42 | −55 | gb105pln | *Arabidopsis thaliana* Columbia myo-inositol-1-phosphate synthase mRNA, complete cds. |
| 700613867H1 | g1805364 | 14 | 2 | gb105eukp | beta-VPE |
| 700616333H1 | g483612 | 17 | 4 | gb105pln | *B. napus* (Topas) mRNA for 44 kDa chloroplast envelope protein. |
| 700613314H1 | g169804 | 58 | −6 | gb105pln | *Oryza sativa* DNA fragment with a miscellaneous signal and an open reading frame. |
| 700461161H1 | g168671 | 82 | −78 | gb105pln | Maize 19 kd zein protein, mRNA (incomplete). |
| 700614940H1 | g20185 | 34 | −32 | gb105pln | *O. sativa* mRNA for calmodulin. |
| 700616118H1 | g2342727 | 9 | −2 | gb105eukp | T14G11.19 |
| 700618540H1 | g482937 | 15 | 1 | gb105pln | *N. tabacum* mRNA for pyruvate kinase (plastid isozyme). |
| 700617633H1 | g2564051 | 20 | −0 | gb105pln | *Arabidopsis thaliana* genomic DNA, chromosome 5, P1 clone: MWD9, complete sequence. |
| 700612494H1 | g22610 | 41 | 14 | gb105pln | *S. vulgare* PEPC gene. |
| 700618591H1 | g409072 | 7 | 8 | gb105allp | HBp15/L22 |
| 700617450H1 | g619753 | 15 | 3 | gb105eukp | TSA1; tryptophan biosynthesis; tryptophan synthase alpha chain; EC 4.2.1.20 |
| 700615126H1 | g963063 | 50 | −4 | gb105pln | *H. vulgare* Ole-2 mRNA for oleosin. |
| 700615504H1 | g22531 | 39 | −35 | gb105pln | *Zea mays* mRNA encoding a zein (clone pZ22.1). |
| 700616451H1 | g2335098 | 18 | −12 | gb105eukp | T11A07.9 |
| 700615156H1 | g2065020 | 23 | 17 | gb105pln | *A. thaliana* mRNA for alanyl tRNA synthetase. |
| 700616008H1 | g2443401 | 60 | −71 | gb105pln | *Oryza sativa* mRNA for orthophosphate dikinase, complete cds. |
| 700613966H1 | g498774 | 70 | −9 | gb105pln | *Z. mays* (cv DH5xDH7) hsp70-5 mRNA for heat shock protein 70. |
| 700613215H1 | g20000 | 26 | −37 | gb105pln | *N. tabacum* RL2 mRNA for 60S ribosomal protein L2. |
| 700612871H1 | g758249 | 37 | −53 | gb105pln | *P. vulgaris* mRNA for plasma membrane H+ ATPase. |
| 700616357H1 | g22342 | 60 | −55 | gb105pln | Maize gene for heat shock protein 70 exon 2 and 3′ -UT (hsp70; clone pMON 9502). |
| 700617820H1 | g2570506 | 48 | −9 | gb105pln | *Oryza sativa* ribosomal protein mRNA, complete cds. |
| 700618252H1 | g20598 | 26 | −1 | gb105pln | *P. miliaceum* mRNA for aspartate aminotransferase (pcAAT2). |

TABLE 1-continued

LIST OF INCYTE CLONES DERIVED FROM SATMON022023
COPYRIGHT 1998 INCYTE PHARMACEUTICALS, INC.

| 700615244H1 | g1488296 | 26 | −8 | gb105pln | *Oryza sativa* osRAD23 mRNA, complete cds. |

TABLE 2

UNIQUE AND HOMOLOGOUS CLUSTERS IN SATMON022023
COPYRIGHT 1998 INCYTE PHARMACEUTICALS, INC.

Cluster number: 1
| Cluster clones: | 700258683H1 | 700259205H1 | 700264431H1 | 700264556H1 | 700258984H1 |
|---|---|---|---|---|---|
| 700263092H1 | 700264115H1 | 700267701H1 | 700263041H1 | 700258873H1 | 700256747H1 |
| 700267341H1 | 700260437H1 | 700260019H1 | 700263142H1 | 700266879H1 | 700257013H1 |
| 700263227H1 | 700260995H1 | 700261107H1 | 700263869H1 | 700258938H1 | 700264615H1 |
| 700263689H1 | 700266249H1 | 700265005H1 | 700263780H1 | 700263813H1 | 700265037H1 |
| 700264795H1 | 700266650H1 | 700266818H1 | 700257018H1 | 700265554H1 | 700257648H1 |
| 700263925H1 | 700259070H1 | 700263957H1 | 700263682H1 | 700258807H1 | 700258542H1 |
| 700262539H1 | 700262666H1 | 700262327H1 | 700263858H1 | 700266737H1 | 700265156H1 |
| 700268023H1 | 700264668H1 | 700267754H1 | 700207109H1 | 700259366H1 | 700258286H1 |
| 700258841H1 | 700262848H1 | 700256721H1 | 700257874H1 | 700266919H1 | 700257489H1 |
| 700257024H1 | 700261628H1 | 700261648H1 | 700266339H1 | 700258337H1 | 700264565H1 |
| 700263809H1 | 700262921H1 | 700262472H1 | 700256709H1 | 700260025H1 | 700256815H1 |
| 700262415H1 | 700262741H1 | 700259711H1 | 700261423H1 | 700263322H1 | 700262549H1 |
| 700264842H1 | 700265959H1 | 700267785H1 | 700265202H1 | 700262683H1 | 700264737H1 |
| 700263896H1 | 700263746H1 | 700257358H1 | 700266374H1 | 700262916H1 | 700261562H1 |
| 700265842H1 | 700258279H1 | 700259153H1 | 700263462H1 | 700267684H1 | 700259057H1 |
| 700264710H1 | 700263740H1 | 700258353H1 | 700261394H1 | 700263037H1 | 700257662H1 |
| 700266623H1 | 700265866H1 | 700256851H1 | 700260402H1 | 700262213H1 | 700261368H1 |
| 700263189H1 | 700267456H1 | 700257170H1 | 700263528H1 | 700259378H1 | 700265447H1 |
| 700257694H1 | 700260277H1 | 700265637H1 | 700258588H1 | 700265770H1 | 700266149H1 |
| 700263344H1 | 700261270H1 | 700264116H1 | 700258582H1 | 700264801H1 | 700256802H1 |
| 700265982H1 | 700267488H1 | 700266028H1 | 700207235H1 | 700259246H1 | 700268118H1 |
| 700263574H1 | 700265164H1 | 700257555H1 | 700258502H1 | 700266664H1 | 700207104H1 |
| 700268036H1 | 700258344H1 | 700266670H1 | 700267304H1 | 700258351H1 | 700263028H1 |
| 700262269H1 | 700264512H1 | 700267808H1 | 700257074H1 | 700261396H1 | 700261110H1 |
| 700265479H1 | 700262761H1 | 700266712H1 | 700258266H1 | 700256970H1 | 700256965H1 |
| 700257755H1 | 700259655H1 | 700258660H1 | 700266234H1 | 700261818H1 | 700266258H1 |
| 700260960H1 | 700263370H1 | 700263056H1 | 700264317H1 | 700263578H1 | 700265636H1 |
| 700266903H1 | 700265728H1 | 700264816H1 | 700258253H1 | 700264845H1 | 700264649H1 |
| 700258840H1 | 700264253H1 | 700265549H1 | 700261381H1 | 700257108H1 | 700265887H1 |
| 700259331H1 | 700257084H1 | 700258173H1 | 700264963H1 | 700266218H1 | 700259372H1 |
| 700262648H1 | 700264929H1 | 700263248H1 | 700257128H1 | 700264472H1 | 700265984H1 |
| 700261783H1 | 700256748H1 | 700207179H1 | 700264218H1 | 700257778H1 | 700264655H1 |
| 700257556H1 | 700259369H1 | 700258138H1 | 700258101H1 | 700262602H1 | 700259556H1 |
| 700266220H1 | 700265708H1 | 700258026H1 | 700257777H1 | 700256876H1 | 700262752H1 |
| 700264375H1 | 700267887H1 | 700264908H1 | 700264029H1 | 700262760H1 | 700261159H1 |
| 700264793H1 | 700265652H1 | 700261841H1 | 700265534H1 | 700265417H1 | 700258255H1 |
| 700264987H1 | 700256808H1 | 700260487H1 | 700263721H1 | 700261870H1 | 700261495H1 |
| 700263905H1 | 700265092H1 | 700266492H1 | 700262804H1 | 700266263H1 | 700264927H1 |
| 700257891H1 | 700265035H1 | 700262827H1 | 700266253H1 | 700268134H1 | 700263086H1 |
| 700267489H1 | 700266838H1 | 700262862H1 | 700265864H1 | 700268061H1 | 700261220H1 |
| 700267722H1 | 700265223H1 | 700258526H1 | 700264304H1 | 700258981H1 | 700264496H1 |
| 700264447H1 | 700259028H1 | 700257825H1 | 700261682H1 | 700262216H1 | 700264775H1 |
| 700267736H1 | 700266112H1 | 700263359H1 | 700265977H1 | 700262002H1 | 700262394H1 |
| 700262362H1 | 700258272H1 | 700259647H1 | 700267751H1 | 700262989H1 | 700258865H1 |
| 700257602H1 | 700263967H1 | 700262590H1 | 700265915H1 | 700266973H1 | 700261101H1 |
| 700258719H1 | 700262610H1 | 700267016H1 | 700258835H1 | 700263218H1 | 700261369H1 |
| 700258095H1 | 700264001H1 | 700262835H1 | 700258745H1 | 700265129H1 | 700258080H1 |
| 700266722H1 | 700260488H1 | 700267063H1 | 700257768H1 | 700268001H1 | 700263937H1 |
| 700259488H1 | 700265795H1 | 700266473H1 | 700264385H1 | 700265009H1 | 700263126H1 |
| 700258318H1 | 700268193H1 | 700263335H1 | 700263537H1 | 700264378H1 | 700258509H1 |
| 700258774H1 | 700261895H1 | 700259233H1 | 700256703H1 | 700260115H1 | 700264984H1 |
| 700268033H1 | 700260712H1 | 700268034H1 | 700266140H1 | 700265450H1 | 700267151H1 |
| 700266144H1 | 700265025H1 | 700262421H1 | 700262296H1 | 700267228H1 | 700267154H1 |
| 700265851H1 | 700259507H1 | 700267878H1 | 700258912H1 | 700264820H1 | 700267046H1 |
| 700262256H1 | 700265670H1 | 700267793H1 | 700266368H1 | 700264983H1 | 700264786H1 |
| 700260309H2 | 700258628H1 | 700259833H1 | 700265026H1 | 700259583H1 | 700266453H1 |
| 700258248H1 | 700264672H1 | 700260902H1 | 700266521H1 | 700267875H1 | 700266279H1 |
| 700266904H1 | 700267222H1 | 700258108H1 | 700258183H1 | 700260167H1 | 700267543H1 |
| 700260243H1 | 700264442H1 | 700267229H1 | 700265108H1 | 700207260H1 | 700259523H1 |
| 700266552H1 | 700262911H1 | | | | |

Percent of clones expressed: 10.07
Weak match to
g170696    Gbl1; storage protein TABLE 2-continued UNIQUE AND HOMOLOGOUS CLUSTERS IN SATMON022023
COPYRIGHT 1998 INCYTE PHARMACEUTICALS, INC.

Cluster number: 32
Cluster clones:  700262466H1  700260708H1  700257007H1  700264163H1  700267502H1
700263162H1  700260391H2  700256778H1  700266425H1  700258188H1  700265862H1
700266815H1  700265810H1  700263031H1  700260579H2  700262716H1  700260122H1
700265265H1  700259508H1  700257236H1  700264926H1  700266276H1  700263214H1
700263151H1  700259182H2  700261316H1  700264913H1  700261711H1  700267126H1
700263424H1  700263709H1  700259082H1  700263821H1  700267434H1  700257190H1
700267983H1  700260881H1  700266513H1  700258154H1  700260157H1  700266014H1
700265274H1  700265089H1  700261140H1  700259465H1  700267633H1  700263527H1
700258391H1  700266293H1  700265790H1  700263232H1  700259348H1  700266820H1
700266530H1  700258041H1  700264806H1  700261626H1  700257744H1  700263393H1
700258482H1  700267263H1  700259102H2  700266127H1  700268130H1  700263186H1
700264133H1  700267995H1  700266064H1  700267944H1  700262543H1  700263061H1
700261889H1  700266048H1  700266039H1  700258291H1  700261071H1  700258294H1
700261027H1  700267393H1  700207247H1  700258211H1  700263132H1  700262478H1
700265360H1  700266895H1  700266553H1  700258306H1  700207205H1  700267570H1
700258756H1  700257959H1  700263886H1  700258916H1  700261175H1  700263801H1
700266867H1  700262407H1  700260823H1  700261679H1  700268025H1  700261096H1
700258692H1  700263033H1  700257908H1  700257912H1  700257554H1  700264982H1
700263296H1  700267355H1  700259096H1  700258862H1  700262046H1  700258014H1
700264511H1  700264124H1  700207273H1  700267283H1  700257308H1  700264440H1
700259844H1  700259680H1  700264428H1  700259088H1  700257869H1  700262922H1
700268021H1  700261141H1  700264853H1  700261742H1  700264943H1  700257330H1
700267428H1  700259622H1  700267352H1  700262207H1  700260489H1  700257611H1
700265039H1  700263592H1  700264504H1  700265493H1  700266874H1  700260012H1
700258310H1  700256726H1  700257954H1  700259657H1  700266317H1  700266633H1
700257995H1  700259473H1  700261712H1  700256924H1  700261370H1  700261013H1
700263341H1  700257943H1  700259025H1  700265658H1  700265001H1  700264393H1
700262939H1  7002S8015H1  700264680H1  700266656H1  700258096H1  700268165H1
700267077H1  700264106H1  700262774H1  700267763H1  700263534H1  700261085H1
700267959H1  700267337H1  700264249H1  700257106H1  700261094H1  700263865H1
700268108H1  700262883H1  700257895H1  700264016H1  700256757H1  700258063H1
700268012H1  700257942H1  700259349H1  700265861H1  700207220H1  700257981H1
700266111H1  700267418H1  700263941H1  700259412H1  700263775H1  700264280H1
700265387H1  700259355H1  700260922H1  700259413H1  700266452H1  700257068H1
700263608H1  700266465H1  700257754H1  700262306H1  700267615H1  700257820H1
700261903H1  700257918H1  700267169H1  700257787H1  700264928H1  700265706H1
Percent of clones expressed: 6.00
Homologous match to
g22284  Glb1-L; vicilin-like embryo storage protein
Cluster number: 21
Cluster clones:  700267167H1  700258189H1  700256910H1  700261221H1  700263825H1
700267469H1  700264321H1  700257769H1  700264452H1  700207169H1  700261561H1
700258871H1  700207275H1  700264683H1  700266653H1  700265105H1  700259422H1
700267007H1  700262245H1  700258135H1  700265995H1  700262811H1  700264794H1
700259715H1  700258087H1  700267865H1  700259520H1  700258682H1  700265606H1
Percent of clones expressed: 0.81
Weak match to
g1800227  Bowman-Birk proteinase inhibitor
Cluster number: 88
Cluster clones:  700267974H1  700266835H1  700261022H1  700262627H1 700267273H1
700258078H1  700266856H1  700266441H1  700263253H1  700261757H1 700266781H1
700267673H1  700266691H1  700257041H1  700265653H1  700259016H1 700260279H1
700262266H1  700256832H1  700264956H1  700259170H2  700258603H1 700257444H2
700260977H1  700260620H1  700262568H1  700267318H1  700262820H1 700266419H1
Percent of clones expressed: 0.81
Homologous match to
g633889  glucose and ribitol dehydrogenase homolog [Hordeum vulgare = barley,
Aura, embryo, mRNA, 1170 nt].
Cluster number: 90
Cluster clones:  700265715H1  700264424H1  700257976H1  700257102H1  700256838H1
700268188H1  700267630H1  700260938H1  700258727H1  700262830H1  700264569H1
700264727H1  700267834H1  700263361H1  700265702H1  700258993H1  700265453H1
700262890H1  700257676H1  700258779H1  700258510H1  700262045H1  700265550H1
700262548H1  700267779H1  700263845H1  700261609H1
Percent of clones expressed: 0.75
Homologous match to
g1421750  Pisum sativum S-adenosylmethionine decarboxylase mRNA, complete
cds.
Cluster number: 99
Cluster clones:  700257656H1  700257725H1  700256862H1  700266893H1  700268195H1
700262789H1  700267316H1  700259365H1  700263428H1  700258775H1  700259085H1
700260746H1  700258990H1  700261880H1  700266312H1  700264243H1  700259356H1
700266412H1  700262645H1  700266408H1  700260466H1
Percent of clones expressed: 0.59
Cluster number: 358

TABLE 2-continued

UNIQUE AND HOMOLOGOUS CLUSTERS IN SATMON022023
COPYRIGHT 1998 INCYTE PHARMACEUTICALS, INC.

| | | | | | |
|---|---|---|---|---|---|
| Cluster clones: | 700265134H1 | 700263153H1 | 700259662H1 | 700266379H1 | 700266354H1 |
| 700265821H1 | 700264808H1 | 700260444H1 | 700264365H1 | 700263672H1 | 700263083H1 |
| 700266037H1 | 700260033H1 | 700262722H1 | 700262421H1 | 700265780H1 | 700262477H1 |
| 700264418H1 | 700258848H1 | 700261386H1 | | | |

Percent of clones expressed: 0.56
Homologous match to
g790640      Hordeum vulgare gamma-thionin (HTH3) mRNA, complete cds.
Cluster number: 180

| | | | | | |
|---|---|---|---|---|---|
| Cluster clones: | 700259612H1 | 700263249H1 | 700265041H1 | 700267236H1 | 700265850H1 |
| 700267348H1 | 700257354H1 | 700260538H2 | 700262454H1 | 700261340H1 | 700267903H1 |
| 700261432H1 | 700260163H1 | 700267153H1 | 700257945H1 | 700266201H1 | 700263648H1 |
| 700266093H1 | 700261610H1 | 700258061H1 | | | |

Percent of clones expressed: 0.56
Weak match to
g1592681      LEA D113 homologue type2
Cluster number: 120

| | | | | | |
|---|---|---|---|---|---|
| Cluster clones: | 700264748H1 | 700258267H1 | 700265586H1 | 700264366H1 | 700257033H1 |
| 700263504H1 | 700266344H1 | 700258339H1 | 700264493H1 | 700267054H1 | 700257827H1 |
| 700257587H1 | 700265472H1 | 700207231H1 | 700267781H1 | 700264335H1 | 700258332H1 |

Percent of clones expressed: 0.47
Homologous match to
g454303      LDJ2
Cluster number: 52

| | | | | | |
|---|---|---|---|---|---|
| Cluster clones: | 700258305H1 | 700262158H1 | 700257691H1 | 700266695H1 | 700265608H1 |
| 700259683H1 | 700263760H1 | 700264204H1 | 700207282H1 | 700261212H1 | 700258308H1 |
| 700207277H1 | 700259831H1 | 700260674H1 | 700266876H1 | 700262808H1 | |

Percent of clones expressed: 0.45
Homologous match to
g2832620      F13C5.90; hypothetical protein
Cluster number: 257

| | | | | | |
|---|---|---|---|---|---|
| Cluster clones: | 700267512H1 | 700258403H1 | 700258089H1 | 700266437H1 | 700261740H1 |
| 700262787H1 | 700259448H1 | 700261277H1 | 700259684H1 | 700262694H1 | 700265466H1 |
| 700261707H1 | 700262359H1 | 700266760H1 | 700266448H1 | | |

Percent of clones expressed: 0.42
Cluster number: 264

| | | | | | |
|---|---|---|---|---|---|
| Cluster clones: | 700266361H1 | 700258485H1 | 700262567H1 | 700265175H1 | 700267963H1 |
| 700258148H1 | 700260185H1 | 700260314H2 | 700266888H1 | 700264396H1 | 700258766H1 |
| 700258870H1 | 700265550H1 | 700261858H1 | | | |

Percent of clones expressed: 0.39
Weak match to
g16427      protease inhibitor II
Cluster number: 75

| | | | | | |
|---|---|---|---|---|---|
| Cluster clones: | 700265949H1 | 700260414H1 | 700266176H1 | 700264322H1 | 700263996H1 |
| 700266170H1 | 700266571H1 | 700265918H1 | 700256771H1 | 700258511H1 | 700258468H1 |
| 700262356H1 | | | | | |

Percent of clones expressed: 0.33
Weak match to
g2832620      F13C5.90; hypothetical protein
Cluster number: 101

| | | | | | |
|---|---|---|---|---|---|
| Cluster clones: | 700266946H1 | 700265562H1 | 700256892H1 | 700259530H1 | 700259485H1 |
| 700265239H1 | 700265655H1 | 700263876H1 | 700262284H1 | 700258224H1 | 700263408H1 |
| 700261292H1 | | | | | |

Percent of clones expressed: 0.33
Homologous match to
g20163      O. sativa Rr15 mRNA for 5S ribosomal RNA.
Cluster number: 205

| | | | | | |
|---|---|---|---|---|---|
| Cluster clones: | 700257617H1 | 700265824H1 | 700267646H1 | 700264201H1 | 700260349H2 |
| 700265062H1 | 700259547H1 | 700267206H1 | 700264427H1 | 700268030H1 | 700258167H1 |

Percent of clones expressed: 0.31
Homologous match to
g2760173      Arabidopsis thaliana genomic DNA, chromosome 5, Pl clone: MYH19, complete sequence.
Cluster number: 231

| | | | | | |
|---|---|---|---|---|---|
| Cluster clones: | 700266489H1 | 700263485H1 | 700266387H1 | 700257830H1 | 700263468H1 |
| 700262396H1 | 700258694H1 | 700267409H1 | 700263624H1 | 700263674H1 | |

Percent of clones expressed: 0.28
Cluster number: 258

| | | | | | |
|---|---|---|---|---|---|
| Cluster clones: | 700261803H1 | 700263974H1 | 700260780H1 | 700259393H1 | 700258265H1 |
| 700262738H1 | 700258430H1 | 700261306H1 | 700264991H1 | 700258090H1 | |

Percent of clones expressed: 0.28
Cluster number: 249

| | | | | | |
|---|---|---|---|---|---|
| Cluster clones: | 700266869H1 | 700267322H1 | 700266456H1 | 700267450H1 | 700265979H1 |
| 700261039H1 | 700258032H1 | 700261964H1 | 700268020H1 | 700263950H1 | |

Percent of clones expressed: 0.28
Cluster number: 54

| | | | | | |
|---|---|---|---|---|---|
| Cluster clones: | 700257226H1 | 700267172H1 | 700266256H1 | 700262731H1 | 700261788H1 |

TABLE 2-continued

UNIQUE AND HOMOLOGOUS CLUSTERS IN SATMON022023
COPYRIGHT 1998 INCYTE PHARMACEUTICALS, INC.

| | | | | | |
|---|---|---|---|---|---|
| 700257689H1 | 700207281H1 | 700259590H1 | 700262438H1 | 700267180H1 | |
| Percent of clones expressed: 0.28 | | | | | |
| Homologous match to | | | | | |
| g1743006 | C. paradoxa mRNA for ribosomal protein L13a. | | | | |
| Cluster number: 68 | | | | | |
| Cluster clones: | 700268175H1 | 700260322H1 | 700256852H1 | 700258221H1 | 700266545H1 |
| 700261430H1 | 700259522H1 | 700256736H1 | 700266036H1 | 700262977H1 | |
| Percent of clones expressed: 0.28 | | | | | |
| Cluster number: 64 | | | | | |
| Cluster clones: | 700256988H1 | 700266457H1 | 700267622H1 | 700256718H1 | 700261674H1 |
| 700263238H1 | 700258233H1 | 700257728H1 | 700267552H1 | | |
| Percent of clones expressed: 0.25 | | | | | |
| Homologous match to | | | | | |
| g169295 | Pharbitis nil heat shock protein 83 (Hsp83) gene, complete cds. | | | | |
| Cluster number: 476 | | | | | |
| Cluster clones: | 700264630H1 | 700261920H1 | 700266832H1 | 700267260H1 | 700263521H1 |
| 700263725H1 | 700261886H1 | 700261387H1 | | | |
| Percent of clones expressed: 0.22 | | | | | |
| Homologous match to | | | | | |
| g1212995 | H. vulgare mRNA for UDP-glucose pyrophosphorylase. | | | | |
| Cluster number: 98 | | | | | |
| Cluster clones: | 700258832H1 | 700256860H1 | 700261329H1 | 700267893H1 | 700261253H1 |
| 700259675H1 | 700257631H1 | 700267232H1 | | | |
| Percent of clones expressed: 0.22 | | | | | |
| Homologous match to | | | | | |
| g396254 | 40S ribosomal protein S5 | | | | |
| Cluster number: 72 | | | | | |
| Cluster clones: | 700257107H1 | 700257075H1 | 700266325H1 | 700263617H1 | 700265707H1 |
| 700257969H1 | 700256755H1 | | | | |
| Percent of clones expressed: 0.20 | | | | | |
| Cluster number: 440 | | | | | |
| Cluster clones: | 700266986H1 | 700260567H1 | 700265630H1 | 700266351H1 | 700260668H1 |
| 700263949H1 | 700263164H1 | | | | |
| Percent of clones expressed: 0.20 | | | | | |
| Cluster number: 342 | | | | | |
| Cluster clones: | 700261771H1 | 700259341H1 | 700264693H1 | 700261656H1 | 700262506H1 |
| 700261724H1 | 700258662H1 | | | | |
| Percent of clones expressed: 0.20 | | | | | |
| Cluster number: 294 | | | | | |
| Cluster clones: | 700266583H1 | 700266548H1 | 700264583H1 | 700264245H1 | 700263490H1 |
| 700258357H1 | 700259615H1 | | | | |
| Percent of clones expressed: 0.20 | | | | | |
| Cluster number: 192 | | | | | |
| Cluster clones: | 700257511H1 | 700266333H1 | 700257687H1 | 700267246H1 | 700265570H1 |
| 700267326H1 | 700261478H1 | | | | |
| Percent of clones expressed: 0.20 | | | | | |
| Cluster number: 438 | | | | | |
| Cluster clones: | 700266917H1 | 700262709H1 | 700262001H1 | 700263738H1 | 700264819H1 |
| 0700260532H2 | 700262203H1 | | | | |
| Percent of clones expressed: 0.20 | | | | | |
| Cluster number: 9 | | | | | |
| Cluster clones: | 700261709H1 | 700259705H1 | 700267119H1 | 700265660H1 | 700258955H1 |
| 700207134H1 | 700258410H1 | | | | |
| Percent of clones expressed: 0.20 | | | | | |
| Homologous match to | | | | | |
| g2494121 | T1G11.19 | | | | |
| Cluster number: 66 | | | | | |
| Cluster clones: | 700264084H1 | 700256728H1 | 700264194H1 | 700268194H1 | 700261210H1 |
| 700265442H1 | 700266757H1 | | | | |
| Percent of clones expressed: 0.20 | | | | | |
| Weak match to | | | | | |
| g1160445 | ribosomal protein S7 | | | | |
| Cluster number: 460 | | | | | |
| Cluster clones: | 700265525H1 | 700267628H1 | 700261056H1 | 700265289H1 | 700266053H1 |
| 700267290H1 | 700261283H1 | | | | |
| Percent of clones expressed: 0.20 | | | | | |
| Weak match to | | | | | |
| g162469 | VSG; variant surface glycoprotein | | | | |
| Cluster number: 425 | | | | | |
| Cluster clones: | 700260332H2 | 700267030H1 | 700265094H1 | 700264181H1 | 700264574H1 |
| 700260570H2 | | | | | |
| Percent of clones expressed: 0.17 | | | | | |
| Cluster number: 592 | | | | | |
| Cluster clones: | 700264139H1 | 700263938H1 | 700264676H1 | 700265259H1 | 700267018H1 |

TABLE 2-continued

UNIQUE AND HOMOLOGOUS CLUSTERS IN SATMON022023
COPYRIGHT 1998 INCYTE PHARMACEUTICALS, INC.

700265392H1
Percent of clones expressed: 0.17
Cluster number: 335
Cluster clones: 700265438H1 700258594H1 700261410H1 700267906H1 700262920H1
700264707H1
Percent of clones expressed: 0.17
Homologous match to
g2213424 Citrus paradisi mRNA for hypothetical protein.
Cluster number: 224
Cluster clones: 700257774H1 700264669H1 700265536H1 700261607H1 700258878H1
700264359H1
Percent of clones expressed: 0.17
Homologous match to
g2342735 T14G11.28
Cluster number: 230
Cluster clones: 700267947H1 700258505H1 700259311H1 700264269H1 700257823H1
700264967H1
Percent of clones expressed: 0.17
Cluster number: 422
Cluster clones: 700261564H1 700265121H1 700260272H1 700262380H1 700262448H1
700267265H1
Percent of clones expressed: 0.17
Weak match to
g2827524 F8F16.110; predicted protein
Cluster number: 35
Cluster clones: 700261169H1 700258239H1 700262652H1 700207217H1 700265563H1
700266647H1
Percent of clones expressed: 0.17
Cluster number: 96
Cluster clones: 700266307H1 700266662H1 700256856H1 700257762H1 700266628H1
700265439H1
Percent of clones expressed: 0.17
Homologous match to
g14800.17 Brassica rapa mRNA for ribosomal protein, complete cds.
Cluster number: 255
Cluster clones: 700264867H1 700263715H1 700258075H1 700267790H1 700263114H1
700265277H1
Percent of clones expressed: 0.17
Cluster number: 291
Cluster clones: 700264480H1 700264653H1 700258335H1 700262736H1 700263124H1
700264486H1
Percent of clones expressed: 0.17
Cluster number: 245
Cluster clones: 700263241H1 700260565H2 700264468H1 700257991H1 700260815H1
Percent of clones expressed: 0.14
Cluster number: 462
Cluster clones: 700264242H1 700265846H1 700261133H1 700267833H1 700262251H1
Percent of clones expressed: 0.14
Homologous match to
g2443890 F11P17.16
Cluster number: 167
Cluster clones: 700266907H1 700265819H1 700267629H1 700267912H1 700257223H1
Percent of clones expressed: 0.14
Homologous match to
g296204 pA1aAT-2; alanine aminotransferase; EC 2.6.1.2
Cluster number: 92
Cluster clones: 700264421H1 700267685H1 700267657H1 700256844H1 700264290H1
Percent of clones expressed: 0.14
Homologous match to
g393706 C. sativus mRNA for 3-ketoacyl-CoA thiolase.
Cluster number: 276
Cluster clones: 700261018H1 700262529H1 700263381H1 700258214H1 700262952H1
Percent of clones expressed: 0.14
Cluster number: 69
Cluster clones: 700263991H1 700256737H1 700262622H1 700261566H1 700256911H1
Percent of clones expressed: 0.14
Weak match to
g1016086 groES-A; molecular chaperone; chaperonin; heat-shock protein;
protein folding; GroES
Cluster number: 23
Cluster clones: 700263384H1 700267961H1 700207173H1 700267908H1 700265526H1
Percent of clones expressed: 0.14
Weak match to
g2264302 Arabidopsis thaliana genomic DNA, chromosome 5, P1 clone: MAC12,
complete sequence.
Cluster number: 588

TABLE 2-continued

UNIQUE AND HOMOLOGOUS CLUSTERS IN SATMON022023
COPYRIGHT 1998 INCYTE PHARMACEUTICALS, INC.

| | | | | | |
|---|---|---|---|---|---|
| Cluster clones: | 700266974H1 | 700264673H1 | 700265090H1 | 700263806H1 | 700264450H1 |
| Percent of clones expressed: 0.14 | | | | | |
| Weak match to | | | | | |
| g22447 | Zea mays ZMPMS2 gene for 19 kDa zein protein. | | | | |
| Cluster number: 318 | | | | | |
| Cluster clones: | 700264429H1 | 700262992H1 | 700258507H1 | 700259063H1 | 700260010H1 |
| Percent of clones expressed: 0.14 | | | | | |
| Homologous match to | | | | | |
| g1519252 | Oryza sativa GF14-d protein mRNA, complete cds. | | | | |
| Cluster number: 267 | | | | | |
| Cluster clones: | 700258159H1 | 700263077H1 | 700266981H1 | 700267115H1 | 700262418H1 |
| Percent of clones expressed: 0.14 | | | | | |
| Homologous match to | | | | | |
| g2288886 | Arabidopsis thaliana mRNA for mevalonate diphosphate decarboxylase. | | | | |
| Cluster number: 243 | | | | | |
| Cluster clones: | 700257965H1 | 700265374H1 | 700258055H1 | 700262231H1 | 700259027H1 |
| Percent of clones expressed: 0.14 | | | | | |
| Weak match to | | | | | |
| g556685 | Z. mays mRNA for ADP-ribosylation factor. | | | | |
| Cluster number: 111 | | | | | |
| Cluster clones: | 700258116H1 | 700261945H1 | 700256950H1 | 700266476H1 | 700263411H1 |
| Percent of clones expressed: 0.14 | | | | | |
| Cluster number: 559 | | | | | |
| Cluster clones: | 700263110H1 | 700267827H1 | 700268088H1 | 700267012H1 | 700266134H1 |
| Percent of clones expressed: 0.14 | | | | | |
| Cluster number: 191 | | | | | |
| Cluster clones: | 700262015H1 | 700258572H1 | 700257492H1 | 700265255H1 | |
| Percent of clones expressed: 0.11 | | | | | |
| Homologous match to | | | | | |
| g1711035 | Pisum sativum hydroxyproline rich glycoprotein PsHRGP1 mRNA, partial cds. | | | | |
| Cluster number: 547 | | | | | |
| Cluster clones: | 700263260H1 | 700262902H1 | 700264453H1 | 700263762H1 | |
| Percent of clones expressed: 0.11 | | | | | |
| Homologous match to | | | | | |
| g2821955 | spermidme synthase 1; EC 2.5.1.16 | | | | |
| Cluster number: 416 | | | | | |
| Cluster clones: | 700263540H1 | 700263115H1 | 700260162H1 | 700261839H1 | |
| Percent of clones expressed: 0.11 | | | | | |
| Weak match to | | | | | |
| g454872 | Maize mRNA for group 3 Lea protein MGL3, complete cds. | | | | |
| Cluster number: 606 | | | | | |
| Cluster clones: | 700266062H1 | 700265189H1 | 700264284H1 | 700267187H1 | |
| Percent of clones expressed: 0.11 | | | | | |
| Homologous match to | | | | | |
| g563234 | Zea mays xyloglucan endo-transglycosylase homolog gene, complete cds. | | | | |
| Cluster number: 271 | | | | | |
| Cluster clones: | 700265046H1 | 700258185H1 | 700258961H1 | 700265820H1 | |
| Percent of clones expressed: 0.11 | | | | | |
| Homologous match to | | | | | |
| g438279 | Ribosomal protein L7 | | | | |
| Cluster number: 397 | | | | | |
| Cluster clones: | 700259525H1 | 700259494H1 | 700263195H1 | 700265540H1 | |
| Percent of clones expressed: 0.11 | | | | | |
| Cluster number: 321 | | | | | |
| Cluster clones: | 700264187H1 | 700267217H1 | 700266953H1 | 700258523H1 | |
| Percent of clones expressed: 0.11 | | | | | |
| Homologous match to | | | | | |
| g669002 | Glycine max calnexin mRNA, complete cds. | | | | |
| Cluster number: 280 | | | | | |
| Cluster clones: | 700265071H1 | 700266965H1 | 700258259H1 | 700261654H1 | |
| Percent of clones expressed: 0.11 | | | | | |
| Cluster number: 481 | | | | | |
| Cluster clones: | 700266129H1 | 700267444H1 | 700261486H1 | 700265872H1 | |
| Percent of clones expressed: 0.11 | | | | | |
| Homologous match to | | | | | |
| g2465430 | JRG1.3; 32 kDa protein | | | | |
| Cluster number: 566 | | | | | |
| Cluster clones: | 700263243H1 | 700265040H1 | 700263819H1 | 700264425H1 | |
| Percent of clones expressed: 0.11 | | | | | |
| Cluster number: 410 | | | | | |
| Cluster clones: | 700266952H1 | 700261492H1 | 700263783H1 | 700260015H1 | |
| Percent of clones expressed: 0.11 | | | | | |
| Weak match to | | | | | |

TABLE 2-continued

UNIQUE AND HOMOLOGOUS CLUSTERS IN SATMON022023
COPYRIGHT 1998 INCYTE PHARMACEUTICALS, INC.

| | | | | |
|---|---|---|---|---|
| g2300247 | unnamed protein product | | | |
| Cluster number: 14 | | | | |
| Cluster clones: | 700257546H1 | 700207153H1 | 700264432H1 | 700263105H1 |
| Percent of clones expressed: 0.11 | | | | |
| Weak match to | | | | |
| g2688824 | putative auxin-repressed protein | | | |
| Cluster number: 333 | | | | |
| Cluster clones: | 700264771H1 | 700266859H1 | 700258583H1 | 700258940H1 |
| Percent of clones expressed: 0.11 | | | | |
| Weak match to | | | | |
| g1800227 | Bowman-Birk proteinase inhibitor | | | |
| Cluster number: 375 | | | | |
| Cluster clones: | 700265896H1 | 700259044H1 | 700266962H1 | 700260571H2 |
| Percent of clones expressed: 0.11 | | | | |
| Homologous match to | | | | |
| g1142698 | NADPH-dependent aldehyde reductase; EC 1.1.1.2 | | | |
| Cluster number: 293 | | | | |
| Cluster clones: | 700258352H1 | 700262515H1 | 700259130H2 | 700265934H1 |
| Percent of clones expressed: 0.11 | | | | |
| Homologous match to | | | | |
| g2244749 | hydroxymethyltransferase | | | |
| Cluster number: 408 | | | | |
| Cluster clones: | 700259823H1 | 700267065H1 | 700266174H1 | 700266734H1 |
| Percent of clones expressed: 0.11 | | | | |
| Homologous match to | | | | |
| g960356 | Barley mRNA for S-adenosylmethionine synthetase, complete cds. | | | |
| Cluster number: 212 | | | | |
| Cluster clones: | 700257670H1 | 700259160H2 | 700259542H1 | 700259301H1 |
| Percent of clones expressed: 0.11 | | | | |
| Cluster number: 451 | | | | |
| Cluster clones: | 700262293H1 | 700263135H1 | 700267737H1 | 700260760H1 |
| Percent of clones expressed: 0.11 | | | | |
| Homologous match to | | | | |
| g1143392 | uridine diphosphate glucose epimerase; EC 5.1.3.2 | | | |
| Cluster number: 41 | | | | |
| Cluster clones: | 700262984H1 | 700266019H1 | 700207239H1 | 700261279H1 |
| Percent of clones expressed: 0.11 | | | | |
| Cluster number: 552 | | | | |
| Cluster clones: | 700263734H1 | 700263034H1 | 700265064H1 | 700266549H1 |
| Percent of clones expressed: 0.11 | | | | |
| Cluster number: 490 | | | | |
| Cluster clones: | 700264560H1 | 700264818H1 | 700261649H1 | 700264077H1 |
| Percent of clones expressed: 0.11 | | | | |
| Homologous match to | | | | |
| g218340 | Triticum aestivum mRNA for elongation factor 1 beta'. | | | |
| Cluster number: 275 | | | | |
| Cluster clones: | 700262929H1 | 700258213H1 | 700259539H1 | 700259628H1 |
| Percent of clones expressed: 0.11 | | | | |
| Weak match to | | | | |
| g1171353 | Oryza sativa 18 kDa oleosin mRNA, complete cds. | | | |
| Cluster number: 469 | | | | |
| Cluster clones: | 700262208H1 | 700268183H1 | 700264624H1 | 700261178H1 |
| Percent of clones expressed: 0.11 | | | | |
| Homologous match to | | | | |
| g2564051 | Arabidopsis thaliana genomic DNA, chromosome 5, P1 clone: MWD9, complete sequence. | | | |
| Cluster number: 301 | | | | |
| Cluster clones: | 700259673H1 | 700258414H1 | 700260688H1 | 700267071H1 |
| Percent of clones expressed: 0.11 | | | | |
| Homologous match to | | | | |
| g1143444 | E. gunnii mRNA for cinnamyl alcohol dehydrogenase. | | | |
| Cluster number: 584 | | | | |
| Cluster clones: | 700265529H1 | 700266072H1 | 700263669H1 | 700267123H1 |
| Percent of clones expressed: 0.11 | | | | |
| Weak match to | | | | |
| g304217 | Hordeum vulgare abscisic acid and stress inducible (A22) gene. | | | |
| Cluster number: 444 | | | | |
| Cluster clones: | 700261522H1 | 700260634H1 | 700264024H1 | 700262416H1 |
| Percent of clones expressed: 0.11 | | | | |
| Homologous match to | | | | |
| g1388076 | TRX3; thioredoxin h | | | |
| Cluster number: 387 | | | | |
| Cluster clones: | 700265966H1 | 700264383H1 | 700265018H1 | 700259245H1 |
| Percent of clones expressed: 0.11 | | | | |
| Homologous match to | | | | |
| g2351061 | Arabidopsis thaliana genomic DNA, chromosome 5, P1 clone: MAF19. | | | |

TABLE 2-continued

UNIQUE AND HOMOLOGOUS CLUSTERS IN SATMON022023
COPYRIGHT 1998 INCYTE PHARMACEUTICALS, INC.

Cluster number: 361
Cluster clones:　　　700267149H1　　　700260585H2　　　700266604H1　　　700258877H1
Percent of clones expressed: 0.11
Homologous match to
g1403024　　　　　hnRNP protein
Cluster number: 211
Cluster clones:　　　700257658H1　　　700267161H1　　　700266275H1　　　700266438H1
Percent of clones expressed: 0.11
Homologous match to
g2465430　　　　　JRG1.3; 32 kDa protein
Cluster number: 125
Cluster clones:　　　700260282H1　　　700257048H1　　　700261866H1
Percent of clones expressed: 0.08
Cluster number: 521
Cluster clones:　　　700264510H1　　　700262355H1　　　700263001H1
Percent of clones expressed: 0.08
Homologous match to
g469147　　　　　H. vulgare mRNA for alanine aminotransferase.
Cluster number: 263
Cluster clones:　　　700258129H1　　　700264049H1　　　700263038H1
Percent of clones expressed: 0.08
Cluster number: 157
Cluster clones:　　　700261526H1　　　700265777H1　　　700257177H1
Percent of clones expressed: 0.08
Cluster number: 307
Cluster clones:　　　700266909H1　　　700267852H1　　　700258434H1
Percent of clones expressed: 0.08
Cluster number: 435
Cluster clones:　　　700263054H1　　　700260517H1　　　700263790H1
Percent of clones expressed: 0.08
Cluster number: 121
Cluster clones:　　　700263966H1　　　700257036H1　　　700266056H1
Percent of clones expressed: 0.08
Cluster number: 195
Cluster clones:　　　700257520H1　　　700259317H1　　　700266406H1
Percent of clones expressed: 0.08
Cluster number: 641
Cluster clones:　　　700266666H1　　　700266655H1　　　700265158H1
Percent of clones expressed: 0.08
Homologous match to
g798817　　　　　A. thaliana mRNA for ribosomal protein L2.
Cluster number: 135
Cluster clones:　　　700265717H1　　　700267035H1　　　700257117H1
Percent of clones expressed: 0.08
Cluster number: 300
Cluster clones:　　　700264958H1　　　700258413H1　　　700263702H1
Percent of clones expressed: 0.08
Cluster number: 619
Cluster clones:　　　700267713H1　　　700266629H1　　　700264633H1
Percent of clones expressed: 0.08
Weak match to
g2632129　　　　　PARP; secondary protein modification; poly (ADP-ribose) polymerase
Cluster number: 48
Cluster clones:　　　700266862H1　　　700207262H1　　　700266045H1
Percent of clones expressed: 0.08
Cluster number: 529
Cluster clones:　　　700264625H1　　　700262486H1　　　700268029H1
Percent of clones expressed: 0.08
Homologous match to
g398921　　　　　B. napus cold induced protein (BnC24B).
Cluster number: 346
Cluster clones:　　　700267361H1　　　700262630H1　　　700258693H1
Percent of clones expressed: 0.08
Homologous match to
g218237　　　　　Rice mRNA for ribosomal protein S22 (T47 gene), partial sequence.
Cluster number: 265
Cluster clones:　　　700267537H1　　　700265273H1　　　700258149H1
Percent of clones expressed: 0.08
Cluster number: 228
Cluster clones:　　　700257789H1　　　700264354H1　　　700264628H1
Percent of clones expressed: 0.08
Cluster number: 550
Cluster clones:　　　700268046H1　　　700268054H1　　　700262986H1
Percent of clones expressed: 0.08
Cluster number: 58
Cluster clones:　　　700261347H1　　　700256705H1　　　700257329H1

TABLE 2-continued

UNIQUE AND HOMOLOGOUS CLUSTERS IN SATMON022023
COPYRIGHT 1998 INCYTE PHARMACEUTICALS, INC.

Percent of clones expressed: 0.08
Weak match to
g1707239           C07D8.6
Cluster number: 114
Cluster clones:    700261801H1    700257005H1    700263754H1
Percent of clones expressed: 0.08
Weak match to
g1171347           Triticum aestivum pMA1951 mRNA, partial cds.
Cluster number: 242
Cluster clones:    700259586H1    700267095H1    700257938H1
Percent of clones expressed: 0.08
Homologous match to
g20320             rab25; rab25 product
Cluster number: 533
Cluster clones:    700262629H1    700267330H1    700262839H1
Percent of clones expressed: 0.08
Homologous match to
g2656031           Arabidopsis thaliana genomic DNA, chromosome 5, P1 clone: MXC20.
Cluster number: 564
Cluster clones:    700263159H1    700265491H1    700267294H1
Percent of clones expressed: 0.08
Cluster number: 393
Cluster clones:    700262817H1    700263030H1    700259385H1
Percent of clones expressed: 0.08
Weak match to
g2393722           glutathione-S-transferase homolog
Cluster number: 151
Cluster clones:    700257162H1    700267969H1    700265762H1
Percent of clones expressed: 0.08
Cluster number: 168
Cluster clones:    700257258H1    700263237H1    700266190H1
Percent of clones expressed: 0.08
Cluster number: 497
Cluster clones:    700265448H1    700268074H1    700261810H1
Percent of clones expressed: 0.08
Cluster number: 620
Cluster clones:    700265470H1    700264635H1    700265003H1
Percent of clones
expressed: 0.08
Homologous match
to
g170901            peroxisomal membrane protein (PMP20B)
Cluster number: 530
Cluster clones:    700263455H1    700267885H1    700262526H1
Percent of clones expressed: 0.08
Homologous match to
g1552830           similar to S. cerevisiae YLL062c
Cluster number: 340
Cluster clones:    700265583H1    700258636H1    700265983H1
Percent of clones expressed: 0.08
Cluster number: 315
Cluster clones:    700258493H1    700266323H1    700266114H1
Percent of clones expressed: 0.08
Homologous match to
g804655            Hordeum vulgare L. beta-glucosidase (BGQ60) gene, complete cds.
Cluster number: 261
Cluster clones:    700265481H1    700260558H1    700258115H1
Percent of clones expressed: 0.08
Cluster number: 357
Cluster clones:    700262681H1    700258845H1    700264134H1
Percent of clones expressed: 0.08
Cluster number: 367
Cluster clones:    700260934H1    700262655H1    700258964H1
Percent of clones expressed: 0.08
Cluster number: 635
Cluster clones:    700266423H1    700265291H1    700264923H1
Percent of clones expressed: 0.08
Homologous match to
g1814401           phosphoglucomutase; EC 5.4.2.2
Cluster number: 277
Cluster clones:    700258235H1    700259019H1    700263158H1
Percent of clones expressed: 0.08
Cluster number: 268
Cluster clones:    700263347H1    700264601H1    700258160H1
Percent of clones expressed: 0.08
Cluster number: 400

TABLE 2-continued

UNIQUE AND HOMOLOGOUS CLUSTERS IN SATMON022023
COPYRIGHT 1998 INCYTE PHARMACEUTICALS, INC.

Cluster clones: 700260683H1 700265686H1 700259607H1
Percent of clones expressed: 0.08
Homologous match to
g2388968 SPAC31G5.17c; 40s ribosomal protein
Cluster number: 260
Cluster clones: 700268090H1 700263331H1 700258112H1
Percent of clones expressed: 0.08
Homologous match to
g19538 M. crystallinum mRNA for ribosomal protein YL16.
Cluster number: 383
Cluster clones: 700264817H1 700259208H1 700267876H1
Percent of clones expressed: 0.08
Homologous match to
g1245452 Medicago sativa 3-deoxy-D-arabino-heptulosonate 7-phosphate
 synthase (MsDHS1) mRNA, partial cds.
Cluster number: 53
Cluster clones: 700207279H1 700262950H1 700256840H1
Percent of clones expressed: 0.08
Cluster number: 162
Cluster clones: 700257193H1 700265793H1 700263359H1
Percent of clones expressed: 0.08
Cluster number: 366
Cluster clones: 700264784H1 700264285H1 700258956H1
Percent of clones expressed: 0.08
Homologous match to
g406050 Yeast (Schizosaccharomyces pombe) Let1 (let1) gene, complete cds.
Cluster number: 179
Cluster clones: 700257341H1 700263279H1 700268110H1
Percent of clones expressed: 0.08
Homologous match to
g2218135 UDPGDH; UDP-glucose dehydrogenase
Cluster number: 50
Cluster clones: 700258348H1 700261128H1 700207270H1
Percent of clones expressed: 0.08
Homologous match to
g2829211 Oryza sativa proteinase inhibitor (Rgpi9) gene, complete cds.
Cluster number: 326
Cluster clones: 700258534H1 700266094H1 700261031H1
Percent of clones expressed: 0.08
Homologous match to
g1272405 Arabidopsis thaliana immunophilin (FKBP15-1) mRNA, complete cds.
Cluster number: 28
Cluster clones: 700207193H1 700257816H1 700258328H1
Percent of clones expressed: 0.08
Cluster number: 166
Cluster clones: 700265859H1 700262853H1 700257217H1
Percent of clones expressed: 0.08
Homologous match to
g432367 Rice mRNA for elongation factor 1 beta, complete cds.
Cluster number: 504
Cluster clones: 700264544H1 700263476H1 700261883H1
Percent of clones expressed: 0.08
Cluster number: 562
Cluster clones: 700265902H1 700265804H1 700263149H1
Percent of clones expressed: 0.08
Cluster number: 452
Cluster clones: 700260777H1 700267494H1 700263205H1
Percent of clones expressed: 0.08
Cluster number: 97
Cluster clones: 700264974H1 700256857H1 700260886H1
Percent of clones expressed: 0.08
Homologous match to
g2632251 S. bicolor DNA for gene encoding putative protein serine/threonine
 kinase, clone cSNFL1.
Cluster number: 429
Cluster clones: 700266278H1 700260408H1 700265521H1
Percent of clones expressed: 0.08
Homologous match to
g168481 globulin precursor
Cluster number: 685
Cluster clones: 700266991H1 700266791H1 700267302H1
Percent of clones expressed: 0.08
Cluster number: 473
Cluster clones: 700267768H1 700261238H1 700266225H1
Percent of clones expressed: 0.08
Weak match to

TABLE 2-continued

UNIQUE AND HOMOLOGOUS CLUSTERS IN SATMON022023
COPYRIGHT 1998 INCYTE PHARMACEUTICALS, INC.

| | | | |
|---|---|---|---|
| g205942 | liver nuclear protein p47 | | |
| Cluster number: 105 | | | |
| Cluster clones: | 700258356H1 | 700256915H1 | 700260894H1 |
| Percent of clones expressed: 0.08 | | | |
| Cluster number: 555 | | | |
| Cluster clones: | 700263062H1 | 700266855H1 | 700266630H1 |
| Percent of clones expressed: 0.08 | | | |
| Weak match to | | | |
| g167245 | elongation factor 2 | | |
| Cluster number: 159 | | | |
| Cluster clones: | 700265781H1 | 700267672H1 | 700257181H1 |
| Percent of clones expressed: 0.08 | | | |
| Weak match to | | | |
| g506470 | N. tabacum mRNA pNLA-35. | | |
| Cluster number: 442 | | | |
| Cluster clones: | 700267359H1 | 700268169H1 | 700260582H2 |
| Percent of clones expressed: 0.08 | | | |
| Cluster number: 576 | | | |
| Cluster clones: | 700263386H1 | 700266617H1 | 700265839H1 |
| Percent of clones expressed: 0.08 | | | |
| Homologous match to | | | |
| g1675393 | Oryza sativa class III ADH enzyme (AdhIII) gene, complete cds. | | |
| Cluster number: 570 | | | |
| Cluster clones: | 700263969H1 | 700266624H1 | 700263316H1 |
| Percent of clones expressed: 0.08 | | | |
| Cluster number: 593 | | | |
| Cluster clones: | 700265188H1 | 700264553H1 | 700263948H1 |
| Percent of clones expressed: 0.08 | | | |
| Cluster number: 610 | | | |
| Cluster clones: | 700264364H1 | 700264726H1 | 700265002H1 |
| Percent of clones expressed: 0.08 | | | |
| Cluster number: 359 | | | |
| Cluster clones: | 700263735H1 | 700258860H1 | 700259672H1 |
| Percent of clones expressed: 0.08 | | | |
| Cluster number: 43 | | | |
| Cluster clones: | 700207242H1 | 700258128H1 | 700262733H1 |
| Percent of clones expressed: 0.08 | | | |
| Homologous match to | | | |
| g2673867 | Antirrhinum majus mRNA for fimbriata-associated protein 1, partial. | | |
| Cluster number: 119 | | | |
| Cluster clones: | 700266742H1 | 700266677H1 | 700257029H1 |
| Percent of clones expressed: 0.08 | | | |
| Homologous match to | | | |
| g1050839 | S. tuberosum mRNA for UlsnRNP-specific protein (U1A). | | |
| Cluster number: 31 | | | |
| Cluster clones: | 700207203H1 | 700265627H1 | |
| Percent of clones expressed: 0.06 | | | |
| Weak match to | | | |
| g2633671 | similar to hypothetical proteins | | |
| Cluster number: 589 | | | |
| Cluster clones: | 700263818H1 | 700267037H1 | |
| Percent of clones expressed: 0.06 | | | |
| Weak match to | | | |
| g2529657 | Arabidopsis thaliana chromosome II BAC T30B22 genomic sequence, complete sequence. | | |
| Cluster number: 623 | | | |
| Cluster clones: | 700264709H1 | 700267442H1 | |
| Percent of clones expressed: 0.06 | | | |
| Cluster number: 483 | | | |
| Cluster clones: | 700261552H1 | 700264829H1 | |
| Percent of clones expressed: 0.06 | | | |
| Cluster number: 355 | | | |
| Cluster clones: | 700258826H1 | 700267174H1 | |
| Percent of clones expressed: 0.06 | | | |
| Cluster number: 138 | | | |
| Cluster clones: | 700257129H1 | 700265729H1 | |
| Percent of clones expressed: 0.06 | | | |
| Cluster number: 406 | | | |
| Cluster clones: | 700260596H2 | 700259740H1 | |
| Percent of clones expressed: 0.06 | | | |
| Weak match to | | | |
| g2804277 | Panax ginseng mRNA for squalene epoxidase, complete cds. | | |
| Cluster number: 534 | | | |
| Cluster clones: | 700264445H1 | 700262663H1 | |
| Percent of clones expressed: 0.06 | | | |

TABLE 2-continued

UNIQUE AND HOMOLOGOUS CLUSTERS IN SATMON022023
COPYRIGHT 1998 INCYTE PHARMACEUTICALS, INC.

Cluster number: 176
Cluster clones: 700257313H1 700258228H1
Percent of clones expressed: 0.06
Cluster number: 662
Cluster clones: 790265882H1 700266083H1
Percent of clones expressed: 0.06
Homologous match to
g1632784 Nascent polypeptide associated complex protein alpha subunit
Cluster number: 160
Cluster clones: 700265782H1 700257182H1
Percent of clones expressed: 0.06
Homologous match to
g2264309 Arabidopsis thaliana genomic DNA, chromosome 5, P1 clone: MJJ3, complete sequence.
Cluster number: 679
Cluster clones: 700267663H1 700266562H1
Percent of clones expressed: 0.06
Cluster number: 678
Cluster clones: 700266931H1 700266529H1
Percent of clones expressed: 0.06
Cluster number: 445
Cluster clones: 700260660H1 700267439H1
Percent of clones expressed: 0.06
Homologous match to
g1212780 B. juncea mRNA for oleate desaturase.
Cluster number: 573
Cluster clones: 700263343H1 700266987H1
Percent of clones expressed: 0.06
Weak match to
g1015315 Pisum sativum (clone PsRCI35-2) ribosomal protein L41 mRNA, complete cds.
Cluster number: 624
Cluster clones: 700264725H1 700264805H1
Percent of clones expressed: 0.06
Cluster number: 661
Cluster clones: 700266404H1 700265661H1
Percent of clones expressed: 0.06
Cluster number: 137
Cluster clones: 700265722H1 700257122H1
Percent of clones expressed: 0.06
Homologous match to
g2760536 Lupinus luteus mRNA for cyclophilin.
Cluster number: 663
Cluster clones: 700265948H1 700267531H1
Percent of clones expressed: 0.06
Weak match to
g2654121 Arabidopsis thaliana ribosomal protein L23a (AtrpL23a) mRNA, complete cds.
Cluster number: 407
Cluster clones: 700266882H1 700259741H1
Percent of clones expressed: 0.06
Cluster number: 535
Cluster clones: 700266870H1 700262678H1
Percent of clones expressed: 0.06
Cluster number: 161
Cluster clones: 700265791H1 700257191H1
Percent of clones expressed: 0.06
Cluster number: 639
Cluster clones: 700267277H1 700265031H1
Percent of clones expressed: 0.06
Cluster number: 574
Cluster clones: 700263366H1 700263392H1
Percent of clones expressed: 0.06
Homologous match to
g567040 phosphoprotein phosphatase
Cluster number: 482
Cluster clones: 700261514H1 700262947H1
Percent of clones expressed: 0.06
Cluster number: 443
Cluster clones: 700266366H1 700260622H1
Percent of clones expressed: 0.06
Cluster number: 571
Cluster clones: 700267072H1 700263338H1
Percent of clones expressed: 0.06
Cluster number: 677
Cluster clones: 700267225H1 700266519H1

TABLE 2-continued

UNIQUE AND HOMOLOGOUS CLUSTERS IN SATMON022023
COPYRIGHT 1998 INCYTE PHARMACEUTICALS, INC.

Percent of clones expressed: 0.06
Weak match to
g2062022          putative progesterone binding protein
Cluster number: 229
Cluster clones:   700267874H1       700257792H1
Percent of clones expressed: 0.06
Weak match to
g457708           S. oleracea mRNA for protein kinase.
Cluster number: 251
Cluster clones:   700260522H1       700258060H1
Percent of clones expressed: 0.06
Cluster number: 664
Cluster clones:   700267686H1       700265990H1
Percent of clones expressed: 0.06
Cluster number: 549
Cluster clones:   700267984H1       700262967H1
Percent of clones expressed: 0.06
Weak match to
g2062155          T02004.2; mitochondrial processing peptidase alpha subunit
                  precusor isolog
Cluster number: 392
Cluster clones:   700267080H1       700259361H1
Percent of clones expressed: 0.06
Homologous match to
g1276758          rpl13; 50S ribosomal protein L13
Cluster number: 404
Cluster clones:   700262083H1       700259694H1
Percent of clones expressed: 0.06
Homologous match to
g2286150          Zea mays translation initiation factor (eIF-4A) mRNA, complete
                  cds.
Cluster number: 136
Cluster clones:   700257119H1       700265719H1
Percent of clones expressed: 0.06
Homologous match to
g1931636          Arabidopsis thaliana BAC T19D16 genomic sequence.
Cluster number: 290
Cluster clones:   700258331H1       700265923H1
Percent of clones expressed: 0.06
Homologous match to
g1399563          Hydrastis canadensis nuclear 26S ribosomal RNA gene, partial
                  sequence.
Cluster number: 319
Cluster clones:   700267327H1       700258519H1
Percent of clones expressed: 0.06
Cluster number: 575
Cluster clones:   700265053H1       700263376H1
Percent of clones expressed: 0.06
Weak match to
g2224553          KIAA0306
Cluster number: 341
Cluster clones:   700263758H1       700258652H1
Percent of clones expressed: 0.06
Homologous match to
g496723           N2038 gene product
Cluster number: 660
Cluster clones:   700268173H1       700265633H1
Percent of clones expressed: 0.06
Homologous match to
g1651457          Aminopeptidase N
Cluster number: 498
Cluster clones:   700267368H1       700261812H1
Percent of clones expressed: 0.06
Homologous match to
g18591            GH3; auxin-responsive GH3 product
Cluster number: 486
Cluster clones:   700263329H1       700261576H1
Percent of clones expressed: 0.06
Weak match to
g263500           ribosomal protein L10 homolog
Cluster number: 42
Cluster clones:   700263959H1       700207241H1
Percent of clones expressed: 0.06
Cluster number: 626
Cluster clones:   700267811H1       700264759H1
Percent of clones expressed: 0.06

TABLE 2-continued

UNIQUE AND HOMOLOGOUS CLUSTERS IN SATMON022023
COPYRIGHT 1998 INCYTE PHARMACEUTICALS, INC.

```
Homologous match to
g2815099           Y39E4A.2a
Cluster number: 638
Cluster clones:    700267403H1    700264975H1
Percent of clones expressed: 0.06
Cluster number: 520
Cluster clones:    700262343H1    700265161H1
Percent of clones expressed: 0.06
Cluster number: 380
Cluster clones:    700265045H1    700259124H2
Percent of clones expressed: 0.06
Cluster number: 252
Cluster clones:    700258064H1    700258850H1
Percent of clones expressed: 0.06
Homologous match to
g868003            a member for glyoxylate cycle; aconitase; EC 4.2.1.3
Cluster number: 225
Cluster clones:    700265972H1    700257784H1
Percent of clones expressed: 0.06
Homologous match to
g2832633           F13C5.220; putative protein
Cluster number: 537
Cluster clones:    700266954H1    700262705H1
Percent of clones expressed: 0.06
Homologous match to
g2829911           F22K20.10
Cluster number: 409
Cluster clones:    700261163H1    700260011H1
Percent of clones expressed: 0.06
Weak match to
g984964            SIK1; suppressor of toxicity of GAL4-IKB; Siklp
Cluster number: 665
Cluster clones:    700266044H1    700267731H1
Percent of clones expressed: 0.06
Homologous match to
g22275             Maize mRNA for ferritin (clone FM1).
Cluster number: 587
Cluster clones:    700263787H1    700264401H1
Percent of clones expressed: 0.06
Cluster number: 163
Cluster clones:    700257196H1    700265796H1
Percent of clones expressed: 0.06
Cluster number: 448
Cluster clones:    700262714H1    700260716H1
Percent of clones expressed: 0.06
Cluster number: 214
Cluster clones:    700266442H1    700257672H1
Percent of clones expressed: 0.06
Homologous match to
g1903032           B. napus mRNA for acyl-CoA synthetase (2360 bp).
Cluster number: 174
Cluster clones:    700258044H1    700257305H1
Percent of clones expressed: 0.06
Cluster number: 548
Cluster clones:    700262949H1    700267042H1
Percent of clones expressed: 0.06
Cluster number: 487
Cluster clones:    700261586H1    700266194H1
Percent of clones expressed: 0.06
Weak match to
g16431             PP1-At; cellular regulation; protein phosphatase-1
Cluster number: 676
Cluster clones:    700266517H1    700267106H1
Percent of clones expressed: 0.06
Cluster number: 253
Cluster clones:    700265116H1    700258071H1
Percent of clones expressed: 0.06
Cluster number: 403
Cluster clones:    700259649H1    700265174H1
Percent of clones expressed: 0.06
Cluster number: 538
Cluster clones:    700263554H1    700262707H1
Percent of clones expressed: 0.06
Cluster number: 398
Cluster clones:    700259518H1    700266462H1
Percent of clones expressed: 0.06
```

TABLE 2-continued

UNIQUE AND HOMOLOGOUS CLUSTERS IN SATMON022023
COPYRIGHT 1998 INCYTE PHARMACEUTICALS, INC.

Cluster number: 304
Cluster clones:   700265166H1   700258419H1
Percent of clones expressed: 0.06
Homologous match to
g287398   Rice mRNA for a protein related to chilling tolerance.
Cluster number: 432
Cluster clones:   700260911H1   700260508H1
Percent of clones expressed: 0.06
Weak match to
g21729   T. aestivum Em gene.
Cluster number: 700
Cluster clones:   700268104H1   700268111H1
Percent of clones expressed: 0.06
Cluster number: 449
Cluster clones:   700260738H1   700262870H1
Percent of clones expressed: 0.06
Cluster number: 577
Cluster clones:   700263391H1   700267608H1
Percent of clones expressed: 0.06
Cluster number: 471
Cluster clones:   700265973H1   700261193H1
Percent of clones expressed: 0.06
Cluster number: 611
Cluster clones:   700264495H1   700264411H1
Percent of clones expressed: 0.06
Cluster number: 637
Cluster clones:   700264948H1   700267113H1
Percent of clones expressed: 0.06
Cluster number: 63
Cluster clones:   700264082H1   700256716H1
Percent of clones expressed: 0.06
Cluster number: 49
Cluster clones:   700207267H1   700259143H2
Percent of clones expressed: 0.06
Homologous match to
g1262145   S. oleracea mRNA for proteasome 37kD subunit.
Cluster number: 488
Cluster clones:   700263405H1   700261611H1
Percent of clones expressed: 0.06
Homologous match to
g432488   Wheat initiation factor 1A (eIF-1A) mRNA.
Cluster number: 628
Cluster clones:   700266806H1   700264792H1
Percent of clones expressed: 0.06
Cluster number: 369
Cluster clones:   700258976H1   700268075H1
Percent of clones expressed: 0.06
Cluster number: 650
Cluster clones:   700265408H1   700266076H1
Percent of clones expressed: 0.06
Cluster number: 382
Cluster clones:   700259195H2   700264719H1
Percent of clones expressed: 0.06
Weak match to
g2246624   Oryza sativa protein kinase mRNA, complete cds.
Cluster number: 667
Cluster clones:   700266065H1   700266435H1
Percent of clones expressed: 0.06
Homologous match to
g474007   Rice mRNA, partial homologous to ribosomal protein S12 gene.
Cluster number: 692
Cluster clones:   700267148H1   700267140H1
Percent of clones expressed: 0.06
Weak match to
g667069   ORF
Cluster number: 436
Cluster clones:   700260525H2   700263301H1
Percent of clones expressed: 0.06
Cluster number: 525
Cluster clones:   700262381H1   700268122H1
Percent of clones expressed: 0.06
Homologous match to
g2582643   RSZp21; RSZp21 protein
Cluster number: 19
Cluster clones:   700261454H1   700207165H1
Percent of clones expressed: 0.06

TABLE 2-continued

UNIQUE AND HOMOLOGOUS CLUSTERS IN SATMON022023
COPYRIGHT 1998 INCYTE PHARMACEUTICALS, INC.

Cluster number: 330
Cluster clones: 700261054H1 700258564H1
Percent of clones expressed: 0.06
Weak match to
g1209316        Hevea brasiliensis ethylene-inducible protein (ER1) mRNA, complete cds.
Cluster number: 33
Cluster clones: 700207210H1 700262832H1
Percent of clones expressed: 0.06
Weak match to
g804944         wpk4; wpk4 protein kinase
Cluster number: 615
Cluster clones: 700264542H1 700264961H1
Percent of clones expressed: 0.06
Homologous match to
g2656029        Arabidopsis thaliana genomic DNA, chromosome 5, P1 clone: MQ82.
Cluster number: 347
Cluster clones: 700258713H1 700266090H1
Percent of clones expressed: 0.06
Cluster number: 480
Cluster clones: 700261481H1 700261922H1
Percent of clones expressed: 0.06
Cluster number: 586
Cluster clones: 700267946H1 700263708H1
Percent of clones expressed: 0.06
Weak match to
g169538         pyrophosphate-fructose 6-phosphate 1-phosphotransferase alpha-subunit
Cluster number: 129
Cluster clones: 700257062H1 700266486H1
Percent of clones expressed: 0.06
Weak match to
g20681          508 aa peptide
Cluster number: 654
Cluster clones: 700268123H1 700265482H1
Percent of clones expressed: 0.06
Cluster number: 78
Cluster clones: 700257913H1 700256779H1
Percent of clones expressed: 0.06
Cluster number: 526
Cluster clones: 700262409H1 700265595H1
Percent of clones expressed: 0.06
Cluster number: 420
Cluster clones: 700264815H1 700260254H1
Percent of clones expressed: 0.06
Cluster number: 20
Cluster clones: 700207166H1 700258448H1
Percent of clones expressed: 0.06
Cluster number: 313
Cluster clones: 700258471H1 700260908H1
Percent of clones expressed: 0.06
Weak match to
g2298899        unnamed protein product
Cluster number: 297
Cluster clones: 700266971H1 700258407H1
Percent of clones expressed: 0.06
Cluster number: 693
Cluster clones: 700267188H1 700267196H1
Percent of clones expressed: 0.06
Weak match to
g2656024        Arabidopsis thaliana genomic DNA, chromosome 5, TAC clone: K15E6.
Cluster number: 565
Cluster clones: 700263165H1 700264459H1
Percent ot clones expressed: 0.06
Weak match to
g397524         polypyrimidine tract binding protein
Cluster number: 437
Cluster clones: 700263266H1 700260526H2
Percent of clones expressed: 0.06
Cluster number: 675
Cluster clones: 700268103H1 700266433H1
Percent of clones expressed: 0.06
Cluster number: 203
Cluster clones: 700262492H1 700257589H1
Percent of clones expressed: 0.06
Cluster number: 433

TABLE 2-continued

UNIQUE AND HOMOLOGOUS CLUSTERS IN SATMON022023
COPYRIGHT 1998 INCYTE PHARMACEUTICALS, INC.

| | | |
|---|---|---|
| Cluster clones: | 700260512H1 | 700268176H1 |
| Percent of clones expressed: 0.06 | | |
| Homologous match to | | |
| g510931 | V. faba mRNA for alpha 1,4-glucan phosphorylase type H. | |
| Cluster number: 262 | | |
| Cluster clones: | 700258121H1 | 700258124H1 |
| Percent of clones expressed: 0.06 | | |
| Cluster number: 165 | | |
| Cluster clones: | 700258380H1 | 700257211H1 |
| Percent of clones expressed: 0.06 | | |
| Homologous match to | | |
| g1272634 | K07C5.4 | |
| Cluster number: 616 | | |
| Cluster clones: | 700265523H1 | 700264546H1 |
| Percent of clones expressed: 0.06 | | |
| Homologous match to | | |
| g431162 | LIM16; ORF | |
| Cluster number: 510 | | |
| Cluster clones: | 700262502H1 | 700262171H1 |
| Percent of clones expressed: 0.06 | | |
| Cluster number: 370 | | |
| Cluster clones: | 700258992H1 | 700262734H1 |
| Percent of clones expressed: 0.06 | | |
| Cluster number: 653 | | |
| Cluster clones: | 700265452H1 | 700266270H1 |
| Percent of clones expressed: 0.06 | | |
| Cluster number: 385 | | |
| Cluster clones: | 700264716H1 | 700259222H1 |
| Percent of clones expressed: 0.06 | | |
| Homologous match to | | |
| g2344885 | Arabidopsis thaliana chromosome II BAC T13E15 genomic sequence, complete sequence. | |
| Cluster number: 95 | | |
| Cluster clones: | 700256849H1 | 700256865H1 |
| Percent of clones expressed: 0.06 | | |
| Cluster number: 259 | | |
| Cluster clones: | 700258103H1 | 700262756H1 |
| Percent of clones expressed: 0.06 | | |
| Cluster number: 390 | | |
| Cluster clones: | 700259343H1 | 700263290H1 |
| Percent of clones expressed: 0.06 | | |
| Weak match to | | |
| g1842188 | mitochondrial phosphate translocator | |
| Cluster number: 527 | | |
| Cluster clones: | 700262423H1 | 700266345H1 |
| Percent of clones expressed: 0.06 | | |
| Homologous match to | | |
| g1737491 | Triticum aestivum poly(A)-binding protein (wheatpab) mRNA, complete cds. | |
| Cluster number: 281 | | |
| Cluster clones: | 700264395H1 | 700258282H1 |
| Percent of clones expressed: 0.06 | | |
| Weak match to | | |
| g18501 | D-34 Lea protein | |
| Cluster number: 421 | | |
| Cluster clones: | 700260553H2 | 700260255H1 |
| Percent of clones expressed: 0.06 | | |
| Homologous match to | | |
| g1777311 | Arabidopsis thaliana mRNA for novel serine/threonine protein kinase, complete cds. | |
| Cluster number: 153 | | |
| Cluster clones: | 700265767H1 | 700257167H1 |
| Percent of clones expressed: 0.06 | | |
| Cluster number: 508 | | |
| Cluster clones: | 700262084H1 | 700207168H1 |
| Percent of clones expressed: 0.06 | | |
| Weak match to | | |
| g2827079 | Medicago sativa mitochondrial malate dehydrogenase precursor (mmdh) mRNA, nuclear gene encoding mitochondrial protein, complete cds. | |
| Cluster number: 636 | | |
| Cluster clones: | 700264936H1 | 700266594H1 |
| Percent of clones expressed: 0.06 | | |
| Cluster number: 204 | | |
| Cluster clones: | 700262858H1 | 700257609H1 |
| Percent of clones expressed: 0.06 | | |
| Weak match to | | |

TABLE 2-continued

UNIQUE AND HOMOLOGOUS CLUSTERS IN SATMON022023
COPYRIGHT 1998 INCYTE PHARMACEUTICALS, INC.

g2642446           T20D16.20; similar to auxin-responsive GH3 protein
Cluster number: 368
Cluster clones:    700259024H1       700258967H1
Percent of clones expressed: 0.06
Homologous match to
g763204            TCP1beta; Tcp1betap
Cluster number: 561
Cluster clones:    700268170H1       700263143H1
Percent of clones expressed: 0.06
Cluster nuraber: 600
Cluster clones:    700265061H1       700264214H1
Percent of clones expressed: 0.06
Homologous match to
g530206            Glycine max heat shock protein (SB100) mRNA, complete cds.
Cluster number: 617
Cluster clones:    700264588H1       700267362H1
Percent of clones expressed: 0.06
Cluster number: 349
Cluster clones:    700263302H1       700258740H1
Percent of clones expressed: 0.06
Weak match to
g2244802           retrovirus-related polyprotein homolog
Cluster number: 477
Cluster clones:    700262895H1       700261426H1
Percent of clones expressed: 0.06
Cluster number: 371
Cluster clones:    700259008H1       700261145H1
Percent of clones expressed: 0.06
Cluster number: 585
Cluster clones:    700263679H1       700267373H1
Percent of clones expressed: 0.06
Cluster number: 13
Cluster clones:    700207152H1       700266654H1
Percent of clones expressed: 0.06
Cluster number: 388
Cluster clones:    700261670H1       700259310H1
Percent of clones expressed: 0.06
Cluster number: 656
Cluster clones:    700266416H1       700265537H1
Percent of clones expressed: 0.06
Cluster number: 85
Cluster clones:    700256817H1       700261767H1
Percent of clones expressed: 0.06
Cluster number: 154
Cluster clones:    700257172H1       700265772H1
Percent of clones expressed: 0.06
Homologous match to
g1017823           RNA polymerase II subunit
Cluster number: 74
Cluster clones:    700258612H1       700256766H1
Percent of clones expressed: 0.06
Cluster number: 22
Cluster clones:    700207171H1       700264348H1
Percent of clones expressed: 0.06
Cluster number: 329
Cluster clones:    700258543H1       700259318H1
Percent of clones expressed: 0.06
Cluster number: 299
Cluster clones:    700261815H1       700258412H1
Percent of clones expressed: 0.06
Cluster number: 695
Cluster clones:    700267238H1       700267239H1
Percent of clones expressed: 0.06
Weak match to
g2342477           ATP binding protein
Cluster number: 439
Cluster clones:    700265961H1       700260537H2
Percent of clones expressed: 0.06
Cluster number: 567
Cluster clones:    700263263H1       700265395H1
Percent of clones expressed: 0.06
Homologous match to
g2190991           Aegilops squarrosa glutathione S-transferase TSI-1 mRNA, complete
                   cds.
Cluster number: 601
Cluster clones:    700264238H1       700266402H1

TABLE 2-continued

UNIQUE AND HOMOLOGOUS CLUSTERS IN SATMON022023
COPYRIGHT 1998 INCYTE PHARMACEUTICALS, INC.

Percent of clones expressed: 0.06
Cluster number: 461
Cluster clones: 700266280H1   700261123H1
Percent of clones expressed: 0.06
Cluster number: 44
Cluster clones: 700268032H1   700207243H1
Percent of clones expressed: 0.06
Weak match to
g1526424        AtECP63; LEA protein in group 3; ABA-inducible gene
Cluster number: 478
Cluster clones: 700266193H1   700261439H1
Percent of clones expressed: 0.06
Homologous match to
g20321          Oryza sativa RAc1 mRNA for actin.
Cluster number: 372
Cluster clones: 700267454H1   700259015H1
Percent of clones expressed: 0.06
Weak match to
g1707012        T01B08.14; tyrosyl-tRNA synthetase isolog
Cluster number: 512
Cluster clones: 700262831H1   700262230H1
Percent of clones expressed: 0.06
Homologous match to
g2642323        Zea mays profilin (PRO4) mRNA, complete cds.
Cluster number: 674
Cluster clones: 700266413H1   700266866H1
Percent of clones expressed: 0.06
Cluster number: 116
Cluster clones: 700263605H1   700257010H1
Percent of clones expressed: 0.06
Cluster number: 240
Cluster clones: 700266769H1   700257925H1
Percent of clones expressed: 0.06
Cluster number: 657
Cluster clones: 700266121H1   700265546H1
Percent of clones expressed: 0.06
Weak match to
g2245038        hypothetical protein
Cluster number: 389
Cluster clones: 700259674H1   700259328H1
Percent of clones expressed: 0.06
Cluster number: 474
Cluster clones: 700261643H1   700261271H1
Percent of clones expressed: 0.06
Weak match to
g2570121        S. latifolia mRNA, clone CCLS 30.1 rev.
Cluster number: 283
Cluster clones: 700262583H1   700258289H1
Percent of clones expressed: 0.06
Cluster number: 551
Cluster clones: 700263009H1   700263040H1
Percent of clones expressed: 0.06
Cluster number: 423
Cluster clones: 700265465H1   700260273H1
Percent of clones expressed: 0.06
Homologous match to
g303942         Yeast ppe1+ gene for protein phosphatase, complete cds.
Cluster number: 572
Cluster clones: 700266171H1   700263340H1
Percent of clones expressed: 0.06
Homologous match to
g1458098        Gea8; globulin-like protein
Cluster number: 155
Cluster clones: 700265773H1   700257173H1
Percent of clones expressed: 0.06
Cluster number: 278
Cluster clones: 700258252H1   700261367H1
Percent of clones expressed: 0.06
Cluster number: 696
Cluster clones: 700268050H1   700268042H1
Percent of clones expressed: 0.06
Weak match to
g2213600        T7N9.20
Cluster number: 568
Cluster clones: 700265675H1   700263265H1
Percent of clones expressed: 0.06

TABLE 2-continued

UNIQUE AND HOMOLOGOUS CLUSTERS IN SATMON022023
COPYRIGHT 1998 INCYTE PHARMACEUTICALS, INC.

Homologous match to
g22490 ORF1
Cluster number: 418
Cluster clones: 700263654H1 700260177H1
Percent of clones expressed: 0.06
Homologous match to
g1107903 SPAC11D3.14c; unknown
Cluster number: 133
Cluster clones: 700257111H1 700265711H1
Percent of clones expressed: 0.06
Weak match to
g466441 Ser/Thr protein phosphatase
Cluster number: 334
Cluster clones: 700258584H1 700258746H1
Percent of clones expressed: 0.06
Homologous match to
g530206 Glycine max heat shock protein (SB100) mRNA, complete cds.
Cluster number: 602
Cluster clones: 700264246H1 700264277H1
Percent of clones expressed: 0.06
Cluster number: 590
Cluster clones: 700263877H1 700264110H1
Percent of clones expressed: 0.06
Homologous match to
g168575 Maize phospholipid transfer protein mRNA, complete cds. of clone 9C2.
Cluster number: 100
Cluster clones: 700266183H1 700256881H1
Percent of clones expressed: 0.06
Homologous match to
g1469220 B. oleracea mRNA (unknown).
Cluster number: 479
Cluster clones: 700266289H1 700261480H1
Percent of clones expressed: 0.06
Homologous match to
g2641208 Fritillaria agrestis ribosomal protein S16 (rps16) mRNA, complete cds.
Cluster number: 373
Cluster clones: 700264525H1 700259022H1
Percent of clones expressed: 0.06
Cluster number: 305
Cluster clones: 700265054H1 700258425H1
Percent of clones expressed: 0.06
Cluster number: 218
Cluster clones: 700262740H1 700257724H1
Percent of clones expressed: 0.06
Weak match to
g1200282 F48F7.1
Cluster number: 401
Cluster clones: 700259638H1 700265684H1
Percent of clones expressed: 0.06
Homologous match to
g531096 TED2
Cluster number: 513
Cluster clones: 700262270H1 700264718H1
Percent of clones expressed: 0.06
Homologous match to
g514945 Zea mays sucrose synthase (Sus1) mRNA, complete cds.
Cluster number: 680
Cluster clones: 700267585H1 700266586H1
Percent of clones expressed: 0.06
Cluster number: 507
Cluster clones: 700266281H1 700262074H1
Percent of clones expressed: 0.06
Homologous match to
g1514638 S. oleracea mRNA for alpha-glucan phosphorylase.
Cluster number: 424
Cluster clones: 700265111H1 700260321H2
Percent of clones expressed: 0.06
Cluster number: 578
Cluster clones: 700263442H1 700267024H1
Percent of clones expressed: 0.06
Cluster number: 569
Cluster clones: 700263311H1 700267466H1
Percent of clones expressed: 0.06
Homologous match to

TABLE 2-continued

UNIQUE AND HOMOLOGOUS CLUSTERS IN SATMON022023
COPYRIGHT 1998 INCYTE PHARMACEUTICALS, INC.

```
g2388574           YUP8H12.16
Cluster number: 697
Cluster clones:    700268051H1      700268043H1
Percent of clones expressed: 0.06
Cluster number: 344
Cluster clones:    700262829H1      700258685H1
Percent of clones expressed: 0.06
Cluster number: 222
Cluster clones:    700266043H1      700257752H1
Percent of clones expressed: 0.06
Cluster number: 65
Cluster clones:    700256720H1      700265593H1
Percent of clones expressed: 0.06
Homologous match to
g2282036           p34-Arc
Cluster number: 350
Cluster clones:    700264782H1      700258749H1
Percent of clones expressed: 0.06
Homologous match to
g633680            S. tuberosum (Desiree) cr14 mRNA.
Cluster number: 71
Cluster clones:    700266558H1      700256753H1
Percent of clones expressed: 0.06
Cluster number: 591
Cluster clones:    700263923H1      700266271H1
Percent of clones expressed: 0.06
Cluster number: 603
Cluster clones:    700264341H1      700264248H1
Percent of clones expressed: 0.06
Homologous match to
g2829870           F3I6.12
Cluster number: 328
Cluster clones:    700266522H1      700258538H1
Percent of clones expressed: 0.06
Homologous match to
g2414402           Y57G11C.15
Cluster number: 3
Cluster clones:    700262348H1      700207111H1
Percent of clones expressed: 0.06
Homologous match to
g603601            NTF2; Ntf2p: Nuclear Transport Factor 2
Cluster number: 118
Cluster clones:    700259656H1      700257020H1
Percent of clones expressed: 0.06
Homologous match to
g669002            Glycine max calnexin mRNA, complete cds.
Cluster number: 514
Cluster clones:    700264234H1      700262275H1
Percent of clones expressed: 0.06
Cluster number: 642
Cluster clones:    700267184H1      700265169H1
Percent of clones expressed: 0.06
Weak match to
g1216011           NAP57 homologue
Cluster number: 246
Cluster clones:    700260869H1      700258006H1
Percent of clones expressed: 0.06
Homologous match to
g1321660           Rice mRNA for ascorbate peroxidase, complete cds.
Cluster number: 691
Cluster clones:    700267380H1      700267121H1
Percent of clones expressed: 0.06
Homologous match to
g2168136           F. sylvatica mRNA for PKF1 protein.
Cluster number: 140
Cluster clones:    700265732H1      700257132H1
Percent of clones expressed: 0.06
Cluster number: 659
Cluster clones:    700266975H1      700265596H1
Percent of clones expressed: 0.06
Weak match to
g2642157           T517.5; ankyrin-like protein
Cluster number: 24
Cluster clones:    700265962H1      700207175H1
Percent of clones expressed: 0.06
Cluster number: 188
```

TABLE 2-continued

UNIQUE AND HOMOLOGOUS CLUSTERS IN SATMON022023
COPYRIGHT 1998 INCYTE PHARMACEUTICALS, INC.

Cluster clones: 700265564H1 700257428H2
Percent of clones expressed: 0.06
Homologous match to
g1216231 SES1; seryl-tRNA synthetase
Cluster number: 285
Cluster clones: 700258292H1 700260191H1
Percent of clones expressed: 0.06
Homologous match to
g1931637 T19D16.1; receptor-associated kinase isolog
Cluster number: 295
Cluster clones: 700263312H1 700258360H1
Percent of clones expressed: 0.06
Homologous match to
g1743006 C. paradoxa mRNA for ribosomal protein L13a.
Cluster number: 311
Cluster clones: 700258467H1 700265614H1
Percent of clones expressed: 0.06
Cluster number: 553
Cluster clones: 700268064H1 700263044H1
Percent of clones expressed: 0.06
Cluster number: 698
Cluster clones: 700268044H1 700268052H1
Percent of clones expressed: 0.06
Cluster number: 673
Cluster clones: 700266390H1 700266581H1
Percent of clones expressed: 0.06
Weak match to
g1679853 CCoAOMT-5; methylation of caffeoyl-CoA in lignin biosynthesis;
caffeoyl-CoA O-methyltransferase 5; EC 2.1.1.104;
S-adenosyl-L-methionine:caffeoyl-CoA O-methyltransferase
Cluster number: 612
Cluster clones: 700264423H1 700264831H1
Percent of clones expressed: 0.06
Cluster number: 216
Cluster clones: 700257680H1 700257888H1
Percent of clones expressed: 0.06
Cluster number: 604
Cluster clones: 700264271H1 700267230H1
Percent of clones expressed: 0.06
Homologous match to
g2833627 Arabidopsis thaliana chromosome 1 BAC F1707 complete sequence.
Cluster number: 149
Cluster clones: 700265758H1 700257158H1
Percent of clones expressed: 0.06
Cluster number: 55
Cluster clones: 700263130H1 700207284H1
Percent of clones expressed: 0.06
Cluster number: 110
Cluster clones: 700260653H1 700256946H1
Percent of clones expressed: 0.06
Cluster number: 132
Cluster clones: 700257110H1 700265710H1
Percent of clones expressed: 0.06
Cluster number: 669
Cluster clones: 700266110H1 700267345H1
Percent of clones expressed: 0.06
Homologous match to
g1419948 WPS1
Cluster number: 489
Cluster clones: 700261617H1 700266243H1
Percent of clones expressed: 0.06
Cluster number: 39
Cluster clones: 700258975H1 700207229H1
Percent of clones expressed: 0.06
Homologous match to
g2656029 Arabidopsis thaliana genomic DNA, chromosome 5, P1 clone: MQ62.
Cluster number: 554
Cluster clones: 700263053H1 700265118H1
Percent of clones expressed: 0.06
Cluster number: 286
Cluster clones: 700258293H1 700267753H1
Percent of clones expressed: 0.06
Cluster number: 158
Cluster clones: 700265779H1 700257179H1
Percent of clones expressed: 0.06
Homologous match to TABLE 2-continued UNIQUE AND HOMOLOGOUS CLUSTERS IN SATMON022023
COPYRIGHT 1998 INCYTE PHARMACEUTICALS, INC.

g2252863 A_TM018A10.14
Cluster number: 238
Cluster clones: 700257890H1 700267432H1
Percent of clones expressed: 0.06
Homologous match to
g387908 Brassica rapa S-phase-specific (BIS289) mRNA, complete cds.
Cluster number: 682
Cluster clones: 700266764H1 700268040H1
Percent of clones expressed: 0.06
Cluster number: 634
Cluster clones: 700267134H1 700264901H1
Percent of clones expressed: 0.06
Cluster number: 187
Cluster clones: 700257424H2 700267973H1
Percent of clones expressed: 0.06
Cluster number: 699
Cluster clones: 700268047H1 700268055H1
Percent of clones expressed: 0.06
Homologous match to
g902597 MIF homologue
Cluster number: 150
Cluster clones: 700265759H1 700257159H1
Percent of clones expressed: 0.06
Homologous match to
g633889 glucose and ribitol dehydrogenase homolog [Hordeum vulgare = barley,
Aura, embryo, mRNA, 1170 nt].
Cluster number: 465
Cluster clones: 700261167H1 700265845H1
Percent of clones expressed: 0.06
Cluster number: 7
Cluster clones: 700264247H1 700207128H1
Percent of clones expressed: 0.06
Homologous match to
g1173555 galE; catabolism of galactose to glucose in Leloir pathway, and in
galactose synthesis from glucose.; UDP-galactose-4-epimerase; EC 5.1.3.2
Cluster number: 248
Cluster clones: 700258027H1 700260016H1
Percent of clones expressed: 0.06
Homologous match to
g2264314 Arabidopsis thaliana genomic DNA, chromosome 5, P1 clone: MQK4,
complete sequence.
Cluster number: 516
Cluster clones: 700262290H1 700267240H1
Percent of clones expressed: 0.06
Cluster number: 644
Cluster clones: 700265215H1 700265626H1
Percent of clones expressed: 0.06
Cluster number: 524
Cluster clones: 700267871H1 700262368H1
Percent of clones expressed: 0.06
Cluster number: 327
Cluster clones: 700263890H1 700258537H1
Percent of clones expressed: 0.06
Homologous match to
g2624219 M.acuminata mRNA; clone pBAN UD75.
Cluster number: 142
Cluster clones: 700257137H1 700265737H1
Percent of clones expressed: 0.06
Homologous match to
g2262153 T10P11.19; putative chloroplast outer envelope 86-like protein
Cluster number: 270
Cluster clones: 700259216H1 700258184H1
Percent of clones expressed: 0.06
Homologous match to
g1086831 F10E7.7
Cluster number: 652
Cluster clones: 700265688H1 700265436H1
Percent of clones expressed: 0.06
Weak match to
g394874 HSP 70– Pisum sativum
Cluster number: 287
Cluster clones: 700258322H1 700267914H1
Percent of clones expressed: 0.06
Weak match to
g392943 Lophopyrum elongatum salt-stress induced ESI3 gene, complete cds.
Cluster number: 427

TABLE 2-continued

UNIQUE AND HOMOLOGOUS CLUSTERS IN SATMON022023
COPYRIGHT 1998 INCYTE PHARMACEUTICALS, INC.

Cluster clones: 700262936H1 700260354H1
Percent of clones expressed: 0.06
Homologous match to
g508974 Triticum aestivum Chinese spring protein disulfide isomerase (PDI) mRNA, complete cds.
Cluster number: 683
Cluster clones: 700266771H1 700266989H1
Percent of clones expressed: 0.06
Homologous match to
g2827698 Arabidopsis thaliana DNA chromosome 4, BAC clone F6H11 (ESSAII project).
Cluster number: 181
Cluster clones: 700257362H1 700268166H1
Percent of clones expressed: 0.06
Cluster number: 455
Cluster clones: 700260877H1 700262782H1
Percent of clones expressed: 0.06
Cluster number: 466
Cluster clones: 700261168H1 700262181H1
Percent of clones expressed: 0.06
Cluster number: 594
Cluster clones: 700266526H1 700264008H1
Percent of clones expressed: 0.06
Cluster number: 651
Cluster clones: 700265418H1 700267181H1
Percent of clones expressed: 0.06
Cluster number: 76
Cluster clones: 700258105H1 700256773H1
Percent of clones expressed: 0.06
Cluster number: 360
Cluster clones: 700265585H1 700258874H1
Percent of clones expressed: 0.06
Cluster number: 689
Cluster clones: 700267002H1 700268010H1
Percent of clones expressed: 0.06
Homologous match to
g2398680 Morinda citrifolia mRNA for 3-deoxy-D-arabino-heptulosonate 7-phosphate synthase, DS2.
Cluster number: 500
Cluster clones: 700266267H1 700261851H1
Percent of clones expressed: 0.06
Cluster number: 672
Cluster clones: 700266352H1 700266577H1
Percent of clones expressed: 0.06
Cluster number: 645
Cluster clones: 700265224H1 700266394H1
Percent of clones expressed: 0.06
Homologous match to
g2760165 Arabidopsis thaliana genomic DNA, chromosome 5, P1 clone: MAC9, complete sequence.
Cluster number: 143
Cluster clones: 700257140H1 700265740H1
Percent of clones expressed: 0.06
Cluster number: 411
Cluster clones: 700261064H1 700260108H1
Percent of clones expressed: 0.06
Cluster number: 148
Cluster clones: 700257155H1 700265755H1
Percent of clones expressed: 0.06
Weak match to
g2464884 RNA-binding protein homolog
Cluster number: 256
Cluster clones: 700258079H1 700264031H1
Percent of clones expressed: 0.06
Cluster number: 505
Cluster clones: 700261932H1 700263259H1
Percent of clones expressed: 0.06
Weak match to
g1322599 ORF YGL080w
Cluster number: 428
Cluster clones: 700261303H1 700260380H2
Percent of clones expressed: 0.06
Weak match to
g1173905 spliceosome associated protein
Cluster number: 556
Cluster clones: 700263063H1 700266208H1

TABLE 2-continued

UNIQUE AND HOMOLOGOUS CLUSTERS IN SATMON022023
COPYRIGHT 1998 INCYTE PHARMACEUTICALS, INC.

Percent of clones expressed: 0.06
Cluster number: 322
Cluster clones: 700258525H1 700264969H1
Percent of clones expressed: 0.06
Cluster number: 450
Cluster clones: 700264909H1 700260740H1
Percent of clones expressed: 0.06
Homologous match to
g1502354 Yeast (Saccharomyces cerevisiae) genomic sequence from chromosome VII.
Cluster number: 607
Cluster clones: 700265014H1 700264324H1
Percent of clones expressed: 0.06
Weak match to
g1256424 BCPI-2; cysteine proteinase inhibitor
Cluster number: 467
Cluster clones: 700261171H1 700264454H1
Percent of clones expressed: 0.06
Cluster number: 595
Cluster clones: 700264533H1 700264033H1
Percent of clones expressed: 0.06
Cluster number: 233
Cluster clones: 700261667H1 700257842H1
Percent of clones expressed: 0.06
Cluster number: 237
Cluster clones: 700257889H1 700261143H1
Percent of clones expressed: 0.06
Weak match to
g780814 3-ketoacyl-acyl carrier protein synthase I
Cluster number: 365
Cluster clones: 700266914H1 700258953H1
Percent of clones expressed: 0.06
Cluster number: 378
Cluster clones: 700259101H2 700259071H1
Percent of clones expressed: 0.06
Weak match to
g2330773 SPAC23C11.09; alanyl-trna synthetase
Cluster number: 646
Cluster clones: 700265261H1 700265873H1
Percent of clones expressed: 0.06
Homologous match to
g527618 Glycine max 3-methylcrotonyl-CoA carboxylase mRNA, biotin-carrier domain, partial cds.
Cluster number: 633
Cluster clones: 700264889H1 700266527H1
Percent of clones expressed: 0.06
Cluster number: 493
Cluster clones: 700265993H1 700261664H1
Percent of clones expressed: 0.06
Cluster number: 144
Cluster clones: 700265751H1 700257151H1
Percent of clones expressed: 0.06
Cluster number: 540
Cluster clones: 700262764H1 700265963H1
Percent of clones expressed: 0.06
Cluster number: 668
Cluster clones: 700266078H1 700262062H1
Percent of clones expressed: 0.06
Weak match to
g1042260 {Mu1 element insertion site, clone 10} [maize, Transposon, 285 nt].
Cluster number: 434
Cluster clones: 700263307H1 700260513H1
Percent of clones expressed: 0.06
Cluster number: 272
Cluster clones: 700258190H1 700260138H1
Percent of clones expressed: 0.06
Cluster number: 220
Cluster clones: 700262527H1 700257732H1
Percent of clones expressed: 0.06
Homologous match to
g19010 H. vulgare mRNA for jasmonate-induced protein.
Cluster number: 454
Cluster clones: 700260850H1 700264066H1
Percent of clones expressed: 0.06
Cluster number: 183

TABLE 2-continued

UNIQUE AND HOMOLOGOUS CLUSTERS IN SATMON022023
COPYRIGHT 1998 INCYTE PHARMACEUTICALS, INC.

Cluster clones: 700257371H1 700263354H1
Percent of clones expressed: 0.06
Homologous match to
g303834  Rice mRNA for 21kd polypeptide, complete cds.
Cluster number: 186
Cluster clones: 700257421H2 700264446H1
Percent of clones expressed: 0.06
Cluster number: 468
Cluster clones: 700265369H1 700261176H1
Percent of clones expressed: 0.06
Homologous match to
g1305548  Glycine max asparagine synthetase mRNA, complete cds.
Cluster number: 608
Cluster clones: 700264325H1 700264766H1
Percent of clones expressed: 0.06
Cluster number: 613
Cluster clones: 700264435H1 700265218H1
Percent of clones expressed: 0.06
Weak match to
g2564237  omega-6 desaturase
Cluster number: 582
Cluster clones: 700267447H1 700263622H1
Percent of clones expressed: 0.06
Homologous match to
g1322621  NBP35
Cluster number: 502
Cluster clones: 700263918H1 700261873H1
Percent of clones expressed: 0.06
Homologous match to
g2244827  hypothetical protein
Cluster number: 688
Cluster clones: 700266948H1 700266956H1
Percent of clones expressed: 0.06
Cluster number: 630
Cluster clones: 700266569H1 700264810H1
Percent of clones expressed: 0.06
Cluster number: 106
Cluster clones: 700256921H1 700257781H1
Percent of clones expressed: 0.06
Weak match to
g531481  P. ciliare (Higgins) apospory associated mRNA, 1398bp.
Cluster number: 379
Cluster clones: 700262872H1 700259092H1
Percent of clones expressed: 0.06
Homologous match to
g2828151  cyclophilin-33B
Cluster number: 647
Cluster clones: 700265467H1 700265271H1
Percent of clones expressed: 0.06
Cluster number: 519
Cluster clones: 700262326H1 700263710H1
Percent of clones expressed: 0.06
Homologous match to
g2465430  JRG1.3; 32 kDa protein
Cluster number: 145
Cluster clones: 700265752H1 700257152H1
Percent of clones expressed: 0.06
Cluster number: 413
Cluster clones: 700263724H1 700260133H1
Percent of clones expressed: 0.06
Cluster number: 541
Cluster clones: 700262812H1 700263453H1
Percent of clones expressed: 0.06
Cluster number: 671
Cluster clones: 700267744H1 700266245H1
Percent of clones expressed: 0.06
Cluster number: 70
Cluster clones: 700256752H1 700264212H1
Percent of clones expressed: 0.06
Cluster number: 147
Cluster clones: 700265754H1 700257154H1
Percent of clones expressed: 0.06
Weak match to
g1813968  HCMVUL61
Cluster number: 558
Cluster clones: 700263074H1 700264529H1

TABLE 2-continued

UNIQUE AND HOMOLOGOUS CLUSTERS IN SATMON022023
COPYRIGHT 1998 INCYTE PHARMACEUTICALS, INC.

```
Percent of clones expressed: 0.06
Homologous match to
g2352492         TIR1; transport inhibitor response 1
Cluster number: 415
Cluster clones:       700260139H1       700264067H1
Percent of clones expressed: 0.06
Cluster number: 324
Cluster clones:       700258528H1       700267309H1
Percent of clones expressed: 0.06
Homologous match to
g1143499         H. vulgare mRNA for ADP-glucose pyrophosphorylase small subunit.
Cluster number: 580
Cluster clones:       700264021H1       700263550H1
Percent of clones expressed: 0.06
Homologous match to
g1122312         P. glaucum mRNA for heat shock protein, HSP 16.9.
Cluster number: 609
Cluster clones:       700265696H1       700264338H1
Percent of clones expressed: 0.06
Cluster number: 649
Cluster clones:       700265404H1       700265420H1
Percent of clones expressed: 0.06
Cluster number: 597
Cluster clones:       700266061H1       700264101H1
Percent of clones expressed: 0.06
Cluster number: 235
Cluster clones:       700261288H1       700257866H1
Percent of clones expressed: 0.06
Cluster number: 15
Cluster clones:       700266821H1       700207154H1
Percent of clones expressed: 0.06
Cluster number: 130
Cluster clones:       700267867H1       700257080H1
Percent of clones expressed: 0.06
Homologous match to
g295925          RPG19; ribosomal protein
Cluster number: 200
Cluster clones:       700257575H1       700258276H1
Percent of clones expressed: 0.06
Homologous match to
g2673912         T24P15.12
Cluster number: 503
Cluster clones:       700261877H1       700263822H1
Percent of clones expressed: 0.06
Cluster number: 631
Cluster clones:       700264837H1       700265410H1
Percent of clones expressed: 0.06
Homologous match to
g1871196         T06D20.22
Cluster number: 491
Cluster clones:       700262550H1       700261652H1
Percent of clones expressed: 0.06
Homologous match to
g158308          Dsub\Rp49
Cluster number: 364
Cluster clones:       700258946H1       700264230H1
Percent of clones expressed: 0.06
Cluster number: 648
Cluster clones:       700265281H1       700266964H1
Percent of clones expressed: 0.06
Weak match to
g415314          Rice mRNA for NADP dependent malic enzyme, complete cds.
Cluster number: 146
Cluster clones:       700265753H1       700257153H1
Percent of clones expressed: 0.06
Homologous match to
g289749          ZK1236.7 protein
Cluster number: 670
Cluster clones:       700266377H1       700266204H1
Percent of clones expressed: 0.06
Cluster number: 274
Cluster clones:       700264174H1       700258208H1
Percent of clones expressed: 0.06
Homologous match to
g1788589         o660; This 660 aa ORF is 30 pct identical (9 gaps) to 301 residues
                 of an approx. 320 aa protein FMT_ECOLI SW: P23882
```

TABLE 2-continued

UNIQUE AND HOMOLOGOUS CLUSTERS IN SATMON022023
COPYRIGHT 1998 INCYTE PHARMACEUTICALS, INC.

Cluster number: 632
Cluster clones: 700264859H1 700264884H1
Percent of clones expressed: 0.06
Cluster number: 687
Cluster clones: 700266930H1 700267050H1
Percent of clones expressed: 0.06
Cluster number: 325
Cluster clones: 700258530H1 700262088H1
Percent of clones expressed: 0.06
Weak match to
g479146          putative ATP synthase subunit
Cluster number: 27
Cluster clones: 700612490H1 700612385H1 700461251H1 700612484H1 700461151H1
700612384H1 700616535H1 700614492H1 700615823H1
Percent of clones expressed: 0.83
Cluster number: 195
Cluster clones: 700614804H1 700617467H1 700616219H1 700615762H1 700613366H1
700616166H1 700615063H1 700613383H1 700615910H1
Percent of clones expressed: 0.83
Homologous match to
g927239          Glb1; globulin1
Cluster number: 238
Cluster clones: 700614478H1 700617616H1 700616030H1 700617633H1 700615250H1
700617463H1 700613994H1 700614079H1
Percent of clones expressed: 0.74
Homologous match to
g2564051         Arabidopsis thaliana genomic DNA, chromosome 5, P1 clone: MWD9,
                 complete sequence.
Cluster number: 217
Cluster clones: 700616325H1 700617108H1 700616885H1 700613938H1 700616492H1
700613904H1 700613916H1 700613823H1
Percent of clones expressed: 0.74
Homologous match to
g296094          M(3)95A; ribosomal protein S3
Cluster number: 144
Cluster clones: 700612838H1 700614159H1 700618455H2 700613865H1 700613843H1
700614163H1 700616055H1
Percent of clones expressed: 0.65
Homologous match to
g790640          Hordeum vulgare gamma-thionin (HTH3) mRNA, complete cds.
Cluster number: 96
Cluster clones: 700616172H1 700612544H1 700616239H1 700615865H1 700618678H1
700615857H1 700616743H1
Percent of clones expressed: 0.65
Homologous match to
g313026          L. esculentum rpl38 mRNA for ribosomal protein L30.
Cluster number: 40
Cluster clones: 700617162H1 700614349H1 700461172H1 700612467H1 700461272H1
700615208H1
Percent of clones expressed: 0.56
Cluster number: 285
Cluster clones: 700616783H1 700618556H1 700616541H1 700618102H1 700614983H1
700616813H1
Percent of clones expressed: 0.56
Weak match to
g1015315         Pisum sativum (clone PsRCI35-2) ribosomal protein L41 mRNA,
                 complete cds.
Cluster number: 237
Cluster clones: 700613985H1 700614487H1 700614572H1 700614758H1 700617421H1
700616088H1
Percent of clones expressed: 0.56
Homologous match to
g2244857         hypothetical protein
Cluster number: 198
Cluster clones: 700613391H1 700617958H1 700615155H1 700618544H1 700614013H1
700614058H1
Percent of clones expressed: 0.56
Weak match to
g2765836         Arabidopsis thaliana mRNA for nitrilase associated protein
                 NAP16kDa.
Cluster number: 95
Cluster clones: 700612637H1 700613884H1 700614904H1 700617159H1 700615618H1
700612541H1
Percent of clones expressed: 0.56
Homologous match to
g2760173         Arabidopsis thaliana genomic DNA, chromosome 5, P1 clone: MYH19,

TABLE 2-continued

UNIQUE AND HOMOLOGOUS CLUSTERS IN SATMON022023
COPYRIGHT 1998 INCYTE PHARMACEUTICALS, INC.

complete sequence.
Cluster number: 129
Cluster clones: 700612879H1   700613815H1   700612744H1   700617319H1   700613042H1
700613808H1
Percent of clones expressed: 0.56
Homologous match to
g2408019        SPAC17G6.06; 40s ribosomal protein
Cluster number: 230
Cluster clones: 700615723H1   700613960H1   700615271H1   700613926H1   700615493H1
Percent of clones expressed: 0.46
Homologous match to
g432367         Rice mRNA for elongation factor 1 beta, complete cds.
Cluster number: 63
Cluster clones: 700617247H1   700613685H1   700617685H1   700612322H1   700617582H1
Percent of clones expressed: 0.46
Homologous match to
g218160         Oryza sativa mRNA for elongation factor 1 beta'.
Cluster number: 51
Cluster clones: 700612687H1   700614552H1   700461288H1   700461188H1   700614520H1
Percent of clones expressed: 0.46
Cluster number: 68
Cluster clones: 700614087H1   700612583H1   700612353H1   700612588H1   700616043H1
Percent of clones expressed: 0.46
Homologous match to
g474009 Rice mRNA, partial homologous to ribosomal protein S19 gene.
Cluster number: 81
Cluster clones: 700614700H1   700613121H1   700612426H1   700613736H1   700613004H1
Percent of clones expressed: 0.46
Homologous match to
g540534         Rice mRNA for q group of receptor for activated C-kinase, complete
                cds.
Cluster number: 105
Cluster clones: 700618591H1   700616740H1   700618135H1   700612581H1
Percent of clones expressed: 0.37
Homologous match to
g1633049        RpL22; ribosomal protein Rp122
Cluster number: 269
Cluster clones: 700614534H1   700616105H1   700616419H1   700614688H1
Percent of clones expressed: 0.37
Homologous match to
g1553130        Gossypium hirsutum ribosomal protein L44 isoform b (RL44),
                complete cds.
Cluster number: 178
Cluster clones: 700613175H1   700613176H1   700616402H1   700615274H1
Percent of clones expressed: 0.37
Homologous match to
g1542941        AACT; Acetoacetyl-coenzyme A thiolase; EC 2.3.1.9
Cluster number: 201
Cluster clones: 700616721H1   700613480H1   700613448H1   700614258H1
Percent of clones expressed: 0.37
Weak match to
g1060912        RP85
Cluster number: 119
Cluster clones: 700612668H1   700615231H1   700615447H1   700616068H1
Percent of clones expressed: 0.37
Weak match to
g170899         peroxisomal membrane protein (PMP20A)
Cluster number: 176
Cluster clones: 700615337H1   700613171H1   700616224H1   700616322H1
Percent of clones expressed: 0.37
Homologous match to
g1272405        Arabidopsis thaliana immunophilin (FKBP15-1) mRNA, complete cds.
Cluster number: 222
Cluster clones: 700614535H1   700617606H1   700617205H1   700613857H1
Percent of clones expressed: 0.37
Homologous match to
g458972         F37C12.4
Cluster number: 37
Cluster clones: 700613787H1   700461167H1   700461267H1   700614006H1
Percent of clones expressed: 0.37
Weak match to
g2264309        Arabidopsis thaliana genomic DNA, chromosome 5, P1 clone: MJJ3,
                complete sequence.
Cluster number: 314
Cluster clones: 700615855H1   700617825H1   700615915H1   700616379H1
Percent of clones expressed: 0.37

TABLE 2-continued

UNIQUE AND HOMOLOGOUS CLUSTERS IN SATMON022023
COPYRIGHT 1998 INCYTE PHARMACEUTICALS, INC.

Cluster number: 101
Cluster clones: 700613036H1 700613431H1 700612560H1 700614704H1
Percent of clones expressed: 0.37
Homologous match to
g416265  Rice mRNA for ribosomal protein A2, partial sequence.
Cluster number: 218
Cluster clones: 700613829H1 700614882H1 700614889H1
Percent of clones expressed: 0.28
Weak match to
g2252849  A_TM018A10.1
Cluster number: 276
Cluster clones: 700615878H1 700614761H1 700615106H1
Percent of clones expressed: 0.28
Homologous match to
g1181672  Sorghum bicolor heat shock protein 70 cognate (hsc70) mRNA, partial cds.
Cluster number: 346
Cluster clones: 700617791H1 700616956H1 700617411H1
Percent of clones expressed: 0.28
Homologous match to
g2150129  Arabidopsis thaliana cytoplasmic ribosomal protein S15a mRNA, complete cds.
Cluster number: 134
Cluster clones: 700617169H1 700617208H1 700612791H1
Percent of clones expressed: 0.28
Cluster number: 298
Cluster clones: 700615177H1 700616314H1 700616307H1
Percent of clones expressed: 0.28
Homologous match to
g436031  Nicotiana tabacum (TSC40-4) 60S ribosomal protein L34 mRNA, complete cds.
Cluster number: 154
Cluster clones: 700612923H1 700616940H1 700614467H1
Percent of clones expressed: 0.28
Homologous match to
g1353644  L43
Cluster number: 88
Cluster clones: 700613751H1 700616536H1 700612470H1
Percent of clones expressed: 0.28
Cluster number: 203
Cluster clones: 700614886H1 700613720H1 700613686H1
Percent of clones expressed: 0.28
Homologous match to
g506471  unnamed protein product
Cluster number: 297
Cluster clones: 700616734H1 700615685H1 700615172H1
Percent of clones expressed: 0.28
Homologous match to
g2331300  Zea mays ribosomal protein S4 type I (rps4) mRNA, complete cds.
Cluster number: 193
Cluster clones: 700613360H1 700616341H1 700615541H1
Percent of clones expressed: 0.28
Homologous match to
g4755  ORF1
Cluster number: 174
Cluster clones: 700613407H1 700614830H1 700613160H1
Percent of clones expressed: 0.28
Homologous match to
g1276652  Porphyra purpurea chloroplast genome, complete sequence.
Cluster number: 196
Cluster clones: 700613376H1 700617820H1 700615183H1
Percent of clones expressed: 0.28
Homologous match to
g463251  M. sativa (Nagyszenasi) mRNA for ribosomal protein RL5.
Cluster number: 300
Cluster clones: 700617711H1 700615223H1 700617716H1
Percent of clones expressed: 0.28
Cluster number: 225
Cluster clones: 700613875H1 700615270H1 700615279H1
Percent of clones expressed: 0.28
Cluster number: 177
Cluster clones: 700613174H1 700618523H1 700614374H1
Percent of clones expressed: 0.28
Cluster number: 311
Cluster clones: 700615959H1 700615927H1 700615792H1
Percent of clones expressed: 0.28

TABLE 2-continued

UNIQUE AND HOMOLOGOUS CLUSTERS IN SATMON022023
COPYRIGHT 1998 INCYTE PHARMACEUTICALS, INC.

Cluster number: 231
Cluster clones:      700616737H1      700615918H1      700613936H1
Percent of clones expressed: 0.28
Weak match to
g2645165           Oryza sativa mRNA, similar to ribosomal protein 41.
Cluster number: 142
Cluster clones:      700613419H1      700614067H1      700612824H1
Percent of clones expressed: 0.28
Homologous match to
g886739            Z. mays histone H4 gene.
Cluster number: 321
Cluster clones:      700616049H1      700617120H1      700617427H1
Percent of clones expressed: 0.28
Homologous match to
g169537            Potato pyrophosphate-fructose 6-phosphate 1-phosphotransferase
                   (PFP) alpha-subunit mRNA, complete cds.
Cluster number: 136
Cluster clones:      700612810H1      700612803H1      700614203H1
Percent of clones expressed: 0.28
Homologous match to
g2288886           Arabidopsis thaliana mRNA for mevalonate diphosphate
                   decarboxylase.
Cluster number: 277
Cluster clones:      700614763H1      700615175H1      700617682H1
Percent of clones expressed: 0.28
Weak match to
g2656031           Arabidopsis thaliana genomic DNA, chromosome 5, P1 clone: MXC20.
Cluster number: 358
Cluster clones:      700617506H1      700617538H1      700617585H1
Percent of clones expressed: 0.28
Cluster number: 124
Cluster clones:      700612713H1      700612712H1      700615508H1
Percent of clones expressed: 0.28
Homologous match to
g1762930           Nicotiana tabacum ribosomal protein S14 mRNA, partial cds.
Cluster number: 66
Cluster clones:      700612346H1      700616014H1      700614219H1
Percent of clones expressed: 0.28
Homologous match to
g536891            Wheat mRNA for protein H2A, complete cds, clone wcH2A-4.
Cluster number: 73
Cluster clones:      700612367H1      700617929H1      700618125H1
Percent of clones expressed: 0.28
Cluster number: 59
Cluster clones:      700612309H1      700612636H1      700613161H1
Percent of clones expressed: 0.28
Homologous match to
g2656028           Arabidopsis thaliana genomic DNA, chromosome 5, P1 clone: MNF13.
Cluster number: 289
Cluster clones:      700615041H1      700616380H1      700615082H1
Percent of clones expressed: 0.28
Homologous match to
g1370141           L. japonicus mRNA for small GTP-binding protein, RAB11A.
Cluster number: 164
Cluster clones:      700613018H1      700617409H1      700614538H1
Percent of clones expressed: 0.28
Cluster number: 77
Cluster clones:      700612747H1      700613021H1      700612382H1
Percent of clones expressed: 0.28
Weak match to
g2465927           RKF3; receptor-like serine/threonine kinase
Cluster number: 132
Cluster clones:      700614362H1      700612761H1      700613889H1
Percent of clones expressed: 0.28
Homologous match to
g2529657           Arabidopsis thaliana chromosome II BAC T30B22 genomic sequence,
                   complete sequence.
Cluster number: 254
Cluster clones:      700614352H1      700614347H1      700616085H1
Percent of clones expressed: 0.28
Cluster number: 275
Cluster clones:      700616679H1      700616988H1      700614760H1
Percent of clones expressed: 0.28
Homologous match to
g2827544           T12H17.60; HSP associated protein like
Cluster number: 293

TABLE 2-continued

UNIQUE AND HOMOLOGOUS CLUSTERS IN SATMON022023
COPYRIGHT 1998 INCYTE PHARMACEUTICALS, INC.

Cluster clones: 700615233H1 700615077H1 700615309H1
Percent of clones expressed: 0.28
Weak match to
g2213425  unknown; hypothetical protein
Cluster number: 190
Cluster clones: 700613705H1 700613329H1 700613704H1
Percent of clones expressed: 0.28
Cluster number: 243
Cluster clones: 700614060H1 700616082H1
Percent of clones expressed: 0.19
Homologous match to
g2634023  uridylate kinase
Cluster number: 313
Cluster clones: 700615812H1 700618612H1
Percent of clones expressed: 0.19
Homologous match to
g2789433  Lycopersicon esculentum mRNA for CLB1, complete cds.
Cluster number: 20
Cluster clones: 700461139H1 700461239H1
Percent of clones expressed: 0.19
Homologous match to
g2104956  Arabidopsis thaliana immunophilin (FKBP12) mRNA, complete cds.
Cluster number: 85
Cluster clones: 700616552H1 700612444H1
Percent of clones expressed: 0.19
Weak match to
g1063617  Yeast (Schizosaccharomyces pombe) cosmids 359, 1198 and 1683.
Cluster number: 240
Cluster clones: 700614010H1 700614183H1
Percent of clones expressed: 0.19
Homologous match to
g1167963  18-56 protein
Cluster number: 170
Cluster clones: 700613140H1 700613183H1
Percent of clones expressed: 0.19
Cluster number: 224
Cluster clones: 700613870H1 700617388H1
Percent of clones expressed: 0.19
Cluster number: 352
Cluster clones: 700617069H1 700617074H1
Percent of clones expressed: 0.19
Cluster number: 282
Cluster clones: 700617225H1 700614855H1
Percent of clones expressed: 0.19
Cluster number: 310
Cluster clones: 700615730H1 700616524H1
Percent of clones expressed: 0.19
Weak match to
g1542940  R. sativus L. (Saxa knacker) AACT mRNA.
Cluster number: 299
Cluster clones: 700618252H1 700615189H1
Percent of clones expressed: 0.19
Weak match to
g435456  Proso millet gene for aspartate aminotransferase, complete cds.
Cluster number: 205
Cluster clones: 700613703H1 700613706H1
Percent of clones expressed: 0.19
Cluster number: 167
Cluster clones: 700613106H1 700613112H1
Percent of clones expressed: 0.19
Homologous match to
g1006641  F46C5.8
Cluster number: 307
Cluster clones: 700615495H1 700617459H1
Percent of clones expressed: 0.19
Cluster number: 295
Cluster clones: 700618284H1 700615133H1
Percent of clones expressed: 0.19
Cluster number: 116
Cluster clones: 700612662H1 700617996H1
Percent of clones expressed: 0.19
Homologous match to
g556672  S. cereale (Halo) chloroplast mRNA for heat-shock protein.
Cluster number: 43
Cluster clones: 700461277H1 700461177H1
Percent of clones expressed: 0.19

TABLE 2-continued

UNIQUE AND HOMOLOGOUS CLUSTERS IN SATMON022023
COPYRIGHT 1998 INCYTE PHARMACEUTICALS, INC.

Cluster number: 244
Cluster clones: 700616922H1 700614069H1
Percent of clones expressed: 0.19
Cluster number: 36
Cluster clones: 700461165H1 700461265H1
Percent of clones expressed: 0.19
Cluster number: 283
Cluster clones: 700614924H1 700616613H1
Percent of clones expressed: 0.19
Cluster number: 353
Cluster clones: 700617259H1 700617267H1
Percent of clones expressed: 0.19
Cluster number: 29
Cluster clones: 700461254H1 700461154H1
Percent of clones expressed: 0.19
Cluster number: 220
Cluster clones: 700613837H1 700614026H1
Percent of clones expressed: 0.19
Cluster number: 82
Cluster clones: 700612427H1 700612442H1
Percent of clones expressed: 0.19
Weak match to
g2065531    Cel3; endo-1,4-beta-glucanase; EC 3.2.1.4
Cluster number: 128
Cluster clones: 700612737H1 700612771H1
Percent of clones expressed: 0.19
Cluster number: 194
Cluster clones: 700613364H1 700614892H1
Percent of clones expressed: 0.19
Homologous match to
g622980    Arabidopsis thaliana indole-3-glycerol phosphate synthase mRNA,
           complete cds.
Cluster number: 334
Cluster clones: 700616621H1 700616392H1
Percent of clones expressed: 0.19
Homologous match to
g21628     Sorghum vulgare mRNA for phosphoenolpyruvate involved in C4
           photosynthesis (EC 4.1.1.31).
Cluster number: 264
Cluster clones: 700614527H1 700614795H1
Percent of clones expressed: 0.19
Homologous match to
g2160155   Sequence of BAC F21M12 from Arabidopsis thaliana chromosome 1,
           complete sequence.
Cluster number: 8
Cluster clones: 700461114H1 700461214H1
Percent of clones expressed: 0.19
Cluster number: 186
Cluster clones: 700613275H1 700617263H1
Percent of clones expressed: 0.19
Homologous match to
g1841401   fae1; condensing enzyme involved in fatty acid chain elongation in
           developing seeds and podwall; fatty acid elongation 1
Cluster number: 34
Cluster clones: 700461262H1 700461162H1
Percent of clones expressed: 0.19
Cluster number: 117
Cluster clones: 700618388H1 700612663H1
Percent of clones expressed: 0.19
Cluster number: 7
Cluster clones: 700461211H1 700461111H1
Percent of clones expressed: 0.19
Weak match to
g600855    bZIP protein
Cluster number: 175
Cluster clones: 700615382H1 700613163H1
Percent of clones expressed: 0.19
Cluster number: 345
Cluster clones: 700616987H1 700616955H1
Percent of clones expressed: 0.19
Weak match to
g2564051   Arabidopsis thaliana genomic DNA, chromosome 5, P1 clone: MWD9,
           complete sequence.
Cluster number: 99
Cluster clones: 700618660H1 700612557H1
Percent of clones expressed: 0.19

TABLE 2-continued

UNIQUE AND HOMOLOGOUS CLUSTERS IN SATMON022023
COPYRIGHT 1998 INCYTE PHARMACEUTICALS, INC.

Homologous match to
g16086  A. porrum dnaJ mRNA for DNA J protein (partial).
Cluster number: 84
Cluster clones: 700612436H1  700612437H1
Percent of clones expressed: 0.19
Cluster number: 156
Cluster clones: 700612932H1  700615003H1
Percent of clones expressed: 0.19
Homologous match to
g600750  Sm D3
Cluster number: 265
Cluster clones: 700614531H1  700618478H2
Percent of clones expressed: 0.19
Cluster number: 335
Cluster clones: 700618588H1  700616433H1
Percent of clones expressed: 0.19
Cluster number: 65
Cluster clones: 700612337H1  700613934H1
Percent of clones expressed: 0.19
Cluster number: 137
Cluster clones: 700612806H1  700613971H1
Percent of clones expressed: 0.19
Cluster number: 306
Cluster clones: 700618618H1  700615458H1
Percent of clones expressed: 0.19
Cluster number: 3
Cluster clones: 700461104H1  700461204H1
Percent of clones expressed: 0.19
Cluster number: 12
Cluster clones: 700461118H1  700461218H1
Percent of clones expressed: 0.19
Cluster number: 130
Cluster clones: 700612745H1  700615851H1
Percent of clones expressed: 0.19
Homologous match to
g603269  YER036C; Yer036cp
Cluster number: 316
Cluster clones: 700615866H1  700615858H1
Percent of clones expressed: 0.19
Cluster number: 185
Cluster clones: 700613252H1  700615066H1
Percent of clones expressed: 0.19
Cluster number: 113
Cluster clones: 700615450H1  700612643H1
Percent of clones expressed: 0.19
Cluster number: 241
Cluster clones: 700614048H1  700617494H1
Percent of clones expressed: 0.19
Homologous match to
g577548  C16C10.7
Cluster number: 140
Cluster clones: 700613744H1  700612817H1
Percent of clones expressed: 0.19
Weak match to
g2565036  APC binding protein EB1
Cluster number: 210
Cluster clones: 700617087H1  700613747H1
Percent of clones expressed: 0.19
Weak match to
g736721  stearoyl-acyl carrier protein desaturse
Cluster number: 258
Cluster clones: 700617233H1  700614388H1
Percent of clones expressed: 0.19
Cluster number: 149
Cluster clones: 700615441H1  700612869H1
Percent of clones expressed: 0.19
Homologous match to
g886679  LeUBC1; ubiquitin conjugating enzyme
Cluster number: 236
Cluster clones: 700614376H1  700613970H1
Percent of clones expressed: 0.19
Homologous match to
g1430979  NOP1
Cluster number: 157
Cluster clones: 700612933H1  700615333H1
Percent of clones expressed: 0.19

TABLE 2-continued

UNIQUE AND HOMOLOGOUS CLUSTERS IN SATMON022023
COPYRIGHT 1998 INCYTE PHARMACEUTICALS, INC.

Cluster number: 227
Cluster clones: 700618649H1 700613886H1
Percent of clones expressed: 0.19
Cluster number: 219
Cluster clones: 700613831H1 700616041H1
Percent of clones expressed: 0.19
Cluster number: 89
Cluster clones: 700612471H1 700613716H1
Percent of clones expressed: 0.19
Homologous match to
g2388578 YUP8H12.20
Cluster number: 347
Cluster clones: 700617209H1 700616961H1
Percent of clones expressed: 0.19
Homologous match to
g1781347 S. tuberosum mRNA for protein homologous to plastidic aldolase, partial.
Cluster number: 121
Cluster clones: 700615530H1 700612681H1
Percent of clones expressed: 0.19
Cluster number: 336
Cluster clones: 700616463H1 700616606H1
Percent of clones expressed: 0.19
Cluster number: 280
Cluster clones: 700614118H1 700614809H1
Percent of clones expressed: 0.19
Homologous match to
g435172 A. sativa (Pewi) ASTCP-K19 mRNA for t complex polypeptide 1.
Cluster number: 266
Cluster clones: 700614542H1 700617941H1
Percent of clones expressed: 0.19
Cluster number: 138
Cluster clones: 700615207H1 700612807H1
Percent of clones expressed: 0.19
Homologous match to
g403318 COQ1 (YBR0109); hexaprenyl pyrophosphate synthetase
Cluster number: 208
Cluster clones: 700613734H1 700617006H1
Percent of clones expressed: 0.19
Homologous match to
g2958 Mucor racemosus RPG19 gene for ribosomal protein.
Cluster number: 26
Cluster clones: 700461249H1 700461149H1
Percent of clones expressed: 0.19
Cluster number: 102
Cluster clones: 700612567H1 700616372H1
Percent of clones expressed: 0.19
Homologous match to
g2641210 Fritillaria agrestis histone-like protein mRNA, complete cds.
Cluster number: 55
Cluster clones: 700461294H1 700461194H1
Percent of clones expressed: 0.19
Weak match to
g2230878 hNop56
Cluster number: 350
Cluster clones: 700616990H1 700618567H1
Percent of clones expressed: 0.19
Cluster number: 317
Cluster clones: 700615867H1 700615859H1
Percent of clones expressed: 0.19
Homologous match to
g1166431 Acl1; Cl-g1; acyl carrier protein
Cluster number: 330
Cluster clones: 700616327H1 700618263H1
Percent of clones expressed: 0.19
Homologous match to
g2443401 Oryza sativa mRNA for orthophosphate dikinase, complete cds.
Cluster number: 211
Cluster clones: 700613762H1 700613788H1
Percent of clones expressed: 0.19
Cluster number: 141
Cluster clones: 700612820H1 700614973H1
Percent of clones expressed: 0.19
Cluster number: 239
Cluster clones: 700614002H1 700618282H1
Percent of clones expressed: 0.19

TABLE 2-continued

UNIQUE AND HOMOLOGOUS CLUSTERS IN SATMON022023
COPYRIGHT 1998 INCYTE PHARMACEUTICALS, INC.

Weak match to
g1458245        F54D11.1
Cluster number: 356
Cluster clones:        700617406H1        700617407H1
Percent of clones expressed: 0.19
Cluster number: 21
Cluster clones:        700461140H1        700461240H1
Percent of clones expressed: 0.19
Homologous match to
g2827140        Arabidopsis thaliana cellulose synthase catalytic subunit (Ath-A)
                mRNA, complete cds.
Cluster number: 320
Cluster clones:        700616046H1        700616045H1
Percent of clones expressed: 0.19
Cluster number: 180
Cluster clones:        700613189H1        700613424H1
Percent of clones expressed: 0.19
Cluster number: 309
Cluster clones:        700615667H1        700615666H1
Percent of clones expressed: 0.19
Cluster number: 250
Cluster clones:        700614295H1        700614289H1
Percent of clones expressed: 0.19
Cluster number: 86
Cluster clones:        700613344H1        700612447H1
Percent of clones expressed: 0.19
Cluster number: 93
Cluster clones:        700612526H1        700614047H1
Percent of clones expressed: 0.19
Homologous match to
g2827079        Medicago sativa mitochondrial malate dehydrogenase precursor
                (mmdh) mRNA, nuclear gene encoding mitochondrial protein, complete cds.
Cluster number: 209
Cluster clones:        700616140H1        700613740H1
Percent of clones expressed: 0.19
Cluster number: 139
Cluster clones:        700612808H1        700612907H1
Percent of clones expressed: 0.19
Homologous match to
g348717         Medicago truncatula protochlorophyllide reductase homolgue protein
                mRNA, complete cds.
Cluster number: 337
Cluster clones:        700617464H1        700616538H1
Percent of clones expressed: 0.19
Weak match to
g2160182        F21M12.12
Cluster number: 197
Cluster clones:        700616583H1        700613386H1
Percent of clones expressed: 0.19
Cluster number: 267
Cluster clones:        700616761H1        700614565H1
Percent of clones expressed: 0.19
Homologous match to
g16931          60S ribosomal protein L32
Cluster number: 103
Cluster clones:        700612570H1        700618695H1
Percent of clones expressed: 0.19
Homologous match to
g558651         T. aestivum VDAC3 mRNA for voltage dependent anion channel.
Cluster number: 301
Cluster clones:        700617625H1        700615227H1
Percent of clones expressed: 0.19
Homologous match to
g309071         RPS7; ribosomal protein S7
Cluster number: 260
Cluster clones:        700614451H1        700614452H1
Percent of clones expressed: 0.19
Cluster number: 161
Cluster clones:        700613011H1        700615185H1
Percent of clones expressed: 0.19
Homologous match to
g2529386        Zea mays triosephosphate isomerase 1 gene, exon 2-9 and complete
                cds.
Cluster number: 318
Cluster clones:        700615868H1        700615860H1
Percent of clones expressed: 0.19

TABLE 2-continued

UNIQUE AND HOMOLOGOUS CLUSTERS IN SATMON022023
COPYRIGHT 1998 INCYTE PHARMACEUTICALS, INC.

Cluster number: 6
Cluster clones: 700461107H1    700461207H1
Percent of clones expressed: 0.19
Cluster number: 261
Cluster clones: 700614472H1    700614956H1
Percent of clones expressed: 0.19
Weak match to
g559557    AGP; arabinogalactan-protein
Cluster number: 340
Cluster clones: 700616615H1    700617789H1
Percent of clones expressed: 0.19
Cluster number: 212
Cluster clones: 700613763H1    700616010H1
Percent of clones expressed: 0.19
Cluster number: 45
Cluster clones: 700616753H1    700461180H1
Percent of clones expressed: 0.19
Weak match to
g2465428    JRG1.2; 32 kDa protein
Cluster number: 270
Cluster clones: 700618001H1    700614696H1
Percent of clones expressed: 0.19
Weak match to
g2244870    Arabidopsis thaliana DNA chromosome 4, ESSA I contig fragment No. 3.
Cluster number: 38
Cluster clones: 700461268H1    700461168H1
Percent of clones expressed: 0.19
Weak match to
g1532072    Z. mays mRNA for S-adenosylmethionine decarboxylase.
Cluster number: 287
Cluster clones: 700617890H1    700615008H1
Percent of clones expressed: 0.19
Weak match to
g2264305    Arabidopsis thaliana genomic DNA, chromosome 5, P1 clone: MBK23, complete sequence.
Cluster number: 357
Cluster clones: 700617472H1    700617471H1
Percent of clones expressed: 0.19
Weak match to
g1788589    o660; This 660 aa ORF is 30 pct identical (9 gaps) to 301 residues of an approx. 320 aa protein FMT__ECOLI SW: P23882
Cluster number: 296
Cluster clones: 700618146H1    700615157H1
Percent of clones expressed: 0.19
Homologous match to
g975887    Mesembryanthemum crystallinum myo-inositol-1-phosphate synthase mRNA, complete cds.
Cluster number: 123
Cluster clones: 700612710H1    700615067H1
Percent of clones expressed: 0.19
Cluster number: 251
Cluster clones: 700614312H1    700617451H1
Percent of clones expressed: 0.19
Homologous match to
g1890353    B. napus mRNA for ascorbate peroxidase.
Cluster number: 331
Cluster clones: 700616331H1    700616779H1
Percent of clones expressed: 0.19
Homologous match to
g2244898    strong similarity to protein phosphatase 2A regulatory chain, 74K
Cluster number: 11
Cluster clones: 700461117H1    700461217H1
Percent of clones expressed: 0.19
Cluster number: 268
Cluster clones: 700617904H1    700614593H1
Percent of clones expressed: 0.19
Cluster number: 69
Cluster clones: 700614705H1    700612357H1
Percent of clones expressed: 0.19
Weak match to
g1906830    heat shock protein
Cluster number: 302
Cluster clones: 700615286H1    700617690H1
Percent of clones expressed: 0.19
Cluster number: 360

TABLE 2-continued

UNIQUE AND HOMOLOGOUS CLUSTERS IN SATMON022023
COPYRIGHT 1998 INCYTE PHARMACEUTICALS, INC.

```
Cluster clones:        700618490H2  700617614H1
Percent of clones expressed: 0.19
Cluster number: 76
Cluster clones:        700612380H1       700613350H1
Percent of clones expressed: 0.19
Cluster number: 90
Cluster clones:        700614003H1       700612486H1
Percent of clones expressed: 0.19
Homologous match to
g2113867               rplD
Cluster number: 290
Cluster clones:        700616513H1       700615051H1
Percent of clones expressed: 0.19
Cluster number: 232
Cluster clones:        700613946H1       700616369H1
Percent of clones expressed: 0.19
Weak match to
g2244904               similar to hypothetical protein C02F5.7 - Caenorha
Cluster number: 83
Cluster clones:        700612435H1       700613153H1
Percent of clones expressed: 0.19
Cluster number: 23
Cluster clones:        700461243H1       700461143H1
Percent of clones expressed: 0.19
Cluster number: 319
Cluster clones:        700616023H1       700616756H1
Percent of clones expressed: 0.19
Homologous match to
g2088722               F53G12.10
Cluster number: 179
Cluster clones:        700613185H1       700614709H1
Percent of clones expressed: 0.19
Weak match to
g2351071               Arabidopsis thaliana genomic DNA, chromosome 5, P1 clone: MVA3.
Cluster number: 213
Cluster clones:        700613764H1       700613772H1
Percent of clones expressed: 0.19
Cluster number: 341
Cluster clones:        700617985H1       700616755H1
Percent of clones expressed: 0.19
Cluster number: 271
Cluster clones:        700618477H2       700614703H1
Percent of clones expressed: 0.19
Homologous match to
g1161311               Arabidopsis thaliana Columbia myo-inositol-1-phosphate synthase
                       mRNA, complete cds.
Cluster number: 278
Cluster clones:        700615933H1       700614768H1
Percent of clones expressed: 0.19
Homologous match to
g2565339               Lupinus luteus ribosomal protein S14 (rps14) mRNA, complete cds.
Cluster number: 1
Cluster clones:        700461101H1       700461201H1
Percent of clones expressed: 0.19
Weak match to
g1931649               T19D16.15; DNA helicase isolog
Cluster number: 288
Cluster clones:        700618549H1       700615031H1
Percent of clones expressed: 0.19
Cluster number: 348
Cluster clones:        700618496H2  700616962H1
Percent of clones expressed: 0.19
Homologous match to
g1006830               Gossypium hirsutum acyl-CoA-binding protein mRNA, complete cds.
Cluster number: 308
Cluster clones:        700618356H1       700615562H1
Percent of clones expressed: 0.19
Cluster number: 28
Cluster clones:        700461252H1       700461152H1
Percent of clones expressed: 0.19
Cluster number: 42
Cluster clones:        700461276H1       700461176H1
Percent of clones expressed: 0.19
Homologous match to
g1871173               Arabidopsis thaliana chromosome II BAC T06D20 genomic sequence,
                       complete sequence.
```

TABLE 2-continued

UNIQUE AND HOMOLOGOUS CLUSTERS IN SATMON022023
COPYRIGHT 1998 INCYTE PHARMACEUTICALS, INC.

Cluster number: 252
Cluster clones: 700614336H1 700615840H1
Percent of clones expressed: 0.19
Cluster number: 322
Cluster clones: 700616065H1 700618590H1
Percent of clones expressed: 0.19
Cluster number: 182
Cluster clones: 700613217H1 700617532H1
Percent of clones expressed: 0.19
Homologous match to
g2160158 F21M12.3
Cluster number: 312
Cluster clones: 700615793H1 700618525H1
Percent of clones expressed: 0.19
Cluster number: 339
Cluster clones: 700616574H1 700616578H1
Percent of clones expressed: 0.19
Weak match to
g2351061 Arabidopsis thaliana genomic DNA, chromosome 5, P1 clone: MAF19.
Cluster number: 199
Cluster clones: 700613780H1 700613403H1
Percent of clones expressed: 0.19
Cluster number: 163
Cluster clones: 700613048H1 700613016H1
Percent of clones expressed: 0.19
Homologous match to
g2245038 hypothetical protein
Cluster number: 291
Cluster clones: 700617303H1 700615053H1
Percent of clones expressed: 0.19
Weak match to
g218099 Rice mRNA for ribosomal protein S12 (320 gene), partial sequence.
Cluster number: 233
Cluster clones: 700613949H1 700613950H1
Percent of clones expressed: 0.19
Cluster number: 303
Cluster clones: 700615328H1 700617945H1
Percent of clones expressed: 0.19
Homologous match to
g1167953 putative 32.6 kDa jasmonate-induced protein
Cluster number: 361
Cluster clones: 700617803H1 700617688H1
Percent of clones expressed: 0.19
Cluster number: 242
Cluster clones: 700614213H1 700614052H1
Percent of clones expressed: 0.19
Homologous match to
g2245020 growth regulator homolog
Cluster number: 221
Cluster clones: 700613844H1 700615734H1
Percent of clones expressed: 0.19
Cluster number: 259
Cluster clones: 700614389H1 700615168H1
Percent of clones expressed: 0.19
Cluster number: 80
Cluster clones: 700613778H1 700612408H1
Percent of clones expressed: 0.19
Homologous match to
g2688979 AtKUP1; high-affinity potassium transporter
Cluster number: 9
Cluster clones: 700461215H1 700461115H1
Percent of clones expressed: 0.19
Cluster number: 342
Cluster clones: 700617573H1 700616757H1
Percent of clones expressed: 0.19
Cluster number: 329
Cluster clones: 700616321H1 700616507H1
Percent of clones expressed: 0.19
Cluster number: 272
Cluster clones: 700615018H1 700614712H1
Percent of clones expressed: 0.19
Homologous match to
g2270994 GmPM13; Ca + 2-binding EF hand protein
Cluster number: 214
Cluster clones: 700613774H1 700616059H1
Percent of clones expressed: 0.19

TABLE 2-continued

UNIQUE AND HOMOLOGOUS CLUSTERS IN SATMON022023
COPYRIGHT 1998 INCYTE PHARMACEUTICALS, INC.

Cluster number: 359
Cluster clones: 700617507H1 700617539H1
Percent of clones expressed: 0.19
Homologous match to
g2586122 Allium porrum b-keto acyl reductase (glossy8) mRNA, partial cds.
Cluster number: 223
Cluster clones: 700613867H1 700616992H1
Percent of clones expressed: 0.19
Homologous match to
g499294 asparaginyl endopeptidase (Legumain)
Cluster number: 125
Cluster clones: 700615193H1 700612714H1
Percent of clones expressed: 0.19
Cluster number: 32
Cluster clones: 700461159H1 700461259H1
Percent of clones expressed: 0.19
Cluster number: 151
Cluster clones: 700613806H1 700612905H1
Percent of clones expressed: 0.19
Homologous match to
g1208445 Rice (YK426) mRNA, complete cds.
Cluster number: 234
Cluster clones: 700613951H1 700613955H1
Percent of clones expressed: 0.19
Cluster number: 351
Cluster clones: 700617016H1 700617488H1
Percent of clones expressed: 0.19
Homologous match to
g166410 nucleic acid binding protein; Alfin-1
Cluster number: 362
Cluster clones: 700617741H1 700618491H2
Percent of clones expressed: 0.19
Homologous match to
g21271 S. oleracea mRNA for phosphoglycerate kinase (chloroplast isoenzyme).
Cluster number: 153
Cluster clones: 700612929H1 700612921H1
Percent of clones expressed: 0.19
Homologous match to
g575291 H. vulgare mRNA for SNF1-related protein kinase.
Cluster number: 61
Cluster clones: 700612316H1 700613330H1
Percent of clones expressed: 0.19
Cluster number: 106
Cluster clones: 700612592H1 700613101H1
Percent of clones expressed: 0.19
Weak match to
g972261 expressed sequence tag; human homolog
Cluster number: 343
Cluster clones: 700616845H1 700617245H1
Percent of clones expressed: 0.19
Cluster number: 145
Cluster clones: 700612847H1 700613662H1
Percent of clones expressed: 0.19
Cluster number: 54
Cluster clones: 700461293H1 700461193H1
Percent of clones expressed: 0.19
Cluster number: 56
Cluster clones: 700461295H1 700461195H1
Percent of clones expressed: 0.19
Weak match to
g1098971 myo-inositol monophosphatase 3
Cluster number: 49
Cluster clones: 700461284H1 700461184H1
Percent of clones expressed: 0.19
Homologous match to
g310932 Nicotiana tabacum ribosomal protein L17 mRNA, complete cds.
Cluster number: 4
Cluster clones: 700461205H1 700461105H1
Percent of clones expressed: 0.19
Homologous match to
g1711035 Pisum sativum hydroxyproline rich glycoprotein PsHRGP1 mRNA, partial cds.
Cluster number: 187
Cluster clones: 700613304H1 700614027H1
Percent of clones expressed: 0.19

TABLE 2-continued

UNIQUE AND HOMOLOGOUS CLUSTERS IN SATMON022023
COPYRIGHT 1998 INCYTE PHARMACEUTICALS, INC.

Homologous match to
g1143863    Oryza sativa beta-glucosidase mRNA, nuclear gene encoding
            chloroplast protein, complete cds.
Cluster number: 5
Cluster clones:    700461206H1    700461106H1
Percent of clones expressed: 0.19
Weak match to
g2829910    F22K20.5
Cluster number: 47
Cluster clones:    700461282H1    700461182H1
Percent of clones expressed: 0.19
Homologous match to
g1737491    Triticum aestivum poly(A)-binding protein (wheatpab) mRNA,
            complete cds.
Cluster number: 184
Cluster clones:    700615215H1    700613245H1
Percent of clones expressed: 0.19
Homologous match to
g1053056    Triticum aestivum histone H3 gene, partial cds, clone W1.
Cluster number: 363
Cluster clones:    700618281H1    700618261H1
Percent of clones expressed: 0.19
Cluster number: 305
Cluster clones:    700618095H1    700615446H1
Percent of clones expressed: 0.19
Weak match to
g22526    Zea mays mRNA encoding a zein (clone zA1).
Cluster number: 327
Cluster clones:    700616457H1    700616208H1
Percent of clones expressed: 0.19
Homologous match to
g5069 Yeast (Saccharomyces pombe) rpl7 gene for ribosomal protein L7.
Cluster number: 107
Cluster clones:    700616385H1    700612604H1
Percent of clones expressed: 0.19
Cluster number: 87
Cluster clones:    700612465H1    700618510H1
Percent of clones expressed: 0.19
Homologous match to
g17863    r-protein BnS15a
Cluster number: 94
Cluster clones:    700612840H1    700612529H1
Percent of clones expressed: 0.19
Homologous match to
g1256495    H10H10.1
Cluster number: 216
Cluster clones:    700614875H1    700613809H1
Percent of clones expressed: 0.19
Cluster number: 262
Cluster clones:    700614476H1    700614930H1
Percent of clones expressed: 0.19
Weak match to
g872079    M20.5
Cluster number: 344
Cluster clones:    700617033H1    700616933H1
Percent of clones expressed: 0.19
Cluster number: 274
Cluster clones:    700617533H1    700614728H1
Percent of clones expressed: 0.19
Homologous match to
g16204    A. thaliana mRNA for beta-oxoacyl-(acyl carrier protein) reductase.
Cluster number: 192
Cluster clones:    700613356H1    700613355H1
Percent of clones expressed: 0.19
Cluster number: 325
Cluster clones:    700616120H1    700616111H1
Percent of clones expressed: 0.19
Cluster number: 39
Cluster clones:    700461169H1    700461269H1
Percent of clones expressed: 0.19
Weak match to
g1173840    malonyl-CoA:ACP transacylase
Cluster number: 364
Cluster clones:    700618620H1    700618629H1
Percent of clones expressed: 0.19
Cluster number: 46

TABLE 2-continued

UNIQUE AND HOMOLOGOUS CLUSTERS IN SATMON022023
COPYRIGHT 1998 INCYTE PHARMACEUTICALS, INC.

| | |
|---|---|
| Cluster clones: 700461281H1 | 700461181H1 |
| Percent of clones expressed: 0.19 | |
| Cluster number: 349 | |
| Cluster clones: 700616967H1 | 700617522H1 |
| Percent of clones expressed: 0.19 | |
| Cluster number: 53 | |
| Cluster clones: 700461191H1 | 700461291H1 |
| Percent of clones expressed: 0.19 | |

SEQUENCE LISTING (7600 sequences)

SEQ ID NO: 1 - DNA, 267 bp, Zea mays
  misc_feature: Incyte ID No: 700548301H1
  unsure 43, 80: a, t, c, g, or other
gaaggggcttgaggcatctagtagcaaggagagcgcgtgaggntcaggatctatctagtgttgtttatgaaaattgtatnctgggcttctcgagttagcagttcatatccttttaaccgcatcgcgtttcaggccatgtagcgatattgtttgtagtttgtaccgggagtaacatatttggttgagcttctacgtattgaagaaacaacttatctgtgaagctgatgtgaacaaattctatttattatctatttttagtttgttctg

SEQ ID NO: 2 - DNA, 180 bp, Zea mays
  misc_feature: Incyte ID No: 700548303H1
  unsure 45: a, t, c, g, or other
cacccaatcagatccgatttcgtagagatgaagccggcagtagangcggaggctgacgagcgagcggcggaggagatggcacctaagaaggcagcggctgccaagaaagcggccgaggaagttgaggtggaggaggtggtggacggggacgaggcggtcgatggggagggcgacggtgac

SEQ ID NO: 3 - DNA, 99 bp, Zea mays
  misc_feature: Incyte ID No: 700548305H1
  unsure 15, 32-33, 51, 73, 86, 94, 97: a, t, c, g, or other
ccgacgactcatcanacatggcgaaccggccnngcggcgaaggaagccctnctgcggcgtgcgacgcgtacgnactgaacactggntactggcnacngg

SEQ ID NO: 4 - DNA, 95 bp, Zea mays
  misc_feature: Incyte ID No: 700548306H1
  unsure 37-38, 44, 53, 55, 58, 63: a, t, c, g, or other
ttatgtgattgtgatttgggccgcataactacatgtnngcaganacaagggtntnccnccgtnaacagcagtgatgcggcccaaatccacaatca

SEQ ID NO: 5 - DNA, 270 bp, Zea mays
  misc_feature: Incyte ID No: 700548309H1
  unsure 51: a, t, c, g, or other
atgtggttcatggtgggcacttggctctttgcaccattcctgttcaatccnctggatttgagtggcagaagattgtggatgactggactgattggcacaagtggatcagcaatcgtggaggtattggtgtggcaccagagaaaagctgggagtcatggtgggaaaaagagcaggagccccttcgttactctgggaagcgtggtactattgttgaaatactgcttgcattgcgtttctttatctatcaatatggactcgtgtatcatctga

SEQ ID NO: 6 - DNA, 280 bp, Zea mays
  misc_feature: Incyte ID No: 700548311H1
agcaacccgccgcaatgtgaagaagaagagttctgacggcgacaaagaagacagcagaagcgagtccgtagtgacatctgagtgccaggatggccatcaagccaacacggaggctgggtgtgtcactccatcgtccaagccagtgtcaaggaagaggaagtgcgttgaacgaagccccgactgcattgcaagcaggctgcggtctcggctcagtatgccgtgatcccccccatggacagtgatcagcatcatgggtctctttttactgtctgaatgcaga

SEQ ID NO: 7 - DNA, 89 bp, Zea mays
  misc_feature: Incyte ID No: 700548313H1
  unsure 36, 46, 54-55, 59, 62, 65, 70: a, t, c, g, or other
ttatgtgattgtgatttgggccgcataactcatgtngcagagacangggtttanncttnacngcngtgangcggcccaaatcacaatca

SEQ ID NO: 8 - DNA, 282 bp, Zea mays
  misc_feature: Incyte ID No: 700548315H1
  unsure 158: a, t, c, g, or other
tatttatagactgatttgtgaattttgaattagttcttagtttctgtcatcataaataacatattcaaaattcacaaatcagtctataaataacaatccatgaaaggcagacacagtaggttcatcatgctgtgcaagtaaacaccattaatatgaancctccttccagatgttacatgcaagcatgtcaactgcctgctgaaactgattccaggctactgtactgctaatttaattatatatctagatcagtagataattgaaaatagattcacgaacagg

SEQ ID NO: 9 - DNA, 283 bp, Zea mays
  misc_feature: Incyte ID No: 700548316H1
  unsure 164: a, t, c, g, or other
gctgactgacgaggaggtcgacgagatgatccgtgaggccgacgtcgacggggacggccagatcaactaccgaggagtttgtcaaggttatgatggccaagtgaggagcggtccccgtgaaataagtatctatggattgaagcggattatcaggcacacaagcngtactttgtcatgtccctttgagtacgcatcagtgtcatgcaggtggttatgtcttgtagtggtccgtttaggcggtgtagtcatgggaacgcgacatcagatacctggtttcttttga

SEQ ID NO: 10 - DNA, 275 bp, Zea mays
  misc_feature: Incyte ID No: 700548317H1
  unsure 53, 135-136: a, t, c, g, or other
ccgaagggaagctgttacttggtatccgtccgactccacatcagctggtggangcttacctggcttagaagatctcgttagcgctgcaaaaccagagtcaagatcatctttgcaagacctgtattggggagatannctgctggaacatagtgccgctttcttccgttgaactcagtagcattgctatgcttgtgtaatttgtgtgttggatggaggagcataatagcatatagcgagtcatggtgcaccctgtacaggtggctgagctgcatcct

SEQ ID NO: 11 - DNA, 276 bp, Zea mays
  misc_feature: Incyte ID No: 700548318H1
ggtctttgagaaggtgacagaatctcctggaagggtttacatcttgaagtttaagcaagacagcagaaaattcttcttctggatgcaggaaccaaatgctgatggggactcccagacttgcatgcaagttaatgcctacataaatcgatcattagatgctgaggctgatcttcgagtacctattgaagcagaaatgtctgaagatacggctgatgatgatatctcttccagagctgggaatctagttgagagcatgaccgctgatttggctggtga

SEQ ID NO: 12 - DNA, 276 bp, Zea mays
  misc_feature: Incyte ID No: 700548319H1
  unsure 13: a, t, c, g, or other
ggtctttgagaangtgacagaatctcctggaagggtttacatcttgaagtttaagcaagacagcagaaaattcttcttctggatgcaggaaccaaatgctgatggggactcccagacttgcatgcaagttaatgcctacataaatcgatcattagatgctgaggctgatcttcgagtacctattgaagcagaaatgtctgaagatacggctgatgatgatatctcttccagagctgggaatctagttgagagcatgaccgctgatttggctggtga

SEQ ID NO: 13 - DNA, 97 bp, Zea mays
  misc_feature: Incyte ID No: 700548324H1
gagaagatggagcacacaattgtgagagccaagttctagtgaagtaggatgctcccaatgttggaaacggaaacttaggcagctaacttgatataac

SEQ ID NO: 14 - DNA, 100 bp, Zea mays
  misc_feature: Incyte ID No: 700548326H1
  unsure 69, 73: a, t, c, g, or other
gagttactaaacaaattatgcagagaacgaagtatatcacccatagtatttccagtggctggcagcacncccncattccttggcagtttttatcaaaggc

SEQ ID NO: 15 - DNA, 279 bp, Zea mays
  misc_feature: Incyte ID No: 700548328H1
gactagttctagaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttat

SEQ ID NO: 16 - DNA, 280 bp, Zea mays
  misc_feature: Incyte ID No: 700548329H1
  unsure 36, 84, 92: a, t, c, g, or other
gaaaaacagcggcgtagtttcacactctagagcatnggaaaccgaaaaccaattcccatcctcaggacagctcagacggcaagnttgctgtngacgggcaagtggattcccatggtggtaggcttgagatgaatacgtccaaaggatctgatacaattacccatctagtgaccagtagtgaaccgacgaaaaggagtgatggcaaagaggtctcacacagcaaacatgagaacctggcacgggaagatggtaaccagaagggtgagactgaacaggagca

SEQ ID NO: 17 - DNA, 97 bp, Zea mays
  misc_feature: Incyte ID No: 700548330H1
  unsure 38, 53, 58, 71, 76, 95: a, t, c, g, or other
ttatgtgattgtgatttgggcccgcataaactcatgtngcagagacaagggtntaacncctttaacagccngtgangcggcccaaatcacaatcnac

SEQ ID NO: 18 - DNA, 278 bp, Zea mays
  misc_feature: Incyte ID No: 700548331H1
gaaccatgggaaagttaagattggagacttcggtttggcaatggtaatgcagcagaggaaaacacagagtatacaaggcaccttagagttcatggcaccagagctgtttggtgaaaactacaacgagttggtggatatatactctttcggcatgtgcatgcttgagatggtgactggtgagtgccctacagtgaatgtcagggcttgttcagatatacaagaagatatctgaaggtgtaaaaccagttgctctctccaaggtcaaagatgcagaagta

SEQ ID NO: 19 - DNA, 286 bp, Zea mays
  misc_feature: Incyte ID No: 700548332H1
ttctgacatcctgggcagccactgttagaaggaagggcatccctgaaaaggatggtccggaaagcacatatgctgtattcactgttgaagaaccgaagaaaaaaagtggagcttggatcaagacaggggggcagaacaaaaaacatcaccttttatctagcatagttggggaaataaaggttgcgcgtcgaaaatcaagatgcccccatacaaccgatgttcatgtacacagggaatttgtgttggttggttccaaatttctaccatcgtctgaagaatcaggtga

SEQ ID NO: 20 - DNA, 274 bp, Zea mays
  misc_feature: Incyte ID No: 700548334H1
aaccatgggaaagttaagattggagacttcggtttggcaatggtaatgcagcagaggaaaacacagagtatacaaggcaccttagagttcatggggccagagctgtttggtgaaaactacaacgagttggtggatatatactctttcggcatgtgcatgcttgagatggtgactggtgagtgcccttacagtgaatgtcagggctttgttcagatatacaagaagatatctgaaggtgtaaaaccagttgctctctccaaggtcaaagatgcag

SEQ ID NO: 21 - DNA, 277 bp, Zea mays
  misc_feature: Incyte ID No: 700548340H1
  unsure 84-107, 173: a, t, c, g, or other
ggagttgcaagttggtgagatggatctgttggagcggaatattaagacggagacgggggagacgcacaaggaacaggagcgtannnnnnnnnnnnnnnnnnnnnnnngggagaggaagacccaggagccgccgcagcaaggccagggcctcagcctctcactcgccaacggtngtggcaggtctggaatgttgccgatgtcaaacatgtcagctaatccttcacagcttacaattttctatggcggatcatgcctgtgtatgactcatgccaccgga

SEQ ID NO: 22 - DNA, 276 bp, Zea mays
  misc_feature: Incyte ID No: 700548342H1
  unsure 5-6, 70, 76: a, t, c, g, or other
ctganngagataatgttctcaatcagtttcgaactggcagggcttcagtattagtagccacagatgttgntgctcntggacttgatatcaaagatattagagtggtaatcaattatgacttcccaactgggatagaggactatgtgcatcgcatagggcgcacaggaagagctggcgctactggagtctcgtacacatttttctcagaacaagattggaaatatgcttgtgatttggtgaaatcttgcaaggtgccaaccagcttgtccctccgct

SEQ ID NO: 23 - DNA, 278 bp, Zea mays
  misc_feature: Incyte ID No: 700548345H1
gtaaaggcgacaggcaggtgcgagccgtgaaggacgggagcgagcagtgaccaccgcgccagattcagaccacaccacccaccgcaatcaggagcggagccaaggaaggagggggcagcgggcgacgacgaagcagcggcaatccgacggcgtaatggcggcggggagggggtgaggcggcgccctgagccgtaaaggagccggctttcgtagctcttcctgggagtgaccttctccgacgaaacgaaatggcccatcaaggaccaggagtgcctaag

SEQ ID NO: 24 - DNA, 279 bp, Zea mays
  misc_feature: Incyte ID No: 700548347H1
ctccaaaggaggcccccaagccaaaggtggttgaggcaccagcagaagaggaagcaccaaagccaaagccaaagaatcctcttgacttgctgccaccaagcaagatggtccttgatgactggaagaggctatactcaaacacaaagactaacttccgggaggttgccatcaaaggtttctgggacatgtacgacccagagggctactctttgtggttctgtgactacaagtacaatgatgagaacaccgtctcctttgtgacctggaacaaggttggtg

SEQ ID NO: 25 - DNA, 272 bp, Zea mays
  misc_feature: Incyte ID No: 700548350H1
  unsure 50, 162, 167, 169, 262: a, t, c, g, or other
ggaaaccaccgagccagccgtttgcttgagtgatgatatacaaacaaacnagtgcctagagaacaatggtggctgttggcaagataaggctgccaacatcactgcatgcaaggatacattccgtggaagagtttgcgagtgtccagttgtgaaaggcgtcanatttntnggcgatggctatactcactgtgaagcttccggatctggtcggtgtgaaattaacaacggagggtgctggaaagataccaagaatggtcggacntactctgcct

SEQ ID NO: 26 - DNA, 178 bp, Zea mays
  misc_feature: Incyte ID No: 700548351H1
atcgaaccccacgcctctggagggtgatggcatgatccaagcaaggttctgcagcgccgttactgagatgcaggtcactggccttgttcggatgccgagcaagagaaggcccgatcttgtgcagagaatcgcgttcggtccttaacagctcggtgattacatgcatgctatacagacg

SEQ ID NO: 27 - DNA, 270 bp, Zea mays
  misc_feature: Incyte ID No: 700548352H1
cccgtccttctgatccttgctggtggtgctggtaactgagagcagaaaaatggttgtggttaggttggttgtggactgtgattttggcaatgccacgccgcccaagagggctgtttctcctacttctgttgtggtgagctttgaatcttgcagagctcagcgtaaactatttcgaaaggagtggagaaattgcttggtattgctggatgtaaattgggtcgggatagattgataaaatgaaaacagaactgcgccagtaatctttctgta

SEQ ID NO: 28 - DNA, 176 bp, Zea mays
  misc_feature: Incyte ID No: 700548353H1
tagggtttggaggcggatccgatgttgtcatgtgtaggttgtaagcgggcaatgtgattggctgtgtatctgcttcgctcaagttgctttatgtcattcctaatggaataggaaatgccgtgtttcttacgcctgcttttggttctgcattctactgaaaatgcgtacgataatta

SEQ ID NO: 29 - DNA, 90 bp, Zea mays
  misc_feature: Incyte ID No: 700548356H1
  unsure 23, 82: a, t, c, g, or other
ggtggctgctcaggtacctgacngcggcccgtgcgtcacatatattggcaaaggtgtctcagggcaacttcgtcaagatggntcacaatg

SEQ ID NO: 30 - DNA, 275 bp, Zea mays
  misc_feature: Incyte ID No: 700548359H1
gatttgtgacaagcaagggataccatatgaatatgggaaaggacgcttggaggagcgctctcagctgttggaggacattagaaatgtgaagccaactcaagtttttaatgctgccggagtcactgggagaccaaatgttgattggtgtgagacccataaacaggacaccatccgcaccaatgttgtaggcatattgaatcttgctgatgtctgtcgcgagcagggtctgctaatgattaattatgctacaggttgtatatttgagtatgatgcca

SEQ ID NO: 31 - DNA, 272 bp, Zea mays
  misc_feature: Incyte ID No: 700548360H1
  unsure 8, 137: a, t, c, g, or other
atgacagnttggcaaggctggtggtgacaagtggaagtccctgtctgatgccgtgagtttgtttgttccccagtcccattttaaccgtttgagtccgcagttggttgcggtgtgcgttgttcttacgataagcgtgntgctctagatgtatccgcgctcgtcccctgtgtgtttgtatgtatatcagtaattatattatatatcatgtttacccgatccatcgttagatctgctaaaattccatatgttaaattcgaaatgggttggtatac

SEQ ID NO: 32 - DNA, 159 bp, Zea mays
  misc_feature: Incyte ID No: 700548366H1
  unsure 93: a, t, c, g, or other
gtgtgtgtagtgtaactgtgtatgcaggcggtgatttatatgcatgcttcctttaagtagattgccagtagtatttgcgtatggtgagctggncggtccttaatgtctgcccccaatgtacaaaaccagatcaagatgcttgggcttccagttgagttt

SEQ ID NO: 33 - DNA, 271 bp, Zea mays
  misc_feature: Incyte ID No: 700548369H1
agtcgaagcgtagatcgcggcggagagaggcatggatggaaagagctttagcaacgaacagcaagcccaacaaaagaacccagacgcagtgacaaacagtggtccgagccaaggccaggagcccttgaacacgtttccagattcagacgatggaaacacgaacaccggtccgttgaatggccacgcagcagctcatgtgaacatggaagctgccatctccacggaggacgtcatacgggctggcgggttcggagcgaaggacgacatcggc

SEQ ID NO: 34 - DNA, 276 bp, Zea mays
  misc_feature: Incyte ID No: 700548372H1
  unsure 125: a, t, c, g, or other
gcaagaagccagcagttgccacagatgctgttcaagtagattgggtgaagacagacgaagctaaccctcaaaagtccaagttgcatgaggaaatggaagttctagacgaacttcttggaaaaganaacatggagaacagcggtatttcgagcactgatgagaattatgctgaaaaaactggagatgatatcttgtttgaggatggcgttctgattgagaatgggttagccactgcttatgaacatgatttgctttggggttggaaggccctgcagc

SEQ ID NO: 35 - DNA, 179 bp, Zea mays
  misc_feature: Incyte ID No: 700548375H1
  unsure 2: a, t, c, g, or other
tncaaataggagtgtaggtagtgatcagtagcaggtcagaagcaggattagtgctaccacaggcaggttcctaagcagataaagatgagtatcatagccatgtcctttgactccttgactagagcaattgtgagcttcagtgtttcgcctcattattgtcaagagaaaaaagtggccac

SEQ ID NO: 36 - DNA, 231 bp, Zea mays
  misc_feature: Incyte ID No: 700548376H1
ccaatactagtgatcacaaagacagcacaaactcgttggtagataagaaagaggagcaagcagcggagcctgttaactgtgaaacagagggcagtatggaacaagaagcagcagctgaaaatgatttggccgacgataaggaggttgctttggctgcagccaaggatggtaacggtgaatcaagttttgaagcatcgactccaaaggcaagcaatgggaccagacaagaag

SEQ ID NO: 37 - DNA, 94 bp, Zea mays
  misc_feature: Incyte ID No: 700548380H1
  unsure 35, 71, 82: a, t, c, g, or other
gaaagacacagactatgcggccaagccaaacattncattgataaactttttcactgattggagaaaagttncttggtaaaanttcatattatta

SEQ ID NO: 38 - DNA, 273 bp, Zea mays
  misc_feature: Incyte ID No: 700548381H1
  unsure 15, 91-92, 94: a, t, c, g, or other
caaggaggcatccangtcactgcctgacttcaagaaggatgatcagaaggctgtggattctgctctgatcaaggctatcgaggctgtcccnnanactgaaaacctatcttggcgcccggttctctctcagggatggtgacaagccccatgagatggtcttctaagctcttagttttggagttcggaggaagctgttttgtctgtgttcttgtacttctgagttttgtaccagtagcgaatgtttcattgtggttgaaatcttcctgccaaata

SEQ ID NO: 39 - DNA, 270 bp, Zea mays
  misc_feature: Incyte ID No: 700548384H1
  unsure 8, 185, 261: a, t, c, g, or other
agctaagnggggatgatgacgacgacaatggtgatctagaaccaccgcgtaatgaatcagaggataaaatcatcaccaatgacgatgtcttaggggatgaagtgccatatgaccagcaagaagctttgcgtgtgctatgttataagttgcttgaaatgccccttataaggggacattcacaattncctggatcacatccatcctctcttaacagtgaaaatctgcaactacttagacagcgatactactatgctacatggnaagctgagc

SEQ ID NO: 40 - DNA, 95 bp, Zea mays
  misc_feature: Incyte ID No: 700548388H1
  unsure 48: a, t, c, g, or other
agatggtgctgaagacggaactctgccgcttacagtggccagaagatncttattccctgggaaaggcatcccggtttattcgtggctgattactc

SEQ ID NO: 41 - DNA, 176 bp, Zea mays
  misc_feature: Incyte ID No: 700548389H1
  unsure 70: a, t, c, g, or other
ccattttgtaacaagtttttgtttcctcgtcgcctacttttgcttcatagtgttctggacatcatggtcnctgttagaatttacttgtaaaaaccaagtgaatatgccttcagcacatattattgtattatgatttgttcatgctacaaacgaagtgaatacgccttttgtgattt

SEQ ID NO: 42 - DNA, 74 bp, Zea mays
  misc_feature: Incyte ID No: 700548391H1
  unsure 7, 28, 55, 61: a, t, c, g, or other
cggtctncgaggactagttctatgatcncgagcatccctctactgcttttttagncttgtnctggaataaaatt

SEQ ID NO: 43 - DNA, 278 bp, Zea mays
  misc_feature: Incyte ID No: 700548395H1
  unsure 75, 100-101, 265: a, t, c, g, or other
gcggcgaggagctcctcttcagcagcagcaaggcaatcttcaagccgccaagagcgacccgtggtggcattccgntatgcttcccacagtttggaaactnnggaacattggagcagcatggatttgcaaggaacaagatatggacaatagacgatgaggctccacctctaaattatggtgataataacagcaacaaagcttctgttgaccttctgctaaagccatctgaagatgacctgaagtgctggccacactgttttgagtnccgtctcagagtc

SEQ ID NO: 44 - DNA, 316 bp, Zea mays
  misc_feature: Incyte ID No: 700548401H1
ggcagaacggccgctgtaccaggttcttgaacaaaaggaagaaaggatcgcccctgggactctatatgggtcaagccatacgtatgtgttgggaacacaagataaatcatcagctccgaaaagggtggatctgcttaagaatcaaaagtcagacaaggtggacgtcaccatgccaacccgaggaactggaagccatggatgatgttctggcagccaagtatgaagaagctcgagaggaagagaagcttcggaaccaaaaggaggacttcagtgacatggtggcagagatgctcacaagaggaagaggaagcaagag

SEQ ID NO: 45 - DNA, 140 bp, Zea mays
  misc_feature: Incyte ID No: 700548402H1
gactagagcatagttttttttaggcggttccacttctgaagtatcgtttggattctggaagttgtctgactctgaaaccatgagtaggatgtgtccccagcacgtatatacgctttgtttggtgtgctttgtttggtgtg

SEQ ID NO: 46 - DNA, 303 bp, Zea mays
  misc_feature: Incyte ID No: 700548403H1
  unsure 25-26: a, t, c, g, or other
aacataaaccgcaaccaccggcagnncactactgacgctacagcaccgtcagatgcctgactttctgaaggagctatgaatcatgaatgttaagagaaccattttctcttcggtgcgtgcgctgttctagatcactatcgtgtgcctatgaagtgatcagtgtcacacaagcaacggcattgtgggctaaagcatatctccacctttacttagcttggtacaggcaggagacttcccattgtcattaccgtgttctatgctgagtcatgtgctgctttcgttggccgggtgaggtgtgcttgt

SEQ ID NO: 47 - DNA, 301 bp, Zea mays
  misc_feature: Incyte ID No: 700548404H1
  unsure 39: a, t, c, g, or other
ggatgctttacgtactagctttgaatcattgcttgttcnagcgtttgagcaagcatgcaagacaatgtttgagcaaatagatggtgcatttcaaaagggaatgtctgagcactccaccgctattcagcatcaagtcgagtcttcacatagtccgttagcgctaactctaaaagaaatcatcaattctgcatcatccatcacccagagtttttcatcggagttacttgatggcaatcgcaagctactggcacttgttacttctgggaatgccatggcacataataccagtgctttgcagccc

SEQ ID NO: 48 - DNA, 297 bp, Zea mays
  misc_feature: Incyte ID No: 700548407H1
cccgtccttctgatccttgctggtggtgctggtaactgagagcagaaaaatggttgtggttaggttggttgtggactgtgattttggcaatgccacgccgcccaagagggctgtttctcctacttctgttgtggtgagctttgaatcttgcagagctcagcgtaaactatttcgaaaggagtggagaaattgcttggtattgctggatgtaaattgggtcgggatagattgataaaatgaaaacagaactgcgccagtaatctttctgtagattgtaaactattgaactccagtgct

SEQ ID NO: 49 - DNA, 306 bp, Zea mays
  misc_feature: Incyte ID No: 700548408H1
  unsure 66, 136, 144-145, 148-149: a, t, c, g, or other
gaaggccggtgctgttctactgctcgcataactttccctttccccatcccacgcagcagcgacaanagcaaatcgaagggctaacgactgagcgagtgccactatccctttgcttgccctgtgagaggagagggtncgctatgnnacnntacagggagcagctccattctggtgcacattctggtggtcgccctatgcctgaccgcctttggcttcgccgtcgccgccgagcgccgccgcagcacggggccaatagtcacagacagctccaatgccacattttgtgtttatgactccgatattgct

SEQ ID NO: 50 - DNA, 77 bp, Zea mays
  misc_feature: Incyte ID No: 700548409H1
gaaagaatcgagtgggaagggtgaactgtggtaatctaaatcttttctcgcaacaattaaaattcactgcttagtct

SEQ ID NO: 51 - DNA, 306 bp, Zea mays
  misc_feature: Incyte ID No: 700548411H1
agaagtattcgagtttattgagaaatacaacttgcatgatgccattcatgataagattgtcaatcttatgatagtggacaataaaagaacagttcacctactgatccaacatcgtgataccattcccccatatgaagttgtggagcagctgttgcataccagtacaaaatgtgacaagagatatttgttacacctgtatttgcatgctttatttgagatagatatacacgctggaaaggattttcatgatatgcaggtggagctttatgcagactacgagacaaggatgctactacccttccttcg

SEQ ID NO: 52 - DNA, 301 bp, Zea mays
  misc_feature: Incyte ID No: 700548418H1
  unsure 23, 56, 66, 68, 70-71, 95, 108, 114, 177, 183, 189, 204, 240, 261, 264-265: a, t, c, g, or other
aagataaactcatttttatcatncctttgtggagggcagcacatctccaacggcgnggaagaggangnannacagaagccaatgctacgctcagntctcctcaaccanagatcntcttgtcgatgctattgtgtcgatccaccctctttgatgacggcaaaaaggtaaactgatttnatctcnattgtnaaatttgcaccagtncagtcaatgctactatttaagtattgaatagttatnctataattgttttgcgcaccngcnngcccggtggctacaacttcaagttttgaattgcata

SEQ ID NO: 53 - DNA, 300 bp, Zea mays
  misc_feature: Incyte ID No: 700548419H1
  unsure 211: a, t, c, g, or other
gggagagaggataggtggaacaatttcaataggtatggaagaactggtccttatagtagacgctctccagtaaggagataccatggctcgccaagagccaatagcccatccaggtaccaaagaagaggccggagcaggtcacgcagcccggcgacgcgtcatgaccgtggagggtatcgccgccccagcccaaggcgcagcgcagccctgncagacccgagacgcgatgcgaacgataggcctcgatcaggtcacggtggaggcggtcctgaccaccgtggccacagcccccctgccaac

SEQ ID NO: 54 - DNA, 296 bp, Zea mays
  misc_feature: Incyte ID No: 700548422H1
  unsure 2, 9, 28, 30, 127, 147, 150, 200, 222, 261, 285, 289, 295: a, t, c, g, or other
gngaacaanccaaccattgtacagcccngntttcgttgacaataattgtggctggaaaatgccatttgctaatgtccaaccttgtgatgataccaaattaagcgttgttcctcagttctttagacancctgttcaggtagttagagnganctcggttcaaaacaaggggctggtaatatttccccagttggtgcagccanatttcgcaagatcacaagggcnaccacagtggcaggggctgtttccccacatgcaacagangccaaggcaaggatgtactccgcncggncttganc

SEQ ID NO: 55 - DNA, 306 bp, Zea mays
  misc_feature: Incyte ID No: 700548427H1
  unsure 4, 18, 22, 27, 267: a, t, c, g, or other
catntcactcaaatctgngctntgctncctgtacgaggccctgaactgattaaattcattagcagatgcaaaaatttgcaactcttatgggtgatggacttgattgaagaccatggtcttgctgttgtggcatcgtcttgtaacaaactgcaggagttgcgggttttcccttctgcctcctttcgaagcagctgagcaggtctctttgactgaaagaggtcttgttgatgtatctgccagttgcccaatgctggagtcagtcctctnacttttgcagacggatgaccaacgaggcccttattacca

SEQ ID NO: 56 - DNA, 298 bp, Zea mays
  misc_feature: Incyte ID No: 700548428H1
  unsure 2, 8-9, 20, 92, 100, 133, 145, 191, 207, 240: a, t, c, g, or other
gnttgaanncattaatgagncgcctgaggacaagaccattactgtatacaggtgtggtcctttagttgacctatgccgtgggccacacatcncaaatacngcctttgtcaaagctttcgcttgtctgaaggcncatcatcatatnggagaggaaaagttgaccgcgaaagcctgcagagagtatatggaanttctttccctgattcncgacgtctcacggaatataaacattttctagangaagctaagaaacgtgatcataggatattagggaaagcacaggaatcttctttttcca

SEQ ID NO: 57 - DNA, 304 bp, Zea mays
  misc_feature: Incyte ID No: 700548430H1
aggaccttcggcgcccgttcaggatccacatcttcccgagcgagttcttggttgacctcttcccccttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgttcacgtgcgcatccagcagcgtaatggtcgcaagagcctgactaccgtccagggattgaagaaggagttcagctacagcaaga

SEQ ID NO: 58 - DNA, 102 bp, Zea mays
  misc_feature: Incyte ID No: 700548432H1
  unsure 2, 9-11, 22, 26, 43, 45, 92, 97, 100-101: a, t, c, g, or other
gngattagnnngatttgctcanaggnggccacctggcatatanangagggactatattgaagcattgtattcattttaccatgaggttccanacaanatnng

SEQ ID NO: 59 - DNA, 295 bp, Zea mays
  misc_feature: Incyte ID No: 700548436H1
  unsure 287: a, t, c, g, or other
gcctcagcttctgctccttttcctttcccagcgcatcagggaggcggcgattcgcggcggtgagggcgtccgcggagacgatggcgacggagaagctgggcatcaaggtggagcgcaacccgcccgagtcccgcctctccgagctcggcgtccgccagtggcccaagtgggggtgcgagaagagcaagttcccgtggacctactccgccaaggagacgtgctacctgctgcaggggaaggtgaaggtgtaccccgaaggccacggggaggagttcgtggagatcggnccgggaga

SEQ ID NO: 60 - DNA, 295 bp, Zea mays
  misc_feature: Incyte ID No: 700548437H1
  unsure 83: a, t, c, g, or other
atcaagaggagtgcggtttcctggacgtgacaatgagagcttggctcctatatttactcccgcgcgatcagttgctgaagctncatgttgatgcaagcttgccccagcaggtgttcgaggacgtccatgttcatacatatactgctgaagaaacaaaagaagcatttgatgtagctcgtaacagcgtagaacttctttcaactgttctttcctcttctcctgagcaggatgctttgcaggatgacttgacaaccactcttgtgcaacaatgctaccaatctcagcacactatcca

SEQ ID NO: 61 - DNA, 297 bp, Zea mays
  misc_feature: Incyte ID No: 700548438H1
  unsure 25, 60, 66, 69-70, 73-74, 76, 153, 210, 251: a, t, c, g, or other
ccagagttcctgcagccatacatgntcaatgcatttcaacttgcacatgcctccttccgnctatantgnntannanataatcatgtacaaagtgttaagcttggcccctgcctacttggggatgctccaaaaacagatgtcatccctgctggngatgaagtgaatgaggaacaaggttgttctgaaggttttccagatataagaatatangatgaagatgtgagcatgaaatttcttctctgtggagtacnaccgcaccctggatgcatgtttgttgggggcactagaagatggttt

SEQ ID NO: 62 - DNA, 305 bp, Zea mays
  misc_feature: Incyte ID No: 700548441H1
  unsure 5, 9, 157, 159, 263: a, t, c, g, or other
ggganggtnaaactggcaacaggtttgccctttgggaagatcttgaattgagaggttttctgcccttgcttcctgcacataccattttggatttctcaagcaaacacacatttggaagcaccaaggagaagaaagcacgggttcagcgaatttttgngngcaggaaagtcactgcttaactttgttcagattgatcagttgagaatttattttgattcatcatcgaagaagtttgttatggccaagaaccctccctgtttctnaaactaacacccctcttcacgaatctcctgatgcacttaaaa

SEQ ID NO: 63 - DNA, 300 bp, Zea mays
  misc_feature: Incyte ID No: 700548442H1
aagatatgtctaatagtgggacagttgttcggacccaaaatgaagacccagaaactccacgatcttcaaggtcaaggctggggatccaagaaaaaacatcaaatgctcctcttgaggatagtgccattaaccttgcagaggcaaaggctgctttgcaggctgggttaagaaagggaaatgctcgagaaagaccttttatcaacaggcatgaaaagggatcacatgagcatagatcttctggagtaaatagtcaagaggttcaaagcgaggatgtggacacgcagaaaggtcacaaattac

SEQ ID NO: 64 - DNA, 298 bp, Zea mays
  misc_feature: Incyte ID No: 700548444H1
gcatttagctctggtggacgtgtggttgattccttccgttcgaagcttaaacctaaaattattgaagccttggtttgtactaaggattggaagcttgcttcagacaaagatttggagggtgaaataaaaactataagtgaagctatgaatgctatggaggtggacgatgaggttgcgacttgagatcttcaagcaagcatggattgcttgcactatcttatgttatttaaaaactatcctttattgtaatagtctattgtgttgaactgtcttgtgctatgttaaactcttgggtgag

SEQ ID NO: 65 - DNA, 299 bp, Zea mays
  misc_feature: Incyte ID No: 700548445H1
  unsure 2: a, t, c, g, or other
anacaatggagccggtgcggaagagcgtgtgcgtgaccggcgctggcggcttcgtcgcgtcggagctggtgaagctcctcctctcccggggccaatacgcggtccgcggcaccgtgcgcgaccctggtgctagcaagaatgcccatctcaaggtgctggaaggagctgaggaaaggttgcagcttctcaaggctgatctgatggactacaacagcattgcatcagcagttgccggctgtgagggtgtcttccatgtagccagtcctgtcctttcccatcgaccctccaaccctgaggtg

SEQ ID NO: 66 - DNA, 299 bp, Zea mays
  misc_feature: Incyte ID No: 700548446H1
  unsure 70: a, t, c, g, or other
aatttggcagaaactaggagtatctagacttcgccaccaacttgtcatggggatggagcagagttgtagnttgaaccagggagaccacaactcaatgccttgacttagttgtgagaaacaagatcagtttgtgccctgtagctggaggagctaacctggtactccttttaccctaaatcgtaagttgttttagttttttctagatgcatagcttttacgatgtatcctccagatgcatagtaaaagttatatatttagaaaaaacagaacaacttataatttggaatggagtattcatt

SEQ ID NO: 67 - DNA, 159 bp, Zea mays
  misc_feature: Incyte ID No: 700548448H1
gtgtgtgtagtgtaactgtgtatgcaggcggtgatttatatgcatgcttcctttaagtagattgccagtagtatttgcgtatggtgagctggtcggtccttaatgtctgcccccaatgtacaaaaccagatcaagatgcttgggcttccagttgagttt

SEQ ID NO: 68 - DNA, 293 bp, Zea mays
  misc_feature: Incyte ID No: 700548451H1
  unsure 31: a, t, c, g, or other
gaaccatgggaaagttaagattggagacttnggtttggcaatggtaatgcagcagaggaaaacacagagtatacaaggcaccttagagttcatggcaccagagctgtttggtgaaaactacaacgagttggtggatatatactctttcggcatgtgcatgcttgagatggtgactggtgagtgcccttacagtgaatgtcagggctttgttcagatatacaagaagatatctgaaggtgtaaaaccagttgctctctccaaggtcaaagatgcagaagtaaggagtttcatag

SEQ ID NO: 69 - DNA, 240 bp, Zea mays
  misc_feature: Incyte ID No: 700548452H1
cgaagataccggatcagaaattcaagggcgatgttagctacttcatctgcagcaggcttggggcaggtccaaaggttgttgttgacgaaggtcaagcactgatcgattcagtcaccggacttccaaaaggcgtgtagttctagatttaggttggaataatggtttaagctggggattaaagacaatggtatcatacaagcaacctgggccggccaataaagatagaacacgttctcgcct

SEQ ID NO: 70 - DNA, 289 bp, Zea mays
  misc_feature: Incyte ID No: 700548453H1
  unsure 42, 126, 135, 244-245, 264: a, t, c, g, or other
atctgtcggaaacctcttgcgttgggtggatggttcaatcantttcaagccatttgactttggcaagctttgtgaggacatcctgcaggagttcagcaatactaccagcaaaattctgggcaccanggggtgcangctggagatcgacgctggggctatggagcaggtagtggcagcggcatgggcatccgattcgcatgagaatgagaagaggcctgtgcggacgtgggtggagcagtgtttnncaggagccttgagcagtcnagatgaggtgtgagaatctgagcag

SEQ ID NO: 71 - DNA, 297 bp, Zea mays
  misc_feature: Incyte ID No: 700548459H1
agtatagctcaggcttgtgggctgtcaaggcaaagcttatcgaagtgactggaaaggccctggacgctgttggctacggcacagtggttctcccggcaccatctagattccatctcctgaagacatggcttccttatatccaaacgacaaaacgttcgctggatggaaatagcaagggcgaaatgtctctgcagatggattcagacatgtggcagaatgtggagagcgcaatagtctcgatggtgctagcgctgccgtctgatgaccaggccgatatcctgtcggagtggatgaaga

SEQ ID NO: 72 - DNA, 297 bp, Zea mays
  misc_feature: Incyte ID No: 700548460H1
  unsure 21, 94, 182, 191, 240, 242: a, t, c, g, or other
aaagggttccacgaacatggncggacaactgcacctggattaccttatgtcgaggaggcaattaccaatgctggtgactggttggttggtgggnacttggaggttatagaaccaatcaagtacaatgatggtctagatcagtatcgcctgtctccagcacagctgcgtgaagagtttgccanccgcaatgntgatgcagtatttgcctttcagcttcgcaatcctgtacacaatgggcancntcttcttatgaccgacacacgcaaacgtctccttgagatgggttataaaaaccct

SEQ ID NO: 73 - DNA, 146 bp, Zea mays
  misc_feature: Incyte ID No: 700548461H1
  unsure 68: a, t, c, g, or other
aagaagaaaaggggaaagaccccagaactaacattacaaagagaaaacacccacacacgcgcacacangaaaaccccacccagccagagcagggccagagtgcctgtcagctggcagacaccccaacaataacaacagagaaacta

SEQ ID NO: 74 - DNA, 56 bp, Zea mays
  misc_feature: Incyte ID No: 700548462H1
  unsure 24, 55: a, t, c, g, or other
gttgagtgtttactttagcttaancaatcttatagttttttaattaattaatgana

SEQ ID NO: 75 - DNA, 111 bp, Zea mays
  misc_feature: Incyte ID No: 700548463H1
  unsure 78: a, t, c, g, or other
ggaagtcagagacagggaggagggcggcggaatcggcgccggcgggaggcatgcatggaggacctgagcgtggagganctcgcctccaacctctccacacaacatacgatg

SEQ ID NO: 76 - DNA, 78 bp, Zea mays
  misc_feature: Incyte ID No: 700548466H1
  unsure 73: a, t, c, g, or other
tgaaagaatcgagtgggaagggtgaactgtggtaatctaaatcttttctcgcaacaattaaaattcactgctnagtct

SEQ ID NO: 77 - DNA, 302 bp, Zea mays
  misc_feature: Incyte ID No: 700548468H1
  unsure 253, 260-261, 293: a, t, c, g, or other
gagggatccatctccgttgagtcgaggcggctccaactccggctcgtggcctcgcggaccaacatggccgccccttcgccctcgccggtggaggctaccctaccgcctgaggccgcggctgccgccgaggaagaccagtgggatgctgacggatatgttattcctaatttgcccactcaagataatgatgtggctgagcctagtgtccccaaagaaaaagatcctgagcctctacaggcaagcgatgagaaantatatcnnggacctcatggagctccaccatctcaagcagngaccaggag

SEQ ID NO: 78 - DNA, 301 bp, Zea mays
  misc_feature: Incyte ID No: 700548470H1
  unsure 10, 33, 35, 158, 214, 266: a, t, c, g, or other
ggaagtggcngaagcgaacagggaagccgtggncncgctgccacagggtgctcgccttgctctcccagccgcatgactccgcgcaggccaggagcatagctctgggcacggacgaagcatgtgccaggttcaggaaggtggtctctctactgagcaanggaggagcggggctaggagaagccgggccgtcatgcggaagcgcaaggcaagccgncctagagctaagcttgttagcagaagacagaatccagggttcttgacccagnaaggcttcctggacagcaacaccccggtcgtggtg

SEQ ID NO: 79 - DNA, 296 bp, Zea mays
  misc_feature: Incyte ID No: 700548474H1
  unsure 80, 159: a, t, c, g, or other
cgaaggaggagtacgacgagtctggcccggcaattgttcaccggaagtgcttctagggtttcacaagttcctcgtcgttnacctagtctcaaattatgtcccctccatttctcgagatatgtgtggcagatttgcatgatacgtttgtttgtttccatnggacctgaagtcttcttggggataggctcccccctttgtatgttgtggctccaatccatgtgcgagcacgctgtgtctgtcgtgacacctggttcgtgagatgggttgtcaaacttgattggtttgttgtgcgtggc

SEQ ID NO: 80 - DNA, 296 bp, Zea mays
  misc_feature: Incyte ID No: 700548475H1
cttcgagcagcatgccaaagatgagcattttgcaccacttttcgagcaaatagccaagttagatgaggcactttacaatatccagtttgaacagcactggctagaggcccaaactgaccgtcaagcaatattgaacgagaacatgagcaggagggcagtccacaaggcactcttcgagtcggcggcactgatcgcggccagcgtcatccaggtctatctcctgcgccggctcttcgagcgcaagtggggacgtctagggtttaaggctccactagtatccaactctcccttgtagt

SEQ ID NO: 81 - DNA, 296 bp, Zea mays
  misc_feature: Incyte ID No: 700548479H1
  unsure 109: a, t, c, g, or other
agatcaacaggggctttgctaccttgagggagattggacatggacacgatctaaagaaattcctaattgttatcgcaggtctctggctcctttcagttcttgggagccntgcaacttcctgacactgttctatattgtctttgtggcactgtacactatacctgttctgtatgagaaatatgaggacaaggttgatgcttttggtgagaaggctatgatcgaactgaagaagtattatgccatcttcgatgagaagtgcctatcgaagattccaaagggcctcaaggataagaagc

SEQ ID NO: 82 - DNA, 303 bp, Zea mays
  misc_feature: Incyte ID No: 700548480H1
  unsure 21, 41-42, 62, 78, 84, 101: a, t, c, g, or other
agctacctcaaggctgccgcnctctacacgcaggccatcanngctcgaccccgacaaacgcnaccctctacagcaacngagctntggcattcctgcagttnggttaagcttagcaaagcgcttgctgatgcagagacaacagtcaggctgaagccacaatgggagaagggtcatttcaggaaaggttgtgttttggaggcaatggagcgctatgaagaggcgatagtgcatttcagatagctttgcagcacaattcacaaaatacagaagtctcgagaaaaatcaagaggctatctcagttgg

SEQ ID NO: 83 - DNA, 311 bp, Zea mays
  misc_feature: Incyte ID No: 700548481H1
attgtttcgttgcattttgagaatccaaatttagaggagctcgaggtgttggatctgcagacactagtttcctacataagctatgcaaggaagtatattcagccacagttaactgatgaagctgcagaggagttaactcgtggctatgttgagatgaggaaaagagggaatagccctgggagcagaaagaaggtcataactgcaactgctagacaaatagagagtttgattcgtctaggtgaagcattagcccggatgcggttctctgaagtggtcgaggtgcgagatgttgtggaggccttcaggcttct

SEQ ID NO: 84 - DNA, 303 bp, Zea mays
  misc_feature: Incyte ID No: 700548484H1
aagaaagaagccgtgtccgcgtgattttctgggtgaatttttcccggcctccgctccggccagatcggcgcgggtgaaccccagcccctaccgatccggatccgtccccatcgcctcgtgtgttttccgtcgagtattttagcgtgtgtgtccccccctcttcgcttcggttggtgcgtgcggctgtctcgggtagatctggtggtttagttcgccttgaaggcgcgcggcggcggtgtcgcggcttgtagcttgcgatttcacggtggagcttgtcggctgttggggtcggatttggagttt

SEQ ID NO: 85 - DNA, 302 bp, Zea mays
  misc_feature: Incyte ID No: 700548486H1
agagagcgtgtggatttgggggagcttcttcactggagagtggagagctccggtagcgaggcgaaggaaggaagagggaggaggggaatcagagaggtctccccgatggcggactggggccccgtgatcgtagcgacggtgctgttcgtggtcctcacgccggggctgctctgcacgctgccgggccggggccgcgtcgcagagttcggcagcatgcacaccagcggcctggccatcctcgtccacgccgtcctctacttcgcgctcatcaccatcttcctcatcgccatcggcatccacgt

SEQ ID NO: 86 - DNA, 296 bp, Zea mays
  misc_feature: Incyte ID No: 700548488H1
  unsure 63, 81-82, 92, 97, 126-127, 152, 191, 220, 235, 257, 260, 290: a, t, c, g, or other
cacaccccatatgaccctgtacaagatccaggaagctgataaacttgtgcatagaggagcttncgaggctttcagaactcnntgcacgcttncaganaaaaacatcctaagccaatagctgcatcnntcaagattcacgcttgctttctganatacaagagcagcagaacttgttgaagacctacgaggtnatggtaaatcagttccagtcccagatccngaccagagacactgngataacccatctacagcagcanatngatgaagctaaacttcggaaatcaaagctngagagg

SEQ ID NO: 87 - DNA, 220 bp, Zea mays
  misc_feature: Incyte ID No: 700548490H1
  unsure 79, 155, 167: a, t, c, g, or other
atgtaaatctgtacagattgtaatgaatcacgtggtctataatctggcaagctgaatttgccttccaacagtgattgtntgatcctaaccggttctcagcacaggtagagatgggaaccggttaggatcagacaatcactacctgtgctgagaanattgtaggcgcnttatcatttgttactacagcggggaatgctctagtgtgcatcggggacggcta

SEQ ID NO: 88 - DNA, 292 bp, Zea mays
  misc_feature: Incyte ID No: 700548493H1
  unsure 6, 46, 63-64: a, t, c, g, or other
ctcggnctctcgggattctagagtggcggccggctctccgcctgtncttgtcgtcgctgctcnnttcccaggatgtcggaacgttctgagagcgcaactgaaaagattatgagcagcatcatggataccattgctgacaaccttcctaagcagaagtccgggaaatttgatccaggttcagtctctgacaaagtgaagaataagctgtttggtcgtcagaagaccttgcatggagttctgggtggtggaaaacctgctgatgtgctgttatggaggaacaaaaagatatcat

SEQ ID NO: 89 - DNA, 297 bp, Zea mays
  misc_feature: Incyte ID No: 700548496H1
ctaccagccgcagtacgcggtgtcggagctgaacgagaaggacttctggcgcatgttcgacgcgtcgcactacgagcactgccgccaaaagtacggggcggtgggcacgttcatgagcgtgtactacaagtccaagaaggggcgcaagacggagaaggaggtgcaggaggcggaggcggccatactggagccggcctacgcggacgaggaggcctaaaagctcgtggtcgttttgcttagcccattttaattagaattgatggatgtagtgtgtgtctgtctcaagtcatttaatta

SEQ ID NO: 90 - DNA, 285 bp, Zea mays
  misc_feature: Incyte ID No: 700548502H1
  unsure 10: a, t, c, g, or other
gcgatgcaanctcgcttgtcctttttggtgaaattgtgctggcccagaagattatgtatgaaagatttgggggggatttcattgtgaactttatagcaaaaggtctttctggagttcactgcccaccggacctagctgaacagtactaccagaagttaaagggaaatgatatcaaggcattcaggtcattttatcaatcgcttgttgagagaataagaccgcagggaaatgggagtcttgttttcagatagcatcatccttcatttcatatgttttccaccaaaa

SEQ ID NO: 91 - DNA, 292 bp, Zea mays
  misc_feature: Incyte ID No: 700548503H1
  unsure 94, 174: a, t, c, g, or other
acgacatcttcgagaagctcgccgccgaggccgcacaagctgcgcgcggtacaacaagaagcccaccatcaccttcccgtgagatccagacctnccgtggcgcctcgtcctccccggggagctcgccaagcacgccgtctccgagggcaccaaggccgtcaccaagttcacctncgtcctaggctgcgtggcctccgcttgcaggcttccctcgtatgttcgcgtgtcttgctgtagttaggtgctgctgtgtctggtctcctccggtagcaatgttatctgatggaacata

SEQ ID NO: 92 - DNA, 285 bp, Zea mays
  misc_feature: Incyte ID No: 700548505H1
  unsure 108, 136: a, t, c, g, or other
gcaactttgcaggcattgctttcatgctcgccttttgtctaccttttacaggatttgaggaaccgcaggatacctaaggttggctacccaactctgagtgcatttgtngagttgatatctcaattggatgtgcctncatgagtcagttatcaagaaaaatgagaaggttattactgttgccgcaaaaccacttaatacctgccatgtttgatggctgttctcagaaactttacaccagatgtgccggctggaataactgctcggcctaggcaggaagatgctcaa

SEQ ID NO: 93 - DNA, 279 bp, Zea mays
  misc_feature: Incyte ID No: 700548508H1
  unsure 14, 18, 103-104, 112, 122, 182, 239, 260: a, t, c, g, or other
ataacaatgctganatgncacagtgtgcgatatggctggagtggaggacctgatggacactatcgaggaagttaaaccttgctggaccaaaccaagtccaaannatcagccncctaatggtnttgttacattctccttgactatgggccctgaatatcacatctcacagatgcacagatgcngtggttgttgcgaggtatctaggtgcaacatttgtactcccagacatcagaggaatngaattaggaaataagcgaaantccaagactgtacatgtgg

SEQ ID NO: 94 - DNA, 273 bp, Zea mays
  misc_feature: Incyte ID No: 700548510H1
  unsure 218-219: a, t, c, g, or other
tggcccattataaaattgtacaaagcttctccaaatatgccaattgatccattacaattgtttcataactactgtttatggattttgggactgcagaactgatggattctaacagatgtaacagacctacagtagggatgctaggccaaggagttaaaatatatccacatgttagaatatttccgtaactgtagtaacttcaacattatatagattanntcatgaacttttagttgtattaaacaaataagctctgtatgttcatgttgtaga

SEQ ID NO: 95 - DNA, 117 bp, Zea mays
  misc_feature: Incyte ID No: 700548513H1
  unsure 83: a, t, c, g, or other
atatgatgtagtattatatatatgtccatgcatgcaatgcatctcgtcgtccatcgcatgttgttgtcgttgttgtgtgtgtnttcgatgatcctgtctctgttataaatatcatta

SEQ ID NO: 96 - DNA, 280 bp, Zea mays
  misc_feature: Incyte ID No: 700548515H1
  unsure 3, 28, 45: a, t, c, g, or other
ggnacttggtggggattcatcgaagatncgccctagtgaagaggncagtctcaagtgtatgtgctgatgtatctgaggatcacccaaacatcaagaactggcagattcgaaagctacggcgagcgcgagtaccacagggccaaagtggcacttaagatgtgcgcgtgggcagtccatttccgcaattcaaattcgcaagctttgggacaccttacgggaacctgtggagattccagcaaggagatgccattcagctaactctcacacatcctagagaaga

SEQ ID NO: 97 - DNA, 287 bp, Zea mays
  misc_feature: Incyte ID No: 700548517H1
  unsure 90, 112, 129, 153: a, t, c, g, or other
gtcagtaaaagcggctagcgttgcttctcaatggttggaattactgcatcaggacataaggggacgtcttgctgctttaaagcgcacagngaagagagtcagaaatgctctncacacggaactgccatncccttaccgcgacagaattttcanctaatcaagagaacgaatcatccattgcaaatacttctgagattggatgtactgacaaagcggtttcagaagctcatgtggcacgatggaggtctcgtttgttcagatggacaaaacacttcaggaggaaggga

SEQ ID NO: 98 - DNA, 277 bp, Zea mays
  misc_feature: Incyte ID No: 700548521H1
  unsure 57, 79, 106, 202, 275: a, t, c, g, or other
actatccccatcgcagcatcttgccaagaggattgtaaagcttgagaagggtttganatactattatcccagcaatgtnctcaaatccaccaagatgataattctnctcttctgcactatattcagactcatcaggataatgttaagcaaaatgttctacttcaactacttgctctgttggcaagcagccagcttttctccnattgcgatcagttgagcaacttggctacatagcgctcttaggcaaagaaagatcaggtgtccgtgggttgcantt

SEQ ID NO: 99 - DNA, 278 bp, Zea mays
  misc_feature: Incyte ID No: 700548523H1
  unsure 20-21, 86, 178: a, t, c, g, or other
gggatcaaaatgatattttnncatccacttcaattaaatatctaaactgttagtaatttgttgaattttagatatttaattgaaantggatcaaaatgatatttttgagccgagcagctgatataggctcctcgaactacagtgtgtcgcctgtgccaaatgcatcacaggttcatgntccacacgaactataattgtgcttcttcaaactgtggtgtggagctgagccatttagaggagtcacacactgtgtgtgtattttaaaaaaagcggatcgg

SEQ ID NO: 100 - DNA, 279 bp, Zea mays
  misc_feature: Incyte ID No: 700548530H1
  unsure 62, 146-180, 259, 277: a, t, c, g, or other
ggaagcccggcagtagaggcggaggctgacgagcgagcggcggaggagatggcacctaaganggcagcggctgccaagaaagcggccgaggaagttgaggtggaggaggtggtggacggggacgaggcggtcgatggggagggcgnnnnnnnnnnnnnnnnnnnnnnnnnnnnnnnnnnntgcagacgacgaggaagaggtccgacggtgaagacgatgcaggaggaggagtgggaaccgagtatctggttcagcctcntgggcggctgaagacganag

SEQ ID NO: 101 - DNA, 212 bp, Zea mays
  misc_feature: Incyte ID No: 700548531H1
  unsure 57, 89, 99, 155-156: a, t, c, g, or other
cataatgacaaagattgtgattggtggtttgcagatgttgtcgtgcctgaaagaacntatgtgttggattgggtttttgctgacggccnccccagggantgcaaggaattatgacaacaatggaggacatgattttcatgctacccttccaaatnnccatgactgatgaagagtattggatggaagaagaacaaaggatctatacaaggctc

SEQ ID NO: 102 - DNA, 158 bp, Zea mays
  misc_feature: Incyte ID No: 700548535H1
  unsure 11, 35, 48, 70, 103, 111-112, 127, 153: a, t, c, g, or other
tcagaatatgngaatatagatactatacaagcagnaaatcaagttgantttgacgacagaaatcaacatngtggcagcgatgtttacatggcgcgatcagagnacagaggnngctactggttttatncccaatattgatgcgtatgatcagancagtg

SEQ ID NO: 103 - DNA, 212 bp, Zea mays
  misc_feature: Incyte ID No: 700548536H1
  unsure 102: a, t, c, g, or other
ggcggagaaaggacaaccctgaggcgatggaggaagacgaagtggatgagatcgctgagatcagggcccctcacttgcgaggagtcgatgaagtatgctcgncgtagtgtcagtgatgctgatatccgcaagtatcaggcgtttgcccagacattgcagcagtcccgggggttcggcagtgagttccgcttctgcggatcagccggcgacag

SEQ ID NO: 104 - DNA, 93 bp, Zea mays
  misc_feature: Incyte ID No: 700548540H1
  unsure 26, 81: a, t, c, g, or other
gagggaccactggcaaaacccaagancaagcatgcttctgcggcggccaccttccaggtggcagctgggaagcttgcgatnctcctcttccac

SEQ ID NO: 105 - DNA, 279 bp, Zea mays
  misc_feature: Incyte ID No: 700548541H1
  unsure 98, 116, 118, 131, 153, 163-164, 191-192, 200, 221, 231, 233-234, 237, 240,: a, t, c, g, or other
aaggcgaagtacacaacttggtcttgtaaattttgtactctagagaacagcactaaacttgacaaatgctcagcatgtgatcaatggagatactcatntgggccacctgtagccananatggcccaagctntgattgagataacagtgaaggncacaatagcnnagacgacacttctgggcaggcatctgnngtcattgnacgatataagttgtgtgatcnggcaacagtncnngcnctntaactactcacgacatatcnngtgnccataggtcnggaa

SEQ ID NO: 106 - DNA, 276 bp, Zea mays
  misc_feature: Incyte ID No: 700548542H1
  unsure 14, 76, 115, 157, 218, 240, 245: a, t, c, g, or other
tggcccattataanattgtacaaagcttctccaaatatgccaattgatccattacaattgtttcataactactgtntatggattttgggactgcagaactgatggattctaacanatgtaacagacctacagtagggatgctaggccaaggagttanaatatatccacatgttagaatatttccgtaactgtagtaacttcaacattatatagattantcatgaacttcagttgtattanacaantaagctctgtatgttcattgttgtagaacta

SEQ ID NO: 107 - DNA, 140 bp, Zea mays
  misc_feature: Incyte ID No: 700548544H1
atggagactcccagaacaccccccaacaaacccttgtattcccaaaggggaatgcaattcctagcactaaagttcttaccttctttaaatccagtacatttgaagttgatgttttgtatgtcgacccaaacggcttacaa

SEQ ID NO: 108 - DNA, 133 bp, Zea mays
  misc_feature: Incyte ID No: 700548545H1
  unsure 8: a, t, c, g, or other
catcatgntgtagtattatatatatgtccatgcatgcaatgcatgctcgtgcgtcccatacgtcatgttgttcgtcgttgttcgtgtgtgttttgcgatgatacctgtctcctgttataaatatcattattat

SEQ ID NO: 109 - DNA, 278 bp, Zea mays
  misc_feature: Incyte ID No: 700548546H1
  unsure 6, 23, 66, 108, 121, 152, 168, 183, 219, 222, 225: a, t, c, g, or other
ggaagncggcagtagaggcggangctgacgagcgagcggcggaggagatggcacctaagaaggcancggctgctcaagaaagcggccgaggaagttgaggtggaggangtggtggacgggnacgacgcggtcgatggggacggcgacggtgnacgaggacgacgacgncgacgacgaggactncagacgacgaggaagaggtcgacggtgaagacgatncangangaggagtgggaaccgagtatctggttcagcctcttgggcgggctgaagacgaa

SEQ ID NO: 110 - DNA, 286 bp, Zea mays
  misc_feature: Incyte ID No: 700548547H1
  unsure 26, 41, 60-61, 85-86, 93, 98, 142-145, 160, 251, 283: a, t, c, g, or other
ggaactttgtggggattcattgaagntcgccctagtgaagnggtcagtctcaagtgtatnntgctgatgtatctgaggatcaccnnaacatcncgaantggcagatcgaaagctacggcgagcgcgagtaccacagggtccnnnntgcacttaagatgtncgcgtgggcagtccatttccgcaatcaaattcggcaagctttgggacacctaacgggaacctgtggagatttccagcaaggagatgccatncagctaattctcacacagtcctagagaagaanggc

SEQ ID NO: 111 - DNA, 181 bp, Zea mays
  misc_feature: Incyte ID No: 700548552H1
  unsure 99: a, t, c, g, or other
gagcttcgttcgttcagttcatccgtgttcttgtttgcgaggtccgagagagagaggatgtcgtgctgcggaggcaactgtgggtgcggctccggctgncagtgcggcaacggctgcggagggtaagccccgtccagtccgcgttgcgctctcggccggagtcagatctgacggcggatga

SEQ ID NO: 112 - DNA, 152 bp, Zea mays
  misc_feature: Incyte ID No: 700548554H1
  unsure 34, 37, 83, 134: a, t, c, g, or other
gacaagaggaaggagttctacacaaaactagagnccnaaacataaagctttggaagcagagaaggacgaggctgaggccaggnaaaaggaagagcaagacgttgctataaagcaactaaggaagtcattggtgnctagagcgaaacccatgc

SEQ ID NO: 113 - DNA, 272 bp, Zea mays
  misc_feature: Incyte ID No: 700548556H1
gacattcaccaacttgttcaaatagaggaaaaggatatggatgagcacgaggagtaaaagaaacagaagaaggctgagtgtgattctcatatgcttattttcttgtcctgtgtaatggatgtgtgtatgtgaaccatatgcgaacttaaacgtctttgtttgtaccggtcaggccattctgagtgagggttccgtctcttctttttaggactccactgcgaggtgtcggtgtgtgagaaatggtgcaaacaagtttctgagaaatggtgcaa

SEQ ID NO: 114 - DNA, 271 bp, Zea mays
  misc_feature: Incyte ID No: 700548557H1
  unsure 2, 41: a, t, c, g, or other
angctcttatcagcagatgagctaaagcctgtaattggtancctccatccatcagaatacttctatgccaagcaacaagccgactatgtaatatctcaggctgacacgaacaaagatggacaattgagcatgaatgagatgatcgagaacccctatgtcttttacaatgctttattcacagaagatgattatggctttcatgacgagctccgttagttcccaagtcaagtaagggcacaaacttgtactctgttcttgtttctgcatctgc

SEQ ID NO: 115 - DNA, 269 bp, Zea mays
  misc_feature: Incyte ID No: 700548559H1
  unsure 27, 99, 197: a, t, c, g, or other
gtaccagcactggatcaaggacatgcnccacagcaacagttcaaggacgaggaagggtacccggccttcggcttcgtcaacagggtcaccggcgaggcntcaagcactcccagggcgagggccacccggtcaagctggtgccctacaaccccggctaccaggacgagtcggtgctgtggacggagagccgcgacgtncggccacggctttccgctgcgtccgcatggtcaacaacatctaccttcaattcgacgcttccaggcgacaag

SEQ ID NO: 116 - DNA, 126 bp, Zea mays
  misc_feature: Incyte ID No: 700548560H1
  unsure 92: a, t, c, g, or other
catttacatgacaccattctttcatgtaaatgtagctctagtcgtgtcgcattctttgatttgttgtttcagcagcaccggatgtacaagtnttgagtttgggctagcaagaataagtaatctttt

SEQ ID NO: 117 - DNA, 267 bp, Zea mays
  misc_feature: Incyte ID No: 700548561H1
atgcccttattcagatggaagtggtagaactggaagtattctcccggttcaaggtatggtggtggcactggtggacgtggtgatcgctttggaggatcagatcgttttgctcgctatgatgatgatcgatatgatggtgggcgctatgtggacagcagggatacttattatggttccgggcgcgatcgctatgcaccggcagcagaacgctatctggtgacagtacatggtgcagatcgatatgcgtccagcggctttgccagagaa

SEQ ID NO: 118 - DNA, 271 bp, Zea mays
  misc_feature: Incyte ID No: 700548562H1
  unsure 42: a, t, c, g, or other
cagcagggcgaagtggagaacaatattagggagctgcttcancaggacccaggacttgcgcgtcagatcctctcaatgaccgttcaatgagagttgtttttctctccatttaattttttagataatttgtaatgtcgcagtttgatcagtcatgctgtggtctgccttatctgtgagacatgtgcggtctgtaatttctgaggtgtttggctggtggaagatgtggtccatcatatctcactctagtgctttgtttggtttgtggaataga

SEQ ID NO: 119 - DNA, 277 bp, Zea mays
  misc_feature: Incyte ID No: 700548566H1
  unsure 141, 225, 242, 258, 262: a, t, c, g, or other
gacatcgtagtcgagttcatcaagaacgaggattacaagtatgttcgtgttctcggggccttctacctgcgtctcactggcacaattgctgacgtctaccagtatcttgagccgctctacaacgactaccgcaagatcagncacaagcttcagcgatgggacagttcacacttacccatgttgcatgagttcatgatgagttgctggaccaaggatatcctgtgntacagcccatgcctcgncatccagaaaagtggncccntgcagcgtcggaatc

SEQ ID NO: 120 - DNA, 276 bp, Zea mays
  misc_feature: Incyte ID No: 700548567H1
  unsure 204, 215: a, t, c, g, or other
gccactttgctcatagcgaaagagaacttgggaaaccagcgtacatgccttatggagaacctcctatgggcggtcgatttggaggccgacctgaacctgtgcagccagctgccatgggccctccagcaggaaactttggtgcctcggcgactgccaagatcagtgtggatgcgtctcttgccggtggctaattggtaagggctngtcaacacttngcagataagcagagttacaggcgttcaagctctgtatccgcgaccacgagtctagccccaa

SEQ ID NO: 121 - DNA, 272 bp, Zea mays
  misc_feature: Incyte ID No: 700548569H1
  unsure 14, 32, 61, 127, 162, 192: a, t, c, g, or other
atatgaagcaagtnaagcacgtcatgcctatngtccctctgggcaccgtggtatgagcgtnttaatatttgaaagctcagctgtgggctacatggaagctgaacgtctgcataaacactttgttaancaaggtacagacaggaattcatggcacctacgcanggttcgatttgtgcctggtgggaaaaggcncctatatggtttcttagcaaacaaagaggatatggacgcatttaacaagcatgccatggtaaaagccgtctgaagtatga

SEQ ID NO: 122 - DNA, 114 bp, Zea mays
  misc_feature: Incyte ID No: 700548570H1
  unsure 73: a, t, c, g, or other
ccttgccccggaggaacgacgtctgctccgtctgccacgaccgcttccggatcccgtgccaggtcgaactgcncccattggttctgtggagagtgcatcatccgcgtttggaat

SEQ ID NO: 123 - DNA, 270 bp, Zea mays
  misc_feature: Incyte ID No: 700548571H1
  unsure 15, 75, 132: a, t, c, g, or other
atttcactggggacntcttccgtcgtcttgcaacaatgggcattaatatcaggcagggttctctctgagctcagngaagagttccatgtacttctctatttcatcatctatctttttaacttctctagcaanctacaaccaacttttgtttcaatgagggatcagcctcaatatgtatgcgcacttgacaacgctgtagaagtgccctctatacctttgccactctctctaaacaccaataatttctccagtcctttgtttctggtttca

SEQ ID NO: 124 - DNA, 270 bp, Zea mays
  misc_feature: Incyte ID No: 700548574H1
  unsure 185, 194, 201, 207, 215, 240: a, t, c, g, or other
ctctgtcggaaacctcttgcgttgggtggatggttcaatcaatttcaagccatttgactttgggcaagctttgtgaggacatcctgcaggagttcagcaatactaccagcaaaattctggggcaccagggggtgcaggctggagatcgacgctggggctatggagcagtagtggcagcggcatgngcatccgantcgcatnaggatnaggaagangcctgtgcggacgtgggtggagcangtgtttgggcaggagccttgagcagtcaaa

SEQ ID NO: 125 - DNA, 264 bp, Zea mays
  misc_feature: Incyte ID No: 700548583H1
  unsure 5, 14, 18, 23, 30, 45, 55, 165, 170-171, 184, 197, 211, 252, 262: a, t, c, g, or other
agaanctattgganccantcaanatggganagtgtccaggttaanctacggtgangatcacattcagaccaggtattcaaagatctgaaaaccacacagaatctatggaaggtttaggctgtttgcaaagggcaggagattccgttggatccccagcaagtatancaatnncgattaccaaagnacaatgttctcgnagctcatatggttnataatgcgttgaggagaatggtctgtgaatgagttgaatcnattcgatcgngg

SEQ ID NO: 126 - DNA, 273 bp, Zea mays
  misc_feature: Incyte ID No: 700548584H1
atgcaaattgctacagccaatggccctactggctataatagggattacctgttctcaatggagaaggcattagccagcattagccacgaagatgattcgatcatagagcttgcaaacgaggtgaggaaggtgctcaacagaacaaaggagaccaagatcactggtgccaatgcttccctgaaatcacatgcccctcttgtgcacctgtccgcgcttccagaaggcaccgttgtggactcgagatagctcgccttggacgttggacctctactc

SEQ ID NO: 127 - DNA, 76 bp, Zea mays
  misc_feature: Incyte ID No: 700548586H1
  unsure 25, 33: a, t, c, g, or other
ggatggatatcatttagaatcctanattctagncacgatcattctattccatgagattataaatggtatttattcc

SEQ ID NO: 128 - DNA, 272 bp, Zea mays
  misc_feature: Incyte ID No: 700548587H1
  unsure 9, 81, 155, 167, 223, 235: a, t, c, g, or other
ccgtgtgcnagatgatcattgatcagctccgtgaccagcgcgttgtgagctgttacacaggagtcctttattatggattgnccggatgaagaattagtccatgttcatgattataattttgatcatccagatgcatttcatacagagctacttcncctccttgtatngcaaaacttgaaacatggcaaagctgttcgacatccctaattacaactgcaagacntacaagagtgtnaccaaatgcaaggaaggttaatccttcagatgttata

SEQ ID NO: 129 - DNA, 269 bp, Zea mays
  misc_feature: Incyte ID No: 700548592H1
  unsure 7, 20, 66, 84, 88, 90, 94, 96, 100, 106, 138, 259: a, t, c, g, or other
cgcaacnagacgaaaacgantcaatcctgacgctgatgcagacttgttagagggaggtgaagatgntggtgttgctgaaatggntcangntttngntgangaccangatcttgatgaccatcaagatcaggagaccantcccccttctgttagctctagatgaacagaggccaactaaagagcagattgtaaagcaatggtatagtcaggacgtgttcacagaagcagcaactggcattactgagcagagtgacactgnaagatgaaag

SEQ ID NO: 130 - DNA, 277 bp, Zea mays
  misc_feature: Incyte ID No: 700548595H1
  unsure 13, 19, 40, 48-49, 70, 183-184: a, t, c, g, or other
acttcagtggtanaaaganagggaagaaacagagagacanattatttnngaagatccagagcactcttcncgcgtattgtcttggcattagagtggttaatcccaatcatcttcctcctttaaaggagttgaggaagttgatgagaatccaatctctccgttgcaatggcattatataaccannagcgctaccagattatctgtagtccctatccacgcatcagctctctcggccctaaggtacctgtgtatacgatggggatagaagtgccaaatg

SEQ ID NO: 131 - DNA, 128 bp, Zea mays
  misc_feature: Incyte ID No: 700548596H1
  unsure 3: a, t, c, g, or other
ggnattatcatcagattcatctcaggcatgttcgttcagctttggcatcggttattatgggaatggctcctgtaattgggaaaggacgccactcttgaacaactgcttcccatttttcttctttgctg

SEQ ID NO: 132 - DNA, 211 bp, Zea mays
  misc_feature: Incyte ID No: 700548601H1
  unsure 31: a, t, c, g, or other
cgtgatgagatggaacactttgactcccgcngccggatcggcctgtgttcgttcttgtttccgatctcccttctcctttcccgttgcttcgatcccgtcaagtatggtagaccgtagcctattgttatgtttaaatgtcaattattatgtgaattcctccaagcgccgatgtccaataaggacgaaccggattttcgttagctcgacctcg

SEQ ID NO: 133 - DNA, 270 bp, Zea mays
  misc_feature: Incyte ID No: 700548604H1
  unsure 9, 76, 78, 136, 213, 230, 236: a, t, c, g, or other
gaagaaagnagccgtgtccgcgtgattttctgggtgaatttttcccggcctccgctgccggccagatcggcgcggntnaaccccagcccctaccgatccggatccgtccccatcgcctcgtgtgttttccgtcganattttagcgtgtgtgtccccccctcttcgcttcggttggtgcgtgcggctgtctcgggtagatctggtggtttagtncgccttgaaggcgcgcngcggcngtgtcgcggcttgtagcttgcgatttcacggtgg

SEQ ID NO: 134 - DNA, 266 bp, Zea mays
  misc_feature: Incyte ID No: 700548605H1
  unsure 211: a, t, c, g, or other
tatggttttactgtttaacttgtaccagcaaagtgtaaaacttagttgttttgtggctgggaactggatactgtactaaaattacatccattttcccaccatgattcgggattccggtgacccttgtgtggccaggtgccactgtactcaggatagttctgaggctgttacgagaagcagtggcctcggaaatatctgggttcggaatganctgcattttgaagctggagtgcccctgctgcaagttgattttgtttgaagtgcag

SEQ ID NO: 135 - DNA, 270 bp, Zea mays
  misc_feature: Incyte ID No: 700548608H1
  unsure 5-6, 16, 34, 43-45, 70, 122, 127, 141, 192, 229, 255: a, t, c, g, or other
actgnngactgagganccctaagcggcgcactgngcaggcgannncggcgcgctaccggcgacggccgangggggatacggcgacatcgtccccctcgacccctcctccatccccgacgcgncggtnccagactgcagtgncgaatgctgatttgttgtggcctgttgcgtcttcaccagttcatacattanacttgaagaaccacgtggttgaagaaaagcccactgnaaatgagtaatacatcatcttcgtcnagtgggatgtgtata

SEQ ID NO: 136 - DNA, 273 bp, Zea mays
  misc_feature: Incyte ID No: 700548609H1
  unsure 4, 196, 212: a, t, c, g, or other
aagngagaaggtcttctaaatcttttcctgattctcattgcgaacagggacgcaaacaagagtagtagcagcgctgctggtaaaaggggttggtggacacccctgctattgacagctggggttgcctccgctaaatactcctgcgtcacatagcaaggaggaattctgtctcacaaacacgtcaaaacatctctcncacactatgatctgancaatgaattcttctctcttttcctggatccatcgatgacttactctgtgccatcttcaaga

SEQ ID NO: 137 - DNA, 270 bp, Zea mays
  misc_feature: Incyte ID No: 700548610H1
atgttgttgacttcgtgcgtcagggagctctcattgccatggcaatggtaatgatccaaactaatgaatcctttgattctcgtgttggagcatttaagcgtcagttggagaagatcattcttgacaaacatgaggacaccatgagcaagatgggtgccatattagcatctggtatcctcgatgctggtggtaggaatgttacaatcaagctcctctcaagaaacaagcatgacaaactcacggctgtgattggtcttgccgttttcagtc

SEQ ID NO: 138 - DNA, 271 bp, Zea mays
  misc_feature: Incyte ID No: 700548612H1
  unsure 9: a, t, c, g, or other
atcaaactngttggtgttcattgccatctgggatctactattacaaaggttgatatattcagagatgctgcagtgcttatggtgaattatgtcgatgaaattcgagcacaaggttttaagttggagtacctgaatatggaggtggtttgggaatagattaccatcataccgatgcagtcttacctacacctatggatctcatcaacactgtacgagaatcagttctctctcaagatcttactcttatattgaacctggaagatccttgatt

SEQ ID NO: 139 - DNA, 277 bp, Zea mays
  misc_feature: Incyte ID No: 700548613H1
  unsure 47, 70: a, t, c, g, or other
accactgtatgagtcttctagagttgttgctcagaaaatgactactntggcactgcgccaccttagacanattgctcaagaaacaagtggagaagtagtgtacgccttgggaaggcaacctgcagtcctacggacctttatcaaagactaagcagggggtttaatgatgccattagcggtttcaatgatgatggctggtctgtaatggggggagatggcattgaagacgttgttattgcttgcaactcaaccaagaaaattaggaataccagcaatg

SEQ ID NO: 140 - DNA, 292 bp, Zea mays
  misc_feature: Incyte ID No: 700548616H1
  unsure 41, 50, 74: a, t, c, g, or other
aacggagattccttgccccctttccccttcaccatcgtcgnaaccctagncccgccttcgccgccggcaacgcnggattcggtcggtgccatgtccaaggccagggtctacgccgacgtcaacgtgctgcgccccaaggagtactgggattcgaggcgctcaccgaccatggggtgagcaggatgactatgaagttgtcaggaaggtcgggagaggaaaatacagtgaagtatttgagggtattaatgttaacaataatgagaaatgcatcattaagatcctcaagcctgtg

SEQ ID NO: 141 - DNA, 265 bp, Zea mays
  misc_feature: Incyte ID No: 700548620H1
  unsure 2, 49, 122, 143, 183-184, 192, 253: a, t, c, g, or other
ancctagctcccgcaactgccgccgccactcccacgcccgcagccatgncgcccaagctcgacccgtcgcaggtggtggaggtgttcgtccgtgtgaccggcggcgaggtcggcgcaggtcntcgctggccccaagatcggcncgctcggtctttcccccaagaagatcggagaggacatcgnnaaggaganggccaaggactggaagggcctccgcgtcaccgtcaagctcaccgtccagaaccggcaagcnaaggtctccgtc

SEQ ID NO: 142 - DNA, 263 bp, Zea mays
  misc_feature: Incyte ID No: 700548621H1
  unsure 13, 29, 31, 53, 58, 86, 145, 160-161, 164-165, 167, 170-171: a, t, c, g, or other
caagtgcttggtnatcagggcacttgttncntacagagacatgcatacttttnccttncatttgattttaaggtgctgaatagctngcagttgcttaagtaggagcgagtgaaccagtcagagtgattatgctgtcctgctaatncttctgtattgtgannaannancannctcctggttggtcctgttcaggggattatactacttcaagtcatatttatgctgggttacaggtgtactttttggaatgcctgtgattcttc

SEQ ID NO: 143 - DNA, 261 bp, Zea mays
  misc_feature: Incyte ID No: 700548622H1
  unsure 9, 219-220: a, t, c, g, or other
cacccgaancctagcttaatctatttaggtacgaaaccgagcaccagaaccctaatttttgggtatgtgtatttgtatctgcctaattacaagtttatataggcaacatgtcttataatttcgtttgttttgcaaaagttactgggtcacgcatgtcgtctgctgctgcggtggacgagatggagctggacggcattgagcggcaccgggataaggagnngagggagaggcataggagggaagagaaggatcacaatggcc

SEQ ID NO: 144 - DNA, 144 bp, Zea mays
  misc_feature: Incyte ID No: 700548623H1
ggtgtgtgtagtgtaactgtgtatgcaggcggtgatttttatgcatgcttcctttaagtagattgccagtagtatttgcgtatggtgagctggtcggtccttaatgtctgcccccaatgtacaaaaccgatcaagatgctgggc

SEQ ID NO: 145 - DNA, 272 bp, Zea mays
  misc_feature: Incyte ID No: 700548624H1
  unsure 110: a, t, c, g, or other
atcagttgtcaacgccgtccacatttgcacaagctgctaaactcaagcgcctggctgctgccaaggagaaggaactggcaaaaatgcaggaacatgaccttaaagggaancaatccttatacgacaaatacacaaatttttgttggttactaaggtcataatttatgctgtgctcgttctgtgcttttggagtactcctgtaactggcagttccacaacatcttctacagcccttcggaaaaatgttttcctggagaggtgttgatactgcc

SEQ ID NO: 146 - DNA, 271 bp, Zea mays
  misc_feature: Incyte ID No: 700548625H1
atgacaccgccgaggctcgttcctccatcttgactccccagcaaccccaatgcagtccataccttcacaccctatttttcaatgagcaagctttcatgacggtgttggtagtgtgtgacattcttcactgtactagaggtgaattttgatctcccatcccatgttacattaaccttgagtgacagatgactatgcgtagtgtatcctctatggcagtataactagaacatttgatttatttgttactggtaatgctgagatatagtactgt

SEQ ID NO: 147 - DNA, 194 bp, Zea mays
  misc_feature: Incyte ID No: 700548630H1
  unsure 154: a, t, c, g, or other
atggcacatgatatttatcacaaatctctgattgtcaatgggccaactacaagtattggctcttacaaatatgggctatccagatagagctgcgttattggataaaatgatagttgcagaaagtcagatctgcggtttgtaatcaaacagccanacacaagcttgtttatgcagcatcactgaattaaaaaaaa

SEQ ID NO: 148 - DNA, 286 bp, Zea mays
  misc_feature: Incyte ID No: 700548631H1
  unsure 55, 65, 79, 146, 151, 212, 252, 274: a, t, c, g, or other
agcacgaacttgagtggatcctgcgtggctttgggcagaatttcagagaccaagncaagaaatgncccaagctaaaatncacagggacgtacgtatgcagagaaggctggggatccgaatttcggcgcacctttcctggattgaanctgcngcggcaattggagccgcgagcacagtgaaggtcacgaggcacaggccgccgaggcggaagngccaaggaccctgggctcagctccgcccacgagtagaggncgctatccttgagagcagatancgttcactgcac

SEQ ID NO: 149 - DNA, 285 bp, Zea mays
  misc_feature: Incyte ID No: 700548632H1
agattctctaaggggcagctgtggtctacgaaggtactatggaagcatccattttcaatcacatcatgtaccttcaacaccttactagcataacctggatcgtctccttgaagtagcaaggctggtgacctcggtaatcctgtcatatctctgcttagctgtacaactgtttctgggagtttagggtgagagactcagggtcccttcaggtgttaataatgtagggaggacactcgatgagttacaggaatactagatagcgtctgaggaaacttgggtttgttt

SEQ ID NO: 150 - DNA, 199 bp, Zea mays
  misc_feature: Incyte ID No: 700548633H1
gattaagggcataatttcctgagcggcctggtgtattggacatgccactcagaagattaagggcgtaatgtcatgagcagacttgcaaggttggtcacagttgtgtgaaggaaattatttctggcaacatatgattttgtgtgatgaaatgacggacactgttcactgctgaatgggatgactagatgtttctctgtgc

SEQ ID NO: 151 - DNA, 274 bp, Zea mays
  misc_feature: Incyte ID No: 700548634H1
aggcgatacgccgctccatcatgctgctagaggagaacatttggatgttgtcaagcttcttctccaggctggggcgtcccccaagaaggagaacacttacgggcagacacccgctgatatggctgaccaagacacgaagttcgaaccctgttgactgccaagcaaattgaggcaagcacacacatgagtgatgattaagcggcattggaatccttagttgcaactggtaatgttgagaaatagccgtaacatcttatctgccatccaaattcat

SEQ ID NO: 152 - DNA, 267 bp, Zea mays
  misc_feature: Incyte ID No: 700548635H1
  unsure 76: a, t, c, g, or other
caaggtgactttttggtccattttatggatattgctcgagaggagcttacaaagaaaccagaagaaatatccgctnaaaaacttcagtctctgcttgacattgctttacggagtactgcagctgcttcagaccaagccatgaggaattaatctgctgtgtggaaaggagttccctccttaagaaactggccactctgaaggacttggatcctgcagataagcttgctgcagcagatgttgatcgatcatgcaattaagcatcagggt

SEQ ID NO: 153 - DNA, 65 bp, Zea mays
  misc_feature: Incyte ID No: 700548638H1
gatggatatcattagaatcctaatctagtacgatatctattccatgaatataaatggtatttatt

SEQ ID NO: 154 - DNA, 263 bp, Zea mays
  misc_feature: Incyte ID No: 700548642H1
caggagctgagcaagcaagggtgtatcctggaggctgttattgaagcaagtgctactgaaattatcaatctcatggatagcctaaatgaatgggacagtaaagtgggcgatggtgactgtggaagcacaatgatagaggtgcaacagctattcttgaagatatgaaaaagcgttaccctatgaatgatgcagcgggaacaataaatgaattggggcaacaatccgaaggtgatgggtggaacaagtggaatctgtatgccata

SEQ ID NO: 155 - DNA, 270 bp, Zea mays
  misc_feature: Incyte ID No: 700548643H1
  unsure 73-93, 195-197: a, t, c, g, or other
gcaggctagcagcacagcagcagccagagccatcccctctcctccgctacgcttcgcttcctcggcgccgatnnnnnnnnnnnnnnnnnnnnnctcgtccgtccccttccggcgcacgagctcgcccgagatggcaacgcgagatcgggtgtcgctgtgaacgatgagtgcatgctgaagtttggcgagctgcannncgaagaggctgcaccgcttcataactttcaagatggacgacaagttcaaggagatagttgtggaccagtcggg

SEQ ID NO: 156 - DNA, 270 bp, Zea mays
  misc_feature: Incyte ID No: 700548644H1
caagaagatgctttccatccagctccgtgggtccgcagccaagggcaagctcgtgaaggtcaaggcttcgtacaagctctcggacgccgccaagaaggcatcccccaagaccaaggctaagccggcaaaggccgcgctgccaagaccaccgcccccaagccggccaaggccgccgccgccaagtcaaagaaggcagcggctgccaagccaaagaaggccgctgctgctgggaccaagcgcaaatgcccgagaagaaggtctggcgaacga

SEQ ID NO: 157 - DNA, 275 bp, Zea mays
  misc_feature: Incyte ID No: 700548645H1
  unsure 75: a, t, c, g, or other
gagatagatgagcaagaaaatgatggagctattgatggactgcaggatcgtgtcagcattctacaagcggttgtncaggcgatatccatgaagaggtggagactcataacagaatgctggaccgaatggtacacttgtcccccatcctttgcttgttgtaagatctgaatctactatcctactcacgtggacaaattcaggggaacgatatggatacttcaaggggttttctgtctgggaccgtggacaaattcaagatggtatttgagaccaaa

SEQ ID NO: 158 - DNA, 278 bp, Zea mays
  misc_feature: Incyte ID No: 700548646H1
agaacatgctaatgacacagcgtcaaatgctgcattcagagagcatgaggttcccaaatccagaacgaatttccaaggtaaagaaatcaatgtgccggataaagcatgtcttgactgagagggctatagcggagcccgatccaaggagatcttcggaaatgaagcggatgataaatgccctgtgattcactcacaggcattctcccttgggacttttgatggtacttattagaaagatctgctgccttctgttgtatctttatcccataagaactgtg

SEQ ID NO: 159 - DNA, 261 bp, Zea mays
  misc_feature: Incyte ID No: 700548651H1
  unsure 42, 45-46, 59: a, t, c, g, or other
ctttctaatctgaggaatattggatgtcgcttgggtggtggnccnnaggaagatgctcngagtttttaaggcatcttgtgatgtctatgcaagcagcttgcttggatgggctgggtggtgagaagcagttgagccaagtttgcaggaaacaacactgatacaacagatgtttggtggccgtcttaaatccaaggttaagtgcctcagatgttatcacgagtctgaacgatatgagaatataatggatcttacttggagatt

SEQ ID NO: 160 - DNA, 263 bp, Zea mays
  misc_feature: Incyte ID No: 700548652H1
  unsure 31: a, t, c, g, or other
atctcctcgcatttccttgcaaccgattgcnttcccccctcccaacccaagaccgatggcgcccaaggccgagaagaagcccgcggcgaagaagccggcggaggaggagcccgcggcggagaagacgccgccgggaagaagcccaaggcggagaagcggatccccgctggcaagtccgccggcaaggagggcggcgagggcaagcgtggcaagaagaagggcaagaagagcgtggagacgtacaagatctacatcttcaaggt

SEQ ID NO: 161 - DNA, 259 bp, Zea mays
  misc_feature: Incyte ID No: 700548654H1
  unsure 39, 159, 251: a, t, c, g, or other
gctcctcctcgcgattccaatccacgcacgccatctccnactccgcgtccgcctcgcgcaggacatatattcagtgatggaacacaaggaggccggctgccagcagccggagggcccaatcctatgatcaataactgtggtttctttggaagcgctgcnaccatgaacatgtgctccaagtgccacaaggagatgataatgaagcaggagcaggcccagttggctgcctcctccatcgatagcattgtcangggcggtg

SEQ ID NO: 162 - DNA, 261 bp, Zea mays
  misc_feature: Incyte ID No: 700548655H1
  unsure 34, 37, 83: a, t, c, g, or other
gacaagaggaaggagttctacacaaaactagagnacnaaacataaagctttggaagcagagaaggacgaggctgaggccaggnaaaaggaagagcaagacgttgctataaagcaactaaggaagtcatggtgattagagcgaaacccatgccaagcttctatcaagaaggccccccaccaaaggctgaacttaagaaggtgcctcctactcgtgccagatcaccaaagtttacaagctcaaggagaaagagctgcaatgac

SEQ ID NO: 163 - DNA, 265 bp, Zea mays
  misc_feature: Incyte ID No: 700548657H1
tctgatttggcacagaagttaacagtggcagagcccagcaaggaggaaaatgcagagaaagaggaggctcctgcatccgatgataagaaggatgataaagagtgaaggttgaaggcaaacaagggtcaaatgatgccattccattcatttcgtttccaaggttcagcttccccgcaaattttcattgtgttttctccgagatgaatgtttgtgttcggtgaaatcagagtcgtcagtcatctacatagcttttcttggttgatag

SEQ ID NO: 164 - DNA, 268 bp, Zea mays
  misc_feature: Incyte ID No: 700548658H1
  unsure 53, 62, 101, 125, 227, 231: a, t, c, g, or other
tgacgaagttggtgatgggacaacttctgttgttgttctagctggagaacttntgaaggagncctgagaagttaattaacatgaaaattccataccgatgncctattattgcaggttacagaatngctctcgatgtgccagagattctttgctaaaaaagaccatggacaacaaagaaaatacagataaattcagatctgatctcatgaatattgctatgactactncttngttcaaaaatactttcccaagacaaggtgtacttcgc

SEQ ID NO: 165 - DNA, 267 bp, Zea mays
  misc_feature: Incyte ID No: 700548660H1
  unsure 54, 98, 259: a, t, c, g, or other
ggtagatttcgcggcagagggggaagctgtttcttccacaccgcagttgaccgncaccctgtgccaggcactgctgttgtgcacgccgcacagcagcncacggctgtacaaacgtcctggagtccatcgaggcgactccgggggcattgtcagcagccagggagttgttgtgacaccctccaagctccacggcctcactaggggccatgaagcaattgcgggacgacgtcgaccgactactcggtatggcacattctanctcgacca

SEQ ID NO: 166 - DNA, 270 bp, Zea mays
  misc_feature: Incyte ID No: 700548661H1
  unsure 133: a, t, c, g, or other
gaagccactgaggctgatgccacgctgacatgggaccttactgtgctggggtgggaggtgaactacaaggaggagttcgtgccggcggacgagggctcctacaccatcatcgtcaggaagggcaagaagatgngtccggcgaggaggcggtccgcaactcgttccgcaccggcgagccgggcaaggtcgtgctcaccgtccagaacacctcgcacaggaagaagaaggtgctgttcaggcacaaggccaagagcgcctgcgccaagaagt

SEQ ID NO: 167 - DNA, 181 bp, Zea mays
  misc_feature: Incyte ID No: 700548662H1
tggcacatgatatttatcacaaatctctgattgtcaatgggccaactacaagtattggctcttacaaatatgggctatccagatagagctgcgttattggataaaatgatagttgcagaaagtcagatctgcggttgtacatcaaacagccatacacaagcttgtttatgcagcatcactg

SEQ ID NO: 168 - DNA, 279 bp, Zea mays
  misc_feature: Incyte ID No: 700548665H1
  unsure 30, 63, 75, 82, 89, 94, 98, 100-101, 106: a, t, c, g, or other
agcaaagatatggagtatgaagcaagacanatgtgtatttgatttcaaggagcataccaaggngatatacactantcggtgnagcccancaggnccangnncaaanaatcctaatcagcagttgcttttggccagcgcgcttttgattcaactatcaagctttgggaagtcgagcaaggatgccttctgtacagcttgtctggtcataggcaaccagtgtattctgttgcattagccccgacggcgaatacttagcgagcgggtccctggatcagtgcc

SEQ ID NO: 169 - DNA, 164 bp, Zea mays
  misc_feature: Incyte ID No: 700548666H1
  unsure 63, 65: a, t, c, g, or other
gctgatctcaaatgtaaaggacagtacatgccagctctgatcaatctctgaagggcttgatcncngcggcattgtttcaccacattaactgcattgcttgaaagatgcctgtcatccattgctgctgttaacttttgatgggttaatattgaattattacatcg

SEQ ID NO: 170 - DNA, 276 bp, Zea mays
  misc_feature: Incyte ID No: 700548667H1
  unsure 177, 181, 268: a, t, c, g, or other
caacttgtggcaaatttgagagaactggggtatgcttatgtgaacaggaatgaaagatgggagaggttcatggagtctgagagagaaaagagcaatggagaatgccatggtggcagacatgcatctgacgttatgaacaacgaatgacaaaccaccgtggtggttggcggggtgctngatnccgtggccatctgaggaacttccgaggtccaagaatgcgcaatgagtttgctgatgaatctattggtggcaacaggcactcatttgnagatgaac

SEQ ID NO: 171 - DNA, 271 bp, Zea mays
  misc_feature: Incyte ID No: 700548668H1
  unsure 28-30, 33, 73, 138, 142, 145, 165: a, t, c, g, or other
gcctgatgagcatccacatgccggcctnnngangacgcgctccgcaagggcgtctccacggtcatgatctccnactccagctggaacgggctcaagatgcacgccaaccacaacctcatcacaggcttcctcaagggnagcnganttccagggcttcacgatctnggactgggaaggcatcgacaggatcaccagccctccaggggcgaactactcctactctgtgcaggcttcattcttgctggcattgacatgatcatggtgccaaaca

SEQ ID NO: 172 - DNA, 267 bp, Zea mays
  misc_feature: Incyte ID No: 700548670H1
  unsure 264-266: a, t, c, g, or other
aacaggttcaaacccaatggttgatgttgagctaacaaatttcgatgagaaactggccaatcttgcagaaggcaagaatcagcgactttcagatgcaagccagttaagaacaggttcaaacccaatggttgatgtgagctaacaaatttcgatgagaaactggccaatcttgcagaagacaagaatcagcgactttcagatgcaaaccagttaagaacagggaggctggtgaagaactggtcgagaatatttggccaaacagcnnng

SEQ ID NO: 173 - DNA, 267 bp, Zea mays
  misc_feature: Incyte ID No: 700548671H1
tccttgcctgggtaccaacaggtagttcaaggcgaatggaacgtagcaggcattgcccatagagcttatgatcttgaaggaaaaactgttgggactgttggggctggtcgtattggcaggctcttgcttcagcgtttaagccctttaactgcaacctgctttaccatgacagacttcagattgacccagagcttgagaaagaaattggggccaaatttgaggaggacctggatgctatgctccaaagtgtgatgtgattgtgatcaa

SEQ ID NO: 174 - DNA, 265 bp, Zea mays
  misc_feature: Incyte ID No: 700548672H1
  unsure 33, 37, 40, 83-84, 86, 133: a, t, c, g, or other
gaatatttcatgtttctcctcagcacacgtgcnggcnccncttgggttgaacttgcagacggcggacactgtccattatattnngntagtgactggaaccctcaaatggaccaacaagctgaagaccgtgccntcgtatagggcagaagaatgaagtgcgtgtgtttgttcttgttagtgtcggctccattgaagaagagatcctggaccgtgcaaaacaaaagatgggtatcgatgcaaaagttatccaggctgggttgtttaa

SEQ ID NO: 175 - DNA, 264 bp, Zea mays
  misc_feature: Incyte ID No: 700548673H1
  unsure 184: a, t, c, g, or other
tggagacctagttagatgtggtttcacatcatctgaggtgcagaatttcatcaaagcaatattcgctgactcgcctcttaggaaggagtgcctaggatggatcgttaggactccagcttagaatacagaacatcatatttctgtctgtgggtcaatgatttttttcatattcttttgtccaccntaccatatagtgaagtattaattggtatgagcccagtttgcactggagacagacttgcaatctgactccctagttcaata

SEQ ID NO: 176 - DNA, 264 bp, Zea mays
  misc_feature: Incyte ID No: 700548675H1
  unsure 67: a, t, c, g, or other
cccgtccttttcctttcataaaccccaagccgcgccgcaatagctcgccccctcgttacgccgcctnctcctgctcctaccgcagctctccctcaggtttagtgttcgcaatggcggccttcaacaagcttgtggccttctaaggcacagtgctctggtgagcggtatcactggtggctcttctcctgcagtgttcaatgctgcacggctcatgtctaccaagctatttattggtggtcttgactggggtgttgatgacgtgaa

SEQ ID NO: 177 - DNA, 264 bp, Zea mays
  misc_feature: Incyte ID No: 700548676H1
  unsure 189: a, t, c, g, or other
gtgatccaagatttcacttacatatacagccaaatgtgcagtctcaccaaaacatgagatttgcagaccatatgcaggatggtttgaaccatatgaatgataatagatttttaggtcagaaccatggtctctatccccttatgtgcagattccgcaacaacccagaaactcgcaggttacaaatggtcntgggatgggtggagtgattcgagacaagggaatagcactcctatgtcagacatgtcgaggatattatatccaagt

SEQ ID NO: 178 - DNA, 124 bp, Zea mays
  misc_feature: Incyte ID No: 700548677H1
gttttgctagagttcattctggttataattgtagaggaacgaaacgatgagagaacactgacttttccgtttctctgcaattcatgtaatatgatctcggaagcaataacatttcatcttctat

SEQ ID NO: 179 - DNA, 266 bp, Zea mays
  misc_feature: Incyte ID No: 700548678H1
actgccaagtcccttggctatacagaaccagatccacgtgatgatctaggtggaatggatgtcgctagaaaggcattgatcctggctaggcttcttgggcaacagataagcatggagagtatcaatgttgaggtttatatcctagtgaattaggacctgatgcagtgtccacaaaggacttcctgaaagtggtttagtgcaattgacaagagcatggaagaaagaatcagagcagcatctcgagaggaaacgttctcgctacgtct

SEQ ID NO: 180 - DNA, 278 bp, Zea mays
  misc_feature: Incyte ID No: 700548680H1
  unsure 11, 210: a, t, c, g, or other
agcatgagganaaccaccagcctaaattgcatggaggacttgtgatcaagcacaatgccaatcaacgatatgccgccaaatgctgtgacagcatttatttttcgagaaattgctgagagacaccagctacctatacaggttttgttgttcgcaatgacatggctgtggttcaacaattggcccaatacttgctagtggtgttggtatcgncactgttgatattggagcaccccaatatcaatgcacagcatcagagaaatgtgtgccgctgacgatat

SEQ ID NO: 181 - DNA, 232 bp, Zea mays
  misc_feature: Incyte ID No: 700548682H1
  unsure 2-3: a, t, c, g, or other
gnnagttcgggcctcgtcctccccggggagctcgccaagcacgccgtctccgagggcaccaaggccgtcaccaagttcacctcgtcctaggaccgcgtggcctccgcttgcaggcttccctcgtatgttcgcgtgtcttgctgtagttaggtgctgctgtgtctggttcctccggtagcaactgttatctgatggaacagtaacaatgcttattgaatccagctagttgctt

SEQ ID NO: 182 - DNA, 160 bp, Zea mays
  misc_feature: Incyte ID No: 700548683H1
  unsure 140: a, t, c, g, or other
caaatggggggccaaggattcttctatttgtagggtagtggcactttcaaagaaggccaaggattctatttgtagggtagtggcactttcaaagagtttctttctcttttaaaaactcgttaatctcgagctgttaacancaaacataaaagattacgaa

SEQ ID NO: 183 - DNA, 272 bp, Zea mays
  misc_feature: Incyte ID No: 700548685H1
  unsure 8-9, 17, 53, 76-77: a, t, c, g, or other
cggagagnnacaaggangagtcgggcgtgacagtgctggacaagatctccgancaagctccacgggcgcgggggcnnctcgtcttcgtcgtcggactcggacgacgagcgctcgtcggcgacggccgccgtgaaggccaagatctaccgcatcttcgggcgcgagaagcccgtgcactccgtcctcggcggcggcaagccgccgatctgtttctatggaggaacaagaggatctctggtggggtgctcgcaggcgcaactgccttctggctg

SEQ ID NO: 184 - DNA, 89 bp, Zea mays
  misc_feature: Incyte ID No: 700548688H1
  unsure 62: a, t, c, g, or other
gtccagttgaccgaagttggaaaatacttctgatacttacagatttcacagaggtcttgttnactcaaacgtactattccacacaacat

SEQ ID NO: 185 - DNA, 262 bp, Zea mays
  misc_feature: Incyte ID No: 700548689H1
atcgtgaaagagatccctaccatgacagggatagtgatagatcccgtgagcatgatagagaaagagattatgaacatggtggatttaatagagaaattgactatcccatggaccgagatcgtgaaggagatgagagacgtcctagagaacatgatcgtacagcagaaatgcataatgtggattcagataatgacaaagataaggaacatgtatcaagaaaaaggttcagccgcccaaaaggtcgtgatagcagagatttatc

SEQ ID NO: 186 - DNA, 259 bp, Zea mays
  misc_feature: Incyte ID No: 700548691H1
  unsure 8: a, t, c, g, or other
agtagtgntaccggcattagaacactagactactctatgtgaatggagtacatacagaaacagaatacaacttccttcgttagattctgattgatataatggtgatagggagtcaaaaagaatggatacctatgcatcctagagcacgtctgtacctgatattcatatgttacatcgtcgatcgcggcaattcatagctccgtgtcgtggaggcatagtacaagaagaggaaaacttgagtttgtgctacctcgcataa

SEQ ID NO: 187 - DNA, 276 bp, Zea mays
  misc_feature: Incyte ID No: 700548696H1
atcaatcacaggctcagtttgtttgtgattgattattactctaagaagggcttggtggtaaatcctgcctgcggagaaaccaccaaaggaagtgactgctgaggtgctgaaagccctctcatgatgaaatgccccttttctgagtttattcaggttaagcatgatatgtaccgaaatccctttgtctgggtttcttcacaccagcatcatgcagtttccttttgtgcgattacaccatttatcatagctttgacaagctcggtaactgtctgaata

SEQ ID NO: 188 - DNA, 286 bp, Zea mays
  misc_feature: Incyte ID No: 700548703H1
  unsure 42, 63-64, 183: a, t, c, g, or other
cgcttatttggtatgattaatgaattgcaaactgtttttgangttgtctccggtgcgagacanncaacaatctaaagagaggtccagtatggacaatggtggtagagccaagcctgtaaagatagaaaataatggaaaagtcacagacgaagcatacgaagatgacagtgatcacggtgaaancctatgtggaacctgtggtgggatatacaacgcggatgagttttggatcgggtgtgactgtgcgagcgatggtaccatggcaatgtgtcaagataactcctgc

SEQ ID NO: 189 - DNA, 284 bp, Zea mays
  misc_feature: Incyte ID No: 700548705H1
  unsure 36, 38, 40, 216: a, t, c, g, or other
gacgaagaagaaaaacgcgtgtcgctagaagcgaangnangaacttacgtgggagaagctcgagtcagctgcagctttccagccagtgactggccatacagccgtcctagtaggccaccggccgtacagcaaatctgatcgccaccatgatctagctcatgcatgtatgccgaacaagcgaatgtggtgctctcccccccttttggtgaggcgcanaagtgtagtgttctctattttgctcctgcttattattattttccttttgctggtatgggtaatcatgt

SEQ ID NO: 190 - DNA, 116 bp, Zea mays
  misc_feature: Incyte ID No: 700548706H1
  unsure 20-21: a, t, c, g, or other
aagctgcagcatgtaaaagnntgcgctgataattatcgaaattgatccaataattatcagcgcagagacatcatccatcgaggtgaagcatgtaaaagtctgcgtgcgtcgacagc

SEQ ID NO: 191 - DNA, 135 bp, Zea mays
  misc_feature: Incyte ID No: 700548708H1
  unsure 3, 16, 20, 26-27, 32, 41, 43, 46-47, 52-54, 76, 89, 102: a, t, c, g, or other
agngttaatcctaggntggncgcagnntgttncgatgatgntncannttagnnntggtaaagcgatagctcctctntcaggatggtcanggagttactagantcacgatacagcctatccacattgtcatgagat

SEQ ID NO: 192 - DNA, 280 bp, Zea mays
  misc_feature: Incyte ID No: 700548710H1
  unsure 9, 40, 130, 143, 164: a, t, c, g, or other
caaggtggngtggggcgaggccaccatggtggaggcaganaggatgttgtttgccgccgcgcttcaggatcccgcgaaccagcgctttgttttgctctctgatagctgtgtcccactctacaatttcagntccatatatactncacctgatggcttcacctaancagttttgtagacagctttgttgataagacggagaagcgttataatcaaaacatgtctcctggccattccaaaggataaatggaggaaaggatctcagtgggtagtattaatcaga

SEQ ID NO: 193 - DNA, 278 bp, Zea mays
  misc_feature: Incyte ID No: 700548711H1
aaggaggctgcttgggccatctcaaacgctacctctggtggttcccatgagcaaatcaagtacttggtgtctgagggctgcatcgtgccgctgtgcgaaccttcttgtttgccctgatccgagaattgtaacagtttgtctggagggtctgagaatattcttaaagtaggggagcacgacaagaccatgggcgcaacaggtgacattaatgttttcgctcagatgattgacgacgcggaaggcctggaaaaaatcgagaacctacagagccatgataa

SEQ ID NO: 194 - DNA, 96 bp, Zea mays
  misc_feature: Incyte ID No: 700548712H1
tatcttaacatcaccaggagagggaaacatatttggacatttctagcttattagggccttgtgtggaacatgtttgaacaattatctcatttaaac

SEQ ID NO: 195 - DNA, 281 bp, Zea mays
  misc_feature: Incyte ID No: 700548714H1
cacagttctttgagggtctggattggatgatcccgccttcctgctaccaagactccaatggcatccattcagttaccacatcggatagcatctttaatccgtctgaaggtataccaccttccacaatgaacgcggacggcatggacgcgttccaaacctcttgcctttccgagtgttttcctaattccatccaagaattcatcagcagtccagatataaacacactgacatttatgtcgcctgagatgcaacatctggatgcccaacacgacggcagcaat

SEQ ID NO: 196 - DNA, 281 bp, Zea mays
  misc_feature: Incyte ID No: 700548715H1
  unsure 6, 22, 41, 44, 57, 65, 73, 92, 158, 160, 162, 226, 256: a, t, c, g, or other
cgttcnctgtttaagtcatgtnaggcacaaacccatatggnaanagaccaaaccttnttaaccanatttatantaccaactatatccctacnactttggtatcacacccccaggctgataccataaagagaaaaagttatgatgtcccaaagtagagnangnatgctgcacacccaatttcagttaactgaaacagctctacactaagcgtgacagagagttttgnaactcctttttctctaaattataaatttgncaagccaatctttgtatgaaactgt

SEQ ID NO: 197 - DNA, 286 bp, Zea mays
  misc_feature: Incyte ID No: 700548716H1
ggacaaggacattgacaggtttagtaaggctttgctcaattcatggttgcatgacaaatctctagatggcaacaattgttcaaaatgttgccagctaacaatggagcttgagtccatgagtattgcttccaaggaaaatggtaaagcaagacgacaaggcacacgaggaaagatccaacaacatataaatgatagtaccaagtgctgcagctgcaagcagaggcgaatagcttcatatataagtgaagctaggagggcttgcaggcttccacttttgataggcgca

SEQ ID NO: 198 - DNA, 283 bp, Zea mays
  misc_feature: Incyte ID No: 700548717H1
agctggggagaggaaaccgcgacaaggtgcagcagttcatgaccattaccggcgccagtgagaaggttgcccttcaggcactgaaagctagtgattggcacttggaaggagcttttgacttcttctatagccaacctcaggtttctgtggtcaatactcggcatcttgaagatattttcaacagatataaagaacctgatgctgatatgataatggtggaaggaatatctcaattttgcaagatctgcagttgatcctcagatattgtcagctgtcatatcag

SEQ ID NO: 199 - DNA, 277 bp, Zea mays
  misc_feature: Incyte ID No: 700548721H1
  unsure 56, 183: a, t, c, g, or other
cttgacatgatcatgagcaagttgtgtccaatggaacagtccttgctagtcagagncaggctctgaaccagatcacttctggaaagctttgggaggacgatcggagtactcgaaagaaaagcgtgtgaaaggttggcctgcagatccacatctgtatgcttgtagatttgaacaaggtttacncaaggtcaaggaggtattcagcttctgtaaggatgacctggcaactgaagagacgttgatctggactgcaatgaagaatctacgtctgggtggg

SEQ ID NO: 200 - DNA, 277 bp, Zea mays
  misc_feature: Incyte ID No: 700548722H1
  unsure 166-167: a, t, c, g, or other
acctttgatgcctctgtttgtcttggtctggttccagtgatagctgtatcttgtgctaggttatggttatagcagttcatcatatgagcttttggagaccagcaagatatggaaagttcctggtaattacttaagtatcatttcactgaatgagtaatgctagctnnttagtgaaaaggaacatgtcagcacctaactgcaccagatatcagaccgcaacatcaggatacaatacaatgcagcgagataaacagtctacccaacgagtataaatata

SEQ ID NO: 201 - DNA, 282 bp, Zea mays
  misc_feature: Incyte ID No: 700548724H1
  unsure 3-4, 6, 9, 11, 13, 17, 24, 26-27, 29, 38, 45, 57-58, 67, 70, 74-76, 82, 85,: a, t, c, g, or other
canncncgncnanaggnccggagncnngngtcctcgangaactgnccatgggccggnngttcggaanctnacgnnnaaatgnaanaatctacctngagttcccgacctaccaaggcggaaagggagagggggcgctgtggctcaggaaataactggaagccgagggctgagggcgatttcagagtcaggtggttatcgtttctttttcgttttctttttccggagggtagtatngggatgccggttgctagccgganccgcaggagccccgggtgatcgccc

SEQ ID NO: 202 - DNA, 275 bp, Zea mays
  misc_feature: Incyte ID No: 700548728H1
cgaaggaggagtacgacgagtctggcccggcaattgttcaccggaagtgcttctagggtttcacaagttcctcgtcgttacctagtctcaaattatgtcccctccatttctcgagatatgtgtggcagatttgcatgatacgtttgtttgtttccatcggacctgaagtcttcttggggataggctcccccctttgtatgttgtggctccaatccatgtgcgagcacgctgtgtctgtcgtgacacctggttcgtgagatgggttgtcaaattga

SEQ ID NO: 203 - DNA, 275 bp, Zea mays
  misc_feature: Incyte ID No: 700548729H1
  unsure 9, 74, 132: a, t, c, g, or other
ccggaggcnctccgggtccttgctggactggatctgaagtgtttcgtgttctcgctcatcaaccttcacttcangatcaagccaatccagtcttgagctccatcccaagccttcatgtagctggtttgtgcnactgcgagtgttttgagagagaaccttttaaccatgtaagatgatgttgatattgtggacgatgcgtgcgatcggccctgtgtggtgcacttagtggaagtggaacccccctttgcattgttttgtgcaaatgctgaaaaaaa

SEQ ID NO: 204 - DNA, 287 bp, Zea mays
  misc_feature: Incyte ID No: 700548733H1
gaaaggcaggaaaagcatgtatctgactcgatccgatgtttctcacgggcaccatgggaatgggaattgctgttgccctcgttttaaactcatctagaggatattgcccacgcccagatcagtatgctctgtctctccatctccatgcttcacctccggcattgatgcagccagctgtatcaattctgcaaaagaaaagttcctatctggtaaactgctgatgaactaggagcctaggacaacatgaatttttgtttcgcttcagtgcttggtcagtgaaccgtcca

SEQ ID NO: 205 - DNA, 232 bp, Zea mays
  misc_feature: Incyte ID No: 700548734H1
gcccgatgtacggggtgataaataaggtggttattgccagtgtacgtgggataataaggttgtatgctggtgtaggtgttctgcaggctgcagcgtgttactaattaagtgcatctcttgtcctattatgtattgctgaggtagttgttgtcgagttgaagtttcagtgtctcagatacatggggatagtgatgtacccagcactcggtcactagtgaagtccggtcattgg

SEQ ID NO: 206 - DNA, 276 bp, Zea mays
  misc_feature: Incyte ID No: 700548735H1
  unsure 240: a, t, c, g, or other
atcatctgcagttgtagctatgctggcaaaatcaggtttcacggcggcatttacactgatttttgtatctgagattggagataagacgtttttcattgctgcactactcgcgatgcagtatcaaagagcactggttttacttgggtcaatggctgctctctccctgatgactattgtgagtgttataattggacggattttccagtctgtgccagcacagttccaaacaacgctacccancaggagagtatctgcattgctctgctggcatcttgg

SEQ ID NO: 207 - DNA, 276 bp, Zea mays
  misc_feature: Incyte ID No: 700548736H1
  unsure 154, 156, 241: a, t, c, g, or other
cgggttgcggggatggccctcggcatcgcacctggcgccacacacacacgacacgtacaacgatgcccggtggatggtgtgttgttgcatgagctcatggggctagaattgtcagagatcatgaattatattttctagtgtagtctatatgacntnttataaggaataaaacttctctaatcagtaatcatagatttaaccttttggaaagaaaaatttaagatcaagaattattctgccncatgacttgaaactatgtttgagccatgtgttggc

SEQ ID NO: 208 - DNA, 275 bp, Zea mays
  misc_feature: Incyte ID No: 700548737H1
gtccaaaacagctccgggactatgcgataccactgggatggcaatcttcctgcaatgtcgtggtgcgtccacttctaccatgatttgcagcacgttttggtgatttgccctgccacagcacgggctgctcacattttgtacattggtcgttaaataggataagcgtgttggcctacattagatataatgatgattgatgatatgaggaataggagaggcattcaagtacttgtatgtgtctctatgccaatgctttatctatatagctgtatcag

SEQ ID NO: 209 - DNA, 272 bp, Zea mays
  misc_feature: Incyte ID No: 700548743H1
  unsure 9, 28, 44, 88, 140, 142, 155, 185, 212, 220: a, t, c, g, or other
aggtgccanattggttcctcgacaggantgactacaaggacaanaggttctcacagatcatctccaacgccctcggtatgaagctcanggacaacctcagcaagctcaaaaagatcagtcccttgttggatttcatttcnancctacccgatggngagagcaagtgaacgcatgcgcacttggangagacaacgtcacatgataaggttgtncaaggcgntgatcaagtggacgtagcggcttatcgacaagcatgttttggtcctggagag

SEQ ID NO: 210 - DNA, 271 bp, Zea mays
  misc_feature: Incyte ID No: 700548744H1
  unsure 183: a, t, c, g, or other
atctggtatttcgaaggaatctacgcatgctccccgcagataccaggtgttcgttttccaggattgactcatcctggtgttgtgggaactgcaccgtcacttgagctcctaaatatatggaatgaaagagagaaaagtttgtctgagacaagcccggagactattaaactgtgtgaagttctncaccagaggccccttgctcatttaccgacccctgaaaattgcttacttgggaaggtccaagaagggactgctgaatggcacataattg

SEQ ID NO: 211 - DNA, 265 bp, Zea mays
  misc_feature: Incyte ID No: 700548745H1
  unsure 133-164: a, t, c, g, or other
cgaagagcactcgagcgactttgaaccggaagaaaacggtgagggtgccgaccgatgaggagattcgatgaagaggacgatgacggtgaggactctgtgaaggcgcagaccttctacgaagaggaagaggtcnnnnnnnnnnnnnnnnnnnnnnnnnnnnnnnngggatgatgatggtgacgatgatgacgatgggaggccaccatcaaagcgatatatggttagctctagttttgtagctgtgtcctgggtgtttggtagtagg

SEQ ID NO: 212 - DNA, 277 bp, Zea mays
  misc_feature: Incyte ID No: 700548748H1
cagatccaatatgaatgctgttgacatcacctctcaatatggatctggtactaatatacaagacaattcccttgtacatgtttcaaaagctaacattagcgggaaggtcctcccaaccataattggaagcaacgtgacagtgggtcacagtgctgtattacatgcatgtaccattgaggatgaagcttttgttggtatgggtgccactctgcttgatggagtggtggttgaaaagcacagcatggttggtgcaggatctcttgttaagcagaataca

SEQ ID NO: 213 - DNA, 275 bp, Zea mays
  misc_feature: Incyte ID No: 700548752H1
  unsure 19-20, 83, 85, 107, 175: a, t, c, g, or other
ggatcaaaatgatattttnnatccacttcaattaaatatctaaactgttagtaatttgttgaattttagatatttaattgaananggatcaaaatgatatttttganccgagcagctgatataggctcctcgaactacagtgtgtcgcctgtgccaaatcatcacaggttcatgntccacacgaactataattgtgcttctcaaactgtggtgtggagcttgagccattttagaggagtcacacactgtgtgtgtattttaaaaaaagcggatct

SEQ ID NO: 214 - DNA, 269 bp, Zea mays
  misc_feature: Incyte ID No: 700548755H1
gatactctgcacatttcagagggcaagctcatttctttgggtacgaaggaagatgcggccttcctactaattttgattctaactattgctatgcattaggctatggcgctggtgcccttctccaaagtgggaagacaggacttatttcctcggttggcaaccttgcggctccagttgaagaatggactgttggtggaacagcattaacatcactgatggatgttgagaggaggcaggcaattcaagccagtgatcaagaaggctatggt

SEQ ID NO: 215 - DNA, 276 bp, Zea mays
  misc_feature: Incyte ID No: 700548756H1
  unsure 9, 22, 28, 34, 47, 65, 73: a, t, c, g, or other
gaatcaganacacctgccgctnttcagnttgttncacgcaactcctnctcctatcttctatctcncctcgctnccctacctcggcgtcgcgttggcaccgagccctcccgccatggcaaggccgctgcaggaagcgatcgataccttcatcagcatcacgggggcggacgaggccgtcgccgtacgcaagctcgaggaacatggtggtgaccttaatcgagcaataaattcgcatttcaatgatggagacagcatattgaatgggatcagtcaaaa

SEQ ID NO: 216 - DNA, 270 bp, Zea mays
  misc_feature: Incyte ID No: 700548758H1
  unsure 31: a, t, c, g, or other
ggaggagattcagcgcatcaaagctgcgaanccagatatccctcacagggaggccttcagcatggctgccaagaattgggcgaagtgtgacccgcgctgctcgacgactgcctctactgccacttctaacagcgctcctgagcctgctagagtcgtcgtgcccactcctcatgtaactgagccacgctttgatctggaggatagggccaaggagcatgtcattgagagcttcgacatcttcaagcagattgagcgcaacatctagatgtc

SEQ ID NO: 217 - DNA, 263 bp, Zea mays
  misc_feature: Incyte ID No: 700548760H1
gtctatgacatggagctctacgagtggaccaaggtggacatctctgatgaggcccagaaggagcgtgtcaatgcgatgattgaggaccaggagccctttgagggcgaggccttgcttgacgcgaaatgcttcaagtgagtgtgcttgcctggagacagaactgtttagcccttgaatttgcctatggaagagtttgcccttttactagtgtcgatgttgatctggtataccttgctatgaactggttaaagtttgtgctggtt

SEQ ID NO: 218 - DNA, 272 bp, Zea mays
  misc_feature: Incyte ID No: 700548763H1
  unsure 19, 24, 48, 51, 81, 139, 157, 166, 202, 247, 270: a, t, c, g, or other
atttattgctcgatagttnatttntaactaaaacgtgataaataaaantcnagatggagcagtcgttatagctctattttnatgtctatatttatatggatgattataaacctagacatatataaaacatatacattanttattgtattaattcagncaaaaaatncaagaaattttaatttaggacggatagagcactatntaattttaaataataagatattttgatctctcaatttcctctgtnactcttgcttccaaataattccncg

SEQ ID NO: 219 - DNA, 272 bp, Zea mays
  misc_feature: Incyte ID No: 700548767H1
  unsure 180-181: a, t, c, g, or other
agtgcaactgatgctggagctgaagttagcgtctgtttctaatttctaggtttctgtgtttcaatggcctcttgaaaattgaaaatggcctcttgtaggttgaaggatgtatgcatggaatagaagtcagataacacttttgtgcaacaggctgaagtcattcttgttgatgggaaattnncagaggctaatgctgaccaacttgctaaggtttaaatgcaggtcatttgcctactaagcatccacaaaatctcatataagttctgagaagg

SEQ ID NO: 220 - DNA, 242 bp, Zea mays
  misc_feature: Incyte ID No: 700548772H1
  unsure 43: a, t, c, g, or other
ctcccaggctcccaccccgccttgctcgcagcctccccaaaancctagccctagccctagccctagccctagctctcccacacccgcactgggagatggacggcggcggcacgcaccgcacgccggaagacgtgttccgggatttccgcgcgcggcgggctggtatgatcaaagcgctcaccaccgacgtggagaagttctaccagcagtgtgacccagagaaagagaatctgtgtttgtat

SEQ ID NO: 221 - DNA, 268 bp, Zea mays
  misc_feature: Incyte ID No: 700548773H1
gttctagatcgcgaggccgccccaagacctcatcacctccccttcgccgtgaaccctaaccccgcgccccttcgcccccttccttctcgtcgtcatcgccgcccgcttttccgggcccccatcgcctcttctcttccacgagtggttcaagcatggtggtcgtgggctccgcggactccttcaacagcatcttttccaaggtgcaagatgaaaagctaccagctgtcttttactacacggcggtgtggtgtggaccatgtagggcgat

SEQ ID NO: 222 - DNA, 267 bp, Zea mays
  misc_feature: Incyte ID No: 700548774H1
  unsure 9, 21, 33, 53, 67, 87, 106, 155, 200: a, t, c, g, or other
cgccgccgnccgcaggcacgngcgcggacgganagactgtcagcgtcgcgctnctagctactaggcntttcatccccgtgtggcgtnttctatcgttcgcgtcccnttattgccacctgtccgatagacaacttgttctcgatccggtaatttcnccgtgcttcagctgcgtgtgtttggaaaaattgattcggtttcgngtattgttaagagatcgatgggagaagtgaaacattgttgggcgttcagtatgctctgtaatacctt

SEQ ID NO: 223 - DNA, 265 bp, Zea mays
  misc_feature: Incyte ID No: 700548776H1
ctgcatgctgaggcctgtgtcgagtgagatcaagattgacgagacagagattcaggcagcgaaggtgcgtctccatctttatttcaaggggatttcatcacgttttttcttttaaacgagcctgcaaaactagtactggagaaaaaaaacatttcaggcttcatttcacgatattcagataatgaatgaagttcgggacagtgatcgatcgataagctgcgctaacccaccgagagagacgtttattttcagtggatggcgcgga

SEQ ID NO: 224 - DNA, 270 bp, Zea mays
  misc_feature: Incyte ID No: 700548779H1
  unsure 138, 265: a, t, c, g, or other
cgaaagatggttctgggtacaagttcttgggtgagatcgttttgcagccttgacaagataaaccctcaggtggcctcccgcatggtttcagcattttctcggtggaggcggtacgacaagaccagacaagctcttgtnaaggcccagctggagatgatcgtgtcggccaatgggctctccgaaaacgtgttcgagattgcttcaaaaagcttggcggattagcttgggcagttccgaggaattgcgagtgggagtgcttaatgantctct

SEQ ID NO: 225 - DNA, 196 bp, Zea mays
  misc_feature: Incyte ID No: 700548780H1
atagggtttggaggcggatccgatgttgtcatgtgtaggttgtaagcgggcaatgtgattggctgtgtatctgcttcgctcaagttgctttatgtcattcctaatggaataggaaatgccgtgtttcttacgcctgcttttggttctgcattctactgaaaaagcgtacgataattaacacattcacctttgaaga

SEQ ID NO: 226 - DNA, 272 bp, Zea mays
  misc_feature: Incyte ID No: 700548783H1
gattgataccattttcgttggagaatcaggttcgcaaatgcgcgcctctgcactgagtttaacaaaatgcttagcacaaacagcacaaaagactttcagtgattttgaagaagctgttgaaaaggatgcaacaaagaatattcatacctgatggaacagttcatcctttaacaagctatgtgatcaactatgttaagtttttgtttgactaccagtcaactctaaagcagcttttccaggagttcaaggaagatgggacaggttctgagctg

SEQ ID NO: 227 - DNA, 98 bp, Zea mays
  misc_feature: Incyte ID No: 700548784H1
  unsure 29, 96: a, t, c, g, or other
actcttagaagtctttcgctccgaatctncgggacgagattcttttaaggggggagggttgtaacacccctggtgtttatattccacacaacatancg

SEQ ID NO: 228 - DNA, 265 bp, Zea mays
  misc_feature: Incyte ID No: 700548785H1
  unsure 8-9, 12, 21, 42, 49, 78, 81, 84, 97, 115, 131, 158, 172, 189, 205, 208,: a, t, c, g, or other
ggtgaagnnatnggcggcgcnggcggcatggacgaggacgcncccgatngcagcggcggccctggccccaagatcgangangtngactaagcggtangttgtcagtacttgagcntgctgcagttgctggntggcccagtcgctgccgcgagttatcntcgtcggtcggtgnggtgtgtccgcttagantttatttgtggtgggntgncancatgtgtggtggttattttttntggantcgtgatagtcggtcggttccatgtta

SEQ ID NO: 229 - DNA, 265 bp, Zea mays
  misc_feature: Incyte ID No: 700548787H1
gaagcaaacaccacccagactttcttcttagtttgccattatcacatctgtactcatcatgcacatgaaacttttggttatgtacaactcaaaggtagaaggaagaccttaaggtatgttgtcatagtaattgtgaaatggatttggcactggtatttgatattttctgacttctagcatcactctgaaggcacatgataaagctcgagctttatcgatggtcggacgatgataacgcgctggaagaagtaatgagtagagagta

SEQ ID NO: 230 - DNA, 263 bp, Zea mays
  misc_feature: Incyte ID No: 700548789H1
ggattccggtttgatagactctgatgggaatacaaacaacagtttgagccataatcaatcattggtccgcggtattatatgttctgggctttttcctgggatagcatctgttgtgcatcgagaaagctctatgtcctttaagaccatggatgacgggcaagttcttctttatgctaattcagtaaatgcaaaatatcagaccatcccatatccatggctggtctttggtgagaaggtgaaggtgaatgctgtcttcatccgtg

SEQ ID NO: 231 - DNA, 196 bp, Zea mays
  misc_feature: Incyte ID No: 700548790H1
  unsure 46, 67, 79: a, t, c, g, or other
gtgtttgtgtattgttgttcttgttctgctggtgtctccgccgttnaatttgacctatgttatggantgagtgatatancgtgccgtcactcctagtatatagtagtgagtgactagttggtatgtgtagtactgtactatctttctccatatgcatgttttgccagcgcgtaatgaatgtaatgtcagtactgct

SEQ ID NO: 232 - DNA, 290 bp, Zea mays
  misc_feature: Incyte ID No: 700548805H1
  unsure 77, 120, 228: a, t, c, g, or other
ccagaccaccaaacaagtgccagcgccctctcgcagtcgccgcaatggagagcaccttcatcatgatcaagcctganggcgtccagaggggcctcattggtgagatcatcagctgttttnagaagaagggcttctacctcaaggccttgaagcttgtcaacgtggagaggtcgtttgccgagaagcactacgccgatctcgcctccaagcccttcttccagggcctcnttgactacatcatctctggccctgtggtggccatggtctgggaaggcaagagcgtcgtcaca

SEQ ID NO: 233 - DNA, 206 bp, Zea mays
  misc_feature: Incyte ID No: 700548806H1
  unsure 144-145: a, t, c, g, or other
aatcatgcttttatatggcttctacatgttgtggttctttcttgatctgcaccgcgcttatcgtttgtgttgtactgccctaataagtggtgcttatgaggactgtttctggttttgctgcttatgttgtaatgctttgaaacnntgaaagaagctacaggccacagctattttgagaagtaatggaacctcgtgccgttttgatt

SEQ ID NO: 234 - DNA, 288 bp, Zea mays
  misc_feature: Incyte ID No: 700548810H1
atcgcggtcccttactctggatcttttgaagtcataaggtacagactgaaacaaatatacgagagcgtggagtcagcaacagaggaatctgatgttccgacgttaatcgtgcatgaaagagtgacggttcgcctggattcagaaagttatgttacactgcagtggtcgtccgatcccatcagcgacatggtgtctgattctgtggtggctatggtcttgaacatcggtcgggaaggccccaaagttgttccggtcgaagaagcggtgaagaccaaagaggagacggag

SEQ ID NO: 235 - DNA, 289 bp, Zea mays
  misc_feature: Incyte ID No: 700548811H1
  unsure 163: a, t, c, g, or other
cacgccttgcccggtgtgcaccgacgaaaccagcgacagcagcacagagacgaacggcgtggtatcctcctgcctcagctgcttcctagctgggggtgctctctaccgtttcgagtacgcagtcaacccggcgctcttcctcgccaaagcgcgaggagggacncgcacgctcgctccctctgaccctgacgacacggtggctcgccgcgccagatacctgctgagcaacggtttcaggtgctacaacctgttcaagagcaactgcgaggattcgcgatatactgcaaga

SEQ ID NO: 236 - DNA, 292 bp, Zea mays
  misc_feature: Incyte ID No: 700548815H1
agattttctccaattagctattggccaggagtgttcgttgtgcctttcgcttgagctctctggacagaacaataatgcaggaacagtaggacagcaagatcatatggatacaaattatcctggaaatcttgcagtagccactgtaaatgggaaggagtcctcaaataaggatgtgagagggttcctaaccccaaaagcttagaaatctacctgctccatatgttccatgaaattcttaggaaactcaggagaaatctcgtcatgtggttcgctaccagagttctgctcaagc

SEQ ID NO: 237 - DNA, 290 bp, Zea mays
  misc_feature: Incyte ID No: 700548818H1
  unsure 163, 166, 288: a, t, c, g, or other
gtctaatgttgcagtgacatgtaatggcgcacccccgtcctactaacagatgcttactggagattgccatagctgatcttgtaatttgttatagggcagtatgaatatatttatggtagcttgaatctatttgtggattcacttcgtttttccatgtttcctngtntccagacctggactggactgctattgatttttgtttcagaattcctagctacctgttgcctagtgcctcccagcttggctcctgtcgattattgcacactggcgatggtactgttctgatgntg

SEQ ID NO: 238 - DNA, 290 bp, Zea mays
  misc_feature: Incyte ID No: 700548819H1
  unsure 167, 184, 191, 194, 222, 269, 278: a, t, c, g, or other
ggcgaccgtctcacccgcgccgcaaaggtgctcgagcagctcagcggaccagacccccgtcttctccaaggcgaggtacacggtgcggtcgttcggcatccggcgtaacgagaagatcgcctgctacgtcacggtgaggggcgagaaggccatgcagctgcttgagngcggcctcaaggtcaangagtacncanctgctcagaaggaacttcagcgacaccnggtgctttggtttcggcatccaggagcacatcgaattggtatcaatnagatcttcnacagggatctac

SEQ ID NO: 239 - DNA, 285 bp, Zea mays
  misc_feature: Incyte ID No: 700548820H1
aaaggctcaaccaactcaactcctccggtggtgctgatgacgacgatgaggacgacgagtaaagtttagtgccatcgaagtggtgctatctcaatccagcgatcagcaattgtgtactgtcttatgcggggacctgtagtactgcaataggcatttttgtttaagttttgcgaggtgaacaaaactgtttctgttagtttcgagcttgagctctcaatgtttactctttacattgaaatgctgccgtttggacatgttttttctgagttctacacctgcttgtct

SEQ ID NO: 240 - DNA, 286 bp, Zea mays
  misc_feature: Incyte ID No: 700548821H1
attactcatgtatggtggatcttctctgccgagctggtctgcttgaaagagctgtcaacatgatccattcaatgccctttgagccacatccttctgcctatggcaccttgctgactgcttgtagagtttataagaatttggagtttgctgagtttgctgctagaaagctgattgaacaggatccacagaatgcaggtgcctatgtacagctggcaaatatttatgcggtggcaaataagtgggctgatgtctctagagtaaggagatggatgaaggataatgcggt

SEQ ID NO: 241 - DNA, 203 bp, Zea mays
  misc_feature: Incyte ID No: 700548826H1
ttttatctgctttcatcgtagaaccatgtggtgtggagaacatgtctcagacgaaatgacgagtggttttggatttgctgcggattttaattttcgtggtcttgtcagtctggcaagagtatgatgactctgtatgttgaatttgacctcccccgctggatgacatgtataaaaggatgagaaaaaaaggatagtttggagct

SEQ ID NO: 242 - DNA, 115 bp, Zea mays
  misc_feature: Incyte ID No: 700548827H1
attgaaggaataaatgtctgaggacatcgacagtttattgtgaccgctacaggttcatgtgaccaaaggctagctatttttacgactgaatgagttatgcatgtattggtctttt

SEQ ID NO: 243 - DNA, 284 bp, Zea mays
  misc_feature: Incyte ID No: 700548828H1
  unsure 46, 157, 194: a, t, c, g, or other
gtcaaggagctatttggtggggctggttccacaaccacacattganttatactagaccacatcttgtggagttgatgtattctaccaatgtcgtcatatctaatctaaccttcaagaactcgccgttttggaatatccaccctgtgtactgcagccncgtgcttgtccggcatgtcacaatcctagcgcctttncattcgccaaacaccgacggcgttactccagactcttccacgaatgtgtgtatcaatcattgctatgtaagaaatggcggtgatgttatt

SEQ ID NO: 244 - DNA, 101 bp, Zea mays
  misc_feature: Incyte ID No: 700548829H1
  unsure 2, 32, 81: a, t, c, g, or other
cnttgcacggcaaatatacaacaatgaaaganttgattatgtttgtgtatgcatctcctgttctttttagataatggaganaagattccggctttcctctc

SEQ ID NO: 245 - DNA, 290 bp, Zea mays
  misc_feature: Incyte ID No: 700548831H1
  unsure 8, 74-75, 95: a, t, c, g, or other
gaagatgngcgatgaccgtcgaaggtgagtgcgcctagacccttctccccccgatttccaacattttcctgtanncccagcttccgattcccgtncgtttgggacgccgattcgtgcatggagtcaggccgattgggttgttgctagggttccgttccagtccgatggatggactcggttgctctcttcggaatcagggctttggagatcccgaatagattaaggatggtgcgctgtaagttacctctggcagcgcacgccagcactggatgctcgttcggtcgaggtgg

SEQ ID NO: 246 - DNA, 299 bp, Zea mays
  misc_feature: Incyte ID No: 700548833H1
  unsure 160-161, 222, 229: a, t, c, g, or other
ggacctttcactggaaagagatgcggaggaggaggctgagttcagagcaaagatgaaggagcaggcaaacgcacctgaagatttgcccccacaacttctctttgctcatcagggccagagagacttgaaagaactgcactggcacccacagataccgtcnncgatcatatcaacggcaattgatggcttcaacgtgttgatgcctagcaacattgatacaancattccngggagcactgatgcagcaatgccatctgctgagccacagcactagccaacattgatacaagcattctggc

SEQ ID NO: 247 - DNA, 98 bp, Zea mays
  misc_feature: Incyte ID No: 700548834H1
  unsure 9, 18, 44, 56, 63, 68-69, 72, 95-96: a, t, c, g, or other
agactgcgngagagaganagagagttgtacaaggctcgtcgccngccgcactgtangggtacnttgannctnttcaccgccgtcgcctgccgccnnaa

SEQ ID NO: 248 - DNA, 176 bp, Zea mays
  misc_feature: Incyte ID No: 700548835H1
  unsure 149, 161: a, t, c, g, or other
catgttgaacgaggcaattctaatgtaataataatagacaaagtgccttatgaaggacatggttgacatgcctttgttgctgtatgagtgatgtttatagttttgagggtttgaagatgtggatcatttgcctattattcttccgctgnaccgtatgagcntgtttatcaatatgc

SEQ ID NO: 249 - DNA, 287 bp, Zea mays
  misc_feature: Incyte ID No: 700548836H1
  unsure 9, 30, 84, 125, 187-189, 231: a, t, c, g, or other
agataatancaagttcaccttttattgatntaaggactagtaatttaggctcaacagttcttggaaaaagaaggttggatgaancattttctcaatggtcccaaataagaggaagacgttttccnaagtctgagcttgacacatacttagaggaagaacttgtgagaatagatgaaagatttgaaannnccaaattggtggaggacaaatgcaaacaaatacccggtgccnctcagctatggcgcgtgatattttagcaataccttgagcactgttcctcggagttt

SEQ ID NO: 250 - DNA, 283 bp, Zea mays
  misc_feature: Incyte ID No: 700548841H1
  unsure 18: a, t, c, g, or other
atgacaccgccgaggctngttcctccatcttgactccccagcaaccccaatgcagtccataccttcacaccctatttttcaatgagcaagctttcatgacggtgttggtagtgtgtgacattcttcactgtactagcaggtgaattttgatctcccatcccatgttacattaaccttgagtgacagatgactatgcgtagtgtatcctctatggcagtataactagaacatttgatttatttgttactggtaatgctgagatatagtactgtgcagattctga

SEQ ID NO: 251 - DNA, 235 bp, Zea mays
  misc_feature: Incyte ID No: 700548851H1
cgaacaaaacatcagcccccctacatgtttcatctatatcacgaagttgcagatatgtggtaactatcaaaaggatttaccgtacctgggccagtgttttcgccttcaccatacctgcccattgtcagtactatttcctagatttggagtagtcccgtagctaatcctcttccctgcggaggtgatgggattttatgttgtattgatgttgtcaacaatgtcgttcttagccatg

SEQ ID NO: 252 - DNA, 281 bp, Zea mays
  misc_feature: Incyte ID No: 700548852H1
  unsure 2, 75, 125, 194-216: a, t, c, g, or other
angccgcttgcccatctactgcacagcaaagggactgcgattcctttagcgatgggctatgtcgtctcgaaagcngtcccacctgttaggagggactctgcacaactcaccaaggatgaacagcnctctgttctctcagtcagcatcatcgatcactatggaggcagcagtgggactgttcaagagaagatgannnnnnnnnnnnnnnnnnnnnnnaaacaggcaaggaacttgagtcaggagacaacaggtcgtgagtgtgagatggagatgcatagtgt

SEQ ID NO: 253 - DNA, 280 bp, Zea mays
  misc_feature: Incyte ID No: 700548853H1
tcagtaaaagcggctagcgttgcttctcaatggttggaattactgcatcaggacataaggggacgtcttgctgctttaaagcgcacaggaagagagtcagaaatgctcttcacacggaactgccataccttaccgcgacagaattttcatctaatcaagagaacgaatcatccattgcaaatacttctgagattggatgtactgacaaagcggtttcagaagctcatgtggcacgatggaggtctctgtttgttcagatggacaaaacacttcaggaggg

SEQ ID NO: 254 - DNA, 279 bp, Zea mays
  misc_feature: Incyte ID No: 700548855H1
  unsure 197-220, 247, 264: a, t, c, g, or other
gtcacgtcatcgtcacccccttttatttaccttgccgcctcggttcggcacgagcactgactgactcccggcctcttcgctgtcggctgtcgctgggtctctcccctcacgatcggccggggaagacgaacgagggcgctggctgcggttgggcttcgttccgtctcccccccccacgcgacgtggctgccacgctnnnnnnnnnnnnnnnnnnnnnnnncttgtctctcctccacacttggtcgtngcgcggcggtcaggaangaggagatctcatct

SEQ ID NO: 255 - DNA, 281 bp, Zea mays
  misc_feature: Incyte ID No: 700548856H1
  unsure 2, 23: a, t, c, g, or other
tngaatatcaagagaaccataanaggatatatcaatgctggttttgctggaattatgcttgaggatcaggtggcacctaaagcatgtggacatactgaaggaaggaaagtcatatcaagggaggaagctgtcatgcacataaaagctgctgtagatgctaggaaagagagtggctctgacattgttattgtagcaaggacagattctcgccaagctatttctcatgatgaagcattatggagggtgaaagcatttgctgatgctggagcagatgttctatt

SEQ ID NO: 256 - DNA, 280 bp, Zea mays
  misc_feature: Incyte ID No: 700548857H1
  unsure 6, 8-9, 16-17, 29, 35, 64, 156-159: a, t, c, g, or other
gctggngnnactaganntgcatggactanttttantcgacctgttagtccaaatgtgcagccanaccctactggccttaaaaagtcatggcatcagctttttatacgctcagcatcagtggccccttatcctgacgttacaacttcaactcatgannnnattcggaagccagaaccaaatggagcacaaataaacaatgctcatacatttctctctcagtatcctcctctggactgcaagccaagttcagcccagtccatgcaatatcctggttttccac

SEQ ID NO: 257 - DNA, 280 bp, Zea mays
  misc_feature: Incyte ID No: 700548858H1
  unsure 9, 23-24, 29: a, t, c, g, or other
aactccacntacagccaccttcnntgcgncttcagccacttatgacaaccaggtctgtcctatctgcctcgtgaaccccaaggacatggcgtttggttgtggacaccagacctgctgtgactgcggacagatcctggagtcgtgcccaatctgtcgcactcccatcaccacaaggataaagctatactagcaagtagtggtttggatcattgtcaatgggtggtatactggaggagccacccagcgtcacactggaggatcgtgtcagcatgcccataga

SEQ ID NO: 258 - DNA, 226 bp, Zea mays
  misc_feature: Incyte ID No: 700548859H1
  unsure 10, 153, 215-216, 225: a, t, c, g, or other
gggcagctgntgaagtgcgcatacaattttattgcattcgcttatcaaatctgaatgatctcccgttttctggagtgcttggatagtagttctaacttgcagataccttttgaggatcagcgaagggttctgaaaggagcctgtgagaacccngtttcccaaagaagatggtttgttttcccaaatttcttcgacaactaaaattagcttccacnnaacatacgnc

SEQ ID NO: 259 - DNA, 203 bp, Zea mays
  misc_feature: Incyte ID No: 700548863H1
cgaatggctatgctggatatgcgtaggcggcattgctgatgtgttacttggtgtacctccttatccaggcttgctgcctaccactcactccctgtgtgacgttttgccgaaattggtttgtattgtgcacgataatatctggaaatagactctagacagtccttagttatcttttattataaaaaaagtcagtgcctctcgtc

SEQ ID NO: 260 - DNA, 277 bp, Zea mays
  misc_feature: Incyte ID No: 700548868H1
cgtgatggcaatgatgccatacgggctcttgatggttatccatttggccctggcagacgcaggctttcagtagagtggtcacggggtgatcaagctggtagacgtgatggcaacaaaccagaagcaaatactaagccaacaaggacactgtttgtcattaactttgatccaatgaacacaagagtcagtgacatcgaaaggcacttcacaccatttgggaacatatcaagtgttcggataaggaagaactttgctttgttcagtttgaaactatgga

SEQ ID NO: 261 - DNA, 279 bp, Zea mays
  misc_feature: Incyte ID No: 700548871H1
  unsure 2, 34: a, t, c, g, or other
anctgattcaatctacatggaagtggagctccgnaggctatcattcctcagagatacctactctcggggaaacacccctagcaatgcggtggtaggcagcttgaactcttcccccgctgcgagcgccaagaagctgcagcgtgaacgggagatgcttgcgtggcagatgcagaagcggctcacggcagaggaaagggagcgcctgtacaccaaatggggcatttcgctggactccaagaagaggaagctccaggtcgctcgccggctctggaccgaggc

SEQ ID NO: 262 - DNA, 277 bp, Zea mays
  misc_feature: Incyte ID No: 700548872H1
  unsure 18, 61, 87, 159: a, t, c, g, or other
acaatgctagagtccatntatctaggttttatgctggtgaaaaacttttgaagtaaaaganagtctgttagacttgtacttggtccntttgtcatgcaacattttcaggaagatgtcgacctcatgaaaagtttgaattttgatgcctaccggtttctnatctcatggtccaggatcttcccagatggcgagggaagagtcaatccagaaggtgttgcctattacaacaatctgataaactacctgcttcggaaaggcattacaccgtacgccaatc

SEQ ID NO: 263 - DNA, 274 bp, Zea mays
  misc_feature: Incyte ID No: 700548873H1
taagagttgtgtaaaccctgattacatgtccagtcagcaagatataaattcaaagatgagagcaattctgattgactggctgattgaggttcactacaagtttgaactgatggatgagacgctatttcttacggtaaacgtaatagatagattcttggaaaaggaagtggttccaaggaagaagctacaactggttggaatcacagctctgctcttgcttgcaaatatgaggaggtctcagttccagttgttgaggacctgtgctcattccgac

SEQ ID NO: 264 - DNA, 278 bp, Zea mays
  misc_feature: Incyte ID No: 700548874H1
caaggattctgagggatttgtgccaatatcagtaattgctggctttaagaaagtaaaaacttctgtgcgcaataatgtgatgcttgctgcggctctccgaacctcatcaaaacttgttgtaagcgatgacggtaagagagtcaaaaggcagcagccatttacagaatctgatttgcaggagctccagtcccggattgttgtagcagaaaatcttcctggtgatccctcctaccagaatcttaagaagatattttcaactgttggaagtttgatttcaa

SEQ ID NO: 265 - DNA, 221 bp, Zea mays
  misc_feature: Incyte ID No: 700548878H1
  unsure 9, 66, 157-159, 162: a, t, c, g, or other
agtgattcngatgaagaaaatgacccgactgttcagccgccagctgtctatgaaaatactcctacncatgatgacagttttcctttcgtcactgatgctgccggatctggatatcctgaaaggtaccaggaggatgctagtgttggtacaagtggtnnnggnttattgaggcagaacactggtgaatttgaaataaataactggcaaatgcttcttccaca

SEQ ID NO: 266 - DNA, 280 bp, Zea mays
  misc_feature: Incyte ID No: 700548880H1
  unsure 204, 219, 226, 233: a, t, c, g, or other
attttagccgccgccgctgctcatctcacatccctcgagaagacgcctgctcctccgccgatcgatacgatggccgtcttctccgacctccacaccgccgacggcctcaagtccctcgaggctcacctcgccggcaaaacctatgtgtctggtgactccattactaaggatgaattaaggtcttcgccgcggtgccgtcgaagnctggcgctgagtttnctaatgncgcccgntggtacgaaaacgtctctgcggggtagctcaagattcctgtaagctg

SEQ ID NO: 267 - DNA, 135 bp, Zea mays
  misc_feature: Incyte ID No: 700548883H1
  unsure 97: a, t, c, g, or other
atctttgccaatttgtggatgaacaaattgtcctacagttgaatttcacctcagcttgcctattatgattggctgacgcagaatcatcaagtgctanttttatttccaaaatgtctgaagctttggtttgaattc

SEQ ID NO: 268 - DNA, 278 bp, Zea mays
  misc_feature: Incyte ID No: 700548888H1
  unsure 2, 74: a, t, c, g, or other
angagctcttcctctccgaccacttggacacgcagagcgcgcacaccattgagggcaagtgcatcgttcactcncttcaagagctacaccaagctcgataacgtcggcccggaggacttctactgccgatttgactacaaggccgccaccggtgcattcacccccgaccgtgtcgccgtgtattgcaagtgtgagatgccgtacaatccagacgacctgatggtgcagtgtgaagggtgcaaggactggttccatccgtcttgtatgggaatgaccat

SEQ ID NO: 269 - DNA, 274 bp, Zea mays
  misc_feature: Incyte ID No: 700548891H1
  unsure 5, 129-130, 132, 134, 144-145, 182, 221, 244, 257, 263: a, t, c, g, or other
gaganagccattgcggagaagtcaaaggctattacctctatgcagggcgagattgcttcttgccaggcaaaaggatctctagctgccgaggagcaggctaacaaggccaatgccaaggctgttgaactnntntngcagattgannagctcaaaaaggatattcaagcacaaagtagtcaganagcagcactagaatctagggccaacgatgccgagaacancgtggaaaagttgaatgaaatgntaatacaatgcanaagganagtggtgagca

SEQ ID NO: 270 - DNA, 280 bp, Zea mays
  misc_feature: Incyte ID No: 700548895H1
  unsure 42, 110, 241: a, t, c, g, or other
atccggtctccggtcgctggcggtgcgcgccgcccctttgangcgccgcatgtcctcctccgtccacgacgacgcctatgagacggccaagtgggagaagatcacctacnccgggatcgtgacctgcaccctcctggcggcgtacaacctgtccaagggccacccccacttcgatgagccgccggcatacccctatctgcacatccgcaacaaggagttcccatgggggcctgatggcttntttgagaagaaggaccaccactgagcctgattagcacac

SEQ ID NO: 271 - DNA, 284 bp, Zea mays
  misc_feature: Incyte ID No: 700548896H1
gatcagtgaaattctttgacatctagccgagaatttttgtttggttatcgataattcactctcattcatgtgagatattgtgctctgcttatttattgatagctgacactggtcacccaggagcacgagattagcgcgttgatgtacttagtactgtgaaatcaaactggaggaggctgcaattctgcattacacctacaaaaaattctcaaacctaacctcaagaagggatagatgtggctgcaaaccaactaaagaagatgtgaagcaatgttttatctgga

SEQ ID NO: 272 - DNA, 251 bp, Zea mays
  misc_feature: Incyte ID No: 700548903H1
  unsure 156, 226, 239: a, t, c, g, or other
agcaaaatctcaaactgaaagcaagaacattgccaatagtttcgagttggacaatggacatgtcactaaagtacaacctatagattccacagggctgggcctacgcgttgatagttcagttactatcaatgtgcctaaaaatcatcccagagatgncccagttcctcttgcaacaaaaatgtatcattcacagggcaactaccgtcttcgatttgagcttggccantttatcgcgatcngtgtgcagcatt

SEQ ID NO: 273 - DNA, 303 bp, Zea mays
  misc_feature: Incyte ID No: 700548907H1
  unsure 15, 92, 131, 188, 192, 195, 285: a, t, c, g, or other
acaagctgggcaatnacgttctgtcccctttcatcaatttattcgggggagggggactattaaacttcaccataacaccaccaacataccanccggggagcatgcccattaaatcatctgcctttcagttncatttcaggccatgcatcttgcggttgcaggaagtgttgtttccacgcagacacatngccnacncagagcatgttccttcagagccttgacattgcgtagtccatggagtccaccaagaagtctgcatcgtccttcgaaaagcacatcggtggnttaatctgaagacgttac

SEQ ID NO: 274 - DNA, 302 bp, Zea mays
  misc_feature: Incyte ID No: 700548909H1
  unsure 47, 131, 253-254, 261: a, t, c, g, or other
atcaagttgagttcctgtccatgaaactagaggcagtgaatgcccangcaaaccagggagttgaagtatttccagccaaagattacggttctcagacatacaacacagctcctgggctgacatttgatacncaaaccagtagagaatacgcccagggcacgtcgacctcggaatggcttcacatgcagattggcagtggctatgaaagggtttcatgaacgagatgaatccaggcaaccgctaaataaagtgnncctgaanaatcattgccctgcttgtagatcatccttttcaattttttt

SEQ ID NO: 275 - DNA, 100 bp, Zea mays
  misc_feature: Incyte ID No: 700548910H1
  unsure 49: a, t, c, g, or other
aaagagtcctatatattaagatctgcaagcatacatgcatggacagaancacttatggaggcatctgcttttgctaatatctcagaagaaaccgtaccaa

SEQ ID NO: 276 - DNA, 103 bp, Zea mays
  misc_feature: Incyte ID No: 700548911H1
ccgaatttcaattttgtggggcgcattttaggacctagaggtaattctctacacgcgagtagaagcatccactgggtgtcgtgttttcattagaggaaagggt

SEQ ID NO: 277 - DNA, 298 bp, Zea mays
  misc_feature: Incyte ID No: 700548912H1
  unsure 158, 168, 213, 232, 245, 247, 252, 267, 282, 286, 292: a, t, c, g, or other
taaagatttgttgaagaatgaatgccctcatattgtggttggcacgcctggtaggatacttgctcttggccagggataaggatctctccttgaagaatgtgaggcacttcattcttgatgaatgtgacaaaatgctggaatcactgacatgcggaganatgttcaggngatcttcaaaatgactcctcatgataagcaagtcatgatgtttcngcacgctcagcaaagagtncgtctgtatgccngnaattnttgccagattccgtnggaatatatgtggtntgangcaaantggccc

SEQ ID NO: 278 - DNA, 221 bp, Zea mays
  misc_feature: Incyte ID No: 700548914H1
gatgatggacgatgaagagagggtgggccatgcggagatcccgaccagtttcggtcccgagctgcgcgcctgcctccgatgccgcctcgtcaagacctacgaccagttcagggagaacggctgcgaaaactgcccgtttctagagatggacagagagcacgacaacgtcgtcaactgcaccacccccaattcactggaattatctctctgatggaccccag

SEQ ID NO: 279 - DNA, 293 bp, Zea mays
  misc_feature: Incyte ID No: 700548915H1
  unsure 109: a, t, c, g, or other
gaaaggctcaaccaactcaactcctccggtggtgctgatgacgacgatgaggacgacgagtaaagtttagtggccatcgaagtggtgctatctcaatccagcgatcagnaattgtgtactgtcttatgcggggacctgtagtactgcaataggcatttttgtttaagttttgcgaggtgaacaaaactgtttctgttagtttcgagcttgagctctcaatgtttactctttacattgaaatgctgccgtttggacatgtttttctgagttctacacctgcttgtcttgctaag

SEQ ID NO: 280 - DNA, 47 bp, Zea mays
  misc_feature: Incyte ID No: 700548917H1
  unsure 22, 38, 44: a, t, c, g, or other
agtagggctccatctagaaggnctctctggttcattgncttggntgc

SEQ ID NO: 281 - DNA, 307 bp, Zea mays
  misc_feature: Incyte ID No: 700548918H1
  unsure 268, 306: a, t, c, g, or other
cctgctggaactccatatgagaacggagtattcaggatgaagctattattgtcacgcgatttccctcaatctcccccaaaagggttcttcttgactaaaattttccatcctaacatagctactagtggtgagatatgtgtaaacacactgaagaaggattggaatcctggccttggattaagacatgttcttctggttgtgagatgccttctgattgaaccatttcctgaatctgcacttaatgaacaagctgggaagatgtactganaattatggaggaatatgcacgccatgcaaggttatccnt

SEQ ID NO: 282 - DNA, 138 bp, Zea mays
  misc_feature: Incyte ID No: 700548919H1
acaattttagactatgttgcagactcaaactgtcgatgtatctgcattctgcctggtttgctttcttatcttaaattgtgttttactagatagtaaataagttcatgctattgcctttaatgcttgtcctagtggtca

SEQ ID NO: 283 - DNA, 299 bp, Zea mays
  misc_feature: Incyte ID No: 700548920H1
  unsure 25, 167, 297: a, t, c, g, or other
gcggaaggagtcggagggaaccganaaactcagggtctcgaatttcctaggagcggaggcgatggctgggaatggaggaaaaggattgctcgccgcgaagacgacggcggccaagtcggcggagaaggacaaggggaagaaggcccccatctcacggtcctcccgcncgggcctccagtttcctgttggacgaatccaccgtcagctgaagcaaaggactcaggcaaatggccgcgttggtgccactgcagccgtctatctgccgccatcctggagtattgactccgagttctggantg

SEQ ID NO: 284 - DNA, 305 bp, Zea mays
  misc_feature: Incyte ID No: 700548921H1
  unsure 86, 102, 217, 237, 287: a, t, c, g, or other
ggtcaatgctcaagttcatcctttagcaaaatatcccacttttctgagtcatcagttgtaacggaggccaaaaaacagatttcagngcgatggtcaatggtnacatgcaatgagcatgagtcaagtgcaactgtcgagaagaaaatgcacgttaggtgagatgctctccattaaggaagcaaaggaagacgaggccaccactgggatgttttatgtntccagcaaccagtcatgtgnccctggagaatgaaccgactaacaacgttctacaaatgtaactacttctngaaaaatggtgacaatgg

SEQ ID NO: 285 - DNA, 300 bp, Zea mays
  misc_feature: Incyte ID No: 700548922H1
  unsure 241: a, t, c, g, or other
atttatgtagatcgttcaaggttgcaattgaataatgtggatgcaattacttccaggacatatatctgcaagtaatagctttttctgagttcagaagatttaaattatgttatattaactcactttatgaattcaaacgaatgcagccattgctacagcaagtttgttgatttcctgctctactggttccgtgtatcattgccccaaaatcttcttccacgtgatgctgcggagagggatngctgctggtacggtttcatgtgccgcacccagcaccatcggctgaccacgccaagaagc

SEQ ID NO: 286 - DNA, 298 bp, Zea mays
  misc_feature: Incyte ID No: 700548923H1
  unsure 32: a, t, c, g, or other
tttcagtctatgccagacatctacatgtctgntggtgctcatataagtgggggttgatatatttgctgtgttcagcttacatctgttgcggccctagttagctatttgtcttttgtgtactatctgaggcaagagattgatcagctaggacttggcgaacacttgcctgtgttggctgttcatctgaaggggaaaatttgcacgagacacctcggatattacaacaatggatagatcaagttgattaaggaagttggcgatgggactttcgggagtgtatggcgtgctataaataaac

SEQ ID NO: 287 - DNA, 300 bp, Zea mays
  misc_feature: Incyte ID No: 700548924H1
  unsure 9, 23, 232-234: a, t, c, g, or other
aagagtagnattggtgattatanccaccagcaccagcatcagtgaggacagttatggcagcttcagtgctaacggaagcaggcctcacatgtcaaaggatgtgagatggggagccatcaggtgcttggctacccaacaagggagcttgggattgaagaacttcaagcttctcaaacaacttggttgtggggatattggcactgtttatttggctgagttagtggggtcagannncagttcgctttgaaggttatggacattgagtatctcataagcagaaagaaatgctcagagcacaaa

SEQ ID NO: 288 - DNA, 293 bp, Zea mays
  misc_feature: Incyte ID No: 700548925H1
  unsure 199-222, 239: a, t, c, g, or other
cgtcacgtcatcgtcacccccttttatttaccttgccgcctcggttcggcacgagcactgactgactcccggcctcttcgctgtcggctgtcgctgggtctctcccctcacgatcgggccggggaagacgaacgagggcgctggctgcggttgggcttcgttccgtctcccccccccacgcgacgtggctgccacgctnnnnnnnnnnnnnnnnnnnnnnnncttgtctctcctccaanttggtcgtggcgcggcggtcaggaagaggagatctcattcagtcccggcaagtc

SEQ ID NO: 289 - DNA, 298 bp, Zea mays
  misc_feature: Incyte ID No: 700548926H1
  unsure 254, 269: a, t, c, g, or other
ccacggccatcttgccaggtctgcaaaaaatatacgcgcgcctacttacattgcctggtcacaaaagatgctatgggttctcagctgctgtcatatcataacttatcatttatgatgcggttaagtagagacctccacatgtctattcttgaaggacgatttgcagaattccgtgcgaggattcttgagggtgcagtttccaacgggagacgttccgcagtgggttcgcaacgcgatggaggtcgctggcattnacatatccgagtgcngtgcttccaccatgtcggaaaccagggaa

SEQ ID NO: 290 - DNA, 148 bp, Zea mays
  misc_feature: Incyte ID No: 700548927H1
atgttccacaaggagattcttctggactacgtgcaccatgatatcaccagaaagtgggctttgatttacttcaagctgcttttgctggtgatggcgaaggacaccatcatgtacttcaatctgttctaagctcaccttctcagtttct

SEQ ID NO: 291 - DNA, 299 bp, Zea mays
  misc_feature: Incyte ID No: 700548928H1
  unsure 157, 199: a, t, c, g, or other
acgcaagaagctcattcagatcgatgtgagctcggatacagtgtgcccttggtgctttgtcggtaaaaagaaccttgagaaagcaatggagcaaaaccaagggcaagtttgatttcgaggtccgttggcatccattctttctgaaccccgacgcgcnaaaggagggcgtcaagaaatctgacttcttcaagatgaagtnacggtcctgtccaatatgagggtgcgatgtctcgcatgactgagatatttcgaggactcgggcttgaatacgacatgtcaggatgacagggaacacgatg

SEQ ID NO: 292 - DNA, 177 bp, Zea mays
  misc_feature: Incyte ID No: 700548929H1
  unsure 2, 6, 75-93: a, t, c, g, or other
cnaganatggaaggctgaactaagagcggttggatatggcatgcatgcatgctgctgctgtgcatatcttagggnnnnnnnnnnnnnnnnnnntgtactgaatttcttcaagttttctctttttttggcatcctgccatcgcagggaagaataatgggtggggtgacctgttgatgc

SEQ ID NO: 293 - DNA, 305 bp, Zea mays
  misc_feature: Incyte ID No: 700548931H1
gcagtgatgagaaaaaatggccgtgaagaacaattgaaacaaatgcatctggacatggaagcattgcttaagtacctttcatccgtaagttttagaagttcagataacgaagacaaaggaaaagatgaaaggtacttaagcagtgatgagaaaaatggccgtgaagaacaattgaaacaaatgcatctggacatggaagcattgcgtgaagataaatcaaagctggaggcgatattggagaagaagactgatgaagagcgcaaactttgtagcagagtagaagatcttgaattgcattgaacaaa

SEQ ID NO: 294 - DNA, 138 bp, Zea mays
  misc_feature: Incyte ID No: 700548932H1
  unsure 130: a, t, c, g, or other
tgctatctcaggtaaaataataatttattggcacaggtttagccattcactaacttgtatcaattttgtgaactaaagaacttactattacatgtgggagccacatgctattctatttcgatggtacctnttttttcg

SEQ ID NO: 295 - DNA, 298 bp, Zea mays
  misc_feature: Incyte ID No: 700548935H1
  unsure 97, 99, 155, 247, 254, 256-257, 261, 277-279, 294: a, t, c, g, or other
ggcttgctatgaggcaaaagttaggcgagttgtggtggtgtcttcatgtggagctgtgtatgctaatcctatttatccgaagggtaaggtgtttgancnaagactgctggtcagatgaggattactgcaggaagaaggaggattggtatttagtncccaaaacactgtcggaacgagaagctcttgcttttgcagcaaaaacagggctggacgttgtaactgtttgtccgtcattagtattggaccntgatcancnncagnaaatttgttgcagcgnnngacctcaataatccnagat

SEQ ID NO: 296 - DNA, 298 bp, Zea mays
  misc_feature: Incyte ID No: 700548936H1
  unsure 8, 49, 109, 114, 120, 141-144, 153, 192, 194, 200-201, 218-220: a, t, c, g, or other
cagaaggnagtcaccctttctgctcagtattgcaatccgctaagaaccntgtcatcattgctggagctggattatttgaacgagaagaccaagttgccctattctcaangattnagactntagcaaagaagttcaatgtgnnnngaccagacnggaatgggttaatgtcttgttgctccatgctgcacaggngncagctnnttgatcttgggcttgcnnntaatcctgccgagagcatcaagtcagcgaagttcctgtatctgatgggagctgatgatataagcctggaaaagcttcc

SEQ ID NO: 297 - DNA, 206 bp, Zea mays
  misc_feature: Incyte ID No: 700548937H1
cagcaggaccctatttgcacagctggtatcgttttaaaagatgaagtactaagaagctttatttacctgaggcaacttgagcttactccgaccctttggtgtggagtgcatgtcagaaacaggattatgaatgctgtgttcagtgcttttcacaaattgttgtattttcaccagaacaatttccctcaattggaagtgaggaaatc

SEQ ID NO: 298 - DNA, 294 bp, Zea mays
  misc_feature: Incyte ID No: 700548940H1
  unsure 30, 198-199: a, t, c, g, or other
gaaagatcccgcggcgcagaagccaccctnctctcctctccgctcccaatctttgtcgtcgcctccctcgaagtcgccgctgccttcattccaccatggcgcttcacgccccggtcctcgtgatgaaggactcgctgaagcgggagtctggcgcgaaggttcacaaagccaacatccaggcggccaaagctgttgctnngacattcgcactacattgggtcccagatccatgctgaaaatgcttctggacgctggacgctggtggcctttatttaataatttgtaaattatatc

SEQ ID NO: 299 - DNA, 98 bp, Zea mays
  misc_feature: Incyte ID No: 700548944H1
  unsure 29-30, 40, 42, 66: a, t, c, g, or other
ggaggatgatttggagaccgcgcactcanngcctcccgtngntcccaagagcgttgctccgctgcngtagaaggtccaggaacccgaagcgtccgacg

SEQ ID NO: 300 - DNA, 142 bp, Zea mays
  misc_feature: Incyte ID No: 700548945H1
  unsure 8, 22, 24, 64, 102-103, 126: a, t, c, g, or other
cgacgcgnaccccacctccgtngncgatgacaccgcgtgccccgcagcttcggcatcacccgcngcacctcctcctcgccgaggctgtcgcctcctggcacnncttccacacaacatacgagacgncgaaagggggatgtgt

SEQ ID NO: 301 - DNA, 299 bp, Zea mays
  misc_feature: Incyte ID No: 700548946H1
  unsure 9, 22, 31-32, 62, 210: a, t, c, g, or other
aggtaatgncccctgctctctncctatttgnnctgctcagtgacttttatttttcaatgaantttcctgggtacttttgcttttgtaggaccaggatatccggtttaccactccttatatgatgactacgtatggatggcgaaattcggagatcctgcgttctgtaggcatgtggcagctgctagcatatggggaatgatggcttgaggntggcaaatgaagacatcctacccttcaattacatgtcctatgcaattgagcttgaggcatacacaaaaacggtagagaatgaagtgaag

SEQ ID NO: 302 - DNA, 102 bp, Zea mays
  misc_feature: Incyte ID No: 700548947H1
agtacagttcctgggtaaatggccacaacaatgtttatagaatgacactgccctgagtgtaatttgtcgtgttcaatgtatgtcctccatagtcttccagcc

SEQ ID NO: 303 - DNA, 302 bp, Zea mays
  misc_feature: Incyte ID No: 700548948H1
  unsure 155-156: a, t, c, g, or other
agaaagaagcagcctgggcaatttcaaatgccacttctggtggcacacatgatcagatcaagtaccttgttgcccagggttgcattaagccactctgtgatctgcttgtttgcccggatcccagaatcgtaacagtttgcttggagggtctcgannacatcctgaaggttggcgaggcagagaaaaaccttggtgcaggtgatgtcaatgtctatgcacagatgattgatgatgctgagggcctggacaagattgagaacctgcagagccatgacaacaccgagtatatgagaaggctgtga

SEQ ID NO: 304 - DNA, 96 bp, Zea mays
  misc_feature: Incyte ID No: 700548952H1
  unsure 62, 64-65, 67, 78-79, 85, 87-89: a, t, c, g, or other
aaggaaaaatcgctccatcccctgactatcactggctcactgcccttccacacaacatacgngnngngcgaaaggggnntgtgcngnnngaaacac

SEQ ID NO: 305 - DNA, 294 bp, Zea mays
  misc_feature: Incyte ID No: 700548953H1
  unsure 2, 9, 30-31, 35-36, 42-43, 64, 68, 82, 87, 109-110, 117, 157, 159, 167,: a, t, c, g, or other
ancttcccnttccgtctccatatccttctnnctannaccgcnntctccactccgcgttccctgnactnccctgcgttgcatnttggnggagagagagaagtgggagacnnacgagangctgccgtgtagggactagggaccgtagagtaagcgacancncaggaggnagagggggatggccnggatcnggccgatcaggcangactgggagccggtggttgtgcggaagaaggcacccaccgccgctgccaagaaggatgagaaggccgtcaagccgcngccgtccggcgcgga

SEQ ID NO: 306 - DNA, 289 bp, Zea mays
  misc_feature: Incyte ID No: 700548957H1
  unsure 127: a, t, c, g, or other
cgatttagttgtgtgttgcttgaatccaacctattggagttgtttatatggtgcggtgtcggaggttccgtgcgacatttttgtttcttcaacaaggcaactggttgcttgaactccaaagtgtacnaccacatcttggtggacgatatgtggtagaatggatgtccaaagatggatgaactccaaactgtagaaccatttttgcttcttcaacaaggcattcattcatcgttttgatggcttgcagcgatctacagtggccaaccctacttggcgggtgttggctcgg

SEQ ID NO: 307 - DNA, 290 bp, Zea mays
  misc_feature: Incyte ID No: 700548961H1
  unsure 123: a, t, c, g, or other
atggaagagcagatgcaatagcaattttcaggagttctgttctcaagtgctatatgaatgtatgagcaaagatagaccatcactgttacaggcctatatcagtttttacacaacaatagagtnaatgtgggagcatttgaagactgggaattttcctttttataattcccttttccttcccaacttgaaggtcgctttggcctacaacgaagcattagttgattctagaatcacaaatggaggaattattcattcgacattctggagtcacttatgaagcgagtgggaga

SEQ ID NO: 308 - DNA, 256 bp, Zea mays
  misc_feature: Incyte ID No: 700548962H1
  unsure 35, 43-44, 160: a, t, c, g, or other
ttaaagctgtgaagttggtggccatgggaccggantacgacanngtagtccgaacacgtgtgcctcgtatcctacggcaaggctcgaggtactgtagactgtagtaagttaggctttttaaagttgtagtaatctgtatttgtaaaatatgtagactcantgatctgtatgtaagatgctgcgatgggtgaagctgtttatctttatcaaattgtagcaacattacagatcacctcttgagtaggtttcacagttc

SEQ ID NO: 309 - DNA, 293 bp, Zea mays
  misc_feature: Incyte ID No: 700548966H1
  unsure 157: a, t, c, g, or other
gcatttgttctgaaattctcagcaattgaaatatacaatgaagctgtaagggatcttctgagtgcagaaaacactcctcttagactctgggacgatgcagagaagggcacctatgtggagaaccttacagaggttgtgttaagggactggaaccacntcaaggggcttatttctgtatgtgaagctcaaagaaggacaggggagaccttcttgaatgaaaaaagctccagatctcatcagatactgagatgcaatgaaattctgcacgggagttctagggaaggacaagtcaa

SEQ ID NO: 310 - DNA, 287 bp, Zea mays
  misc_feature: Incyte ID No: 700548967H1
gtatttccgtggaagtggaaaagctgcagagatgaaacgtgaggcagcacgtagtgtctaagttcagccttctgatgaacatagggcggtctgattagagcagtagatggataagggaagggaacgagatgtgccaattaagccacgcggtcttgtacatcactgcagtacgtggatttggatcgctgaaagctaacagctgatcgtctttttgctcttctgtaaaatatgaacaatcatcatatggtccggatgcgtcaggtgtggttcattcctgccatggttta

SEQ ID NO: 311 - DNA, 289 bp, Zea mays
  misc_feature: Incyte ID No: 700548969H1
  unsure 61-63, 118, 123-124, 243, 255, 267-268, 272, 276: a, t, c, g, or other
gactgtacaaaatattgtttacattatagactattgttttacattgtgtacagtcatacgnnngatctactagtccatagccttaatcagacccgctgcgatattaaattgaattagnaaagnntgcaataggccatgactagtagatcgtccgtatgactgtacaaaatattgtttacattatagactattgttttacattgtgtactttgaaatgagagataattgtttacattaaaaaanagaaaaaaaaangggcggccgcannggcngaancgaatggacccgg

SEQ ID NO: 312 - DNA, 289 bp, Zea mays
  misc_feature: Incyte ID No: 700548970H1
  unsure 188, 219, 235, 273: a, t, c, g, or other
gaagatgcattcccgatgagcttccacttgacaatttcacgagcctggaagatgcattcccgatcagcgatttcatcggttcaagagatgagcatctgtatgagcactatattggcctggctgacattagccacctgcctcttccaatggatgatccagctttcaatctggatgcagagcttgattgncgtgggtttgacttcgctgcgattgaaggtncacttgatgtcctttnaggctggcaatcagtgatgtgttatactgaaacctgcnttgcttatgttgtatt

SEQ ID NO: 313 - DNA, 288 bp, Zea mays
  misc_feature: Incyte ID No: 700548971H1
  unsure 2, 20, 85, 97, 152-153, 159, 249: a, t, c, g, or other
ancttgaggacctgtctgangcttcttctcaagatcaggcaatatactagtaagctgcctgatcttgagaagaagcttgaggacntgtctgaagcanacccaagcgctgacatggatgagatggtgaaggcaattgcgtccagggtaactannttgatnccaaaagctgcatcttttacttcttcccagatggcaacctcaagcaatggattcgactcctcggttatgtctacggcagcgacaaccggnagctctggaagcacggtgactgaccttggggttgtaggc

SEQ ID NO: 314 - DNA, 287 bp, Zea mays
  misc_feature: Incyte ID No: 700548972H1
gattctctaaggggcagctgtggtctacgaaggtactatggaagcatccattttcaatcacatcatgtaccttcaacaccttactagcataacctggatcgtctccttgaagtagcaaggctggtgacctcggtaatcctgtcataatctctgcttagctgtacaactgtttctgggagtttagggtgagagactcagggtccctttcaggtgttaataactgtagggaggacactcgatgagttacaggaactactagatagcgtcttgaggaaacttgggtttgt

SEQ ID NO: 315 - DNA, 281 bp, Zea mays
  misc_feature: Incyte ID No: 700548974H1
  unsure 6, 8, 16, 22, 50, 57, 65-66, 76, 84, 204, 216, 227, 258, 261, 265, 280: a, t, c, g, or other
aggccntngagttganggcggnaggatctgataatcttgggcaagggtgntcctaangctgtcannaacgtaaacnacattatnggaccagcgattgttggaaaggaccccactgagcaggttgagattgacaattcatggtccaacagcttgatggaacctccaatgagtggggctggtgcaaacagaagcttggagcaatgncatccctgcggnttcactgctgngtgcaaagctggaactatggtgaagaagatnccncttnacagcacatcgcaant

SEQ ID NO: 316 - DNA, 283 bp, Zea mays
  misc_feature: Incyte ID No: 700548977H1
  unsure 228: a, t, c, g, or other
gcgctcaagttctcgcgcccacagccaaatttttctccactcaatcgcggcataagtgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagncgtgggcaccggcgcccccgtctatctcgccgccgtgcttgagtacctcgccgcc

SEQ ID NO: 317 - DNA, 292 bp, Zea mays
  misc_feature: Incyte ID No: 700548978H1
  unsure 34, 64, 79, 88, 131, 147, 183, 220, 224, 237, 272: a, t, c, g, or other
ccccgtcccaactccaccacctctcttctatcanggcgcgagcaatgggcggcgccggccgcgngcgtcggcgggaacngggcctcgntctccccatctctccgatcacttctgtcctgtgaaaatggcgnatgaactacgctcaangtctgtgggtcagaagttccatgggcagtccgtgcngttgagcagaatctcttcctattccgccatgaacaancctntattcaacaatgnctattctgcttacaatgtgccccagaggtcatatnatgggatgaatgcaatgctg

SEQ ID NO: 318 - DNA, 290 bp, Zea mays
  misc_feature: Incyte ID No: 700548979H1
  unsure 160: a, t, c, g, or other
gatgatattgaacccagctggcctgctaagaggtcatcagtcagcccagttcatccgaaaaattcacctcaatcagggagctctggtgatgagactagatgtaacaaccaaataaaaagggctcctagtgatgcgactggtgccagtccggcttcacccnaggcatcagagagaagcccagatactattatgtctgcccctaggtgtacgactgcaggagcagtgttctggtgatgcaattagtaagcatgatgttcctcatgttgagaatgcacactccaatgtagccg

SEQ ID NO: 319 - DNA, 258 bp, Zea mays
  misc_feature: Incyte ID No: 700548981H1
  unsure 23, 36, 149-150, 213-214, 216, 230-232, 249, 254: a, t, c, g, or other
cttcatctaacagttcaaaatcnggcaagaaacaanatgcaagaccagttgatctggatccacatggtgaaaaattaatccagattgaagacccgcttgcagaagccacaaaatacttgaagcttctgcagaataactcgtcaaactcnnagagacccatatactttcatttgagctaagcatgagaaagcaaaaggttttacttgctttccnnanagttaaacagctcnnnaattggtggagttatcngacancacg

SEQ ID NO: 320 - DNA, 93 bp, Zea mays
  misc_feature: Incyte ID No: 700548982H1
  unsure 85-86: a, t, c, g, or other
ctcatttgaggtgtctaaatcctttggacatttatcatgtcaaccatttccttttctattgcatgtttagcatgtaaaaaaaaanncaaaaag

SEQ ID NO: 321 - DNA, 89 bp, Zea mays
  misc_feature: Incyte ID No: 700548985H1
  unsure 9, 16, 47, 62, 69-70, 72-73, 78, 80: a, t, c, g, or other
attctacanagaaccngagcatagacatgctgctgacggaggcggantggacctgggcctgntaaaagnncnnaaagntnttccacaca

SEQ ID NO: 322 - DNA, 280 bp, Zea mays
  misc_feature: Incyte ID No: 700548987H1
  unsure 2, 190, 248: a, t, c, g, or other
angaggaagtgacgacgatgatgatggtggagaggatgaagaggaggatgatgacgacgatgatgatggggatggtgacaatgaggaagatgaggaggaagaagaggaagaggatgatgacgatgatgtcccccaaccacctactaagaagaggaaatgatagatggctgtgatttggttggctgtttcntacatgcaggaatgctccctgttcgcccctgcctagcagtctcctgtttagtgggtanggggtttagcttgatcgggacaatcatagcct

SEQ ID NO: 323 - DNA, 282 bp, Zea mays
  misc_feature: Incyte ID No: 700548988H1
  unsure 2, 53, 163, 217-219: a, t, c, g, or other
antcgaccgtgcaaccagagctccatagccagggtggggtgggtgtcctgaanactcagatgtggtgcaaggcaggctgtggaactggcagcatggccccataagcgttgctcgatctcctcatcgctactggatggagagcagttggctagttgttagcggnttccctagtttctcttcctcctgtgttccccgtttcagtttgcttatagccacnnngactcttttctcccgtagtgtcggaatgccaggtctgttgcgtaatggatccgaatgtaccct

SEQ ID NO: 324 - DNA, 283 bp, Zea mays
  misc_feature: Incyte ID No: 700548991H1
  unsure 70, 96, 98, 103, 120-121, 153-155, 158, 204, 267: a, t, c, g, or other
gtcgaccccaaagaggctctcaggaccagcaaacgtgaaatggcggtcgccacgcggggagttgagaganagattggttccctgcaaatggaaggngnaaaangctggttgcagagattnnagaagactgccaagactggaaatgaggctgcnnncancatattagctcggcaacttgtcaggctgaggcaacaaatcctccanttgcaaggcacacggcccagattctggagtagctatcacacacaggcaatgtatgctggcatncatctctgctggaatg

SEQ ID NO: 325 - DNA, 173 bp, Zea mays
  misc_feature: Incyte ID No: 700548993H1
  unsure 154, 163: a, t, c, g, or other
cttcatcaagttgtatttgccctttcatggacttcatcaagttatatacttagttaggctcaatgttagcacaaacagttgatgagcaagtttaaatttagagtacacttatgtatgagttatttgacaatgctatttatgagatattgaatgntatttatcnatattatatt

SEQ ID NO: 326 - DNA, 295 bp, Zea mays
  misc_feature: Incyte ID No: 700548996H1
  unsure 239: a, t, c, g, or other
ggagagatgacccagaggtcaagagcttaattgaggagattgagaaaatgagggaatcgttcgagtctatagaaaggccaacactaagcatagaatctgagaaagcaaaaccactacctgttgagggatcgaaactgagtccttcacctcttcaggctcctgctaccccaaaagctgcacacgttgactcaccaaaatctcccatgaaacctgagcagcatttcgattcagatgcgganttgcaaccctgggatcagagatcgggaaagaagacaaaggtactcagttgaggaga

SEQ ID NO: 327 - DNA, 297 bp, Zea mays
  misc_feature: Incyte ID No: 700549004H1
  unsure 127-128, 160, 228, 280: a, t, c, g, or other
agcacataaatgccctttctagcaatgtggagtatctggcgtcaagggatgcaacaatcatgggaagcaggaatggtcatgcccctatcttcctctggtacaccctcaacaggaagggctacagagnnttccagaaagaagtccaaaagtgcttgagaanaccgcactacctaaaagatcgcctcaaggaagcaggaatcggagcgatgcttaacgagctcagtagcncggtcgtgtttgaaaggccaaaggagaagaatttgtccgaagtggcagctgnttgtgaaggaatattgc

SEQ ID NO: 328 - DNA, 299 bp, Zea mays
  misc_feature: Incyte ID No: 700549007H1
  unsure 64, 157, 159, 161, 169, 251: a, t, c, g, or other
ccttcctcgggaagggcggctccggcaagactaccgcggccaccatcgccgctcagtattatgncaagtgaagtgcttcaagacatgcctggttgttcagtcccaagatcctactgcggagcacttgatgggcagtaaaattgggaattctctgacntncntgtgtggncaatctctcggccataaaggtggagactgttgctgcttgaacccctagaccgactgaagaaggtagacgcccagtcaattancctcaggaatccttgaagggttgtaggagaggagcttggagtttactg

SEQ ID NO: 329 - DNA, 297 bp, Zea mays
  misc_feature: Incyte ID No: 700549008H1
  unsure 59, 66, 76, 78, 83, 86, 116-117, 120-121, 131, 133, 143, 164, 177, 186,: a, t, c, g, or other
cgtcgtccgccgattcgatccggttcttccaacccaggggcagtgatggcgacgaagangagcgtnggcaccctcngngaggnggntctgaaggggaagaaggtgttcgtgcgcgnnganntcaacgtccngntcgatgatgnccagaagatcaccgacgacanccgcatacgcgcntccgtcccnaccatcaagttcatcctnnnccaaggcgncaaggtcatnctngtcagnnactgggncgtccaaaaggtgtcacccaaagtacagcttgaagnctctngttcagcttgttga

SEQ ID NO: 330 - DNA, 296 bp, Zea mays
  misc_feature: Incyte ID No: 700549010H1
  unsure 22, 64, 167: a, t, c, g, or other
atgtggcggcgcgtggtctggntattaatgatgtgcagcttatcattcagtgtgaacctccccnggatgttgaagcttacatacaccggtcaggtcggacagggagagcaggtaatactggtgttgctgtcatgctttatgagcccagatataagcacagtgtcagnagactagaaagggagtctggggttaaatttgagcatatctctgcgccacaacccactgatgtagcacaatctgctggcagtgaagctgcagatgcaattgcgagtgtgtcagacagtgttattctatct

SEQ ID NO: 331 - DNA, 97 bp, Zea mays
  misc_feature: Incyte ID No: 700549011H1
  unsure 13, 15, 19, 29, 42, 47, 51, 68, 76, 81, 85: a, t, c, g, or other
gggatctcgaagngntacnatctggtaanacgatcacacctnagcgnggangggagaactggaaatcnggaggganaccgnagangagaccgccgga

SEQ ID NO: 332 - DNA, 289 bp, Zea mays
  misc_feature: Incyte ID No: 700549012H1
  unsure 144, 172, 200-201, 210, 220-223, 226, 228-230, 232, 259: a, t, c, g, or other
ggtagtagccgcccacttgccttcattaagctttgctgaaatagtcgtgagcaattgagcatcacgcgggtttccactgattggttggacttgggggcggttcaggaggggtggaggtgggtgctcaaggcggccatcaggaanttcaaggcgcggcagcgcggtcccggangctcccctgctccagatgtcctccccanntgtgatgangtcaatcgannnncgngnnncnaaaatttgccttccctttcgcttccanttgttccatcacagttctattatgcatcgg

SEQ ID NO: 333 - DNA, 145 bp, Zea mays
  misc_feature: Incyte ID No: 700549013H1
catatcagtatagttgataaatactatgatcttgccactagcttctatgagtatggttggggtgaatccttcccactttgctcacagatggaatggagaatccttacgtgaaagcatcaagcgacatgagcattttcttgccccg

SEQ ID NO: 334 - DNA, 287 bp, Zea mays
  misc_feature: Incyte ID No: 700549016H1
  unsure 118, 164, 217, 259, 281-282: a, t, c, g, or other
cggatattcttggtggatataatgccggtggttatccctgaaattttgtgtcgagatttgatgatgataaggacaccagtgctttatatgaagaactttgggaggatattcctagtangtgaaagagtaaccctaacactatatttaccaggaattgtatctcntttatgtgatggcatgtcattgtcatcatgggctggtaaagaaagtcagccangctataaagaactatgtgatgttctaggagaaccccttcagnacactaccagattatctcaatnnttctg

SEQ ID NO: 335 - DNA, 294 bp, Zea mays
  misc_feature: Incyte ID No: 700549020H1
  unsure 182, 280: a, t, c, g, or other
gatgatcttttcttttcaagtttcatctccagctttcgaatggcagcctctgcttttcgaaagctggagatgaaacttgaaaagaaaagatcatcgtcaatggacagaattctaggcaaactccgctctgctcagaagaaagcacatgatttgcgaagtgtagtttcttatagtgaagatcnttgtggtgcgaggacaaccaagaagacatctttccttgtcaaaactggcaagccttcagctgctgtttacctaccgtgcttgctagttgtggcacaantggtgccatggatc

SEQ ID NO: 336 - DNA, 293 bp, Zea mays
  misc_feature: Incyte ID No: 700549022H1
  unsure 6-7, 17-18, 29, 34, 50, 52, 59, 61, 100-101, 109, 125, 129, 150, 163, 169,: a, t, c, g, or other
ggctgnntggaaacttnnttcttcaaggnttgtnaccggttgaaggcggnanttcggangngtttgctgtgaaagcagtgcttggggttgcagatttggnnaggaaggntgttaacttggatctnattnaagtagaaggcaaggttggtngggagctggaggncactgnaacttgtntntggattnttgttgacaaagatatgagccatccacagatgccaaagagattgaggatgctaagattgccatcttgncatgcccatttgagcctccgagccaagncangcntangt

SEQ ID NO: 337 - DNA, 171 bp, Zea mays
  misc_feature: Incyte ID No: 700549023H1
  unsure 40, 61, 123, 142-143: a, t, c, g, or other
aaaccctaatccgagcacccagtgtcccagcccctacccngcttcctctcgcgccggcctntggggctctcaccctgagcggtaggaatccgcagggctccagttgggtgccagaagcatccnagtcgttggcgggagaccnngaaatggcggaaaaagaggggctaagtt

SEQ ID NO: 338 - DNA, 294 bp, Zea mays
  misc_feature: Incyte ID No: 700549024H1
  unsure 208, 221, 254: a, t, c, g, or other
gggatctcgagggctacatctgtaaaacgaccacccctcacgcggaagggagactggaaatcgggagggagaccggagacgagaccgccggagatggagccgagatctgcaatctacagatccggcgccctccttctcctcgccgccatccttgcggaggtcgtcatccccgcatccgccatcggagacaagtgcgccgcctgcaagncgttgctgcggantagagattggaatttcgagtgagaagccgaganatcattggacttgcgcaaccgttaaatttaaaggccagag

SEQ ID NO: 339 - DNA, 118 bp, Zea mays
  misc_feature: Incyte ID No: 700549027H1
taccattcgcgccatggaagtaggtcgtgtttattgcctgtggtgggacccatgtccgtgccaacgccaattgccagccgcgtagccgttgatgaagaaaaagccattcgcttggccg

SEQ ID NO: 340 - DNA, 291 bp, Zea mays
  misc_feature: Incyte ID No: 700549028H1
  unsure 170, 173, 180: a, t, c, g, or other
ataacaagaagtgacaacagcttaattcgcgttgatcgtctagaataccacatcagggaagagcttaacaaaacagcccctcgaaccatggttgttttgcgccctctaaaggtggtaataactaacttggaagaaggaaaagtactagaccttgatgggaaaatgtggcnagngctctgntactgatgcttcctctcactataagcttccgttctcaagaactgtctacattgagaaaactgattttcgcttaaggactcaaagactactatgggctggccctggtaaatc

SEQ ID NO: 341 - DNA, 296 bp, Zea mays
  misc_feature: Incyte ID No: 700549030H1
  unsure 151, 216, 225, 230, 238, 252, 283: a, t, c, g, or other
aggacttggagcgtgcggcgtcggagttcgccggcggtgaggaccagaagaggaagggaaccaaacaaagatgggctgctccatctcggggctcaacgcgctctacgacgcggccaagggcggcggcgacgtctggatcaacgaacgccgnttccgcgtccttcgccagatcggcgagggcgggttcgcttcgtttactcgtcagagagcacagcncggcttcgncgcgncgttcgtnttgtgacccgccangtctagaggatgaagtatgcatgaagaagtnctatacagacaag

SEQ ID NO: 342 - DNA, 297 bp, Zea mays
  misc_feature: Incyte ID No: 700549031H1
  unsure 55, 132, 211, 282: a, t, c, g, or other
ttcattatgggcatcctgatatctttgatcgacttttccacctcacacgtggagntgtaagcaaagcttctaagattatcaatcttagtgaagacatatttgctggatttaattcaacactgcgtgaagganatgttacacatcatgaatacatgcaagttggcaagggcagagatgttggtctcaaccagatctcactatttgaagcaanaatagcaaatggtaatggtgaacagacgctgagccgtgacgtgtaccgtcttggacatcgtttgacttttnattttgtgtcctgct

SEQ ID NO: 343 - DNA, 142 bp, Zea mays
  misc_feature: Incyte ID No: 700549035H1
  unsure 30-31, 45, 59, 84, 88, 94, 105, 117, 122, 126, 130-132, 139, 141: a, t, c, g, or other
tggcatccgccagagagtttgttccgtccnngcaaccaaaaagcnttgccccgccgcgnagaggaagaagagagcagaggaggntggntcgtancgaagcagacngcccgaaattcnacggnaggnaagnnnccggaancng

SEQ ID NO: 344 - DNA, 295 bp, Zea mays
  misc_feature: Incyte ID No: 700549039H1
  unsure 9, 153, 201, 268: a, t, c, g, or other
tatctctcnccttgctcgcactcgcggagatcgaagagaagcgcaggaggccccagcactagcgccgccccgccgccgcatcagacatggcgctggccgctcgcctcgtctcgcgctcccgtcagctatattcggttcaagccactttggggnctggaggtgtcactcaagttcgctcctttgccaaggatgcagctccanctgaccgtcctcctgtcagtggggatgatctcctgaaggcatattctttgaggtaaagaagaagttnagacagctcttggtgtcttaaaaagga

SEQ ID NO: 345 - DNA, 293 bp, Zea mays
  misc_feature: Incyte ID No: 700549040H1
  unsure 163, 229, 265: a, t, c, g, or other
tgtgaactagactattacaatggttctggtgattcaaatttcctggatcttgactggctttcagcttcagacaatgaaaggtcaaaagccataagcactcctgatgtgaatatttcaactgatcatccgttatcccatagattacatcatgaacaccatcatnagttgaaatccaggctcagggattatctaaggattttgtgcagtgggttaatcaaggagagacatnttggtactgatattccaagatgggcgtaccatgtanattcaagccacataatggttgcattgca

SEQ ID NO: 346 - DNA, 108 bp, Zea mays
  misc_feature: Incyte ID No: 700549046H1
  unsure 9, 52, 60, 66, 81: a, t, c, g, or other
tcatcttgnagaaaagacagagtgagcgtgagattggcacagggtatagggntcttggtncgatcnaatatctttcccctnttggattctcctcttcgctgcttcgct

SEQ ID NO: 347 - DNA, 294 bp, Zea mays
  misc_feature: Incyte ID No: 700549047H1
  unsure 119, 239, 288: a, t, c, g, or other
gactcacaactcaattggtgagggacttgtaacactgaaaaatgctaaggaaagccatggtactgataagtgccttgagttccttctatgagtggagcctccacaaagctggatgtctnacaggatgtgtcaggttcatttccggaggctcgctcatcagtaaatgccagcgatcttggagaccatggtaatattagtccaaactttagtcatttagcaggaacatcacaagaggacanaaccagtaaactggtatcagaagtatttgcgaggtgggatgcacccacnttctcg

SEQ ID NO: 348 - DNA, 254 bp, Zea mays
  misc_feature: Incyte ID No: 700549049H1
  unsure 122, 158, 190, 192, 204, 237, 242, 244-245, 247-249, 251, 253: a, t, c, g, or other
agcgttctccaaatgtagagagtttcaggtgctcagcaacaaggataggatctgatggtggagtcgcattgtctgaggcattggggacatgcactcgtctgaagaaacttgatcttaggganaacttgtttggtgttgatgcagggttagctctcagngaaaatcttccaaaactacctgatcttgttgngnttatctcagtgntctcaatcttgagaacaagggtactatagcatngaaancnnannnangnc

SEQ ID NO: 349 - DNA, 285 bp, Zea mays
  misc_feature: Incyte ID No: 700549051H1
  unsure 4, 121-122, 152, 164, 233: a, t, c, g, or other
gacncggtctaccggagcgtacggtgccgatcccgtcgccgccgctacccctcaatcgcgagcaacttcttccggattcgcaccaagctctccacaattctatcgctatgctgcggaaggnngtcgtcgccttcatcgcctgcaccgccttnactccacgcctnctctgcctactcccgtcgccagggcgttgcagaggttcaattaccagcagttactcacagggtctactngagagatttgatggccaacacatagtagatgttatggctctatgggagtcgt

SEQ ID NO: 350 - DNA, 209 bp, Zea mays
  misc_feature: Incyte ID No: 700549052H1
agaatcagcgccctcataagcatgttgtgactgcttttctgtacatacgttagattgcagaactctttcactcttgtaaacttgagacctagcaagtggttaacgcaagcctctggggttgcgtacaaataatttgcgtgctgttggtggatgtttaaacctgctatgttttatggtgtgaatgctataaaaagacaacatgttcgttc

SEQ ID NO: 351 - DNA, 290 bp, Zea mays
  misc_feature: Incyte ID No: 700549054H1
  unsure 48, 180, 237: a, t, c, g, or other
cacagcgtgggtctcgcgacctccagcgaacgagatccctaagtttcnatccactgtcccagtggatttgggactgcgatggaggagcagttcatcctccgcgtgccgccatccgtcgcagagcggatcgagcgcctcatgaatgaatccgccgcctcaacctccaaccccgacgaggcntccctggacctctccttctcagaggatggaagaaatggcacatttatgatcggtaangagagctttcctgttctctcttggattacctgctgtggtggagtcatacaaaa

SEQ ID NO: 352 - DNA, 292 bp, Zea mays
  misc_feature: Incyte ID No: 700549056H1
  unsure 226: a, t, c, g, or other
ggagagagcagcgaccatggcctaggtgggtttgagatccgagggaacagatggattactagctagggagtgacaactaagagcaacctgtggagatgctatacaaatgtcacaggagttagcctagccagtgggttcaagtgtaggatgaggtatctggcatgatgttgtagcatgggcaaatcgagatgagtgagcaatcaggttgttgtctgttgattctttnagctgagctgctgaggccttgatcctgtatttaagatgtcaggccttgattctttcagcaagcgtt

SEQ ID NO: 353 - DNA, 291 bp, Zea mays
  misc_feature: Incyte ID No: 700549058H1
  unsure 162, 204: a, t, c, g, or other
ggattatgaaccacagacaggttgtcttaggtggatgaacgagttctcacagtatcacaacaaggttcttgtggagcagctcaagaagcttcgcaagcttcatcctggagcaaccatcatctatgctgattactatggagctgctatggaaattttcctttncgctgaacaatatgggatcgaatatcccctagtggcttgctntggtggagaaggaccctacggtgtgtccccatctacaggctgtggattcggagaatataagctgtgcgataatccagagagtatgga

SEQ ID NO: 354 - DNA, 283 bp, Zea mays
  misc_feature: Incyte ID No: 700549060H1
  unsure 114, 125, 130, 133-134, 136, 138, 141, 149, 198, 230, 242: a, t, c, g, or other
ggtagtagccgcccacttgccttcattaagctttgctgaaatagtcgtgagcaattgagcatcacgcgggtttccactgattggttggacttgggggcggttcaggaggggtgnaggtgggtccnaaagncgnntnanagnagttcaangcgcggcagggcggtcccggcaggctcccctgctccagatggtcctccncatgctgtgatgatcgatcgatcgatctcgcncgctcacacganttgtgcttgcttttgttccactgtccacaagtttatcattg

SEQ ID NO: 355 - DNA, 284 bp, Zea mays
  misc_feature: Incyte ID No: 700549066H1
  unsure 71, 125, 139, 149-150, 152, 229-230, 233-234, 239, 246-247, 255, 258, 261,: a, t, c, g, or other
aacatgtgattcaggggcgtattctcaagtgattcgccgttgtcagttgtatcctttagttagaatgttgnaaatgctatctgcttagtgcatattaggacataactacatagtgtaagcagtcnccatgggggtcatnccacgctatnnanatggctgcttgcctgtgagccatgcgacatatgtatcctgtcgcattaggatgagcgacaacgacacggtcgcaganncannttttncgtggcnnattcacgngcnaancttnnaaaagntgcnncngaggt

SEQ ID NO: 356 - DNA, 291 bp, Zea mays
  misc_feature: Incyte ID No: 700549067H1
  unsure 150, 279, 282, 290: a, t, c, g, or other
ggtagcgccctcgtccttgctgattggggctgcctgatttgcggagaacagagcctgacacgtcgcgttgttccatccgcatgagatctgtagcagtgccataatacttatctgatggtatctaaggcaaaattagtaaacatgttctangtacacctttacgtgtagccattagcaaaaatgtaaggggttcgctccgctctgatgctgtacatgcatttgaacatggtgcctggtgccggcagtgttgtgcctggcaggtcttcgatccgttcgttnctnaatcaatnc

SEQ ID NO: 357 - DNA, 291 bp, Zea mays
  misc_feature: Incyte ID No: 700549068H1
gtgctccttgcccacatgttacgacatgaggtgaacgttctgatactgtatgaacgcgaaacttgatgcagaagtgcaggggaagaaggtcaaggcaggacatctagccagcctcagagggtttggtgctctaacccgaacatttcaccgtacgttggccttcaggtgctgccaggcagaacatgagaagtgggaccaaggctagcggctgtggtcgccagagctcctcctgagttggtcagttttgtagcggcacggcatctgcgtccacttgtagtcatcatcagttgg

SEQ ID NO: 358 - DNA, 173 bp, Zea mays
  misc_feature: Incyte ID No: 700549070H1
  unsure 56, 72, 111, 159: a, t, c, g, or other
agcaagggaataactattccggtgtgaataaatatctcatgctgtcggtcgatggngcatggcagaactgcntacatgccccggaatctagaatcaacattttgtatagtntgcagctgcaaatgtgtatcttgtgattttggggggaggatgcttgtnacaagtaacgctca

SEQ ID NO: 359 - DNA, 290 bp, Zea mays
  misc_feature: Incyte ID No: 700549072H1
ggtagcgccctcgtccttgctgattggggctgcctgatttgcggagaacagagcctgacacgtcgcgttgttccatccgcatgagatctgtagcagtgccataatacttatctgatggtatctaaggcaaaattagtaaacatgttctatgtacaccactacgtgtagccattagcaaaaatgtaaggggttcgctccgctctgatgctgtacatgcatttgaacatggtgcctggtgccggcagtgtggcccctggcaggtcttcgatccgttcgttgctgaagtcgat

SEQ ID NO: 360 - DNA, 285 bp, Zea mays
  misc_feature: Incyte ID No: 700549076H1
  unsure 259: a, t, c, g, or other
gaaatggtatccaggactgtgtattgtactaacattgacaagaagatcgcagaagatgaagtgaagcaattctttgagggaacatgtggtgaagtttctcgtctgaggctacttggtgattatgtgcactccacatgcatcgcttttgttgagtttgtccaagcagatagtgctattctcgctctgaactgcagtggcattgttcttggaacgcttcctgttagggtgagcccatcaaagacaccagtccgctcgcgangcccgtgtgacgtcatactgaattcg

SEQ ID NO: 361 - DNA, 274 bp, Zea mays
  misc_feature: Incyte ID No: 700549077H1
  unsure 102, 108, 114, 120-121, 141, 144, 149, 152-153, 156, 158, 167-168, 173,: a, t, c, g, or other
ctccacgaaatccacgccctcctcgcagaggagtatgccctgatccgtggcgtccggggcgacatccaatttatcaccgacgagctagtcagcatgcagacnttcttnagaacntgagcnngtgcgacgggggccacaacnagncgganggnnggntngaagaaganntggangncncctaaanacntcanactncannngcggnttgcctacagcctccgtccngacccngggcagcgctaggtgacggtgtcncagatnttanagatcggag

SEQ ID NO: 362 - DNA, 239 bp, Zea mays
  misc_feature: Incyte ID No: 700549079H1
  unsure 6, 10, 17, 23, 27, 30-31, 70, 73, 94, 107, 111, 131, 136, 184, 217: a, t, c, g, or other
cgggcnaggnagaaacncagccncaanggnnttcacaaggtaatacatgagttcaacagggcacaatggnccncaaaagtccattcatacttgngacttgactggtnattnaggtgataacgatttggggnccggnacattcaccagtttggccagcttttagccttgcttctagcccatgganacttctgtgtccaggagcgtgcggtggactcanattggccctgtcggtcttgtaa

SEQ ID NO: 363 - DNA, 108 bp, Zea mays
  misc_feature: Incyte ID No: 700549082H1
  unsure 24: a, t, c, g, or other
caagaagctggtaatcaaggaganccccttcggtgacgccgctctcctcgcgggcgcgcacaggtacgagtcaatgcgcagtctctggatgtcgtcctgccagatcac

SEQ ID NO: 364 - DNA, 123 bp, Zea mays
  misc_feature: Incyte ID No: 700549083H1
  unsure 25, 55, 71, 75, 89, 91, 101, 106-109, 114-115, 117: a, t, c, g, or other
gacccggtctaccggagcgtacggngccgatcccgtcgccgccgctacccctcantcgcgagcaacttctnccgnattcgcaccaagcncnccacaattcnatcgnnnngctgnnanaagccg

SEQ ID NO: 365 - DNA, 284 bp, Zea mays
  misc_feature: Incyte ID No: 700549084H1
  unsure 45, 153, 278: a, t, c, g, or other
cttcctgcatgagctgctgtacggcaagaccccgttcaaggggtnagggaaccgtgccaccctgttcaacgtggtaggccagcaactgaaatttccagagtcgccgtccacaagctactcgagcagagacctcatccgtgggctcacggtcanggagccgcagagccgcctgggcgtgaagcggggagcgacagagataaagcagcatgccttcttcgagggtgtgaatgggctctcatccggtgcagcatctcccgaggtcccgaggcctgttgagntgactg

SEQ ID NO: 366 - DNA, 288 bp, Zea mays
  misc_feature: Incyte ID No: 700549085H1
ctgcagagtgggatccttcatgctgaagagaaggattacaagactgcttacagctacttcttcgaagcatttgaagctttcagttcactggaagatcccaaggctatcttcagcttgaagtacatgcttctgtgcaagataatggtcaaccaagctgatgatgttgcaggaatcatctcatcgaaggctggcctcaagtatctgggtcctgatgttgatgctatgaaagctgtggccgatgcctactccaaaaggtctctgaagtacttcgaaactgctctccgtgat

SEQ ID NO: 367 - DNA, 286 bp, Zea mays
  misc_feature: Incyte ID No: 700549087H1
  unsure 132: a, t, c, g, or other
aaaagttgaaatgagacctaatctgattctcaatgctgagaaagagcttgggattgttgctggacttcaggaccgagtggcacaggtttatggtggactagtttatatggattttagccagggtcatatggncaagctgggtcatggcatacacatgccattggatgtcaatctgcttcctcctctatacctcatctatgccgataaccccagtgactctggcaaggtccacagcactgttagacaaagatggctgtcaggtgatgatttataacatcacgtatga

SEQ ID NO: 368 - DNA, 282 bp, Zea mays
  misc_feature: Incyte ID No: 700549092H1
  unsure 27, 42, 77, 81, 86, 93, 103, 123, 130-131, 133, 137, 141-142, 144, 150,: a, t, c, g, or other
caagaagctggtaatcaaggagagccncttcggtgacgccgntctcctcgcgggcgcgcaacaggtacgagtacaangcgncagtntctgganatcgtcctgncagatacaccctgggagaanaaagccnntngggnacannanaaaaancannntngnagtcntccgtggggcgagctntnatgcgatggatggtagtgtcagcggtgcgaggaaagtaggcangnntanctctncgtatctggctggaactagatgcgatacgccaagattgtctgatat

SEQ ID NO: 369 - DNA, 283 bp, Zea mays
  misc_feature: Incyte ID No: 700549093H1
  unsure 73, 121, 139, 143, 156, 162, 248, 262, 268, 274-275: a, t, c, g, or other
ctgggcaccggaggtaaaatgacttaatccatatagccgatggcgcgtttaaccggagccagattcttgccgncgagaaggctattctgaacagcatggagtggaacctaacggtccccancccgtaaccatttccttntgcnggtcccaaggctnccgtantgctgatgaacagcttcagcatacgataaacttctttggagagctcgcgctgatggactacggtatggtgtgacaatcttcgaggnggtgttgccggttngctgcncgctcnngtgggggg

SEQ ID NO: 370 - DNA, 204 bp, Zea mays
  misc_feature: Incyte ID No: 700549094H1
  unsure 151, 158-159, 162-163, 168, 170-171, 175, 177, 194-195, 199, 203: a, t, c, g, or other
ggaaactggaaatagctcgaaactgtaatctagatcggatcaaagatgataggaagcaagaatcatgtttatatgatcttgatttgagaacaggggatgaccggatgagtgagctcggctaactgttgcttcatggctatcctgaatttgnccccccnntgnnactgntnnaaananaaagaaaaaaagggggnncccncctnt

SEQ ID NO: 371 - DNA, 284 bp, Zea mays
  misc_feature: Incyte ID No: 700549096H1
  unsure 144, 153, 159, 166, 172, 179, 183, 198, 203: a, t, c, g, or other
atacagagaaaaagaagaagacgaagagcatcatggttgatgatggccacgaggttggcaagaagggtagagtgaagggcaagcgtgctaccgaggagggaaagaagaggaagaagagcataaagggtgatcgtctgtagaggntcaaggggnagaatncgttgcnttgtcnagaagtnaggncccagggtatatgtnatatnggttccttgagatggccaccaatcattatctgcagaacttggtccctcagttttcttaagtttgttacttagtagctcaat

SEQ ID NO: 372 - DNA, 285 bp, Zea mays
  misc_feature: Incyte ID No: 700549101H1
acaggttggagtcagaaaagaacagatattctgattccgtgctagtctcatcggctttctattctgcagacggtccacaaactacctgccttacacctaacatgacacaagtgcagcaggactgcatatcaagctcctgggagatgcctcaaggtggacctctaggcgagatcttaacgaactccaagattagtgaggactcaagcaagtgtggatctaggtcatatggttggctattgaatcttgaccatgcaccatgattcctcaatccatggagagcttgac

SEQ ID NO: 373 - DNA, 280 bp, Zea mays
  misc_feature: Incyte ID No: 700549102H1
ctgaaaaggtactgttggatcaaaattttattgaagacatgcgtaccatgccaatctacattcaaggaaaaactaaaaacctcatggaacgcgctatttggaacgacacatctttcctaagtaacatgaatgtcatggattactccttgcttgttggagttgacaaagagaagaaagagcttgtatttggaattatagattatttgagacaatatacctgggacaaacagctggaatcttgggtgaagacatctcttgttgttccaaagaatctatcccc

SEQ ID NO: 374 - DNA, 275 bp, Zea mays
  misc_feature: Incyte ID No: 700549103H1
  unsure 247: a, t, c, g, or other
gatttcggcctggcgcgatggcaacctgatggagacatgggcgttgaaacaagagttatcggcacattcggctatctggctcctgaatatgcacagagtgggcaaataacagagaaggctgatgtatactctttcggggttgtgttagtggaacttgtcactgggcggaaggctgttgacattaaccgaccaaagggtcagcagttactaactgaatgggcacgcccattcttggaggagtatgcanttgacgagctcatagacccagactcggg

SEQ ID NO: 375 - DNA, 278 bp, Zea mays
  misc_feature: Incyte ID No: 700549104H1
  unsure 62: a, t, c, g, or other
accggttcgtcaagtggcccaaggtcgtgcgtatccagcggcagcgccgcatgcctcaagcngcgcctcaaggtaccaccggcgctcaaccagttcacccgcaccctcgacaagaacctcgctacgaacctgtttaagatgcttctcaagtaccggcctgaagacaaggctgccaagaaggagaggcttctgaagagggcccaagctgagaatgaaggaaaaactgttgagtcgaagaaaccaattgttgtgaagtatggccttaaccatgtgactta

SEQ ID NO: 376 - DNA, 274 bp, Zea mays
  misc_feature: Incyte ID No: 700549105H1
gaaacattcagtttctagcccagggaagaattcttttcgtgatcatgctgaagagtctaattatgattctattggtgtatctgggagaccatctttacaagcagatcatcaacaattatctcgtagacatgaaaagagaagtccacgaaaatttactgagacttctctgtcaaatggattccatgggcgtgagcatagacattccaataaccatccacctctgccaccaatgccacctccaatttcatccgtgtccatgcaaaatactgattca

SEQ ID NO: 377 - DNA, 270 bp, Zea mays
  misc_feature: Incyte ID No: 700549107H1
acaggttggagtcagaaaagaacagatattctgattccgtgctagtctcatcggctttctattctgcagacggtccacaaactacctgccttacacctaacatgacacaagtgcagcaggactgcatatcaagctcctgggagatgcctcaaggtggacctctaggcgagatcttaacgaactccaagattagtgaggactcaagcaagtgtggatctaggtcatatggttggctattgaatcttgaccatgcaccatgattcctcaatc

SEQ ID NO: 378 - DNA, 271 bp, Zea mays
  misc_feature: Incyte ID No: 700549109H1
  unsure 17, 103-138, 142, 152, 166, 172, 189, 214, 226, 253, 268: a, t, c, g, or other
agcaaacagtcgcgcancttccaccgctccacgtgacctcccaaacctagacctagttgtccttcctgttcaccctgcatagcggcggcgcgtcctgccttcnnnnnnnnnnnnnnnnnnnnnnnnnnnnnnnnnnnnctanatctccgtangcatggcgtgggangaggangcggtagaagaggaggnatacggggaggagatggcggcttcngagtcggaggangacgtcgtggtggggcagatgccgacngtgatggtgccaaancat

SEQ ID NO: 379 - DNA, 269 bp, Zea mays
  misc_feature: Incyte ID No: 700549111H1
  unsure 5: a, t, c, g, or other
atcgngagcgggatgggaaccggtgttactttaatatcagcgaaatgggtttttctgcgtacctttgttatatggctatgtatctcatttttgtggagtttggaatttactggatgcacagagagttgcatgacataaagccactatacaaacatctgcatgcgacccaccatatttacaacaaggagaacaccttgtctccgtttgctggactcgcgtttcaccccactggatggtattctgcaagcgataccgcatgtgcttgcgct

SEQ ID NO: 380 - DNA, 270 bp, Zea mays
  misc_feature: Incyte ID No: 700549112H1
  unsure 34: a, t, c, g, or other
attctgggatccgctatgtgcaatgtatggaggntaaagggagtctagacctagcaaacaatgccctgggctcgtgctactcatgtgtttgtcaagaagcagccggagatccatctgtttagtgctcgctttaaggagcttaatggggatatttctggagcacgtgcagagtatcagcatctttactcagatttatgtcctggctttctagaggccatcgtgaagcattctaatatggaacaccgactgggagataaagaattatcttgt

SEQ ID NO: 381 - DNA, 91 bp, Zea mays
  misc_feature: Incyte ID No: 700549113H1
  unsure 10, 17, 32, 45, 47, 51, 79: a, t, c, g, or other
cgtttcagantgcagantctgtggacaacatnatgcaagagtcanangaancttgtatggtacaacattagttgcagancgtgcgattcct

SEQ ID NO: 382 - DNA, 128 bp, Zea mays
  misc_feature: Incyte ID No: 700549115H1
  unsure 23, 27, 35, 43-44, 48, 79, 95, 127: a, t, c, g, or other
ctacacaaatgatgatgagttcntcgnttgtgtanccctctgnnatanttgaatcctcatggatgtccatcaggttgangtgcagataagtgtgntattagcttgcttgtagaaaccttatgcgagnt

SEQ ID NO: 383 - DNA, 271 bp, Zea mays
  misc_feature: Incyte ID No: 700549116H1
  unsure 2, 241-242, 245: a, t, c, g, or other
anggatgatgaagtcattctttggcgaagtaatagatgacacagaaggttctgaaccaactctaccagtctccaacaaagacgcaaacgaagagtctggtcacaccgtcttggcaaatggtaccattgacaaacaagaagatgatatcagggcactgatccggatgtaaaaggagtcaacccgagtttgtggatggaaggaggaagaagctgaactggtgatgttgctgagaagatactgnnggnccctggtatgagttgaagtgagaagc

SEQ ID NO: 384 - DNA, 275 bp, Zea mays
  misc_feature: Incyte ID No: 700549118H1
cctcccaccgcctcgaggatatcgacgcgtgctccgccgagtgcgaggtccacatcgcgcaggagtggctcgacaagctgccgccaccgtcctacgaggagcggtacgtgctcacgcgcgcgtccaggaaccgcgagctcaacaagcacgcgcgcctgggctgccaggtcgtcctcacgccggagctgcatggcatggtcgtcgctgtccccgagcctaagccgtgggacatcccgtaatggcctgccgcgacgaatggcaaggtgcgctttcga

SEQ ID NO: 385 - DNA, 265 bp, Zea mays
  misc_feature: Incyte ID No: 700549120H1
  unsure 3, 7, 39, 240: a, t, c, g, or other
atntccncattcgttccaactcctgagcactttctcctncgtccccgacaagacaatcgaagccgagatacggccatggactccaccggcaccggagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgcgcantgttcggcaccggcgcccccgtcta

SEQ ID NO: 386 - DNA, 269 bp, Zea mays
  misc_feature: Incyte ID No: 700549121H1
ctagagcatttttcagtatgcagcaataattcgacatggtcccattcggttcgtgtcggggccctctcgtatatcgtatcagcagcgtggcctgtgtaattggatatacgtcatctgtacgagcgccatggcccttgaggagctggtgctttgtgttgttattagtcgtccgttgcagattttaaagacatcgggttcaggttgggcgcccctggccctgtttggtcggaaaacaggcgctctttcaaaatgagttatttctttgtacc

SEQ ID NO: 387 - DNA, 269 bp, Zea mays
  misc_feature: Incyte ID No: 700549122H1
  unsure 70-71, 246-247, 263: a, t, c, g, or other
gactagttctagatcaccagcctacgagcctggaggaggtccgcactctgtggatcggcgacctccagtnntggaccgacgagaactacctctacagctgcttcgctcacaccggggaggtacaatctgttaaaataatacgcaacaaagtaacaagccttcctgagggttatgggtttatagagtttgtttcacatgaagctgctgagaaaattctccagacttacaatggcacacagatgcctnncgctgaacacacatcnggcttg

SEQ ID NO: 388 - DNA, 268 bp, Zea mays
  misc_feature: Incyte ID No: 700549124H1
ccatctcccaacccctacactcccggcggcggcgcaggagcagcagcacccgaggatggtgaagttcctcaagcccggcaaggccgtgatcctcctgcagggccggttcgccggcaggaaggcggtgatcgtgcgcgtgttcgaggagggcacccgcgaccgcccctacggccactgcctcgtcgccggcctcgccaagtaccccaagaaggtggtccgcaggactcggccaagaagacggcgaagaagtcgcgcgtcaagtgcttca

SEQ ID NO: 389 - DNA, 264 bp, Zea mays
  misc_feature: Incyte ID No: 700549125H1
ccaactcagtttggttggaggtttctgaagtgaaaggagatgatgtggtgtgtataatcaagaacacagccaccttggctgggtcactgttcacgctgcattgctcccagattcacattgacttgcccaccctgtctgatgaggataaggatgtcattagaaaatggggtactcccaataagattgacttccttctctgtcctacacaagacatgcagaggatgtgcgccaggcagggaattcctgtcaaaattgggcgatcta

SEQ ID NO: 390 - DNA, 279 bp, Zea mays
  misc_feature: Incyte ID No: 700549126H1
  unsure 17, 28, 36, 38, 48, 52, 55, 60, 64, 88, 97, 99, 108, 122, 164: a, t, c, g, or other
ggctagttctagatcgnaaaaattctcnttccttcnantttcttcttnaacnaanttcanggtnacagcggcgaaccttctcgggtantcatgtctngnccggggaanggcgggaaaggtcntgggcaagggcggggcaaagggcaaccgccaagttgcttgcngcgacaaacatcccagggcatcaccaagccggcgattcgcaaggttggcgaaggaaggggcggcgtcaagcgcatctccgggttcatctacgaggagacccgcggcgtgtcaaga

SEQ ID NO: 391 - DNA, 268 bp, Zea mays
  misc_feature: Incyte ID No: 700549128H1
  unsure 2, 14-15, 21, 239: a, t, c, g, or other
ancaggatgaagannagaagntactagtgacgttgacacaagctctagattcccaagccaaggagttaaaatccttgaccgattcaatcggtcataccagggaacccataaatattaccagggatgataggttttctcagtaccgcccactggaagaccatgcccctactgttataaggaatggggcaattaacagttcatggagagcctctcagcaaactaacatgtatggtgtgtcnaatggcgactttggttccgcagtgaggtc

SEQ ID NO: 392 - DNA, 271 bp, Zea mays
  misc_feature: Incyte ID No: 700549129H1
  unsure 16, 164-165, 206, 248: a, t, c, g, or other
ggtataggctgtccangggaattttagtgggctgttgccagtgggatggggataagcatgtggttatcatcgacaaaataattccccaggcttggaagggtagataccttttcctaatcttctatgttgattcatcaatcccttctacatgcatcacatcatcnnactatttatatgttcagcagtctggttcaaacatgtacttntattacaccactgtttttcacactacactgtacttgtgaacnatcactctgatgcataccagaag

SEQ ID NO: 393 - DNA, 271 bp, Zea mays
  misc_feature: Incyte ID No: 700549131H1
gaaagattggagaaagggtgcacagtggtttacagtgaaacggcagcatgcagttcttattcttgctgacaccctttactatgggaagttcaagcgttactgtaagccaggaaatgagtggcataactgctattcagatgagcactacttgccaactctcttcaatatggctgacccgactggaattgcaaactggtcagtgacgcacgtagattggtccgaagggaaatggcatcccaaagtctacagggctgtggatacgagcttcgag

SEQ ID NO: 394 - DNA, 278 bp, Zea mays
  misc_feature: Incyte ID No: 700549133H1
  unsure 131: a, t, c, g, or other
ccccaaaaggacctcccaagacctggcatctccagcgaatgcgatgccgggaaccaccggtcgtgcgtcctctctcctcgtgcgcttcgcccgtctccacagttggtgcagcttgcgacgcaacttggatnctctcctctcgttgcaacaaggcagtccagtgaatgagacggatggccccagctgtgcctgtagctgatgcatgatggagctgagcctgtgggtgggaatctcttctctgctggtggccatcgcctagctccaaaaacacacacaca

SEQ ID NO: 395 - DNA, 190 bp, Zea mays
  misc_feature: Incyte ID No: 700549136H1
atctgattgagtagaaaggatcatgagtcttgaacttgagcaggagttgtgccttgcgtgttttaagttgttctagggtgaactcttgagttctcattgtctggatcatctttttctccttggatgtgttgcatcttttgagtgtggaaatggatggtactcctcgccatgaatttgctggctactttat

SEQ ID NO: 396 - DNA, 268 bp, Zea mays
  misc_feature: Incyte ID No: 700549137H1
  unsure 263-264: a, t, c, g, or other
tggtgctgcccctacgacggcgaggagcaggagcaggagctgtggctgtgcttcgcacggcacacggggtacgggggatacggtgactggcccagaggagcgaggatccttgaggtcacggaggagccattctcggccgtgtcatggatacggatggagaacgggaccaggcacagcgacgttacactgacctcctgaatccatctgcctgactgattctcttgtataatgtacagtatagaggatatttctttatatatatnnacta

SEQ ID NO: 397 - DNA, 266 bp, Zea mays
  misc_feature: Incyte ID No: 700549139H1
gtgtattatgcttattttttataattttatataaatttaggcttttgattttgggcaacaaagatcatgcgttattttaatttaagttttattagcaattccacggggaaaagttgcatcctaattcctaaggatcttcttaaccgagcatcaaactaaaaggtctgctacagacaataaagtaatccactttgtttaagattttcaagaacaaaacttagtaacaactaaaacctcctcgttgccaaatcctgaaatcaagaggc

SEQ ID NO: 398 - DNA, 265 bp, Zea mays
  misc_feature: Incyte ID No: 700549141H1
gacataacacaccgctttcttccccagttcaagtgccacaccgctcgtcgccttcccatctcgccgcgacatgaatttctgccgccacctgctcctcgccgcggtgttcgcgctcctcctcgctgtctgcgcttctgcggcgagcaggggcgctggttccttcgacccatcccgagtggtccaactctcgtggcgccccagggcgttcctgcacaagggtttcctgtcggatgcggagtgcgaccactcatcgcgctggccaagg

SEQ ID NO: 399 - DNA, 264 bp, Zea mays
  misc_feature: Incyte ID No: 700549142H1
  unsure 2, 93, 102, 213, 222, 224-225, 227-229, 234, 243, 245, 248, 251, 253-254,: a, t, c, g, or other
gnaaaaatgtttttcatatttctcccttttcccagatgattataaatttgataagtctgagattattcgtttatgggattcaataggaatcancggttctantcatacagcaaaagaaaatagaggacataggatcggattattttgatgaactattagatagtggttttcttataaaagggagcaatgatttttatgtaatgcatgatttantcaaaaaanannannnaaaanaaaaggggngnccnccncnnagnnaccccc

SEQ ID NO: 400 - DNA, 262 bp, Zea mays
  misc_feature: Incyte ID No: 700549143H1
catgcggtcattacctccttggcaatccccattcttaggccatcaaaagtttgacacatcaccctccaaatactctatctcgtcaacaaaggtaactacaaaggaggactacctttccagcttttggacaaaattggaggaatcacgaatagctcgcattggatcatctggagattctgctgttgcttctaaattatggaattatggttccaattccagattatttgagaatgacacttccatattctcattgggcacgatg

SEQ ID NO: 401 - DNA, 264 bp, Zea mays
  misc_feature: Incyte ID No: 700549145H1
cagcaacattttcaagaccaggattgaaggtgcaaacatcgctgatacagggcttacagataaggatgacttaattgtcattccttcagatgaatctctagatctctctcgatcagattatcttgataatgaactttccagcttggcaaactggttggagggatcttatcagaagtctaccggcaaactagtcattcccttggagaatggaaacagtcttactttgcaacttgataaggaagcagacaaggaattcatgtccag

SEQ ID NO: 402 - DNA, 271 bp, Zea mays
  misc_feature: Incyte ID No: 700549150H1
  unsure 27, 48, 123: a, t, c, g, or other
ccgcgggactcaccaccatcagtagangacattgaaggcgagtattgngcgtatagtcgaaaagcctactgaagagatagaggtagtatatggtgctgatttggagactggaacttttggtancggtttcccaaagtcttctcccgaagtaaaatctgatgttgagcataagtacttagagtctggttggaacctaaacaacttgcctagactacaaggttcagtagtatcttttgagggcggtgacatctctggtgttttggtccttggc

SEQ ID NO: 403 - DNA, 267 bp, Zea mays
  misc_feature: Incyte ID No: 700549153H1
cacatgaagggtttgcattcatctacatggaagacgaacgtgacgctgaagatgctatcagtagacttgatggaattgattttggcagaaaaggaaggagaatcaaagttgagtggaccaaggaggatcgcactgctgatcgaagaggcaactcaaggaggtctccaaccaatgcaaaaccgaccaaaaccttgttcgtgatcaactttgacccgatcaacacgagaattcgagatctggagaggcactttgataaatatggcaggg

SEQ ID NO: 404 - DNA, 261 bp, Zea mays
  misc_feature: Incyte ID No: 700549158H1
  unsure 14, 23, 45, 51-52, 57, 64, 107, 243, 254: a, t, c, g, or other
taattgacccggcngtggtttcntaagaatgggaaatgtgtaccntgtganntttcnccttggnaatgcacagaagtggacttatataaattgcagcatgacttgtntaatctgaaaggcaaataattttgcatggataaccacacattttatcagtatttaattcagaagattgtaatgccgactggactttggactgtcttcacatatcattttgtgagcaaaatctgatgtatgctttcnaatgttttatntgtgtct

SEQ ID NO: 405 - DNA, 91 bp, Zea mays
  misc_feature: Incyte ID No: 700549161H1
  unsure 25, 28, 31, 43, 47, 66, 72: a, t, c, g, or other
gttctaaaacgcgaacggctagccnttnttnccagtggatggnatangcatgtggttatcatcganaaaatnattccccaggcttggaagg

SEQ ID NO: 406 - DNA, 265 bp, Zea mays
  misc_feature: Incyte ID No: 700549162H1
  unsure 26, 41, 51, 56, 62, 73, 75, 78, 82, 100, 102, 112, 148, 209, 229, 245, 250: a, t, c, g, or other
agggaaggggaagtgaacggagggancggaagaagatctcngagctctcanagctncatccngaacccattcncntangaangggcaaaagaatcggagntnatccggcagncgctctctctcggattgaatacgatttgacgcattngcggccgaactttcttgcacccaagatgagtgggcatggtgacactgcgacctcaggtatncgtaaatggctttctgtgancactcggagtggcgtngcacnaattcctggtgctcg

SEQ ID NO: 407 - DNA, 267 bp, Zea mays
  misc_feature: Incyte ID No: 700549163H1
  unsure 21, 29, 35, 64, 162-185: a, t, c, g, or other
gcacccaacacccggagtgancggcggcnaaggancggatcgtcggcgggcgatggaagacgangtgcagagggcagcggtgagcattggaacgaagcttgactatgaggcggaacgcgtttggtggcggaggcgaaggcgtcgtgggataggaaggcaagnnnnnnnnnnnnnnnnnnnnnnnnacatgatcctgagatgaccttggactactacgcctaccaggctaaaaagtttcgcaacacctggaacatcctctatttcggc

SEQ ID NO: 408 - DNA, 273 bp, Zea mays
  misc_feature: Incyte ID No: 700549165H1
catcgttagcctgcctttcgctgattttcagaaggtgaaggtttcatggaagaacactctcacaaatgggattgttaaggtatcatgcactagcgttggtcggatgccactcctgaaaaggcatgatcggactttcaggttggcggatcctgctcctgagcattgcccacccggagagtttgtccgggagatcccactccctacccgaatccctgaagacgccactctggaagcgtactgcgatgaaacagggacagggctggagatcattgt

SEQ ID NO: 409 - DNA, 270 bp, Zea mays
  misc_feature: Incyte ID No: 700549167H1
  unsure 63: a, t, c, g, or other
ctcaagcgtcaatattaattcctggtggttatgataaggatgttggtgcttccctctactacnatcgactaacattgcaaaccttgcacaagattgaccaaaggtgcttttgggtacggatcatacttctgtttgtctctgatggacaagttgtaccacccggacatgactgttgaggaagcagtagatcttgttgacaagtgcatcaaggagattcggctgcgattggttgtcgcgcctcagaactttgttatcaagattgtcgacaag

SEQ ID NO: 410 - DNA, 254 bp, Zea mays
  misc_feature: Incyte ID No: 700549169H1
gaactgtgcgcagtggtttcctcgaatttaggacccccccaactgcattctgtattgagaacattcctgctaaatacatgatacttgcaggtattgtgttgtgtttgcaacgtgatagcttgtactgggaacaaaggtcaagatgggcgccttggacctacacctgactttgcttctgctcaacatggacaagccaagttaaaggaatatgccaagagctctctgttgtctgatggaaactacaatacagacaa

SEQ ID NO: 411 - DNA, 262 bp, Zea mays
  misc_feature: Incyte ID No: 700549173H1
  unsure 66: a, t, c, g, or other
gctaagggctacctctgttgaaggagatgacaagtctgaagaaagctctgttcatacacacgaggnaaatgacaactcaagctccgagattcttttcaatccgaatgtgtttacagagaaatcgctgctgacgaagagttggtaaaaagggctggtacatatctgtagatatagtgatcccaaagtttgttcaggatctttgttcccttgatatctcccctatggatggacagactttaacagatgcattgcatctccatgg

SEQ ID NO: 412 - DNA, 257 bp, Zea mays
  misc_feature: Incyte ID No: 700549175H1
  unsure 240-243: a, t, c, g, or other
gactagaaccacctgggattcagtttccagatcgtaaatacaaatcttgatgaagttagccctcgtgctcgacgaagaagtgcttacttacatggcaacatatagcatcgctgccacccaatttgcctgttatctattgtggaggctcaatacacagaaggaatctatgactgggcggtttttgctggcagatccagagaacatggtgttgttggtgatatgagagatgcttggccaaannnntcgagtgcgaaaaa

SEQ ID NO: 413 - DNA, 261 bp, Zea mays
  misc_feature: Incyte ID No: 700549177H1
tcatatctatagaggtcaacctcgaaggcatcttctgacaactggatggagttcatttatcaataagaagaaactagtctcaggggatgcagtcttgtttcttagaggtaatgatggtgagctaagattgggtgtgaggagagcagttcaactgaaaaatgaagctctacttgaagctgtcaactgtactgattcgaagctacttatgctgtctgctgtcgccaattctttggacaacagaagtatatttcacatctgttt

SEQ ID NO: 414 - DNA, 263 bp, Zea mays
  misc_feature: Incyte ID No: 700549178H1
tcagcccgcccgccaagagagccggctcggtcggttcgtcgaagatcccggatctgctctgtcacgaggtctttcggcgggtgttgtctcgcgaggtgtagcgagccaagttcaggagagtttcgagaagctgaaatggctcctaaagctgctcctgccaagaagggtgatgccaagacccaggccttgaaggttgccaaggctgtgaagtctgggtcagtaaagaagaccaagaagatccgcagtccgtgacatttcaccgc

SEQ ID NO: 415 - DNA, 267 bp, Zea mays
  misc_feature: Incyte ID No: 700549179H1
  unsure 117-118: a, t, c, g, or other
gtgtactacgcccccggggcggtgctgaggggggaggagttcaacggcgcggaggctgtgcacaggctggagcagtggctgatcgagaaccacagctaccagccgcagtacgcggtnngcggagctgaacgagaaggacttctggcgcatgttcgacgcgtcgcactacgagcactgccgccaaaagtacggggcggtgggcacgttcatgagcgtgtactacaagtccaagaaggggcgcaagacggagaaggaggtgcaggaggc

SEQ ID NO: 416 - DNA, 246 bp, Zea mays
  misc_feature: Incyte ID No: 700549181H1
  unsure 17, 194-195, 223, 229-232, 238, 240, 242-245: a, t, c, g, or other
ggatgtaatgtgtccancctgtacaagtgtgtaacggaaacggtgtaagtatagtaggaaaacaatgtgttagctgtgcggtagcacttgtgtgctagcctaaattgtaatcttgcaagtcggtgcatagctgattgcgcaccaatacgtagttatgaatggaatcgcactcgtgttcgtataaaataaaatannttagcagcgccaaatgtttaaaaaaaanaaaaannnnaaaaanangnnnnt

SEQ ID NO: 417 - DNA, 269 bp, Zea mays
  misc_feature: Incyte ID No: 700549182H1
  unsure 245: a, t, c, g, or other
agaacacaggggcacacgcactacacgcacgggcacgcagatacatatagagagaggttagctatagcttgcacatctatttaactaactaactaactggctagctagctcgatccgcagagcaaagcgaaagcagcaagaagcaaagcaatggagaaccctgcgagtgtgctagttctaccagcgcagttcaccaaactcaccttcggaaacctgtacatccgccgggccgggccgggcagcanggagataaccgaggaaggcagtgt

SEQ ID NO: 418 - DNA, 100 bp, Zea mays
  misc_feature: Incyte ID No: 700549183H1
  unsure 3, 11, 24, 26, 33, 45, 86, 90, 97: a, t, c, g, or other
ctngcggtaantaactgtgttccncncgttaancctaatgcatcnactcagggcagtgaaatgaatctgtgggagcggaacgaganactncctcggngat

SEQ ID NO: 419 - DNA, 222 bp, Zea mays
  misc_feature: Incyte ID No: 700549184H1
actgcagcctccctacctgaatatgctataacatcattgtatgattcaagccccttatctgagcataagagtagagggaactatgctgcattccgtgtatggtcaccttattgtagctattgttgcgacgggccttgtgattttgagtcttgttttaacttttgcagtcttatcggctgtggattcaaaatgaacgaactgaatattcaaaacatgtttgcc

SEQ ID NO: 420 - DNA, 261 bp, Zea mays
  misc_feature: Incyte ID No: 700549185H1
  unsure 214: a, t, c, g, or other
cagtgcatcactaccaaaacggatcctaaaatggactggaacctgtataagaatttcgaagatggcagatgaacttctgtggcgtatccaggtatgaagatgcagtcaggattctaaagacactacttagcacagttgcttgtgatagacggcgaggatattgggcattgaggctatccattgatttggagcatatgggtcgttcaaatgagancctatccacagctgaaggaggggcaattgatccatgggtccatgctg

SEQ ID NO: 421 - DNA, 261 bp, Zea mays
  misc_feature: Incyte ID No: 700549186H1
  unsure 52, 61-62, 90: a, t, c, g, or other
gatactcttctcaatggcagacctgcagcgatcaataccttcaatggttganggccttaannccaggccagaggaaaattctgttttgcncattcaagaggaattttgttaaggaagctaaggtggctcagttctctggttatgtgtcagaacactcagcataccatcatggtgagcagagtttagcaggtacaattattggaatggctcagaactttgttggcagcaataacatcaaccttatgtaccctagtggtcagt

SEQ ID NO: 422 - DNA, 106 bp, Zea mays
  misc_feature: Incyte ID No: 700549190H1
  unsure 59: a, t, c, g, or other
ccgtggtgatgtggtccccaaggatgtgatgctgtgtggccaccatcaagacccagcgnaacatccagtttgtggatggtgcccaatggtttaagtgcggcattaa

SEQ ID NO: 423 - DNA, 255 bp, Zea mays
  misc_feature: Incyte ID No: 700549191H1
  unsure 35, 108, 112, 180: a, t, c, g, or other
ggtgctcttaacgtggatgtgaatgagttccagancaacttggtggcctaaccgagggatccaatttcatgtttcctcctatgctccagtcatctctgctgagaaggnctancacgagcagctgtctgtgggcgagatcaacaacagcggcttcgaagcatcctccatgatgggcaagtncgaatcccgcatggtaagtacatggcctgctgctcatgtaccgtggtgatgtggtccccaagatgtgaatgttgt

SEQ ID NO: 424 - DNA, 255 bp, Zea mays
  misc_feature: Incyte ID No: 700549192H1
  unsure 121, 135, 141, 144, 151, 179, 226: a, t, c, g, or other
cgtttcagagtgcagagtctgtgggacaacatcatgcaagagtcacatgagttgatggtacaacagtagttgttgatcgtgcgactcctaaggatgaagatgtcagataccccccgagtanggcatctcagggtngctatngtncatatancgctacatttcagctgctaccaggtatngcactctgggtgcaccaacgctgtatgaccatctggatcagcttatngcagagggtattatggacctctcaagcag

SEQ ID NO: 425 - DNA, 263 bp, Zea mays
  misc_feature: Incyte ID No: 700549194H1
  unsure 117, 197: a, t, c, g, or other
catatcagtatagttgataaaatactatgatcttgcccactagcttctatgagtatggttggggtgaatccttccactttgctcacagatggaatggagaatccttacgtgaaagcntcaagcgacatgagcattttcttgccctgcaacttggtttgaaaccaggaatgaaggtttagatgtgggctgtggaatangtggaccactgagagaaattgcaagatttagctcaacttcagttaccggattgaataacaacgaat

SEQ ID NO: 426 - DNA, 258 bp, Zea mays
  misc_feature: Incyte ID No: 700549195H1
  unsure 6, 24, 45, 59, 73, 82-83, 91, 131, 136, 154, 197, 204, 209, 229-230: a, t, c, g, or other
tcttangaataaggaatgtttagngctgacagttttcctgagtcnccatgtctaatgcngatggacttaccgngaaaatgtnntgaacttnagctgaaagtgctaaatttaggtctccaacctgtgagctngaagnaaagttccgaaaatgccnagagggagctggaaccaagaaatcctgagttatctggctgagnagaaagntaatngttacatctaatgaactggnngttgtgaatctggtgcgacctgggagta

SEQ ID NO: 427 - DNA, 282 bp, Zea mays
  misc_feature: Incyte ID No: 700549205H1
  unsure 87, 96, 154, 156, 164, 172, 200: a, t, c, g, or other
aggacaccgtggggcagtacagtcccacatcgcgtttcactcttcctgggggtctaaccgtgtcgtccatgggatcgatgttttcgnttcccaagnttcaacattgtctccccctggagcagacatgagtgtttactacccgtatacggaaacngncaagagantcactgcntccatcctgaaatcgagggctcatctanagcgagtcgagaactccgagcacaagttcgtgctgaaggacaagaagaagccgatcatcttctcgtggcgcgtctcgaccgc

SEQ ID NO: 428 - DNA, 273 bp, Zea mays
  misc_feature: Incyte ID No: 700549210H1
  unsure 79: a, t, c, g, or other
cccccagtgatgcaactgtctgcaccagacagaggaagacggagacctagcatggacagtcgtctgaaatttgaccgtngcagtaacaaagaacatgataaagctgagagagatggaggcagatatggtagagacgatcatctccaagccgtgatgggcctgatgatcagatgtttgatggtttccgtggacggccctctaatgctcctttgttgctgaatcccccctccatcgatattgatgccatactggtgctggccctggggccattgt

SEQ ID NO: 429 - DNA, 279 bp, Zea mays
  misc_feature: Incyte ID No: 700549211H1
ggctctacaagggaattgttcctctctggggtcgtcagattccttataccatgatgaagtttgcttcctttgagaccatcgttgagcttatctacaagcatgctgtgcctgttccgaagtctgagtgcagcaagactacccagttgggtattagctttgctggtggttacatgccggtgtcttctgtgctattgtttctcacccggctgacaaccttgtgtctttcctgaacaatgccaagggagctacagtgggagatgctgtaagaagcttggtctc

SEQ ID NO: 430 - DNA, 278 bp, Zea mays
  misc_feature: Incyte ID No: 700549213H1
  unsure 116: a, t, c, g, or other
caaggagtctgacatgcgtgcgatcgacgggttcagaaacctggagatgcgcaaggaagctgacgagcgggaggccctcacgggccgcaccgctggccgaccctgatcttctgtgnagggttcgagttggagcacgcctgtcgggacccgaaagatggtgaactatgcctgagcggggcgaacagaggaaactctggtggaggctcgaagcgatactgacgtgcaaatcgttcgtctgacttgggtatagggcgaaagactatcgaaccatctatagc

SEQ ID NO: 431 - DNA, 285 bp, Zea mays
  misc_feature: Incyte ID No: 700549214H1
  unsure 55, 65: a, t, c, g, or other
aacatttcaaccatctgcccctgctcagagttcgaacatgttctcctttccaacncccaattcanccagcagcttctaccggtggactcccttttttccccaacacaaatcaggccttgacgggacagccaacttctagcctgtccagtatggtcatgcagcctgctcttgtttcaaatccatttgggatgcttccagcaatgcctcagatgtccatcgggaatggtggatcttcaccttcagttcaatatggaatatcaagtttgccggtgcggagaagctctt

SEQ ID NO: 432 - DNA, 280 bp, Zea mays
  misc_feature: Incyte ID No: 700549217H1
  unsure 12, 279: a, t, c, g, or other
ctgcatgctganggctgtgtcgagtgagatcaagattgacgagacagagattccagggcagcgaaggtgcgtctccatcttattttcaaggggatttcatcacgttttttcttttaaacgagcctgcaaaactagtactggagaaaaaaaacatttcaggctcatttcacgatattcagataatgaatgaagttcgggacagtgatcgatcgataagctgcgctaacccacgagagagacgtttatttcatggatggcgctggagagttcgtgaagcanc

SEQ ID NO: 433 - DNA, 93 bp, Zea mays
  misc_feature: Incyte ID No: 700549218H1
  unsure 25: a, t, c, g, or other
ctgaaaaatatccgtcctccgttgnacaaaccatatggttgtttcattccgggaaagatatcaaggccatttggagagaaccagattcagatg

SEQ ID NO: 434 - DNA, 278 bp, Zea mays
  misc_feature: Incyte ID No: 700549219H1
gaaaaggacaatgtccagttgcttttgttcacttcgccaaaacgttcagagcttgagaatgctatagaagaaatggatggtaaaacggtgagaggacctggtcgagggccgtctttcaagatccaggtgtcagttgctcgacctacggcagacaacgacaagaagcgatctcgtgaagaagtgagaactagaagatcaaatgcatcaggagataggcgagattattctcatggaagatatggacacgattcacttgatcgtcagtgaaagctccaaga

SEQ ID NO: 435 - DNA, 272 bp, Zea mays
  misc_feature: Incyte ID No: 700549220H1
  unsure 148-176: a, t, c, g, or other
aggtgatgctatttgtattgagtgcctttagaggtaaatgctttgaaattgcttttactatttgtgttcggagccacactttttttattttataacttgatggatgctgtcacagtattcatatgggaagctgcaggctccatccatnnnnnnnnnnnnnnnnnnnnnnnnnnnnnggctagttcctgatgccctatttggcacaggtaaggttgatggtcggtctctaaaatctgttgggactggagatctaacaatgcagagttgagaga

SEQ ID NO: 436 - DNA, 277 bp, Zea mays
  misc_feature: Incyte ID No: 700549224H1
attttgcaagctgttttatctgcaatcagcaaggggcattgagcaagaactgccctgaaaacaaacatgggcatctatccaaagggtggttgttgtaaggtatgtggcgaagttacccacttggccagacattgtccgaataaagggagacaagatttgatatcctccagagatgatgatgtcaacatggaagagcacagtcaggaatgtcctgcggttcaccatggtggagatgacctagaagatgattcgttaatgaaaagaaccaaaacccgcc

SEQ ID NO: 437 - DNA, 265 bp, Zea mays
  misc_feature: Incyte ID No: 700549225H1
gttgaaggctgaagcctgaaatagttgccgggaatcgtcaaaacccgtcaaatgtttagtgtagttttcacgtgtccttgagacatgtgcatttgtatgtctgtgacgtgatccgttagatcgtgcaatcgtaggttgctgttcttgtgccctttaaaggccagacagatcagggagctctctgcttccttagtgcacttgctttgcagcattcctgttatctactctgaaatcatacatcatgccacaagaaccgatgttcgtg

SEQ ID NO: 438 - DNA, 275 bp, Zea mays
  misc_feature: Incyte ID No: 700549228H1
  unsure 37-38, 96, 105, 118, 129, 176, 184, 260: a, t, c, g, or other
tcaacaacagatattccctagaggtggtcgtggctanngctatgctactggacgtggaatgcctgatcctggcatgctaatgttggtgctgtgatnccatctccntatgagatggganggatggcaatnagagatgctggtgtctcacaacctgttccaattggggcactagccantgcgcttnctaacgcctcaccagatcagcaaagactgatgcttggtgagaacctgtatcctcttgttgaacagctggagcgtancaggctgccaaagtc

SEQ ID NO: 439 - DNA, 126 bp, Zea mays
  misc_feature: Incyte ID No: 700549229H1
  unsure 9, 24, 61, 84: a, t, c, g, or other
atgatgggntgaccatagtggtanggggtgtgtgctagttgttaatgtggtaatgtattcntttgcttgcaagaccaattgtanactgaatgatcgttagatcatatggttcttcctcgttcaaaa

SEQ ID NO: 440 - DNA, 261 bp, Zea mays
  misc_feature: Incyte ID No: 700549230H1
  unsure 41, 72, 80: a, t, c, g, or other
aaaagagtgatggtaattccaggccggagaagacagtaacngattctgaaaatccaggcattctctgtagancggaaggntgaacatccattccaaaatggactagcagagaacagaatggattctactgaggacaacaaaaacttcgtcaaaagcaaaaaaagcacactggagaaaggtagaaccagtgaaggtctatcttatgctcagaaccacgaaaccaaggtccatgttctgcacgttctcaaaaaaaatcccagg

SEQ ID NO: 441 - DNA, 282 bp, Zea mays
  misc_feature: Incyte ID No: 700549231H1
attcttgaaataggggttattctgggaccagaagtgactctgagaactttgaaattcctagtgtagttataaaagaactcagtgaggctgtgtctgcagctgtgaggttactctcaaagttattgaactttgatcttttcatccgcagcataaacggtgaaaaaatcacttctttgctaagaagaacgctcaaatcaaatttcccccttcagtcaaaggattgtcttgcggcatgcctcattaagctagaatccagagctggcttatagagatcaggtgtta

SEQ ID NO: 442 - DNA, 280 bp, Zea mays
  misc_feature: Incyte ID No: 700549232H1
  unsure 265: a, t, c, g, or other
ggaaagggcgactgagcttggttctttggtttttgattagtagctgtggaacttaacttggctatagctgaattttcttgtaagttccctgtagtgcttagccagttgtaacttaaagagttctgtttaggttgcctcttgcggccacaatcatgtagcagaatgtgcgtgtgtttcaggttagcgtgggggtatgtgcatctgtccaaagagagtctgcaattggcaacggatatttgttatcaattcagttactcgaactganatgttctcatctcat

SEQ ID NO: 443 - DNA, 275 bp, Zea mays
  misc_feature: Incyte ID No: 700549239H1
  unsure 20: a, t, c, g, or other
aaaaaaagagcaacttagangggttcccaattgcacagttgtctgcggggaagagagttttcaatagcaggggcattcaggaaagctctggaggtggaaaagaagccatcaccagtggctgatgcagttcaagtggaagtgggcagaagccgtggaagttgtctgaggtgatacgacacagtgatgaaacaatcacgaggattaggcccagacctccatttcttccacataaacctcataatgatgtgaaaggacttgttttgtctcaacaagaa

SEQ ID NO: 444 - DNA, 125 bp, Zea mays
  misc_feature: Incyte ID No: 700549244H1
  unsure 111, 118: a, t, c, g, or other
cttagcggtcaatgatgagactgttaaagtttgaaatctgggatactgccgggcaggagaggtatcatagcttgggctcccatgtactataggggtgcagctgctgccatngttgtcnatgacat

SEQ ID NO: 445 - DNA, 273 bp, Zea mays
  misc_feature: Incyte ID No: 700549245H1
  unsure 59, 148, 162, 185, 202: a, t, c, g, or other
ctctaggtgatgatctggtggggatgctacctggcatccaatgcctgtcttgtctgtcncgttaaacactagaaatcataacagcctctatatttatgtattgtgtggccttttggagagctgccaaaggttcctttatgtttactcnatcactcccaaagnccagaaaaatgtgtcaccatgtnttgttggttacactccncttgtactgcccacttggaccatcttcaacaggaaattttctgttggaagatatggtgcatttacactgat

SEQ ID NO: 446 - DNA, 103 bp, Zea mays
  misc_feature: Incyte ID No: 700549246H1
  unsure 8, 58, 60, 65, 70, 73, 82-83, 89, 91: a, t, c, g, or other
ggaaatcnatggtggtaggcccagagaagtttaagcttagaagtttcctgcaatccgntncaatncaaancancggtttccnncctccntncccccaaccggg

SEQ ID NO: 447 - DNA, 294 bp, Zea mays
  misc_feature: Incyte ID No: 700549248H1
  unsure 14, 60: a, t, c, g, or other
gaaccgagaaagcntgtccctttcaagacccacagccatgagttttaccctgggtggatnactaactttcgagatcgacattgaccatggcaccagtttagctacatctcaagggaagggttttgcaacatttttgggacaggctaaaagcatgtgttctagatgttggggctaactattcagggaataaagctgaagaactgccggaacaaatcttatgctgtgttaggtgaatgggatagatacaccaaataccagctctttgactcagctgctgaataaacgcttacaaga

SEQ ID NO: 448 - DNA, 272 bp, Zea mays
  misc_feature: Incyte ID No: 700549251H1
atcaacgccgccggtgcgtcatcgagaccatctacatcgtcatgtacttcgtctacgcgcccaagaaagccaagctgttcacggccaagatcatggccctcctcaatggcggcgtctttggggtcatcctcctgctcacccttctcctcttcaagggtagtaagcgcgttgtgctgcttggctcgatctgcgtcggcttctccgtcagtgtcttcgtcgcgccactaagcatcatgaggcgcgtgatccagacgaaagcgtagagtacatgc

SEQ ID NO: 449 - DNA, 270 bp, Zea mays
  misc_feature: Incyte ID No: 700549253H1
agattctacatatacctggagtatgttcatcctggttcaatccataagtatgttcatcaacactgtggatcgctgacagaagcagtcatccgtaacttcacacgtcatattctcaagggtcttgcttttttacatagccaaaagattatgcatagggatatcaaaggggcaaatttgttagttgatattaacggtgtagtgaaattggctgacttcggaatggcaaagcatttgagtactgcagctcctaatcttcatgaaggaacacca

SEQ ID NO: 450 - DNA, 269 bp, Zea mays
  misc_feature: Incyte ID No: 700549255H1
  unsure 132, 260: a, t, c, g, or other
caagcaaccaccgcctccccgatctcgtcgagaggaagcccaatcccgaaaccgccgccctattccaatggcgcccaaggccgagaagaagcccgccgccaagaagcctgcggaggaggagccggcggcggnagaaggccacggcggggaagaagcccaaggccgagaagcggctccccgcgggcaagtccgcaggcaaggagggtggcgagaagaaggggaagaagaaggcaaagaatcggtggagactacaatctacncttcaagtg

SEQ ID NO: 451 - DNA, 271 bp, Zea mays
  misc_feature: Incyte ID No: 700549257H1
ctactatggttgacttatggctggagccaagtgccctggtgcaaggtcaggtagagttctctgggatgttgaatctggaccatgcgagtatcaattgtgaggcacaataggacatcctaccaattgtacttctaaatgtacagcatggaacttagagcttgctacatgtattatacagtacctttttatttttcccatcacggtatcaccttagttatcgcggcctttgattatattgtatatcagctcagcaaatatggtgttttttgtt

SEQ ID NO: 452 - DNA, 89 bp, Zea mays
  misc_feature: Incyte ID No: 700549259H1
  unsure 24, 49: a, t, c, g, or other
ccattgcatgtagtccatactggnatgcaatgcacaatcccaagatcgnttaccaaaccgcagggaccataattgggttgtgcattggc

SEQ ID NO: 453 - DNA, 106 bp, Zea mays
  misc_feature: Incyte ID No: 700549261H1
  unsure 35, 49, 63, 68, 70, 79, 81, 89-90, 103, 105: a, t, c, g, or other
ctccggcttctgatctgattcaatggggaatgaanatattcctttagcnttgcctgtacaaanaagananctagaagcngnattagcgnntcaaatgcaaggngnt

SEQ ID NO: 454 - DNA, 276 bp, Zea mays
  misc_feature: Incyte ID No: 700549263H1
cgtttaccgccgccgattctgattctaccaccacccgcctcctcttcgagttcgatctgtttgctcccccagacatgtcgggccgcggcaagggaggcaagggcctgggtaagggcggcgcgaaacgccaccgcaagtgctccgcgacaacatccagggcatcacgaagccggccatccggaggctggctcgcagggcggcgtgaagcgcatctccgggctcatctacgaggagacccgcggcgtgtcaagatctttctcggaagtcatccgcgag

SEQ ID NO: 455 - DNA, 270 bp, Zea mays
  misc_feature: Incyte ID No: 700549267H1
  unsure 4, 15, 34, 50: a, t, c, g, or other
atgnatccgaatttnttggggatccattctcccntttggggcctctctgntgcttaccaagagaaagtccgagaagaagaggggggtgccagtcaatgtgggtggagagcctggctgcgccatccgtaaccacagatttgaaagacctgttaagacgcgctgggaggggatttccacgcttgctgagctatttgagcaatcgtgcaagcagtttgcctctacacccctgtttggcaccaggaagctcatgcaaagaaatggtagtggctg

SEQ ID NO: 456 - DNA, 52 bp, Zea mays
  misc_feature: Incyte ID No: 700549268H1
  unsure 4, 20, 43, 45, 47-48: a, t, c, g, or other
cganagtcctcgtcctgacncctcgcaaaaccctagctgccantnannatga

SEQ ID NO: 457 - DNA, 266 bp, Zea mays
  misc_feature: Incyte ID No: 700549270H1
  unsure 45, 76, 126-127, 133, 214, 224: a, t, c, g, or other
caattactgccgctattgagaaagattatgggcttctggaactgngaatgacgagtatctggaagcctaaattctntatttaccaacttcccaagactagagcaactgaaccagcaacccttagcnncccccntctggttacagccttaaagacaggttcagaggcttgtcaggaagctgcattggatgcacttttcctgctcagacaagcttngtcagcatgnccagctgaagtttctagagctcagtaatgcagctgcaggatg

SEQ ID NO: 458 - DNA, 264 bp, Zea mays
  misc_feature: Incyte ID No: 700549271H1
  unsure 151: a, t, c, g, or other
gatgactgtatgggagatctctctgctgatatcaaggtaggatccagatgtgaggttgaacctggggcaaaaaggggtgttgtaaaatttgttggccgggcagaatcactgggtcctggtttctgggttggtgtccaatatgacgaacccncgggcaaacatgatggcatggtcaaaggagtacgctacttcgaatgccctccatctcatggtggaatggttagaccagagaaagtgaaggtcggtgatacctgaacgagaccc

SEQ ID NO: 459 - DNA, 262 bp, Zea mays
  misc_feature: Incyte ID No: 700549272H1
  unsure 29, 57, 63, 103, 108, 112, 148, 184, 224, 248: a, t, c, g, or other
ggtgttttcagtgtgaggcctccaaaganaacaacaccttctgaaaatgggtccaangaatcnacaagttccagttcagcaggtgttgttttcagtgtgaggnctccnaagnaaagctggaaaaatattgccaatttatctggtggtnagaagacacttagttcactggcttggtgtttgctcntcaccactataaacctactccttatatgttatggatgagntgatgctgcgttggacttaagganatcaatgtgggacc

SEQ ID NO: 460 - DNA, 121 bp, Zea mays
  misc_feature: Incyte ID No: 700549274H1
  unsure 20: a, t, c, g, or other
atttgttccgcaaacaaatncgttagggaacaaatttgtgatatcgatgctcagttgttgggttgtgctacatgtctgttgccagtcttgttggtcaatattacgtagacagtttctgctc

SEQ ID NO: 461 - DNA, 265 bp, Zea mays
  misc_feature: Incyte ID No: 700549275H1
attgtgggcgacttgaagcccaagtatgttctcatggaaaatgtggtggacatactcaaatttgcggatggttacctaggaaaatatgctttgagctgccttgttgctatgaagtaccaagcgcggcttggaatgatggtggctggttgctatggtctgccacagttcaggatgcgtgtgttcctctggggtgctcttcttccatggtgctccctaagtatcctctgcccactatgatgttgtagtacgtgaagagccctaatgc

SEQ ID NO: 462 - DNA, 270 bp, Zea mays
  misc_feature: Incyte ID No: 700549277H1
  unsure 101, 104, 119, 142: a, t, c, g, or other
gacgcgacatactagattacttgaggagagacatgataggaaaagaaggtgaaattttctcagcagaagatgctgacagtgcagaatatgaaggtgctccnagnaaaaaggagggagcnttttatgtgtggaccagtaaagngatcgaagagacacttggggagaatgcagagctattcaagaaccttactatgtgaaatcatctggcattgtgatcttcacgatgagcgatcctcacaatgagttcagttgtagaatgtgctcatagaa

SEQ ID NO: 463 - DNA, 274 bp, Zea mays
  misc_feature: Incyte ID No: 700549278H1
  unsure 15, 53: a, t, c, g, or other
atatgaagcaagtanagcacgtcatgcctatggtccctctggggcaccgtggnatgagcgtgttaatatttgaaagctcagctgtgggctacatggaagctgaacgtctgcataaacactttgttaatcaaggtacagacaggaattcatggcacctacgcaaggttcgatttgtgcctggtgggaaaaggcaactatatggtttcttagcaaacaaagaggatatggaggcatttaacaagcattgccaggtaaaagcgtctgaagtatgaga

SEQ ID NO: 464 - DNA, 269 bp, Zea mays
  misc_feature: Incyte ID No: 700549279H1
  unsure 24, 27, 46, 68, 231, 239: a, t, c, g, or other
ctttgcctactgggcagttatttngangtctggtcaccagacttcncaatccctcttattatagggancgtatgtgatgcgcagacctcctttcagtttaatacttgaaagtgaaaaacaagagggctcactgtaagtttcatgtaactgccttcatgattaatataatctggtctacatgatttgcgcggtggacgtttaggagtacgttttggcgaaatctgcatttcnttagtatnattgaactatatttaagctgataatgtttc

SEQ ID NO: 465 - DNA, 273 bp, Zea mays
  misc_feature: Incyte ID No: 700549280H1
  unsure 71, 138, 146, 165-166, 172, 174, 186, 194, 202, 223, 256: a, t, c, g, or other
atctataactttttcatccattaacaaatcaggcggcttatatactacaaggactatggttcagcagggangatggataccaatgacagtctaagattagcaagtctgtggcattcgatgcatgtatctcccaggaantctccccnacccctgggtgtactgggnntgatcncnttcaagctcatnactttganctcattgnttcaatccctcacagggacanaattttcggtgtatgcgaactggagctccaacnggaagctgctgcaagtg

SEQ ID NO: 466 - DNA, 117 bp, Zea mays
  misc_feature: Incyte ID No: 700549285H1
  unsure 55: a, t, c, g, or other
gtggtggcaatcctggctaacctggtgggcagccctggctaccagggtcaatgangcaactcgaacttccagtgaaacatgaccacgtggcacccctgtttcaaagtagccttctgc

SEQ ID NO: 467 - DNA, 170 bp, Zea mays
  misc_feature: Incyte ID No: 700549286H1
  unsure 50, 70, 148, 157, 166, 169: a, t, c, g, or other
aagcaatccccaaaccccggtttccagaacctttttcgaaacttccccgncggcttccttccaattcggnaccgatgggcgaaggaaccaatggcgcgtggtcgtcactggcggccgcaggacaaattggatatggcctgggtcccangattgctanggggggtangcnt

SEQ ID NO: 468 - DNA, 117 bp, Zea mays
  misc_feature: Incyte ID No: 700549287H1
  unsure 36, 51, 66: a, t, c, g, or other
ctctccgttccaagatgtcgaagcgagggcgtggangttcggctggtaacnagtttccggatgtcnctgggtctaccagtggcagctactgtgaaactgtgccgataaacactggag

SEQ ID NO: 469 - DNA, 264 bp, Zea mays
  misc_feature: Incyte ID No: 700549290H1
  unsure 142, 152, 248: a, t, c, g, or other
aatcaaattttagcctacaaaagaggatgatgcaacaatgtagcatttcagaaaaggagcattttaagatattcaaaattcaaatgatcaaacacaaatatttggcactatatatttctacctcatcaagttttacttcaanattgttaagnttcatctgtaaattttgaaaatctttggttacctgctaaagggggtaaagtagaattaaacacataagattcagaagttaagaactgttgattggnaccaagtgctgtattt

SEQ ID NO: 470 - DNA, 126 bp, Zea mays
  misc_feature: Incyte ID No: 700549292H1
  unsure 15, 17-18, 24, 27, 91: a, t, c, g, or other
ctgtacataaaagtnanngcactngtngtggacccctattgctagtgtgcataacataggggtccaccacaagtgctttaacttttactgnacagatctccacatcccaatgctattgggcagatc

SEQ ID NO: 471 - DNA, 214 bp, Zea mays
  misc_feature: Incyte ID No: 700549295H1
  unsure 5, 11, 24, 34, 89, 161, 173: a, t, c, g, or other
ggaangggagnagagagaggaganggggctgggntccagtgctaaacaaggtggggagctactggtttcagccaaagggccagcaaggnaatcgactccatcggcgacgacattcaactcgatctcaagcagcattggagggtcagccaaatggatggtgnaccaaattaaanggaagatgcagaaagcattccagatctcctcaaggatatga

SEQ ID NO: 472 - DNA, 305 bp, Zea mays
  misc_feature: Incyte ID No: 700549301H1
  unsure 133, 157: a, t, c, g, or other
atgtcctgaaagaaatgttggaagaggaggttggaaataatacacagaaaaataggtttacatatagtgatctttgtgttcaaattcctgaacccaaacttcgcctctgcttgttgagaaccctagagttctnattttcattgatgtgctcatactntactattatgagcttttcttcaggagataagaatattgactccaagggcccagatgaagcatataaggatggcacatctcagaatagcagcgaaactttagttaatttaggaagaggtcattcaagtgcagcagtcactcaggatggt

SEQ ID NO: 473 - DNA, 303 bp, Zea mays
  misc_feature: Incyte ID No: 700549302H1
gcaattgttggagacagatacattttccagctagaccaaggtcttggcatcgggagcaaaaacccatccttcaaccgtcatcaactgactctgaccaagttcatcaatttaaataagcaagagaaaggtgctggcaagccactaccagctgttttggttcttcatagtcattatgctggttgtgtgggtgatttgccaagctatgatgcatttgcacttggagggccttactctgttaggggctttagtaatggtgaactgggcgcttctaggaatattcttgagcttgctactgagttgcgt

SEQ ID NO: 474 - DNA, 301 bp, Zea mays
  misc_feature: Incyte ID No: 700549303H1
  unsure 242, 244, 247, 251-252, 255-257, 259, 262-264, 267, 274, 279, 281, 285-286,: a, t, c, g, or other
agttgatgggctgtaatgcttgagtcaatctttttacttgaaggtacagcggtgttatggaagttatgattatcaattgaatatgttttagcataaagatgagtttcaggatagttgccaatatcaaatgtcgaagttgatggctgtaatgcttgagtcaatctttttacttgaaggtacagcggtgttatggaagttatgattatgtagggtggattaaccttttaccgaaaaaaaaaagngnaanagannaannnanagnnnggngtgaagnggttngnggannatanannanngnngg

SEQ ID NO: 475 - DNA, 299 bp, Zea mays
  misc_feature: Incyte ID No: 700549306H1
  unsure 4: a, t, c, g, or other
agangcagagcgttcttcttccccgacggcccgggccgacggctcgactccactagtcgctggaaccctctgcaacaaagccgcctccacctgaccacctcccttgagctcttccccttcctcgtgggttgtgcgagccctctaccggcgcgcagtacaggggctgattgggtgatcaaacccgcaagatttgggtttgtgatttaggagcaggaggcggtggcaatatggaatataaggcgagatctactggaattcaggaattcgtctaaaagtttccgtgatctgtacaatatgaa

SEQ ID NO: 476 - DNA, 302 bp, Zea mays
  misc_feature: Incyte ID No: 700549307H1
gaaggcaccacacaggtgtatcaatatgcttcaagattgcagaagtgttgatgagtttgagaggctcaacaaaattaacgagggcacatatggtgttgtatacagagcaagggataagaagacaagtgagattgttgcattgaagaaggtaaagatggagaaggagcgagaaggtttcccattaacctctcttagggaaataaatatcctcttgtctttccacaatccttcaattgtggatgttaaggaagtagtagttggaagtagtctagatagtatttttatggttatggagtacatgg

SEQ ID NO: 477 - DNA, 304 bp, Zea mays
  misc_feature: Incyte ID No: 700549309H1
atgtcctgaaagaaatgttggaagaggaggttggaaataatacacagaaaaataggtttacatatagtgatctttgtgttcaaattcctgaacccaaacttcgcctctgcttgttgagaaccctagagttcttattttcattgatgtgctcatactatactattatgagcttttcttcaggagataagaatattgactccaagggcccagatgaagcatataaggatggcacatctcagaatagcagcgaaactttagttaatttaggaagaggtcattcaagtgcagcagtcactcaggatgg

SEQ ID NO: 478 - DNA, 303 bp, Zea mays
  misc_feature: Incyte ID No: 700549312H1
aaacaaggagaaggaggaggacttcatggcgatgaagggctccaagctgccacagaggccaaagaagaggcccaagctgatgcagaagtgcttgcttatggtgagcccaggagcttggttatcagatctatctcatgagagatatgaagttagagagaagaagagttctaaaaagagggctagaggcttgaaggcttgagcatggcgagtgattcagaatagagtttgaggcgaatggatttttggactgacttagctggtggcaagaatctgtagttagtggcactgcctctgcctgtcaga

SEQ ID NO: 479 - DNA, 310 bp, Zea mays
  misc_feature: Incyte ID No: 700549313H1
cgaggagaggaaagaacctggaagagaggagcttgaggagatggcgagcgccgaggggcgagaggtgggtgggactggcgacggacttctcgcaggggagccgagaggcgctgcagtgggcggcgaccaacctgctccgcgccggcgaccacctgctgctgctgcacgtcatcaaggagcccgactacgagcagagcgaggccatcctctgggaatccaccggctccccgttgattcccctctcggagttctctgaccctattatcgcgaagaaatatggagcaaaacccgacatggaaacttggacctc

SEQ ID NO: 480 - DNA, 312 bp, Zea mays
  misc_feature: Incyte ID No: 700549314H1
ttaaaaagccggcggcgagaaggtgggttggggaatctgaagcgatcagagaaggcaagcttgcttgcttgcttctccaccgaatcccccatctcgcgccctccgtctctcgccgcggagactcgcccccccgctgatggaccagctcgtcaatttcatcatccgcccgcccagagctgactacagtccaaatgatgatctattagagcaggagtttatgctgaaggaagatggttcctgaggaaggatttggaggtaaaaaatggtcagggcaagaagttacaatgtagtcactacatgcctgttgtgatt

SEQ ID NO: 481 - DNA, 316 bp, Zea mays
  misc_feature: Incyte ID No: 700549315H1
cgctccgccgccgccgaaacagcacatcgctctctcgatctcagccatggcggaggtggagcagccccaggacgcggtgaagctcttcaaccgctggaccttcgacgatgtccaggtgaacgatatctcgctgaacgactacctggctgtgactgcggcgaacacgcgacattcctgccgcactccgcggggcgctactccaagaagcggttccgcaaggcgcagtgcgccatcgtcgagcgcctcaccaactcgctcatgatgcacgggcgcaacaacggcaagaaggtcatggccgtccgcatcatgaagcaca

SEQ ID NO: 482 - DNA, 315 bp, Zea mays
  misc_feature: Incyte ID No: 700549316H1
  unsure 250, 261, 288: a, t, c, g, or other
gaaacagaagtctgtgccccacctacataactcttttgattattacagcctgcagcaaggtcaactgttcctggaggtcctagtgtggcctgcagcactgccaaagctgttgaatgggacgcatcctggtccaagaaccttgatcctctggccgtgctgctttgggtgttcacgatgctgcgtatgaagacactgcagggaaaactcctgcctctgctgatcctgtctcagacaagggccttcgtccagncattggcgaancctagggacacccgttgcttcagccanagtgtctaacttatgtttatcaccagc

SEQ ID NO: 483 - DNA, 296 bp, Zea mays
  misc_feature: Incyte ID No: 700549321H1
gtttaatacacatgcttctcaagctgaggtattctctgatatccaacctctgatcagatcagttcttgatgggtttaatgtgtgcatttttgcctatggtcaaactggatccggaaagacttacacaatgagtgggccaggcacatcaaaagaagattggggtgttaactatcgagctttaaatgacttgttcgacatctctctaagtagaaggaatgctttctcatatgaggtgggagtgcagatggttgagatttataacgagcaagtgcgggatctctctcaaatgatatgca

SEQ ID NO: 484 - DNA, 298 bp, Zea mays
  misc_feature: Incyte ID No: 700549322H1
ggacttccatgcaagagtttcagactttggtctagccaaacttggatctgatagagctggtggccatgtctcaactcgagttttgggcacacaaggctatgttgcaccagaatacgcattgactgggcatttgactaccaaatcagatgtgtacagctacggtgttgtgcttttggaattacttactggcagagtaccagttgatatgaagaggcctcctggagaaggtgttttagtaaactgggcattgcctatgctcactgaccgagaaaaagttgtgcggatcttggatccagca

SEQ ID NO: 485 - DNA, 298 bp, Zea mays
  misc_feature: Incyte ID No: 700549323H1
cgccgccgacgcaggcacgggcgcggacggagagactgtcagcgtcgcgctctagctctaggcatttcatccccgtgtggcgtattctatcgttcgcgtcccattattgccacctgtccgatagacaacttgttctcgatccggtaatttcaccgtgcttcagctgcgtgtgtttggaaaaattgattcggtttcgggtattgttaagagatcgagggagaagtgaaacattgttgggcgttcagtatgcttttgtaataccttttgttttcttaaataaagtcctaaggagtgttgg

SEQ ID NO: 486 - DNA, 298 bp, Zea mays
  misc_feature: Incyte ID No: 700549324H1
  unsure 147, 172, 269, 272, 278-279, 295: a, t, c, g, or other
attttgcaagctgttttatctgcaatcagcaagggcatttgagcaagaactgccctgaaaacaaacatggcatctatccaaagggtggttgttgtaaggtatgtggcgaagttacccacttggccagacattgtccgaataaagggngacaagatttgatatcctccagagntgatgatgtcaacatggaagagcacagtcaggaatgtcctgcggtcaccatggtggagatgacctagaagatgatttcgttaatgaagaagaaccanaanccgccnntctagaaggcaaagcnatc

SEQ ID NO: 487 - DNA, 304 bp, Zea mays
  misc_feature: Incyte ID No: 700549326H1
ggccaacccaacccaacccaacccaccactgcctccctccccgtttccccagtccccaccccgaccggctggtcctcctcctttccccgcgccatcctcgaggcatcgccggcgccgcaactttcgttcaggaggaagcccgcacccggccccgatccgatggccaacagcaacctcccgcggcgtatcatcaaggagacgcagcgactgctcagcgagccagcgccggggatcagcgcgtcgccctcggaggagaacatgcgctattcaacgttatgatccttgggccggcgcagtcgcccta

SEQ ID NO: 488 - DNA, 302 bp, Zea mays
  misc_feature: Incyte ID No: 700549327H1
aggatgcacctggtgaggctgctaaagagggatggtagccccactgaggaggccgaagaggttgaagatgatgggtaaggcatgaagctgacaatctttactcagtatatgacgatgcacttcttatcctactcataattcgcacctgtttgcagactccatatatgataatagttcatgtttttgttcattttgtgaaattctatgtacgtgaaaaataagagtctctagcttggcattagtggtttttaagtctgggttgtttcttaatgctgtgtgagcgagttaataatttatagaag

SEQ ID NO: 489 - DNA, 306 bp, Zea mays
  misc_feature: Incyte ID No: 700549328H1
  unsure 85: a, t, c, g, or other
tccaaggtttttcacctcttggagcgcaccaacaccacccggagaccggagcgactcgccaccggcgcggaaaaggagggcggangctcgatggcggatgagaatcaggctggaaagaaagaggaggaggaatttagcacaggccctctgtcagtcctaatgatgagtgttaagaacaacacccaggtcctcatcaattgccgcaacaacaagaagctacttggccgtgttcgtgcttttgatcgccatgtaacatggtgctcgagaacgtgcgtgagatgtggacagagatccccaagactggcc

SEQ ID NO: 490 - DNA, 307 bp, Zea mays
  misc_feature: Incyte ID No: 700549329H1
  unsure 301: a, t, c, g, or other
tcgaagccggcggctgtttcaggcccataccttcgttgacaccgaggtacatcggtgtgaatgggatgcgcccacttgcagatgcaatgctgcctgagactgatatgattaaagttttgaggccttgttggataagcaaacttgagccgttcaatggtttgtggcgcttgtttgagaatgaaaagcctcgcggtgaatacgatgcagttgtgatagctcataatgggaaatgtgccaaccgtctgctctctacatcaggattgccattactaacaaaaccaatgagagactagagctccantctgtc

SEQ ID NO: 491 - DNA, 312 bp, Zea mays
  misc_feature: Incyte ID No: 700549330H1
  unsure 150: a, t, c, g, or other
acaggaaaggactggtcccatgcagggtgcattgaatgcacagcagcagtccagtagcaacatgatatccaacaatgcaatgagtacaatgcagactaataacaatgcaaatgcgaattcattgcagcagttaaagcagcaacgtcaggngcatcaaatgatgcaaagtcagcaaatgaagcagcgccagcagatgatgcaacagatacaacaaaagcaaacgcttcaaccgcagctcccaatacagcaataaagaaacaacagcagcaagggcagatgcagtttccacagcttcttctggaaatgatgtga

SEQ ID NO: 492 - DNA, 301 bp, Zea mays
  misc_feature: Incyte ID No: 700549333H1
acacatattccctgcctctcgctagcgccttccctccgcaaacggaaggctctcgtgaccaccgggatgtccgccatggagaccgacatcaacgcgccgccgccgcccgccccagctggcgagggatcctctgcggccggtccgtcctcctcccgcaagcccaacaagcgcttcgagatcaagaagtggaacgccgtcgcgctctgggcatgggatatcgtcgtcgacaactgcgctatctgccgcaaccacatcatggatctatgcatcgagtgccaggcgaaccaagccagcgcgacca

SEQ ID NO: 493 - DNA, 297 bp, Zea mays
  misc_feature: Incyte ID No: 700549334H1
ggtgaaacaatgaaaaacaacattgatgttttggtttgcaaagctgaatactaccaccagagtggagagtaccaaaagtgttttaaactcacatcctcgttacttgagagagaccctttccatctaaagtgcacattagttcatttggcaactgcaatggagcttggtcattccaatgatctttatcttttagcatgcaacttagtgaaggattatcctgaaaaagctctttcatggtttgcgtcggttgctattactattgtattaagaagtatgatcaagcgcgaagatacttcg

SEQ ID NO: 494 - DNA, 76 bp, Zea mays
  misc_feature: Incyte ID No: 700549335H1
agaaagcaccctttcctggtgatatgttgtcctgtgtgtaataacttgttatgcctatgttacattttttttgttg

SEQ ID NO: 495 - DNA, 277 bp, Zea mays
  misc_feature: Incyte ID No: 700549337H1
ggacaaataataaaatgtgaagacccaaatgcgaacctctactcctttgtcggttcaatggaatggagaggccagcagtatcccctgtcacccctacagcttcttctccgggactcaaaactacggaacacagactacatatatggggctgtcatcttcacaggtcatgatacaaaagtgatgcaaaatgcaacagatccaccatctaaaagaagtaagattgagaagaaaatggatcaaattatttacgttctgatgtcttctctactcatgattg

SEQ ID NO: 496 - DNA, 294 bp, Zea mays
  misc_feature: Incyte ID No: 700549339H1
  unsure 14, 231: a, t, c, g, or other
ggccaacctggacnctctcgacgtcaccttcggcggcgacgaggagcccgtggagagggtggagtccggccgcgcactccgcgcgaaggtgttcgagcggcttagcagggagggcgctgtttccggcgacgccgtggccccgacgtcgggtgggtctccgacctcatcaactgaggcggcggcgggtccctggcatggcagtggcaatggcaatgggcatgggcatggagnaaggtgatggtgagccgtatcggagaaggatggcatccaaaaaaatatttccctgcattgatt

SEQ ID NO: 497 - DNA, 297 bp, Zea mays
  misc_feature: Incyte ID No: 700549341H1
ggctgctatggtacctgacatgacaccgttccctgcaaaccggtacatggcgacactcacaccaccaattgaaggtatattgaaaaagtgcgggaagcggccaagaagcactctgtgaaggagaaacttcgctgagaattcaagagaggaaactgtttccgtaaggtcaataaatattcaacctaatgtacaagaacagctttggcacaaactgcaattgccatatttggtgatctagtcagacatcccaatttgccgagcagccatatctagtgaaatcctttttgccattttatg

SEQ ID NO: 498 - DNA, 296 bp, Zea mays
  misc_feature: Incyte ID No: 700549342H1
gatcccagcatccgagagagctccacaggccaggtcccccatcgccgcgggcgcttgccccacctctcccccgcccggtagtagcctcgccgccgttgccgagatggggttcgtgtcttcgtcgggagggtgctcttcgtcgccgctttcctcctctccgcctaccaggagtttaatgaattcggtgctgatggtggaccagcagctaaggccctcggcccaaattcaacgtgtttgtcaaaaatgtatctgctcatctgggagtagctgtgccacacattgagttgaagcagtga

SEQ ID NO: 499 - DNA, 165 bp, Zea mays
  misc_feature: Incyte ID No: 700549344H1
  unsure 62, 64, 66, 148-149: a, t, c, g, or other
gatgaatgaagactatctctgtgccaaactacacttagtagcatcttgctggatcagaacgncncnaagagaactggttcagatggcctgcgcttcaaggaaggtgttcacatcaaccgaggacttctcgctctcggcaatgtcatanntgctcttggagatgag

SEQ ID NO: 500 - DNA, 234 bp, Zea mays
  misc_feature: Incyte ID No: 700549345H1
  unsure 153: a, t, c, g, or other
tggtcctctccccccattccagcagccgcaggatcagggggtttgcggcctgggcttcggcgccggggccggcggggtctgcggattccctcgctacaaaggcgctagaggctaagatcaaggagcagctggaggcggacacagtcacggttntggatacctctggagatggccgccatgtttgcatagacgtgatttccaaggcattgagggaaaatctgctgtaaacaggca

SEQ ID NO: 501 - DNA, 308 bp, Zea mays
  misc_feature: Incyte ID No: 700549346H1
cattgataagcaagagagttctatttatggtgaagcatgttcaatgtctccggtcataatttcttactttggatataagttgttgaacaccattcttagccctcatcatgaatggagtctaccacactagtgctcttcatgccatcagaattatgcaggtgcagtacttttctgattcttttaggtttgggtataatgacgtgctgaattgttattgtaaaacaaaagtggaaatattctcgtgattgtttggatattagttattcaatttttattgtcctgacttgcatgattacactgtaggcttt

SEQ ID NO: 502 - DNA, 309 bp, Zea mays
  misc_feature: Incyte ID No: 700549347H1
  unsure 36, 306: a, t, c, g, or other
aagctcgcaactacttcctcccctccccttccttcnctttccgggccgcctcttgtcctcctcacctcccaaattgaaatcctcctccctccccgcctagggttccgcttcctcccccgtccgagcaccactcaagcggcggcagcagcggtggcagcctggaagcagtcccatctcgtcgccctagacttccctgccgccgcacgtctcagtttcttgttcgcccgctctcctgccggtccgcccatcgcctgaggttcttaggtgccaggagttggcaatgcaagagtgatatgtggtacaacntag

SEQ ID NO: 503 - DNA, 319 bp, Zea mays
  misc_feature: Incyte ID No: 700549348H1
  unsure 2, 9, 20-21, 29, 44, 47, 50, 97, 123, 128-129, 133, 138, 150, 164, 170-171,: a, t, c, g, or other
cncaatccntcccgcctccnnacccgaantccaagtcgccccgnatncgnatggcgcccaaggccgagaagaagcccgcggcgaagaagccggcggnggactgagcccgctgccgagaaggcnccggnngggnagaancccaaggcgganaagcgtgtcccagnaggcanntccgccggcaaggagngcggcgagggaaanatgggccggaanaanggcannnngagntngagacctacaagatctacannttcaaggtgctganacangtgcacccngacatcggcatctcctctanggccatgtccatcatgaantc

SEQ ID NO: 504 - DNA, 297 bp, Zea mays
  misc_feature: Incyte ID No: 700549349H1
  unsure 96-114: a, t, c, g, or other
cgattggcatctccctcccctaagccatggctaccgggcggcccgtacgactcgtgctggatgcctccctcctccttcgacccctcctccaccagnnnnnnnnnnnnnnnnnnnctgcggcccggggtagaggagttgctgcggcggttgcgctactccaacctgagcgtggcaatctgctatgcagagggcatgccaactaatgagtcagactttcttgaaaaggtcgcaagctcacacttgtttggatctatagtacttcttgcaaaaagtgggaatctttctccaattgaatta

SEQ ID NO: 505 - DNA, 296 bp, Zea mays
  misc_feature: Incyte ID No: 700549350H1
aaggcacttccccgtgaccccgtttcctccagtttcctaccttcctctcgtcccagcagccgcaagccaaaaccctagcaagcaaaccaccggagcagcggcgctcgcgcgggcggagccatgggcggacgacgattacaacgaaatcgacatgggctatgaggatgagcctccagaacctgagattgaggaaggggccgaagaagagcttgagaacaacgaagatgcccctgatgatgtcataggtggagagggtgaagataaggaacaggaaaagaccaagcgtgagcgcaaaa

SEQ ID NO: 506 - DNA, 295 bp, Zea mays
  misc_feature: Incyte ID No: 700549353H1
atggaagcatagatggctttaatgagctgaaaagagggccaagaagtggtatgtacaaaaaccagctggggcttgaagctactacccaagcaccagcaaaagagcaggatcttttgtttgctaatggtccacatcctgccatgaaggatcagtataatcaggctgactttgcggaaacatactcagacgctaaattcttcattattaaatcttacagtgaagatgatgttcacaagagcgttaagtacaatgtgtgggctagcactcccaatggtaataagaaacttgatgctgc

SEQ ID NO: 507 - DNA, 294 bp, Zea mays
  misc_feature: Incyte ID No: 700549354H1
agggcaggttctttgccttcggtcgtgtcttctcagggaaggttgctaactggtatgaaggttcggatcatgggtcccaactatgtccccgggcagaagaaggatctgtatgtcaagagtgtccagcgtactgttatctggatgggaaagaaacaagagtcggttgaggatgttccgtgtggtaacactgttgctatggttggtctggatcagttcatcacgaagaatgctacactcactaatgagaaggaggctgacgcttgcccaatcagagcaatgaagttctccgtctct

SEQ ID NO: 508 - DNA, 295 bp, Zea mays
  misc_feature: Incyte ID No: 700549355H1
agcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatg

SEQ ID NO: 509 - DNA, 295 bp, Zea mays
  misc_feature: Incyte ID No: 700549358H1
gcatgacgaagtgacatgcggcacagtccatggagatggggatgtcagttgccaggatgacgccgcgaaattggtagcagaagccatgggatcagatcgaaactcaagttagccgataccagatgttatggtcgctagatcggtgagagattggagagtgatatcgatgggcaggaacgtcagccgggggcctttgcccacggccccacggccgagcaagaggagggtttctcacttttaattcttgcctcctttatttctcatccattgattacataaataggccaactggctg

SEQ ID NO: 510 - DNA, 302 bp, Zea mays
  misc_feature: Incyte ID No: 700549360H1
agaggcttctggcttgagcgacttatctcgagttaccagtgtcgcatccttctttgtcagccgagttcgacacccttatcgacaaaatgcttgagaagattggaacacctgaggcacttgccttgagagggaaggctgccgtcgcacaggccaaactagcaaatcggctctaccagaagaaattctctggcccgaggtgggaggcgttggccaagaaaggtgccaagaaacagaggttgttgtgggcatccaccggtgtcaagaacccagcttatcccgacactctttacatcgacagtctc

SEQ ID NO: 511 - DNA, 306 bp, Zea mays
  misc_feature: Incyte ID No: 700549362H1
gtgaaatagcctccatggaataacccaaagattggatcaaaatgatgcaataaccgctatgtggcaaatgattcatttgacccagtcggcaaagaggcccgcactagataggtgacccaataaggcaataatgaacccatggtcggagtagtggtgtcattacatgaacataagttactatttaattagcatcgagaatagaaggtggcgatcatttcctagctcctgttagtgtccctgaacataagttacccatggtctgagatgttacatctttctgagccatcttctctcggtttgtacttc

SEQ ID NO: 512 - DNA, 293 bp, Zea mays
  misc_feature: Incyte ID No: 700549363H1
  unsure 167, 242: a, t, c, g, or other
gaagtagcgcgctcgcgtcaccctcgttggtgcttgtgctacttgtgtggacaggagacaggccagtggactcgtagccctaggtatcatccatctgcttggctgctccgccatgtctctggtctgtgctcaactgctcatacataaaccgccaggttcttggagcnctcttggggtgctctgcgtcatggtgtctgtacattataagtgcgcggattaactagatttgttggcaagaactnactcttttggtcatataagaacacggtcaagttaatattacatcgttctcg

SEQ ID NO: 513 - DNA, 314 bp, Zea mays
  misc_feature: Incyte ID No: 700549364H1
  unsure 146, 297: a, t, c, g, or other
cagacggccgtcttgtatacgtaccacagactgcagggcagcagcctctggcatgtgacttcgcctctgcctcagcaaggcggttcgtcgattcggcggcggtggcggatccagctccggcggaaagcgacagaggggagatgacngtggcagtaacagcaacagtagccgcaggggctggcaccgtccgtattgatgtttgcaatgccgctgatttgcaattagaagttagaacccagcaattagcatatttatcgcataccatgctggaaactgtactttgaattatgtgttttncctgtgtgcttcgtagc

SEQ ID NO: 514 - DNA, 292 bp, Zea mays
  misc_feature: Incyte ID No: 700549365H1
gacaacatgaccaggtgtgtgaaacaaattaaatggttcttccatttctaccttcgtgattcagtattgtgcatattgtcatccatctgttacaaattacaggtcgttttagtttttctagatacatagttttcttatacacctagctacatacatagcaaaagctaaaatgatttgtaggcaccatgtagtcctttcatttggtcggtttgttttgctataaatctgccattattttttctaaccgcagcaccatgtgttggaaggtgatgtggtggcagctctgccagtg

SEQ ID NO: 515 - DNA, 216 bp, Zea mays
  misc_feature: Incyte ID No: 700549366H1
tctgcagcccgacaccggcgaggtacagtaccaggtgtgctctcctgaggcgctggggaagctgcttgcaaagtccggcctgacacagccaacacccgaggcataatgtactggtttgctgtggcatgtgatgccttctactgctcttagacatggtttaagcagttatgcttctgttgtgtgaacttaaatattcgacaattatgtgttctattt

SEQ ID NO: 516 - DNA, 291 bp, Zea mays
  misc_feature: Incyte ID No: 700549367H1
  unsure 10, 114: a, t, c, g, or other
gcttaatgantggaaccaggaattggatgagatgactgagctagagaagcggacagcaaaggggaagtccatggttgcaacattcaagcagtgtgcacggtatctcagcccgcngtttgagttctgcagaaagaaggtacttcctgatgatatccgtcgagcgttgcttgttattgtcgagtgttgcatgaagcgagattatttagcagcaatggaccaatatatcaagttggcaatcgggaatgcaccatggcccgtaagagtgactatggttggcatccacgagcgttc

SEQ ID NO: 517 - DNA, 290 bp, Zea mays
  misc_feature: Incyte ID No: 700549368H1
cattagacggcagaacggtgtcaactttgggcatatcgggagctaggagggcaggcggctgccatggtctagtttttggtcttggtaccccatgtgcagggccggttgcaggtgaaggtgatattgctgcaccatctgggagaggaggggctcagcagtacctgagagagctgaaactatgtaaattatctgaccgcgaaggagtacggccagtgttaagccagtaaactggcgcagttggtccagagtagttaaggtaagaatgtagcaggtggagactggtaaatgcc

SEQ ID NO: 518 - DNA, 291 bp, Zea mays
  misc_feature: Incyte ID No: 700549369H1
gtgagtcagaagcagaattagatgaaacatgggcgatgatgcatcatgagtataacatgcaggaacacccgtggctcactgatctgtaccagcaaaggcataaatggtgctcggctcttcataaggatgcatttgatggtgggattgaatcaatggataggaatgagagtttgaacaatgttttgagcaacattgacgatgaatcagcttcgctttccacttttgtccttgagttggataaacttgcagggagttggcgtaaaactgagtctttagaggacattcagtgca

SEQ ID NO: 519 - DNA, 291 bp, Zea mays
  misc_feature: Incyte ID No: 700549371H1
  unsure 237: a, t, c, g, or other
attggatctatgagaataggaattggtaattcttatcaactgattggaatttccgcagcacctattgctccatttgatataaaggtttaagccctttttggggggcatttagctaaagtagggcacttttgtatttaccttttggacgctcttttcatatgataatggtcatacagataaaaagagggccgccaaatcaaagttgtcaaagggtatatcttctgatgaggaaagtangaaggacagcacaagggccgccgtaacaaatcttcaaaaaggagaaggaagaag

SEQ ID NO: 520 - DNA, 294 bp, Zea mays
  misc_feature: Incyte ID No: 700549373H1
caaaactctttgcaaaaccctgtttcatattgggacaggagatgctccagcatcaaaagtacatcccatggctgatacatctcgccaatctttgcaatctcaaaatgttgatttactagccatgctgcaaccaaaggagaagcctcaagttcctactggtaattcgggtctgccactatgctccaattaccctgaagcaagtatcgttaatcccaacttgcatagtggagatcttgctcaaggggcccttaatatgcgtcaagatatgcagaatcccagaacattggtattggg

SEQ ID NO: 521 - DNA, 235 bp, Zea mays
  misc_feature: Incyte ID No: 700549374H1
  unsure 27-28, 33, 152: a, t, c, g, or other
gtaaaacttgatgaggaatatgtatgnncaganaactattctggacccacgctttctttgcatacatattcctcatcaagttttacaaaactgtagtccgtggactttgtgtcaatttaacataactgatgataaagttagtcatgtacggngacaataaaacatgcaaatcagcatgggcttcatccgttagcttgggggcaaaggaagcgtgggtccagaatagttttctgtg

SEQ ID NO: 522 - DNA, 297 bp, Zea mays
  misc_feature: Incyte ID No: 700549375H1
  unsure 23, 27, 63, 79, 95, 102, 122, 160, 197, 247, 261: a, t, c, g, or other
ggctggttcatcgatcagaaganaggntacatcgctgttcctctctggtttcagccccatttncttggaacgtgcagtnctgggagtttgaacanttcatcnacagaagccaactcgtctanaacaacaaaggcggtatctacagggagatcctaccaanggcggagtacttctcccaggcactttacaccttcganatcggtcaaaacgacatcacctcaagctactttgttaacaataccaccgnagaagtcgaagccntaatccctgatctgatggagaggctcacatctataa

SEQ ID NO: 523 - DNA, 304 bp, Zea mays
  misc_feature: Incyte ID No: 700549378H1
ctgctgatagtgaagaccagccttctgatggcagttttctgaacctattacccacacaactggagctgccagagagccttgagccctctcctcactccagtatctcttctgaggattcccaagcacgaaataggtagcaggtctctattcagaggacaagctccataaagtttgcttctgaagagctgtttgtggtgctcagcagccatctaatgtacattgtcctgtacattgttactggtttccaaagttcctttggcaacgacacgaggaggttggttgtcatagagagggggaggtattt

SEQ ID NO: 524 - DNA, 307 bp, Zea mays
  misc_feature: Incyte ID No: 700549380H1
  unsure 69, 245: a, t, c, g, or other
gagcaattgaaaatgcaagaaatggtaaacataagcatcaagtactcctggatgctggttggggttcangtgtattgagggatgaagatgcccttagccttgatggttcattttatgggaacgttgggcgatttatcaaccacagatgctatgatgcgaatttagttcagatccctgttgaagttgagacgcctgatcatcattattaccatctggcatttttcacgaacaagaaagtagaggcnttgaagagctaacatgggattatggcattggtttgatgatacggaagggcccagtaaccatt

SEQ ID NO: 525 - DNA, 290 bp, Zea mays
  misc_feature: Incyte ID No: 700549385H1
ccgttgaagagctgctcaacatagatccggatatgtttcccgaagaaggatgtactgttactatatcaagcatcgtgcaaaatagcagatggtggtacccatcttgctccaggtgccacaaatcttcatctcaaacctcaactggatatcactgcacatcatgtggctgcacaaatattaaatttagatacaagctcagcttcattgctactgatggaacatgcgaagcagagttcttttgttttgatagcatagccagaaaaatagtaggagaaccttggggcaacctt

SEQ ID NO: 526 - DNA, 289 bp, Zea mays
  misc_feature: Incyte ID No: 700549386H1
  unsure 115, 180: a, t, c, g, or other
aacaccttctgaaaacaacaccttctgaaggtgttgtttccagcttttctttggaggcctcacactgaaaagctggaaaaatattgccaatttatctggtggtgagaagacacanagttcgctggctttggtgtttgctcttcaccactataaacctactcctttatatgttatggatgngattgatgctgcgttggactttaagaacgtatcaattgtgggacactatgtgaaagatagaaccaaagatgcgcaattcatcattataagtctgaggaacaacatgttt

SEQ ID NO: 527 - DNA, 164 bp, Zea mays
  misc_feature: Incyte ID No: 700549388H1
ggtagtgagaattgagatgaacaggtgtcagagttgtcatgaccaatatatatgttattgtgttttgaacactgaatctgtgtattagactattagtgccagtactagtattggatctgtaagtttttttttgttcgtgaatcaccagtgggtggactgggtgt

SEQ ID NO: 528 - DNA, 292 bp, Zea mays
  misc_feature: Incyte ID No: 700549390H1
  unsure 10, 21, 114: a, t, c, g, or other
tctctttggnccgaaaccganagctagtgcttgattcggtcgtttttgggcaccgaacacgttcttgggaccgccgccgccgcccctacttccagtcccagctgctcaggtctnccatcggcctcgagccctttgccggcgacgagcactcacaacaccagggtgtaacaatgtcttcttcaatggaatcgtcataccttcctgctacaactgagtcatagcccaagcttcaagaggtaaggatgcttcagagtccattcaatcctttaccgtgtcattcaggacccatctt

SEQ ID NO: 529 - DNA, 292 bp, Zea mays
  misc_feature: Incyte ID No: 700549391H1
cagaagttctacaacgtgttgattgaggagctgcctgccaatgttgctgaccttctgtgatcaatttgaagaaaaaacaaaacaaaaaagggtggtgagggaacctggtaaggattggttttgtcgaaataccgtgggagagggggtgataaggacggtggggggtttctatgttgaagtcgtggtcatggacaatttgtgattttttctcctttatgccatgttttggaatttttgtagctgcctaggccttgtggtaatgtgctgctgtgggggttcattagtatgaaga

SEQ ID NO: 530 - DNA, 297 bp, Zea mays
  misc_feature: Incyte ID No: 700549392H1
gcacatttgtctggaaacaattgccttggatgtgctgctggatctgatcttcataagtgggctgccgccgagaaattccagccatcttcaaagtcaagtggtcatctaaatggtactggccaaaaggtgcatagcttagttgattctgagaaaccaagcaatcagagctttgccatgattgtgaaatctcacacattaaggctccctgtcggtaatccggatgggacaatcattataagaaccgaccagtacaacagagatgatctccgagttgactatatgtatgcaaagttcttt

SEQ ID NO: 531 - DNA, 301 bp, Zea mays
  misc_feature: Incyte ID No: 700549393H1
  unsure 240: a, t, c, g, or other
gagaatgaagcttcttcaagatcttgttcctgggatgcagtaagatcactgggcaaggcagtcatgctcgatgagattatcaactatgtacagtcattgcaacgacaagtggagttcttgtcaatgaaactttcaactgttaaccctgaacttggctttgacattgagcagatcatatccaaacaaatgatgctttcacaagacagacatcttgctttctatggagtcgatccaggatcnagcagccttactgctccattcaaccaaggaatcgtgcagccagcaatgatgtgcaacattc

SEQ ID NO: 532 - DNA, 304 bp, Zea mays
  misc_feature: Incyte ID No: 700549394H1
  unsure 159-181: a, t, c, g, or other
agagaagcaaccctatgtggatcaagctgggcagaagaagcaggactatgagaagaccaagggcaaatattgagaaggagagcacaagctcaaagaaggctaagactgatgacgacgatggctcgaagtccgaggtcgatgatgaggatggcggtagtnnnnnnnnnnnnnnnnnnnnnnngtaaatagtatctccgctgtcgtgaggtagcaaatcgattgttaggtccccaattagctcactggtttgctatctttaatgttaagttgtttggaacaggtgtttatgaaggggatctattag

SEQ ID NO: 533 - DNA, 305 bp, Zea mays
  misc_feature: Incyte ID No: 700549395H1
  unsure 22, 27, 42-43, 50, 55, 60-61, 63, 163-165, 240, 248: a, t, c, g, or other
aagagatcctctgaggctttanctttncattgtactcaacanngctagtncagancttcnngnatgaaatgctcagataaagcctcagaggatctcttagctgagcatttcatcaaagaaggtctgactagccttgttgagtacaatgaaaagaagatgtttnnngttaaacttaaagagataaagtcaacactgaccactatgatcaatgatgaggctgcaatacctgaagtgattgancctgtcanacagcaagttaaggatgctaaatttcctgatctagaggtcatcgcatgttgtgggag

SEQ ID NO: 534 - DNA, 311 bp, Zea mays
  misc_feature: Incyte ID No: 700549396H1
atccagtatggcttgagctgcggcatgcacatatagctcatgttaatgaaacgctacatgaaaagatgaccagttttgtatcaaagaacaaagcagctcaactacagcaggcaagatctggtggagagttatctaccaagcagttgcagaaaatggttcaagctcttccacaatacagtgatcaaattgactagctcacccttcatgttgagattgcaggaaaactcaataacataatcaaagaacaccaccttaaagatgttggacagctagagcaagatcttgtgtttggtgatgctgggacaaaagaa

SEQ ID NO: 535 - DNA, 180 bp, Zea mays
  misc_feature: Incyte ID No: 700549401H1
cacaagatcaccaagcaggtggaatactattttagtgacatcaaccttgctactacagatgcatctgatgagattcattaccaaggattctgagggatttgtgccaatatcagtaattgctggcttaagaaagtaaaaacttctgtgcgcaataatgtgatgcttgctgcggctctccga

SEQ ID NO: 536 - DNA, 271 bp, Zea mays
  misc_feature: Incyte ID No: 700549402H1
gaacagacagatctgtgtcaatgaagattgccgcccctctgatgtatactattttgcaatgacgggttgattataagctactccgcatggagaaagagatgttgacagaagccaccgaggtgattgtatggcgtgagatcctgtctgtcctggagattggagagtttgctccagcggaacggaagtcatccaacttctatagtagctttactgctgtggcaaaatgtagtcccgtcgtcgtggtcctgggagtctggcccttgcaggcaga

SEQ ID NO: 537 - DNA, 263 bp, Zea mays
  misc_feature: Incyte ID No: 700549403H1
  unsure 188: a, t, c, g, or other
gtaggatctagtcattcaagatcacctattaggaagagtgagagaaaacatagcaaaagtcctgatggtggaaaaaccgattcatccgtaagttttagaagttcagataacgaagacaaaggaaaagatgaaaggtacttaagcagtgatgagaaaaatggccgtgaagaacaattgaaacaaatgcntctggacatggaagcattgcgtgaagataaatcaaagctggaggcgatattggagaagaagactgatgaagagcg

SEQ ID NO: 538 - DNA, 255 bp, Zea mays
  misc_feature: Incyte ID No: 700549405H1
  unsure 104, 155, 179, 190, 204-205: a, t, c, g, or other
aagaactggttgccaaagatctccatggcactgaatggcattttcggcacatttttcgagggcaacccaagaggcatctccttaccaccggctggagtgtcttngttagctcaaaaagattggtttctggggatgcattcatcttcatgagaggngaaaatggtgagctacgggttggngtaaggaggcncatgagacaagtanntagcatgccgtcatctgtcatatcaagccacagcatgcatcttggagtat

SEQ ID NO: 539 - DNA, 255 bp, Zea mays
  misc_feature: Incyte ID No: 700549406H1
gtgctatatgtttcaagaagcctttctgctagttcctattttcttggttgttcaaattggtatcctggatctacccagaacatttccaaccgcagttaaatcctggaagcttgcagcattcttttgcaataaacagagcttgcttacccggatgaagatgttggaggacccagcttttaaccaaccttagttatctcaatcgcctatggttggccgacagctatgaggtaaatggcttacggtatcaatcatttg

SEQ ID NO: 540 - DNA, 256 bp, Zea mays
  misc_feature: Incyte ID No: 700549409H1
aagcaattctccaaattagggtttctttccgcttgctttccagtttgcggcatcagtcggtggcgcctgcgatggagtctctgttcggccaatcgcagcggaggaggagggcgggcggcagcggcttcgaatcgctcaagcgtctgggtcacatctcacccgctgtgcagtcccacctcaaacatgtgtacctcaccctatgctccgcgctggccttctctgcactcggcgcgtacctccacatcctcctcaacgt

SEQ ID NO: 541 - DNA, 257 bp, Zea mays
  misc_feature: Incyte ID No: 700549411H1
cgagctatgggtaccagggagctccagcagatcctaactatggaagtgcctacccacagccaggatatggtcctcctggtcaggctactggtcaggctggttatgcctcctcagcagccagccagcctgcgtatggccaggcaggatacacccagccgcctacaaatcctccaggttatgagcagtctgcggcaccagcaacaacccagagcggctatgctgcgcccccagcaaatccacagcagcctgctgcagca

SEQ ID NO: 542 - DNA, 250 bp, Zea mays
  misc_feature: Incyte ID No: 700549412H1
  unsure 50, 129: a, t, c, g, or other
ctcgcgcaccgctcctgtccaccctgccaccgccgacgccgcgccgccgnagcaactgtcaccgtcgctatggcccgtatcaaggtgcacgagctccgggggaagagcaagacggacctgcaggcgcanttcaaggagctgaagtctgagctctccctcctccgcgtaccaaggtcaccggcggcgcacccaacaagctctccaagatcaaggtggtgcgcacctctatcgcgcgcgtgctcacagtgat

SEQ ID NO: 543 - DNA, 261 bp, Zea mays
  misc_feature: Incyte ID No: 700549413H1
  unsure 94: a, t, c, g, or other
ccagcttgatggttttgaagcttcaaacaaaattaaggttttgatggcaacaaacagaatagacattttggatcaagcccttttgaggcctggncgcatagacaggaagattgagtttccaaatcctaacgaggactcacgtttcgatattctgaagatccattcaaggaaaatgaacttgatgcgtggtatcgatctgaaaaagatcgcagaaaagatgaatggggcctcaggagctgagctcaaggccgtctgtacaga

SEQ ID NO: 544 - DNA, 274 bp, Zea mays
  misc_feature: Incyte ID No: 700549416H1
  unsure 11, 23, 43, 58, 63, 69, 86, 178, 185, 188, 246, 256, 263: a, t, c, g, or other
ggagcttatgntgctgtcaagcnagagatgatgcaacctactngccagcatcaagganagacnagcatntgcaatgattcacagangctgaggaaaagaatctgataactcctggaaagacaactctgattgagcccacgtcaggcaatatgggtatcagcatggcatttatggccgncatgaanggntacaagatggttttgaccatgccctcttacacaagcttggaaagaagggtgaccaggngcagtggttngagctgnatgaatcctcc

SEQ ID NO: 545 - DNA, 269 bp, Zea mays
  misc_feature: Incyte ID No: 700549417H1
gttatttccctcttcattttcctggtctgcagccagctcccactctatggcattcattcaacaactggagctgatcctttctactggatgcgtgttatcctcgcatcaaaccgtggcactgtgatggagttgggtattactccaattgtgacatctgggatggtaatgcaacttcttgttggatcgaagatcattgaagttgacaacagtgtgagagaggatcgtgctctgctgaatggtgcacaaaagttgcttggtatcctgattgc

SEQ ID NO: 546 - DNA, 262 bp, Zea mays
  misc_feature: Incyte ID No: 700549418H1
gggttcagaagtcaagttcaggctcgtgagtttgtccattgatgatactcccataaaaaacaggtattgaagtcgtggagaagtcttggattctgcagcgcattcttctttgttagctgttgatcctgtgaagtatggtaacgaaatgtccaatggtcaaatgctaccatgaagtgcaatctcagatctgtcagtcgaagtctcagctgaaaagagggctcggctgatttgattcacagaaatagtgaagtaacataacccg

SEQ ID NO: 547 - DNA, 246 bp, Zea mays
  misc_feature: Incyte ID No: 700549420H1
  unsure 50-51, 168: a, t, c, g, or other
ctcgcgcaccgctcctgtccaccctgccaccgccgacgccgcgccgccgnngcaactgtcaccgtcgctatggcccgtatcaaggtgcacgagctccgggggaagagcaagacggacctgcaggcgcactcaaggagctgaagtctgagctctccctcctccgcgtancaaggtcaccggcggcgcacccaacaagctctccaagatcaaggtggtgcgcacctctatcgcgcgcgtgctcacagt

SEQ ID NO: 548 - DNA, 253 bp, Zea mays
  misc_feature: Incyte ID No: 700549421H1
  unsure 21, 59, 96, 105-106, 134, 143, 147, 159, 177, 180, 194, 202, 243: a, t, c, g, or other
ctcgagcctctcgcgcaccgntcctgtccaccctgccaccgccgacgccgcgccgccgnagcaactgtcaccgtcgctatggcccgtatcaagganagggagctnncggggaagagcaagacggacctgcaggngcagtcaangagntgaagtctgagntctccctcctccgcgtancanggtcaccggcggtncacccaanaagctctccaagatcaaggtggtgcgcacctctatcgcgtncgtgctcaca

SEQ ID NO: 549 - DNA, 253 bp, Zea mays
  misc_feature: Incyte ID No: 700549422H1
attcagaaaagcaaagactcatttgacgccctcatcgaagcatattgccagggctcccgattggatgatgcagtgaaggcgtacatggagatgcgtaaatccaggtttaatccagatgagcggtcccttgagggagtacttaatgcctactgcatagcaggggtcatagatgagagtaaagaacagtttgaagaacttcaatctagtgtgactatgcccagcgttattgcctattgcatgatgctgtcactat

SEQ ID NO: 550 - DNA, 82 bp, Zea mays
  misc_feature: Incyte ID No: 700549423H1
  unsure 13, 20-21, 37, 49, 60, 80: a, t, c, g, or other
ttatcacattcancatcctnnattgactgctctgtcngggcgctaacangccatgaccgngaaaggttgctgacgtccantt

SEQ ID NO: 551 - DNA, 258 bp, Zea mays
  misc_feature: Incyte ID No: 700549424H1
  unsure 87, 102, 120, 225, 244, 248, 251: a, t, c, g, or other
aggaatacaagggcatcttctggcaggaggacatcatccccttcttccagaacgtgaccataccccaaggactgcgacaccgtccanaagtgctacatctancctctctggacaagtganggagaagctgggcacgattgacccctactttgtcaagctcggtgacgccatggtcacctggatcgaggcctgggatgagctgaacccgtcgacccctgccgccgnaaatggcaaggccaagtanatgngcnatcactt

SEQ ID NO: 552 - DNA, 254 bp, Zea mays
  misc_feature: Incyte ID No: 700549425H1
ggatgaatcgcaacgaggcggccaaacttgacgtcgctcgtaagtcattgacttctgacagcacagaaagtgatatcctacaagcactccagtatgttgatgagatatgtcagagaagtcgatccaataggcaggttgtgagaagagatgggttgataatcatgattgctgacttgttgaagaatagcagtacgaaagtacggcaagcggcactagggactctttgctccattgcaaaagatgacaatgacaat

SEQ ID NO: 553 - DNA, 254 bp, Zea mays
  misc_feature: Incyte ID No: 700549426H1
  unsure 175: a, t, c, g, or other
gctcttctgggctcatctgcaagcaagtacagtgcattagactgtcagaggccagaactattgaataagaggaaagttcagggaaaaattcttttgtgtggctattcattcaattacatttctgggacagcctcaataaagaaagtgtctcagacggccaggagtctcggcgcantgggctttgttgttgctgtggagaatagttacccaggaacaaaatttgaccctgtaccagtcagcatccctggaattct

SEQ ID NO: 554 - DNA, 239 bp, Zea mays
  misc_feature: Incyte ID No: 700549428H1
  unsure 38, 59, 179: a, t, c, g, or other
gataaagagagatttatcatacacgcaaaagttccatnctcctgtcttatttgtttganctgtatttcgtgatgataaatctctcttggagataattttggatgagaagaatgctgaagtgcgcaagatttctagcagattaaatgatcttgatctgcagctaaggaaggagaaagagnaatgccacaggatgacctcaaaaattaaaaagttccttaaagcccatgctcgctttttga

SEQ ID NO: 555 - DNA, 259 bp, Zea mays
  misc_feature: Incyte ID No: 700549429H1
gagtacatggaacatgatcttaaaggtgtcatggagaccatgaaacaaccatatacccaaagcgaggtaaagtgtttgatgcttcagctgctagaaggtgtaaaatatctacatgacaattgggtgcttcatagggatctgaagacctcaaatcttttgttgaataaccgtggtgagttaaaaatatgtgattttggactgtctcgtcaatatggaagcccattaaaaccttatactcaactggttgtgactttgtggt

SEQ ID NO: 556 - DNA, 259 bp, Zea mays
  misc_feature: Incyte ID No: 700549430H1
  unsure 9, 63, 254, 258: a, t, c, g, or other
cgtgctttntgcacaaacagtgagcgaaatgtgagtgccgtctggggaaagctggcagcaganatcctaatgcagaactgggacgtagctttggaggaactcaaccgcttgaaggaaataattgattcaaagaacttctcatcacctctgaatcagctctagaacaggatatggctgatgcattgggctctgttcatcttctttaaccatgaaaatggtagaaatgggatcatgatctgttcttccagacaggnactnt

SEQ ID NO: 557 - DNA, 271 bp, Zea mays
  misc_feature: Incyte ID No: 700549432H1
  unsure 53: a, t, c, g, or other
ccgcgaggttgtcaggattcaatatgtcgaccagcacattcgctacttcctgncacgctgttgggcaatgttagaacaacgcaggcctcccagacagcggtgaagagcccttcgtctctaagcttcttcagccaagttacgaaggttccaagcctgaagacctccaagaaactggatgtctccgccatggctgtatacaaggtgaagcttgtcgggcctgaaggtgaagagcacgagtttgatgtccagacgacgcctacatccttgacgc

SEQ ID NO: 558 - DNA, 277 bp, Zea mays
  misc_feature: Incyte ID No: 700549433H1
  unsure 10-11, 53, 85, 168, 199: a, t, c, g, or other
ggtatatcannactgttctacctacggaaaatatatccagatgaatttaggancttccttgcagcggatagattttgaagtgaangatgaagaagaacttaaagataagatggatgagatctgtaattgggcgtcttataggggtcaaactctcaccagaacagtaanaggaatgatgtactacagaaaggcacttganatccaatgccttcaagatatgacagatcctgctaaagttgaccgagacagatcaataggatcctaccaagagttgcat

SEQ ID NO: 559 - DNA, 255 bp, Zea mays
  misc_feature: Incyte ID No: 700549438H1
  unsure 131: a, t, c, g, or other
cacccccgtgacttcccgatctccggcgatggccgcgcggcgccttcggatcccccgcatctaggtggctgcgcccgtctgcgctgctcctcctggtcgcctctgctctcctctcggccccgtcgccggcncgggccctccggttcgacctcgagtccggccacaccaagtgcgtctccgacgagatcaaggtcaacgccatggccgtcggaaagtaccacatcgtcgggcccgaccccaactcacccgacgccc

SEQ ID NO: 560 - DNA, 251 bp, Zea mays
  misc_feature: Incyte ID No: 700549439H1
gagaatacatacattaattattgcatgaatccagtaaaaagttaaaacgaattttaatttgagacggagggagtattacttaatttattttggcattctcatcaacttcatgccatagtaaatgatacttggcttcatgaccttcaccaagttgggtcttttttgaacttttgaaggagcataaacttggcttgtcttttcttacattttcagttgctcagtgcacgtgatatggctgaacggaaagtaat

SEQ ID NO: 561 - DNA, 254 bp, Zea mays
  misc_feature: Incyte ID No: 700549443H1
  unsure 138: a, t, c, g, or other
caattcaagcgcaaatcacgttgagaagcattgctagctcgacgcagatgcatgacctgatcaagggcacactggaaaatcagaggaatttcgtctgacatgtgcacggtgcaatcgttcacccatcctacagctggncagtttacatcaagcgaattacttatctagtccacttaggcattacattagatattaataaaggtcagtctagatgtaccgaaatagaccaagataagtaattcgcttgatgtaaa

SEQ ID NO: 562 - DNA, 259 bp, Zea mays
  misc_feature: Incyte ID No: 700549446H1
cgtgctttgtgcacaaacagtgagcgaaatgtgagtgccgtctggggaaagctggcagcagaaatcctaatgcagaactgggacgtagctttggaggaactcaaccgcttgaaggaaataattgattcaaagaacttctcatcacctctgaatcagctctagaacaggatatggctgatgcattgggctctgttcatcttctttaaccatgaaaatggtagaaatgggatcattgatctgttcttccaggacaggtact

SEQ ID NO: 563 - DNA, 263 bp, Zea mays
  misc_feature: Incyte ID No: 700549447H1
gctttgaagatacatgaatacattgaatcagacatgaaaattgttgaaaaactcagttgtcataatcaaaaggaagtccgtcatgacaatgaagcaagacaattaccaaataacaaccaggatgtttgcttgaataagaactttttgcaaaaccgatatcatgtggagtctacacgagctcccagagcaacacatcagattcctatatatcaaccgtttaaaattcaaaatactacagagtgtgatagagctagcctaagtaa

SEQ ID NO: 564 - DNA, 84 bp, Zea mays
  misc_feature: Incyte ID No: 700549448H1
  unsure 50, 52, 59, 70-71, 80: a, t, c, g, or other
gtgatccttgaaacgatgtacattctccaccttgaaacgaaacgatgtangnggtccanaaaaaaaaaannggggggccnccga

SEQ ID NO: 565 - DNA, 275 bp, Zea mays
  misc_feature: Incyte ID No: 700549449H1
  unsure 63, 113, 124, 155, 184, 194, 262, 269: a, t, c, g, or other
agagagatccggagcagccgcagtcccaccgaccccgccgccggtcgccctccatctcctcgncgctgcctctcgtttctcttttcaataatcaagatgagccgtggtggtantgccggtggtngtcaaagttctctgggtaatctctttggaancggtgagccccccaaaccagcagtggcancagctgcaantgctccacctgatgagaaaccaatctgctgcaaagaactgatgcggccaatcaggttgcttcttgggnttaccanccaaac

SEQ ID NO: 566 - DNA, 266 bp, Zea mays
  misc_feature: Incyte ID No: 700549450H1
  unsure 69-70, 82, 223, 244, 257: a, t, c, g, or other
aatatgaagaaatttcaatatctattgcggtgcctcaaactatgggcaagaaaaagaggacttgattgnnatactacttggnttctttgctggaattcatttggctattcttgctgcatatgtttgccgcagacatccaaatgctagtataaatactctgctgtctttgttcttcgatatttttgttcactggccgtggcctcttccagtgagtttgcttganccgccagttctttgtgggggncctgatggtgctnctcatgccc

SEQ ID NO: 567 - DNA, 251 bp, Zea mays
  misc_feature: Incyte ID No: 700549452H1
aaaaactgcttaatgttattgccaagcttgttgctgtattgggaatactgcgaggtacgacggagtccagtgatttgaaaaaaggtttggttaatgctattcaagacctatatgatgttgttcatcatgaagcgttttcggttgatatgagtggccacattgaagactgggatcaaattaatttagcaagggctgaaggtcgcctcttcaataaactcaagtggccaaatgatcccaaattgaaagacttg

SEQ ID NO: 568 - DNA, 252 bp, Zea mays
  misc_feature: Incyte ID No: 700549453H1
ctggaaaagagttcaggcaatgaacagctgattctaaccaccatcatccggcacttggatcacaaaaatgttttacacgatcctcagacaaaatcagatattattcagacagcaacgtccttggcacgacaacttcgatctcgaggatttgctgttgaacttgtagtggcaggtgacttgtgcaagcacttaaggaaaacacttgaggccgtggaatcaggcaatgttgaagatcagaatttgaacgaaccc

SEQ ID NO: 569 - DNA, 114 bp, Zea mays
  misc_feature: Incyte ID No: 700549454H1
catgtaaattatctgaggtatacttgcattattatgagtgctataatcttttcttttactacatgctctaaactgtatcgtgtattcaataataaaatgttaatttactccctc

SEQ ID NO: 570 - DNA, 258 bp, Zea mays
  misc_feature: Incyte ID No: 700549460H1
  unsure 137-159, 245: a, t, c, g, or other
ccggggatccctctccctccttcgatccagctcagctctcttcctcccgccccgtactcttcttgatccgttcactcatacttctcgagagaaaaggaagaggattcgatctgttgctaccgctagctgcggtactnnnnnnnnnnnnnnnnnnnnnnngtaccgtagaagaagggaagggaatccatgaagagatggggcagcagcggacaggccgccgattccttctaccaggtccgccccgnttgcagccaaaag

SEQ ID NO: 571 - DNA, 175 bp, Zea mays
  misc_feature: Incyte ID No: 700549461H1
gtttgatggttttctatgattatagcaaacagaacggtattaccaagcaacaaacaaaaggacatcgagcagtttgctataattgtttgatggttttctatgattatcgatcagcgggatgtgaagtactgtttacattgctcgcgttctaataaagtactgtttggacttgctt

SEQ ID NO: 572 - DNA, 259 bp, Zea mays
  misc_feature: Incyte ID No: 700549462H1
cacaaggataccttggtgtactattttgggacatgggaaagctgtcagttatgtgaggttcttggatccagacacacttgtctctgcatcaaccgacaacacattgaagatatgggatcttaaccagactaattgcagtggattatctaccgattcttgccgcctgactctgaatggtcataccaacgagaagaattttgtagggctatctgttcatgatggatacataacttgtggctctgaaaccaatgaagtgttt

SEQ ID NO: 573 - DNA, 263 bp, Zea mays
  misc_feature: Incyte ID No: 700549463H1
gaaggggacacctagtaaggacctggagagcaaaaaagatgctgtgaggcaaccctttggtgttaaggatatgaacaatacaagagcatgtgatgcagaagggagctccagcagcatgttttggttcttgaagccctgcactttccttgtggagtagcgtcataacactacaattttttaacgaacaacacttgatatagttagaatccattacttcattcatttccaaatattctctgttcctatttgatcgattcattcat

SEQ ID NO: 574 - DNA, 270 bp, Zea mays
  misc_feature: Incyte ID No: 700549464H1
gcgcagactgcaagtcaaagggtcctcgatgggcaagtgtgaatctaggtatctttatatgcatgacatgttctggcattcatagaagcctgggggtgcacatatctaaggtaagatctgccaccctggatacatggctgccagagcaagttgcatttattcaatcaatgggaaacgaaaaagcaaatagctattgggaagcagagctgcctcctaactacgatagggttggaatagagaatttcatccgtgcaaaatatgaggacaaga

SEQ ID NO: 575 - DNA, 273 bp, Zea mays
  misc_feature: Incyte ID No: 700549465H1
  unsure 177, 251, 256, 270: a, t, c, g, or other
ggtatatcaatactgttctacctacggaaaatatatccagatgaatttaggaacttccttcagcggatagattttgaagtgaaggatgaagaagaacttaaagataagatggatgagatctgtaattgggcgtcttataggggtcaaactctcaccagaacagtaagaggaatgatntactacagaaaggcacttgaaatccaatgccttcaagatatgacagatcctgctaaagttgaccgaggacagancaatnggatcctaccaganttg

SEQ ID NO: 576 - DNA, 266 bp, Zea mays
  misc_feature: Incyte ID No: 700549466H1
  unsure 20: a, t, c, g, or other
ttaaaaagccggcggcgagnaaggtgggttggggaatctgaagcgatcagagaaggcaagcttgcttgcttgcttctccaccgaatcccccatctcgcgccctccgtctctcgccgcggagactcgcccccccgctgatggaccagctcgtcaatttcatcatccgcccgcccagagctgactacagtccaaatgatgatctattagagcaggagtttatgctgaagggaagatggttcctgaggaaggatttggaggtaaaaaat

SEQ ID NO: 577 - DNA, 262 bp, Zea mays
  misc_feature: Incyte ID No: 700549467H1
tttctgttttgtccacagaattagacaggaacatcttgtgtctgatcctggtacacttattccttcagatgtttctgttttgtccacagaattagacaggaatttcgtctctgataatcaacactttggccaagatgataataccaatctgttgggatcttctcttaggcggtgtatcgagctcagcgtatggttcttttgagtatgagttacttgaccgaagatccacttcaagcaatgttggtccttctgatactgatgg

SEQ ID NO: 578 - DNA, 243 bp, Zea mays
  misc_feature: Incyte ID No: 700549468H1
ccaatcgtaatattgtcagtagctctagattggatcaaaatccaggcaagaggggaatctataggcggaattgatccaatcgtaatattgtcagtagctctagattcgtcggtagctccagcatgagtgtcggtggtagttctgtgcctgtaaaaacttgggatggttgatcgcgtgtgatcagccgtcatgctcctccagtctctatgaacaagctaagctataatagtattttgctatcct

SEQ ID NO: 579 - DNA, 256 bp, Zea mays
  misc_feature: Incyte ID No: 700549470H1
cctacaatgcagaggaccatttgctcagaggaggcatccccttgttgatgcagcagttgttactaggattcggagatgtttagatgaagggactgaatttcatggtgatctgttaaattttagaaaagattgttctccatacatggccaggctgcaattaacacccatatacggagacgatgaagtaataacacactatatgggcattcagtttttcaatgattctaatgttgacttggggccatcttctggctct

SEQ ID NO: 580 - DNA, 254 bp, Zea mays
  misc_feature: Incyte ID No: 700549471H1
tgaagtatggcttattaataagatctggcttttggtttaatgctacatcattgcgagactggccactgctaatgtgttgccttagtctacccatatttccccttggtgcatttgcagtcgaaaagttggcattcaacaatctcattagtgatcctgctactacctgttttcacatcctttttacaacatttgaaattgtatatccagtgctcgtgattcttaagtgtgattctgcagttttatcaggctttgtg

SEQ ID NO: 581 - DNA, 251 bp, Zea mays
  misc_feature: Incyte ID No: 700549472H1
  unsure 227: a, t, c, g, or other
gaacaaatggagagtgccaaacgatcaggttggtttgctgcttctagagtctctgctacttcttggctacttttctttgttccatgctgggaaccaagctgttcttcggtggggaaagagtcccactatacttcacaaggtgtgcgacctgccatttgttttcttcagcgaccccgagttgatgcccatcttggctgctgctctgatcgctgtttgctacggttgcnatcagaacctaagcgttgtacagc

SEQ ID NO: 582 - DNA, 250 bp, Zea mays
  misc_feature: Incyte ID No: 700549473H1
  unsure 48-50, 56, 65, 144, 148, 176, 185, 202, 205, 211, 213, 226, 234: a, t, c, g, or other
tgttgctggattttctgatgcactcaatggaggatatgaatcatgggnnnccaganggcaaagangacctttcccaaaaagtggtccccatgattcatatcctccattgagtgcatcatggggaccactttttggaaaggtctncttngccttctgggtcattttccatctctacncattcctcnagggtctcatgggtcgncanggccgnantccaaccattgtnattctgtngtcagtgctgttggct

SEQ ID NO: 583 - DNA, 253 bp, Zea mays
  misc_feature: Incyte ID No: 700549475H1
agctactcagttggggcacagcatcttccgccctggccgggtgtcccatgccttgagtgaggatgcgctggcacatgctctgatggacaataagttcccaactgagacactcaaggattatgaggagtggactattgatctggggaagctccacttgggaatgccctttgcacaaggtgcctttgggaagctctacaggggaacatacaatgggatggatgttgctattaagcttttggagcgacctgaggct

SEQ ID NO: 584 - DNA, 254 bp, Zea mays
  misc_feature: Incyte ID No: 700549476H1
cagtgacaaatgttaagagtccagtgaacaagtggcgatgtggtgcggctcctatttcgtctatgatgactgtgcagcgatggtcgcgtggcccttcagccacccaaatcggaaagcctgctgttcacatggctagcgttgacttgaaaggaaaagcatacgatgtattgaggcagaattcttccaggtttttgttggaagatgtctacaggaacccaggtccgctccagtttgaaggaccaggtgccgattca

SEQ ID NO: 585 - DNA, 256 bp, Zea mays
  misc_feature: Incyte ID No: 700549477H1
gcgagggcgcggggcggtggacgacgccggggcacgaggagcggcccaaggggtacctcttcaaccggccgccgccggcgcgaggtgagacgcggaagtgggaggactgggagcttccctgttacatcacttccttcctcaccgtcgtcatcctcggcgtcggcctcaacgccaagcccgacctcacgatcgagacctgggcgcacgagaaggcgctggaacgcctcaagcagcaggagtagccgccgtctccggt

SEQ ID NO: 586 - DNA, 256 bp, Zea mays
  misc_feature: Incyte ID No: 700549478H1
  unsure 79: a, t, c, g, or other
cgcccttggcccccgctcgccggagtccccggggactctgttcgtcaccaccaggagggtgatttggctcagcgaaggnagaagggcaagggctacgcggtggacttcctcgccatctcgcttcacgctgtgtcgcgcgacctcgaggcgtacccctcgccctgtatctacactcagattgaggcagccgttggtacagaagaggaggctggggaatcaaatcctgaagcaaatgaactagagctatctagagtat

SEQ ID NO: 587 - DNA, 268 bp, Zea mays
  misc_feature: Incyte ID No: 700549481H1
  unsure 67, 177, 192, 211, 228, 234, 253, 257: a, t, c, g, or other
gcaggatcgactgattggccatgtccttgatgactgtaaacttgttacaagaattctggaagcaganaagaactctgctctgtcgtcagatttaactaagcatactatgtcttcagagggaagatctcccccaaggataggaattgttggtcatatgacacggatagctaacaggcnccttcagctggtcancacaaacatcatggttcantcacatttgcagcaaanttctgnttggattgagtggcatgcnagtnccctgacgaat

SEQ ID NO: 588 - DNA, 171 bp, Zea mays
  misc_feature: Incyte ID No: 700549482H1
  unsure 135, 147, 152, 157, 163, 170: a, t, c, g, or other
gtaccacattgcaatataaattgggtacccaatgcaatataaattgggtaccacattgccatctgcattggagatgccaatggcaagctcatgcttgcccatgctgccagtgcacaaggaatttcagttgttgancaaatatctggnaaggntcacntcctanatcattna

SEQ ID NO: 589 - DNA, 142 bp, Zea mays
  misc_feature: Incyte ID No: 700549489H1
attccggccctctcgcccgtccgtctcctgcccccgtccctggtcggaccacgagagccccggactgcgttcacctctgccttttgttcacccctgcacgcgttctctggcgctcttgtctcgtgcgtgcgacaacaactgg

SEQ ID NO: 590 - DNA, 251 bp, Zea mays
  misc_feature: Incyte ID No: 700549490H1
acactgcccgagacatagacagcgggacgtcgagatggccgacggggaggacgccgccgccgcgcgccgccgggccgccatcacagactaccgcaagaagctgctcaactgcagggagctagagtcgcgcgtcggcaccgtgagagaaagccttaaaactgcaaagaaggattttaccaagactgaggacgacttaaagtctctgcagagtgtggggcaaataattggagaagtactccgacctcttgata

SEQ ID NO: 591 - DNA, 88 bp, Zea mays
  misc_feature: Incyte ID No: 700549491H1
agatttctgatgatgaagatgaggaagagaagaaagacgctgaggagggaaaggttgaggatgttgacgaggagaaggaagagaaaga

SEQ ID NO: 592 - DNA, 256 bp, Zea mays
  misc_feature: Incyte ID No: 700549492H1
caaggctgaagcatttttcggcaatgaacaagctcaagaagatgggcattaagggttattgctgaaagcctgtcctgaggaagagattggaggcctcaaggagttgttcaagatgattgatactgacaatagtgggactataacatttgatgagctgaaagatggcttaaaaagggtaggctccgaattaacagagaacgaaatccaggctctaatggaagcagctgatattgataacagcggaaccatcgactat

SEQ ID NO: 593 - DNA, 259 bp, Zea mays
  misc_feature: Incyte ID No: 700549494H1
  unsure 24, 42, 225-226: a, t, c, g, or other
cattatggcttagagactatagtngcacagcggaggtaagangtcggaaagttctggatatacaaaactttatgcagaaccctcagctgcaggagtttgaattccagaactttccgacttcttacctccgctgtgctgctcatcgtgttgcacaacattatggcttagagactatagtagcagatagtttagtagaaggctcagttagcaggattgttgcaagannccacagcagaaagcaggtatcctgcaatttttt

SEQ ID NO: 594 - DNA, 263 bp, Zea mays
  misc_feature: Incyte ID No: 700549495H1
  unsure 53, 63, 84, 120, 214, 259-260: a, t, c, g, or other
ctgaagctaacttaagggaaatgagatggccaatggcaacactagtcatcgcntcaagctctncgcttttccttctaactctgnactcttcattcgctgagattttcttcgaagagagantcgaagatggatggaagagccgttgggtgctatccgattggaaaaggagtgaaggaaaagcgggtaccttcaagcacacagcaggaaaatggtntggggatcctgatgacaaaggtctcagacatataatgacgccaannatt

SEQ ID NO: 595 - DNA, 268 bp, Zea mays
  misc_feature: Incyte ID No: 700549496H1
ggaagtcaacattgacagtgtagcaactcttactggggtcatttcacagatatttgacaaagctttgatggaaccaactttctgtgaaatgtatgctaatttttgcttccatctggctggtgccttgcctgacttcagtgaagacaatgaaaagatcacattcaaaagattgcttttgaataaatgccaagaggagtttgagagaggtgaaagggaagaagctgaagctgataaaacagaagaggaaggtgagatcaaacagaccaaa

SEQ ID NO: 596 - DNA, 204 bp, Zea mays
  misc_feature: Incyte ID No: 700549501H1
  unsure 53, 58-59, 145, 174, 195, 198, 201-203: a, t, c, g, or other
atggccttaaaccaggccagaggaagattctgttctgacacataaccagaganctgannccaccttagcttccttgacaaaattcctcttgaatgaacaaaacagaatgttcctctggcctggtttaaggccatcaaccattgangaggaattttgtcaagggaagctaaggtnggctcagttctctggttatgngtnagnnnc

SEQ ID NO: 597 - DNA, 163 bp, Zea mays
  misc_feature: Incyte ID No: 700549502H1
attttcttcttcacatgaaccatgtttcttgctgtttcagtttactcccttgtaattggcagatcgtttcctaccataattttggctgaagagggttgtgcgatttatctggaactgtagctgaataaataatgtcgagaaatgtaccatccttgtgtttatc

SEQ ID NO: 598 - DNA, 183 bp, Zea mays
  misc_feature: Incyte ID No: 700549505H1
  unsure 24: a, t, c, g, or other
ggtgaaggatgtgcctgaagcggnaccggaagagaagaaagactcgtaattttgttgcgtgtcatatccattgtttgtgaagggtcgttgtgtgtttaccatacaccatgggagagacctggtcatctatgaacccctgatgttcctcattcgtttacatgtgctccagtttttcagtttctt

SEQ ID NO: 599 - DNA, 99 bp, Zea mays
  misc_feature: Incyte ID No: 700549506H1
  unsure 47-48, 50, 53, 76, 80-81, 90: a, t, c, g, or other
aagggcgccacctgcgacttcaccggcaccgccgccctcaccaccanngnccnaagttcttcaggctgctcttaanctannggtgcaagnggcgttgga

SEQ ID NO: 600 - DNA, 290 bp, Zea mays
  misc_feature: Incyte ID No: 700549509H1
gaagtacaagcctggtaagtttccattggctattgtcttggcgccaacaagagaacttgcaaaacaggttgagagggagttccttgattcctcccctttggaaacgctgtgtgtatatggagggactccaattatgcagcaaataaaacaacttaattatggtgttgatgtggtcattgggacacctggacgtgtgattgatctgctaaaaaggggtgctcttagtttggcagagatccggtttgttgttctcgatgaagcagatcagatgttgtccgtcgggttcgata

SEQ ID NO: 601 - DNA, 286 bp, Zea mays
  misc_feature: Incyte ID No: 700549510H1
gactggcaaaaaatggaaggatgtatgaagttgatacaactaagcacctgaatgaatatggtgaggcaggcttgcgaacattggcactatcgtacagggtgcttgatgaatcagaatattctcttggaatgctgagtttcttaaagcaaagacctctattgggcctgatagagagttgcaacttgaacgtgtctctgagttgattgaaagagagctgatccttgttggtgcaatgctgtagaggacaaattacaaaaaggggttcctcagtgcatagatcgtttgg

SEQ ID NO: 602 - DNA, 183 bp, Zea mays
  misc_feature: Incyte ID No: 700549513H1
ccatgttgtattatcgtagggcttgtaatgaccacatgccctggttagagttgttcattaggaccagaagctgcttgatttgtgtttcggtgatctagctttgggtagtttgtgcagttggaaggagacattttgttggttgtattgtattgcagcgcacagctagcaagtgttgttgtagcc

SEQ ID NO: 603 - DNA, 290 bp, Zea mays
  misc_feature: Incyte ID No: 700549514H1
cgacgcctacctgttcagcctgatcgacgaggacgacaagagcatccagccggggaacttcgagcggcactggggcatcttcacctacgacggcctgcccaagtaccagctgaacctggggtcgtcgaacgcgggcggcggtggcctcgtgagagccaagggcgtgaagtacctcgagaggaagtggtgcgtgctgaagccttctgtgaacctcaacgacccgaagctggccgacaacgtgggatacgcgtgctccatggcggactgcaccagccttggctacaagacgt

SEQ ID NO: 604 - DNA, 293 bp, Zea mays
  misc_feature: Incyte ID No: 700549516H1
gtcccttcaagcagaccaaaacgatgatacctgtggatcatgtggcgatggtggtgaactgatatgctgtgacaattgtcctgctagttaccatcaagcctgcttgtcttgccaggatattccagatggcaactggtactgctctagctgcctttgcgacatttgtggtgaagtaatcgattcaaaggagcttgtaacttcccttcctgctttagattgctcacagtgcgaacgccaataccatgtaaaatgtgtatctgccaaagttccgtgcaatgaggatggatctggta

SEQ ID NO: 605 - DNA, 293 bp, Zea mays
  misc_feature: Incyte ID No: 700549517H1
actagttctagatcccgggctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcatgagataccaagggcagcaagg

SEQ ID NO: 606 - DNA, 99 bp, Zea mays
  misc_feature: Incyte ID No: 700549518H1
  unsure 30, 38, 48, 51, 94, 97: a, t, c, g, or other
agagggtcattcatctggaacagcagcacntggttggncatttcagangtngcttttaaattaactccaggtgctgctgttccagatgaatganccncg

SEQ ID NO: 607 - DNA, 290 bp, Zea mays
  misc_feature: Incyte ID No: 700549519H1
  unsure 99, 131, 197, 287: a, t, c, g, or other
gccgataactctgtccgaatgtgggatcgtcggaatctgggttcaggaggacgtggttctccaattcacaaatttgaaggccataaagctgctgttctntgtgttcagtggtcacctgacagagcatctgnttttggaagttctgcagaagatggtttcttaaacgtgtgggatcatgagaaggtggggaagaaganaaattctaatgtcccagccgggcttttctttcagcacgctggtcatagggataagattgtagacttccactggaattcgtcagatccttngac

SEQ ID NO: 608 - DNA, 288 bp, Zea mays
  misc_feature: Incyte ID No: 700549522H1
  unsure 24: a, t, c, g, or other
ggaatactagatgcaaatagtgtnatttcagagccagttgtaatcgagggaaaagtgttccgtgagatgtctgaaagtgcaagaggagaggccgccgacaagataattgtgatggggagatcctcgccaaatgataaacttttgcttgtccaagctttaaaacgaaaaggccatgttgtagctgttactggtgatggcacaaatgatgcccctgcattgcacgaggccgatataggtcttcaatgggcattcagggacagaagttgctaaagaaagctctgacattat

SEQ ID NO: 609 - DNA, 297 bp, Zea mays
  misc_feature: Incyte ID No: 700549523H1
  unsure 115, 141, 172, 185, 204: a, t, c, g, or other
tcatctcttctccggcgaagaacccccagtcgcccaccagatcacttgttaaactttgttgaggggtgatggcggtttctttcgcaaacctcagctccgaggcagggcttaaaangcttgatgagtaccttctcactcgcngctacatcactggctaccaagcttccaaggntgacttggctgtntacacttcgttttcgtctnctccctcgtccaagtatatcaacgtagcaaggtggtttaatcacattgatgcgctcgtgaggctgagcggaattactgcagagggccaaggtg

SEQ ID NO: 610 - DNA, 290 bp, Zea mays
  misc_feature: Incyte ID No: 700549524H1
  unsure 13-14, 24, 40, 42, 112, 215, 279: a, t, c, g, or other
aagagagcttgannaggagctcanacaagtcacgaaacanangaatgaagctgttcgaagccaggattttgagaaggctggggaattgagagaccgtgaaatggaattgaangcccagataacagccctcattgacaagagcaaggaattgagcaaagcagaggaagagtctggagagacaggacctatggtcaatgaagaagatatccagcacntagtatcttcatggactggcatccctgtggagaaggtttccagcgatgaatctgataagcttcntaagatggaga

SEQ ID NO: 611 - DNA, 292 bp, Zea mays
  misc_feature: Incyte ID No: 700549525H1
  unsure 3, 33, 46, 80, 122, 125, 176, 178-179, 205, 271: a, t, c, g, or other
ttnttcttcctcagtagtgtcatttacgcttcnacttctctgcagnaactatgcctaaccctaaggtcttcttcgacatngaccattcgggcggtcaatctggctgggccgcatcgtgatgnagntctacgccgacgtcactccccgcaccgccgagaacttccggcgcgctttgnanncggcgagaagggcgtagggcggacgngcaagcccctccactacaagggctcgtccttccacgcgtgatcccgagtttcatgtgtcagggtgngattcaccgccggaaacggaa

SEQ ID NO: 612 - DNA, 288 bp, Zea mays
  misc_feature: Incyte ID No: 700549527H1
  unsure 21-22, 38, 153, 194-195: a, t, c, g, or other
gggttaggatcatcacctagnnctgatgatgatgatgngaggcttccagcaactggaccttgtgatcatcatcatcagggttaggatcatcacctagcccatcatcatccacccccaggagaagaccatctgctgaccacagttataagccanaaacccagagccaagaaggaacggacggaggaggaaaagannttcagggcgaagagcaaagtatttcctggccacacaactcgttgcagttcttgtgttccttcgctgatgggtggggttgatagttccgagcta

SEQ ID NO: 613 - DNA, 288 bp, Zea mays
  misc_feature: Incyte ID No: 700549530H1
agcggtctagcccatactccgcatgcaaacaacctctcggcctcatcaggcccgctgccctccggctccgcctccgccgatcccctccgctgaatcgaatagaagaatcgagcgccgctactggcgaggggctagcggtcggcgcacagcgcggtatggcgagcggcagagcaacggggagccaagcacggcaccgcaggcgaaccggtggtacgacctccggctgggctcttcctgccgtgaaccctcccccaccgccaattctgcaccctccgtatgaatttaagc

SEQ ID NO: 614 - DNA, 296 bp, Zea mays
  misc_feature: Incyte ID No: 700549532H1
  unsure 198: a, t, c, g, or other
attctgacatcctgggcagccactgttagaaggaagggcatccctgaaaaggatggtccggaaagcacatatgctgtattcactgttgaagaaccgaagaaaaaaagtggagcttggatcaagacagggggcaagaacaaaaaacatcaccttttatctagcatagttggggaaataaaggttacgcgtcgaaaatcnagatgcccccatacaaccgatgttcatgtacacagggaatttgtgttggttggttccaaatttctaccatcgtctgaagaatcaggtgattcaaatgt

SEQ ID NO: 615 - DNA, 293 bp, Zea mays
  misc_feature: Incyte ID No: 700549533H1
gtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggctttgctatgtcaaacacaagtgcagggatcgctgggtgttgcaccgtgtctgcattatctgtggttacattctggaccctgtattttctatgcttttatgcccctactgtttagtattaattatcaataaat

SEQ ID NO: 616 - DNA, 293 bp, Zea mays
  misc_feature: Incyte ID No: 700549534H1
gttcgaaagaaagggagaaaatgttatgcttgcttgccttgagggaagcgtcgccgtctgcccacacccgcaccgcacccaaccgcagcggagccgggagccgaaggccgagggtattcttccttcgccgctaagcacgcctcctctccacaggcagccgacccaggggaagcgtcgccgagcagggaccaatcatattgaactcagatttggagcggaccaggagggggagccattgccggtgttctgattgctgctggaggtcgagggatggtaggggtgctgtcgaatcg

SEQ ID NO: 617 - DNA, 192 bp, Zea mays
  misc_feature: Incyte ID No: 700549537H1
  unsure 26-27, 77, 93, 140: a, t, c, g, or other
agcgtactcgtgaggggaagtgcggnntagagtggttaattagggctactctactactaccattgtattttttttgntgctgttgacgatgantaattaggacgcctaatatgtagtacggggtaggttggttgtgtgtnagcttggcgcgtgctatcagagaattgatgagaaaaaggtaagatggaaata

SEQ ID NO: 618 - DNA, 279 bp, Zea mays
  misc_feature: Incyte ID No: 700549538H1
  unsure 126, 128: a, t, c, g, or other
gagttctccgaggcacgcgaggacctgggccgccctggagaaggactacgaggaggtcgccgcagagggcggcagtgatgacggtgacgaggaggaggaatactgatctgcttgcatgaatctgtntngctgtcgagccaggttgtggtgttgaaaaacctttgtttgtgtcctggccccctgggtaatgtttgggtgtttccttccatcatcacttgctgaactgctctagtatttgcattgtaattgaagtctgtcgctttaagcactcttggttct

SEQ ID NO: 619 - DNA, 290 bp, Zea mays
  misc_feature: Incyte ID No: 700549540H1
  unsure 17-18, 22, 39, 43, 59, 61, 66, 71, 80, 109, 111, 115, 124-125, 128, 136,: a, t, c, g, or other
aacgatataccaactgnnccantatccccaacaattgangcantcattttgctccacgntncagtnaatgncatcctctnagaaacaccattcaagtacaaggcttgtngnaccntcagacaannttngctgtatncnngnggaaggnnggcaggtgattactgaaatgagangacnaactggggctgaaattcgagtttactcgaaggcagatanaccaaaatacttgtctttggtgatgaacttgtgcangtgactnaatatntgctaanagcatcaacatatttcta

SEQ ID NO: 620 - DNA, 288 bp, Zea mays
  misc_feature: Incyte ID No: 700549541H1
  unsure 133: a, t, c, g, or other
tgtgggctggtttccagtgggcatcaaaggagggtgcactggctgaggagaacatgcgtggaatttgctttgaggtctgtgatgtcgttcttcatgctgatgctatccacaggggtggtggtcaggtcattcncactgccaggagggtcatctatgcctctcagctcacggccaagccaaggctgctggagccagtctacctggtggagatccaggccccagaaaatgcacttggtggtatctacggtgttctgaaccagaagagaggtcatgtctttgaggagatgc

SEQ ID NO: 621 - DNA, 243 bp, Zea mays
  misc_feature: Incyte ID No: 700549542H1
tccagcaactggaccttgtgatcatcatcatcagggttaggatcatcacctagcccatcatcatccacccccaggagaagaccatctgctgaccacagttataagccaaaacccagagccaagaaggaacggacggaggaggaaaagaaattcaggcgaagagcaaagtatttcctgggccacacaactcgttgcagttcttgtgttccttcgctgatgggtggggttgatagttccgagcta

SEQ ID NO: 622 - DNA, 290 bp, Zea mays
  misc_feature: Incyte ID No: 700549543H1
  unsure 186, 258: a, t, c, g, or other
tttcttttctgcttccagacattgtccacgagctagtgcactggtgtcgcttcgcaaccaaattaaggactgaggcatggcatccaagggcgtcctcttcttgggctctcaacctcctgttcttcacagtggccaacgcctgcggcagctgcccgaccccaacgcccccggtcgagccaccgccgncgcctcctgctaccccacccccttcatcctccagtgggaagtgcccgctgaacgcgctcaagttcggcgtgngcgtcaatgcgctcggcctcgtcaaaggcgag

SEQ ID NO: 623 - DNA, 100 bp, Zea mays
  misc_feature: Incyte ID No: 700549544H1
  unsure 75: a, t, c, g, or other
ctttgtttctgaatggtgaatatgcatactgagagctgtaaggcttaacaaacttttgacttctccaacattgtnccaacgtggctccttttagactggg

SEQ ID NO: 624 - DNA, 286 bp, Zea mays
  misc_feature: Incyte ID No: 700549545H1
  unsure 22, 157, 217, 266: a, t, c, g, or other
ggcaagggcgtgggtgctgatnatagcgggggtgatggcagaatgaagagcacacaagagacggctaggagtggcaaggggaaggacgttttgggggatggaggaagtaagggaaaggggaaggggaatgggaataaggctgtaggcaacaaggaanaaaggggtgaccataaggttgcagggtttatatttatgtgcctgcaaagactaagaaggngtgctaccagaatcgcttgtttgggatgcctggtgggaagattggaatngtccagaagataaggccagg

SEQ ID NO: 625 - DNA, 289 bp, Zea mays
  misc_feature: Incyte ID No: 700549546H1
cctcagttgccacagtttgccatgcctaaggttagacaaatttgaccgagctaggcatgtgtttggtttatagccaagatttttcttctactgtgtaggtcccacttgtcaatttgtaaaagtgtggcatattcctttaggcataccacagttgtggcgcagaatttgagtgaggcaagtgtggcagaaatatgtggcaagttttggcaacttaagcatacaaccaaacccagttgttccatgttggctctttacttgagaaaataatcaagataacatacatgttccc

SEQ ID NO: 626 - DNA, 290 bp, Zea mays
  misc_feature: Incyte ID No: 700549547H1
  unsure 121: a, t, c, g, or other
ctgttgttgtaaagtcagctagaaaatcaggatttcctgtgctattcggagatggttcacgccctgcagttctgcaatctgctggcataacgtttccaaaagctatcatggttatgtatantggaaaggaaaaaacaattgagtctgtaagcagattgcgtcaagctttcactgcggttccgatatacgctagagctcaagacctctcacatttgttagatcttaagaaagcaggcgcaacagacgttgtcctggaaaatgccgagctgcagctaggttcaatacttttg

SEQ ID NO: 627 - DNA, 291 bp, Zea mays
  misc_feature: Incyte ID No: 700549548H1
  unsure 23, 196, 205, 211, 220, 241, 255: a, t, c, g, or other
gttcaatgatggctctaagaganatggcacgtgtatttccgatggttgctctccaatagcatcaccaacagctagctttgtcattgactcattgagagcaaccatcggaaatacacgtgccatttctcttagagccatcattgagtcaatgacaaagctagctgttggtgatgctattggagagatttatgatggnacaattcgngtctancccataganagtgtcacaaagataagaatncttgatgcaatggnccaccaggccttccaagttacttgcagggtcatcgg

SEQ ID NO: 628 - DNA, 290 bp, Zea mays
  misc_feature: Incyte ID No: 700549549H1
  unsure 4, 11, 21-22, 38, 42, 53, 64-65, 70, 78-80, 89, 97, 125, 136, 153, 159-160,: a, t, c, g, or other
ggtngctgctnaggtacctgnnagcggcccgtgcgtcncatntattggcaaangtggatcaggnnacttngtcaagannnttcacaatngaattgantatggttgcatgcaacttatcgacgagncttatgatttnctcaagtcggtgagtangctcannaacagcgagctgcatcaggtgttctctgngtggaanaagggtaagctcctcagtctcttgattangatcacggccgacatcgttngtatctaggatnacaagggtgaatgctacctngtcgtcaaggtnc

SEQ ID NO: 629 - DNA, 290 bp, Zea mays
  misc_feature: Incyte ID No: 700549550H1
  unsure 70, 87, 92, 94, 122, 156, 275: a, t, c, g, or other
tgttgtaataggcggcgcaactgtcatctgggttctgttcgaagtgccttgattaccacctcctgacccngatatcccatgtactgnttggngngcttgccaccttattcctgtggtccaangcaaccaccttcatcaagaagagtccaccagatnttccagtagtgcaggtatctgaggaccttgttgtgaatgtttcacgggcattacggaatgacatcaacagagcgcttcacttgttccgtgagatcgcaatggggcatgatctgaagaanttttgggtgtgatcg

SEQ ID NO: 630 - DNA, 290 bp, Zea mays
  misc_feature: Incyte ID No: 700549551H1
gcctcgtggcggtaatggtaacggtaaccatggccagaagagacacaagcggcgatacgccgacaagtagaccaattctacccaacactttagggttcagcatgttgtgtttgcattgtcgcgcatctttgagcaatgagcaagattgggttgctcctccctcccggaggcactgttgaaccatacatggaggaaggagactcgggtcatgggcaccctttaccgtgagaagcgttgtagcctacaccaccaatatttctctttcttttacttcttcccaggtgtactat

SEQ ID NO: 631 - DNA, 291 bp, Zea mays
  misc_feature: Incyte ID No: 700549552H1
  unsure 114, 186, 191, 245: a, t, c, g, or other
gtctactagaggccgcagtagaagccgtagcaaaagtgacagtagaagccgtagcccaagtcccaagaagtcacgtccgtcatgaaggtagacgtagcaggactaagagcaggngcaggagcaggagccgtagaaatcatggcgctagccacagcaagagtcgcagccctgtcgctagccgtaggnatganaagactgcttcaggatctgctcggcctaactcggggcatgcagagcacaaaagncctccaagatctcactctagggatgaccatgtgaaccactctgacc

SEQ ID NO: 632 - DNA, 289 bp, Zea mays
  misc_feature: Incyte ID No: 700549553H1
acagaatcaaagtgccccaccagacagcagcagcacacctgcacaggctgcatctgggagtgcagacagagctagggatgtcccaaatgattctacgagttcccgtcaacataaccgcgaccaaattgatgagcctaattctaaaaggcaaagaactagtgactgattggaatctacttgtgagctgagaatcttgccagttcttgatttaccccagcggatgatcaaaataaggacttgagacaaatggtggcagtattgagacaaaaatggattagctgtggtatat

SEQ ID NO: 633 - DNA, 287 bp, Zea mays
  misc_feature: Incyte ID No: 700549556H1
  unsure 2, 9, 11, 17, 20, 29, 211: a, t, c, g, or other
gncattcancntcagangangtgttcttngaaaatgtatcattcttcgtgctacggggtacatctagtgatacaatcacattcgcaccatccatgcacgaagaatgatacattttccaagaacacatcttctgacgctgaaatgcctctgcctgttggaacctgtgagctcgtcgatagaccttcttccgagaatgacatgtctgagcacncctcttttgatggtaaacggcctgcggatgataggactttggaagagaacgaaatggttatgcctggtgatgaaaa

SEQ ID NO: 634 - DNA, 286 bp, Zea mays
  misc_feature: Incyte ID No: 700549558H1
  unsure 190: a, t, c, g, or other
agttagaatccttgtaaagcgtgatgagctgaccctggagggcatcaaacaattttttgttgctgttgagaaagaggaatggaagtttgatactctttgtgatctttatgatacactcaccatcacacaagctgttattttctgcaatacttctcagaaaggtggattggcttactgaaaaaatgcgcanaataacttcacagtatcggctatgcacggtgacatgccccaacaagaaagggatgccattatgggcgagttcaggtccggcgcaactcgtgtgcta

SEQ ID NO: 635 - DNA, 284 bp, Zea mays
  misc_feature: Incyte ID No: 700549559H1
  unsure 71: a, t, c, g, or other
ggcgaggcctaggtgtccaggcgcccggccaggctcatcgtgatgcggcaccttcgcctgaagatggctangcggacgcctgaagggatggtggaggcaagcaatcacagcagccccaaaggaggctcgcaaggggctgaattcctaataatcttggtggcctgggagttatggaagcaccgtaatgcttgtgtttttgagaagcataggcttaggattcaagatgttcttagttatgttagtttggagggagacctgtggtgtttggcagggcctccaaactc

SEQ ID NO: 636 - DNA, 288 bp, Zea mays
  misc_feature: Incyte ID No: 700549563H1
  unsure 192: a, t, c, g, or other
cgctactccatagcacttgttccagctagctaggagagagagctttgtttaggcggcggcaagatgaacaggaagccaggagactgggactgcagggcgtgccagcacctcaacttcagccgtcgggatgcatgccagcgctgcagtgaaccacgtggagttggtgatcgtagcggcggtggtggcgacttnggtgggcgtggtggttcctccttcggcggtggcttagtgctggctctgatgtccgccctggtgactggtactgctcctgcggcgcaacacaattcg

SEQ ID NO: 637 - DNA, 285 bp, Zea mays
  misc_feature: Incyte ID No: 700549568H1
  unsure 199-222: a, t, c, g, or other
ggccgagaacaggcagagcaccgggatctagggtttcgcacccaacacccggagtgagcggcggcgagggatcggatcgtcggcggcgatggaggacgaggtgcagagggcagcggtgagcagttggaacgagcttgactatgaggcggaagcgcgtttggtggcggaggcgagggcgtcgtgggataggaaggcaagnnnnnnnnnnnnnnnnnnnnnnnnacatgatcctgagatgaccttggactactacgcctaccaggctaaaaatttcgcaacacctgg

SEQ ID NO: 638 - DNA, 285 bp, Zea mays
  misc_feature: Incyte ID No: 700549570H1
gaagtagcgcgctcgcgtcaccctcgttggtgcttgtgctacttgtgtggacaggagacaggccagtggactcgtagccctaggtatcatccatctgcttggctgctccgccatgtctctggtctgtgctcaactgctcatacataaaccgccaggttcttggagctctcttggggtgctctgcgtcatggtgtctgtacattataagtgcgcggattaactagattttgttggcaagaactaactcttttggtcatataagaacacggtcaagttaatattaca

SEQ ID NO: 639 - DNA, 99 bp, Zea mays
  misc_feature: Incyte ID No: 700549573H1
  unsure 9, 24, 41, 43, 53, 62, 72, 83-84, 93: a, t, c, g, or other
cagatagantttaagggtttagcngcttctatttctgagcnanggtgtatccnccaggggcngcggcgatcncagcgtgcagnntgagctggnatttgc

SEQ ID NO: 640 - DNA, 288 bp, Zea mays
  misc_feature: Incyte ID No: 700549577H1
  unsure 220-224, 232-235: a, t, c, g, or other
tgaaccacggcaacatcgtcagattacatgatgttgtccacagcgagaagcgcatataccttgtcttcgagtacctggatctggacctcaagaagttcatggactcctgcccggagtttgctaagaatcccactttgatcaagtcatacctctaccagatactccacggtgttgcgtactgccattctcatagagttcttcatcgagacttgaaaccttnnnnncttattgnnnntatcggcgcactaatgcactgaagcttgcagactttggtttagccagggcatt

SEQ ID NO: 641 - DNA, 290 bp, Zea mays
  misc_feature: Incyte ID No: 700549578H1
  unsure 148, 219, 226, 251: a, t, c, g, or other
agcaatctcgtccccaaacaagcaaccaccgcctccccgatcttcgtcgagaggaagcccaatcccgaaaccgccgccctattccaatggcgcccaaggccgagaagaagcccgccgccaagaagcctgcggaggaggagccggcggnggagaaggccacggcggggaagaagcccaaggccgagaagcggcttccccgcgggcaagtccgcaggcaangagggtngcgagaagaagggaagaagaaggcnaagaagtcggtggagacgtacaagatctacatcttcaag

SEQ ID NO: 642 - DNA, 289 bp, Zea mays
  misc_feature: Incyte ID No: 700549579H1
  unsure 264: a, t, c, g, or other
aaagtggatggttctatcacctttggcttttagctcaaacgtcttgtccagataacccccagctgattgcttcatggccttctaatgctgcaaagctcagttcctctttggtcaaggaaaaagttgagcagcacagacagtcatccatcttgtcaaggactgtacccattgttctttattttaatgagcctgtcaaaggattaaatcaatcaagtgttaacttaaagtctgatttggagttcagtaaggatattatatggaggnccctcacaatggcagactctgggta

SEQ ID NO: 643 - DNA, 291 bp, Zea mays
  misc_feature: Incyte ID No: 700549580H1
gcccccatattgtggttgggcacgcctggaaggatactagctctagctagagataaggaccttcccttgaagaatgtgcggcatttcattcttgatgaatgtgacaagatgctcgaatcacttgacatgcgcagagatgtccaggagatcttcaaaatgactccgcatgataagcaagtgatgatgttttcagcaacactcagcaaggagattcgacctgtttgcaagaggttcatgcaagatcctatggaaatttatgttgatgatgaggctaaactgacccttcaggtc

SEQ ID NO: 644 - DNA, 286 bp, Zea mays
  misc_feature: Incyte ID No: 700549584H1
cgcatgatgccatcaacctaccgtggatcttggggaagaactcggtcggaagatttcctctttggtcgattatactgtttggtcctttcttgacgcttgctcggacatatgcgatggttaagagatacatgaggaaggaggccgtgtatgacaagatcgtggaaggcctatatctcggaggatggccgtttctcttgaaacatttgccccctggaaacccatctgtcatagattgcacttgtgagcttccaagaagttcattcgttccagcagacgagtatctttg

SEQ ID NO: 645 - DNA, 285 bp, Zea mays
  misc_feature: Incyte ID No: 700549585H1
cgccgccgacgcaggcacgggcgcggacggagagactgtcagcgtcgcgctctagctctaggcatttcatccccgtgtggcgtattctatcgttcgcgtcccattattgccacctgtccgatagacaacttgttctcgatccggtaatttcaccgtgcttcagctgcgtgtgtttggaaaaattgattcggtttcgggtattgttaagagatcgatgggagaagtgaaacattgttgggcgttcagtatgctttgtaataccttttgttttctaaataaagtcct

SEQ ID NO: 646 - DNA, 285 bp, Zea mays
  misc_feature: Incyte ID No: 700549586H1
  unsure 20, 239: a, t, c, g, or other
gtctactagaggccgcagtngaagccgtagcaaaagtgacagtagaagccgtagcccaagtcccaagaagtcacgtcgtcatgaaggtagacgtagcaggactaagagcaggagcaggagcaggagccgtagaaatcatggcgctagcacagcaagagtcgcagccctgtcgctagccgtagtatgaaaagactgcttcaggatctgctcggcctaactcggggcatgcagagcacaanagccctccaagatctcatctagggatgaccatgtgaaccactctga

SEQ ID NO: 647 - DNA, 286 bp, Zea mays
  misc_feature: Incyte ID No: 700549587H1
atgttctctgacaagcagcaaaagttcaccggcaaccacaattcgacttccaaccctaaaaccaaggggcagtcgaggaatcaaaacacgaggcagtatcctcatctcatgggtttgcaaacaccaacttcatcagtgtactcagctaatggaatttatgggtatgatgggagctatggacccggcctttggtatggatcgcacatgtataattctggattatatggtggatggaattcactgtatgatggaaagtacagaaccagaggaagaggtaacaatgggt

SEQ ID NO: 648 - DNA, 285 bp, Zea mays
  misc_feature: Incyte ID No: 700549588H1
  unsure 16, 28, 243: a, t, c, g, or other
gataacatatcagttntcaagggttcgncatttgcacatgctgagtggcaaggaataacgaacaatgtaccattaactgaagataatagtatgaacggacctctgtgtaagatcattgcaatgattgtgaatcatattatatccctggccaatgaagttgctagcagagatatctgcatatcatctgcagtggataaggcatacaaaactccttcagacttatgctaaagcttgtttcatgcnacccttctgctgctgctgtaactcttcatatactgaaaagcc

SEQ ID NO: 649 - DNA, 285 bp, Zea mays
  misc_feature: Incyte ID No: 700549589H1
ctcacggaccacaaaagccttactcagcttaacgagcagcgcctgcacacgccctgggcaacacaaagtcttcaccaaacttttgggcttgaattaccgcatccagtacagaagtggctctgacaaccgtgctgctgacgccctgtcacggcatagttttgcagaatgtcaagccgtctccgttattgttcctcaatggctggttgccgtccaagatagttatcaccaagataaacaagcactttccctcatctctaaattggctgttgacccagcggctgtacc

SEQ ID NO: 650 - DNA, 284 bp, Zea mays
  misc_feature: Incyte ID No: 700549591H1
gacgagacaaatatcgcaacccaaaaggttctgaagggttctaaagataaaagaaaggaaacctttgcagaaggcaacactcaggaggaatgcaagtattattcaacacctggaggatgcaaattcggtaaaacttgcaaatacctccaccgtgagggaaatggagggaaaacagaggttgaaaaagctgagctgaactttctaggtcttccactgcgaccaggtgaaaaggagtgcccatactatatgcgcactgggagctgcaatttgcgactaactgcaat

SEQ ID NO: 651 - DNA, 282 bp, Zea mays
  misc_feature: Incyte ID No: 700549592H1
  unsure 38, 98, 100, 262, 273-274, 278-279: a, t, c, g, or other
gaaggccaggggctggatggcgtgctgcgcgccatgtnatggtggacacttcagttcaacatctgtatatatgtttcccgcattaaccaccctagctnangcaaccatctgcaattgttgcaattgcaaagtttatattcttcattgtgctggactaagttgattatacattcgtgcctctactttgtgtatgtatatatctgacctaaagttgctgaacatagacaatttcacttgcctctggtatccaggttttgataanaaaaaaaacannaaanntcc

SEQ ID NO: 652 - DNA, 95 bp, Zea mays
  misc_feature: Incyte ID No: 700549593H1
  unsure 19, 43, 74, 81, 83, 93: a, t, c, g, or other
atctctcaagccttttgangccaccaatggtgaaaaccgaggnggcggaggagcgggagcccctcttcccggangccagcngnggcagtagcngt

SEQ ID NO: 653 - DNA, 288 bp, Zea mays
  misc_feature: Incyte ID No: 700549594H1
ggatcatgggctactttgagaccattgttaaaaaacatgcctgccaaccaacctaccaggaagcgggcacaacaaacagatgattaagaatatattggtcagtatcagctgaagacacaggccaaagagagactgcattggtttgtcttgctcttgccttcccagcttcaagcaattggccatctgtaactattaccattgttttgtacagtacgccaaatgcgtatttgatgaagaacaggtgaattttggtcctttgccttcagcgtttggttctccattggagcc

SEQ ID NO: 654 - DNA, 290 bp, Zea mays
  misc_feature: Incyte ID No: 700549595H1
gagcaaggccgtgggatcggaattcccttccggacaagacacctaccaccacccaccacccagcgcaaggccaggcggcccaggccaccactccttaccttttccccctcttttgttccttcattcacgaatcccgtcttcttcctttcttggccttctccacctcatcgccgagacgagatctctcccacacgaggaagggagagatgggcgggcgggtggatcacgagtactcctacctgttcaagatggtcctcatcggagacagcggcgtcggcaagtccaatatc

SEQ ID NO: 655 - DNA, 288 bp, Zea mays
  misc_feature: Incyte ID No: 700549596H1
  unsure 191-192: a, t, c, g, or other
ggaagtgcttaaagcactgcaagaactgaatgtttactggaaaaagattggacactacaacatgaaatgcagatggagtcctggctgccttgagagtatgatgcataactgtgatggcttagtgcagagtctgctataattgaaactgatgatctcatagcgaaatcaacccgtatagtgaagtttgaganncagcttacaaaacgagggatgagaagtaccttcttgacctgcaaagggtcagtggaccacaatcctctttctggacttgtgttccgcctttctaac

SEQ ID NO: 656 - DNA, 258 bp, Zea mays
  misc_feature: Incyte ID No: 700549602H1
cttgttcaacctcaagaggtaatctggtggtccgttgcgcggaagttttgatctgctgctatggcctatatgagaatgggttaaccgttttgttagtgtcactggagtcgtagtagtagtatcttactatcagctggataatagactagatgaacatgtatggcacgtacctttactttctgaagttttcaatgataataagagtcgtgaacacaaacatgagggataattgagttcttgtctggtcttttgagttgc

SEQ ID NO: 657 - DNA, 269 bp, Zea mays
  misc_feature: Incyte ID No: 700549604H1
  unsure 189: a, t, c, g, or other
attgattctgctgttctctcaaggctgaagcatttttcggcaatgaacaagctcaagaagatggcattaagggttattgctgaaagcctgtctgaggaagagattggaggcctcaaggagttttcaagatgattgatactgacagtagtgggactataacatttgatgagctgaaagatggcttgaaangggtaggctctgaattaacagagaacgaaatccaggctctaatggaagcagctgatattgataacagcggaaccatcgac

SEQ ID NO: 658 - DNA, 267 bp, Zea mays
  misc_feature: Incyte ID No: 700549605H1
  unsure 44-45, 97, 106, 137, 244: a, t, c, g, or other
aaagaaatggcccagggtcataatggagaattggctgaagggannataaggagcgtggggctggatcccattatggatatcttgcaatcaccttctngctggcctncggaattcgagaagaacagcaggagatcatngacctgtggcatggatgcaacgtttccttggtccacaggacttactttttcctgctgttcaaaggggacccagccgacgccatttacatggaagtggagcttaggangttatcatttctcaagaacacat

SEQ ID NO: 659 - DNA, 266 bp, Zea mays
  misc_feature: Incyte ID No: 700549606H1
  unsure 54, 73, 90, 110, 132, 134, 140, 152, 229, 232, 258: a, t, c, g, or other
aggtctcaagtaagattggtgtcattgagtcgttgctggcgaaggtcgatatcntcatccttggtggtggtangatctacacattttacnaggcacaaggatattctgtnggaaaatcttcgtggaagaggntnaacttnagctcgcaactnctcttattgagaaggcgacagcaaagggggtttctcttttgcttcccactgatattgtagtagcggacaagtttgcngcngatgctgagagcaagattgtccctgncactgcta

SEQ ID NO: 660 - DNA, 268 bp, Zea mays
  misc_feature: Incyte ID No: 700549607H1
  unsure 144, 169, 187: a, t, c, g, or other
ggacaaactgttctgtcatatgttaatatggtgtgttcgaccttgaggaactccatcccaaaatctattgtttattgccaagtgcgagaggccaagcgctcgctgctcgatcacttcttcatgaactgggagcaagagagatgnagcaactttccaagcttctcgacgnagatccagcagtcatggnacgcagaactaaccttgcaaagaggctggagctgtaccggagtgcccaatcggaaatcgatgcagtcgcatggtccaaata

SEQ ID NO: 661 - DNA, 269 bp, Zea mays
  misc_feature: Incyte ID No: 700549608H1
tctctgcccccgaagccgcccaagcgctcgtccaaaaagaaggggaaggagaagcttaaagcggcgcaccatcaacacacagagtcggcgccactggtcacgctggtcaccggtggtaaggcgggaagttagtcaccgccgagatgccgcgtgtggacctcctccgtgtgcttgcagaaatcgacgagaggttcttgaaggcgtcagagagcgccggtgaggtatctaaggcgctggaggccaacaggatgcattaccactccaatttc

SEQ ID NO: 662 - DNA, 270 bp, Zea mays
  misc_feature: Incyte ID No: 700549610H1
  unsure 9, 36, 72, 269: a, t, c, g, or other
agaacaagnccagtctgtccagaaatacattagaanaaagagccaaagaggagaacaccggccggcgaagtngacgaagcggcccgccgaggaaatggcgtcgatgcagagctggcgcaaggctacggcgccatcaaggacaccaccaccgttagcctcgccaatctcaactccgacttcaaggtgtgccttcgatccggatctggatgtggcgatcgtgaaggcgactaaccacgtggagtgcccgcctaaggagcgacacctgcgcng

SEQ ID NO: 663 - DNA, 269 bp, Zea mays
  misc_feature: Incyte ID No: 700549612H1
caaagctgttatccaagctgagttggcagttgagggcttaacatggcatgtcacatgtgttagcatgggcaacccccactgtgtcacatttggggcaaacgagttaaagaccttgcagatcgcgatttaaaactcagcgaaattgggcctaaatttgagcatcatgaaatgtttcctgctcgcacaaacacagagtttgtacaggttttgtctcgctcacacctcaaaatgcgagtctgggaacgtggtgctggagcaactcttgcctg

SEQ ID NO: 664 - DNA, 270 bp, Zea mays
  misc_feature: Incyte ID No: 700549613H1
aaagactctgataagaagagcacagaggaagctaacattcttgtgccagctagtcaggcatcaaatgttataggaaaatctggtgctgtcatcaagcatcttcggtcaacatcaagagcattcttaaagtgagcccaaaagatccaagtgaccctacacattcatgtgctatgagttttgataattttgttcagataactggtggtgctgaagctgttaaaaaagcactgtttggagtatcaaccatcatttacaagcacccatcaaaag

SEQ ID NO: 665 - DNA, 273 bp, Zea mays
  misc_feature: Incyte ID No: 700549614H1
attggatcagaagaccttgctgctaaccatgacgtgatgcaaattgttgaagtattggatgatagaacaagggattcaagattacttgccttgcttgacaaataccatcaagcacaaagcaacaggttttggtttttgtgctgtacaagaaagaagctgcacgagtggaaacaatgcttcagagaaggggatggaaggctgtttcagtccatggcgacaaggctcagcatgatagaacaaaagctttatctttatttaaagaagggaaatgcc

SEQ ID NO: 666 - DNA, 261 bp, Zea mays
  misc_feature: Incyte ID No: 700549619H1
gatgcaatgactagctcgggtgctcctttctggtctgctcctaagcggttcccgcgacctctggagttctcgtcttccgactcaagtcaccttaacttcttgttggctgcatcttattaagggcagagacatttggaatacacatacctgattgggctaagaacccaaagaaactggctgaagctgtggacaaggtcattgttccggatttccaaccaaaacagggtgttaagatagagacagacgagaaggctactagcc

SEQ ID NO: 667 - DNA, 265 bp, Zea mays
  misc_feature: Incyte ID No: 700549621H1
  unsure 202-205: a, t, c, g, or other
tgtgagattgctctcagcacgttgctggacgagttgcagcctgaccaatggccagtcgaggctgggaaccgtgcgatccgttgcactggtgttgcgctcagtgtagctgctgggttactggtgcttgcatgcctggaacaggtgcaaggatcatcgcattgctaggtggtccgtgtactgagggacctggaatgattgtttnnnncgatttgtcagaaccagttagatcacataaggatcttgacaaggatgcagctcctcactt

SEQ ID NO: 668 - DNA, 266 bp, Zea mays
  misc_feature: Incyte ID No: 700549622H1
gggatcacatgcagttcaaggatgtctgtgttaaagttgcaaatgtcgagctatattacaaggcagttcacttttatttgcaagagcatcctgatctcatcaatgatatgctaaacgtgttgcacttcgtttagatcacaccagagttgtagacataatgcgcaaggctggtcagttgcatcttgtgaaaccatatatggttgcagttcagagtaacaatgtatctgccgtgaatgaagccttgaatgagctttatgtcgaagagg

SEQ ID NO: 669 - DNA, 208 bp, Zea mays
  misc_feature: Incyte ID No: 700549624H1
gagtgggagacccgcgagaggctgccgtgtagggaccgtagactcagcgactgcgaaggaggataaggggatggccgggatcggaccgatcaggcaggactgggagccggtcgttgtgcggaagaaggcacccaccgccgccgccaagaaggatgagaaggccgtcaacgccgcgcgccgcccggtgcggagatcgataccatgaaga

SEQ ID NO: 670 - DNA, 268 bp, Zea mays
  misc_feature: Incyte ID No: 700549628H1
aaaaaagttgaagctgcagctgttgcttcacttaatcatgataatgctgacattgcggcaactctgtctagcttaaacctatctggaaataagatgtcaaatgtggaaaatcaagctcagatcatgtttaccagaactttggtgaccagacagatgtgctctttaatgtaccaaaggaacataggcaattttcaccacaaattttaagtcaaaataccgatgacggctcgtttaatgcccctgaatatgtagtttttccaaatggggg

SEQ ID NO: 671 - DNA, 116 bp, Zea mays
  misc_feature: Incyte ID No: 700549630H1
atttggttaagtttgatttgatgcaagggaaatgggtggcggttgattgctaataattcccgttgatatttgtcatgcgtacgtgaacttgataacaaaatgcatgatgtcttctc

SEQ ID NO: 672 - DNA, 275 bp, Zea mays
  misc_feature: Incyte ID No: 700549631H1
ggtgctgagtacaatttaaagcctgcagagaatgccccatcacgagatgccattgttctaatactaaggctattcaggatgaaggctgttgagaagagcaagggaaaaagaaagggcatcttcttcaagtagtttgtagttgtagcagtattactacgtagtgtcatggcaggttgactgtatctgttacctatgttttcgcggttcatgtatttagaaggaaagagcaagttgtctgcgtgcttatgtaaagttccgatcaattcgattagatc

SEQ ID NO: 673 - DNA, 269 bp, Zea mays
  misc_feature: Incyte ID No: 700549635H1
  unsure 46, 89, 92, 95: a, t, c, g, or other
attttaactaacctgaactcaattaaaatgagtttagttcacttgntatgctgatcctatagttaacatttaacatcacaatgtctcangcnggnaccccccgaatcctatgcttctttgtacctatacatatttcctccatatgcttttatgattccgggatggttgatgaggtgctggatgcagaggattcggggggtgcctgcatgagacattgtgatgttaaatgttaactatagatcagcatagcatatggaggaaatatgtat

SEQ ID NO: 674 - DNA, 266 bp, Zea mays
  misc_feature: Incyte ID No: 700549636H1
ggcgcctgcaaccaccaggcagtttggacagtttggaactttccattttaggactggtgggatgcatgcccatgcccatgcccaacaaaactctggtggctcaactgtcaggatgcttatcagctgttgcctgtcctactgctgctgttgctcaacttcctgccatcctctgagcctgtctactcgctgtcccgttcatacccttatgagcataagttccaaaccccacgtggagttgcatactatgtcaagatgtctaatttcga

SEQ ID NO: 675 - DNA, 265 bp, Zea mays
  misc_feature: Incyte ID No: 700549637H1
  unsure 22, 53, 85, 119, 124, 203-204: a, t, c, g, or other
caacgaagtattcaaaccgaanacaatggagccggtgcggaagagcgtgtgcntgaccggcgctggcggcttcgtcgcgtcgganctggtgaagctcctcctctcccggggccaatacnggtcnccggcaccgtgcgcgaccctggtgctagcaagaatgcccatctcaaggtgctggaaggagctgaggaaaggttgcagcnnctcaaggctgatctgatggactacaacagcattgcatcagcagttgccggctgtgagggtg

SEQ ID NO: 676 - DNA, 265 bp, Zea mays
  misc_feature: Incyte ID No: 700549638H1
actaaagattggcaaccgactgtcacggtagatgaggatgggatccttaaccaattgcactctgcactcctacattctcgagatgcccctgttgcgcaaacttttggcagtctacaacgccacaacggaacccccaccttccagctattcaagcatgtattgatgcaatcacagagcatcagaggctcaacactctgatgaagggagagctgataaaaggcttgttgccacagagtagtgtccgtgctgattacactgtccagag

SEQ ID NO: 677 - DNA, 266 bp, Zea mays
  misc_feature: Incyte ID No: 700549640H1
accaagagctgttagtgagcgggaagacaagctattcctcgaccagattgattccctaatggagcaaaacgcagaggtcgatggtgatgctgacagtgaagaggaggaagatacaggaagggggacgtcgacattacaaattctggcgtcgctgcttactaaggctacactggttgatttggatgagctttgctgtacagcaccagctaagttctaagccgttctgtttggaagcagtttctttctgttaggttttggtgaattcg

SEQ ID NO: 678 - DNA, 270 bp, Zea mays
  misc_feature: Incyte ID No: 700549642H1
  unsure 16, 19, 21, 27, 29, 36, 38, 42, 44-45, 61, 71: a, t, c, g, or other
tggtgtaataagcggnggnantgtcancnggggtcngntccnanntggcttgataacaacntcccgacccngatatcccatgtactgattggtgtgcctgccaaccttattcctgtggtccaaagcaaacccacttcatcaagaagagtccaccagatattccagtagtgcaggtatctgaggaccttgttgtgaatgtttcacgggcattacggaatgacatcaacagagcgcttcacttgttccgtgagatcgcaatggggcatgatc

SEQ ID NO: 679 - DNA, 267 bp, Zea mays
  misc_feature: Incyte ID No: 700549643H1
  unsure 170: a, t, c, g, or other
taggccttttacactttccatggccaatgcgggacctaacaccaatggttctcaattcttcttcaccactgtagcaactccatgggctagataacaaacacacagtgtttggtagagttggaaagggatggatgttgtccagcaaattgagaaggtcaagactgacaagnatgacaaaccatatcaagatgtaaaaatcttgaatgttacagttcccaagacataagcgcgtgatcagttgggttcggaaattgtgcctgcactcct

SEQ ID NO: 680 - DNA, 268 bp, Zea mays
  misc_feature: Incyte ID No: 700549644H1
ggggaaggacggcgcgtccaagcctccggagccgcccaaggactacatccacgtccgggcgaggcgcggcgaggcgacagacagccacagcctcgctgagagggtgagaagggagaagatagccagcggatgaagcttctgcaggatctcgtcccgggctgcaacaaggtggtcggcaaggcggtgatgctggatgaaatcataaactacgtgcagtccttgcaacggcaagtcgagttcctgtccatgaaactggccaccgtgaatt

SEQ ID NO: 681 - DNA, 270 bp, Zea mays
  misc_feature: Incyte ID No: 700549646H1
  unsure 72, 176: a, t, c, g, or other
tccatgtggttcatggtgggcacttggctctttgcaccattcctgttcaatccttctggatttgagtggcanaagattgtggatgactggactgattggcacaagtggatcagcaatcgtgaggtattggtgtggcaccagagaaaagctgggagtcatggtgggaaaaagagcangagccccttcgttactctgggaagcgtggtactattgttgaaatactgcttgcattgcgtttctttatctatcaatatggactcgtgtatcatc

SEQ ID NO: 682 - DNA, 275 bp, Zea mays
  misc_feature: Incyte ID No: 700549648H1
  unsure 2, 4, 7, 11, 18, 25, 27, 50-51, 60, 78: a, t, c, g, or other
angngancaanggagagnagtgtcngntatcagtgcgttctcaagctcanntgttcccanttttctcatcaagtgggntacttttcaatctggctctggtgcactcagcaaaccaattaccaataaccgcaatctattattaagtggcttgtcgaccttgaagtcaaggggctcaaagtgtttggagactacagttctgtattatggagaggtttgcttatgatggggtcaagaatggccatgggaacatgattcattcagatgcggaccttttc

SEQ ID NO: 683 - DNA, 268 bp, Zea mays
  misc_feature: Incyte ID No: 700549650H1
tctttgcttaactttattctgcccaatatttttaattcatctcagaattttgaggaatggtttaatgcaccatttgcatgtgatgttagtcttaatgatgaggaacagctattaatcatcatcgtctgcatcaagttttgcgtccatttttgctgaggaggaaaaaagatgaagtggaaaaatatctccctgtcaaaacacaagtaattctcaagtgtgatatgtctgcttggcaaaaagcatactatgaacaagtcacaagcagggt

SEQ ID NO: 684 - DNA, 266 bp, Zea mays
  misc_feature: Incyte ID No: 700549651H1
ctggaaactatggtgaacaccctgacgatggctacgacaggaacgcgcttcccaccataagcaacataaccatcaaggatgtcgtgggtgtcaaaattggtgttgcaggaatgctgcaggcattccgggggatagcttcagtggcatctgcttgtcaaatgtttctctaagtgtcaggtctactgatccatggaattgttcacttgtcgaagggtattcgagctctgtgtcacctgaggtgtgcgagcaactgagagccactcctg

SEQ ID NO: 685 - DNA, 265 bp, Zea mays
  misc_feature: Incyte ID No: 700549652H1
agttttttgaagaacgagctgcccttgaggcaaagtaccagaagctttatgaacctttatacacaaagaggtatggaattgtaaatggagaagtggaggtagatggtgtttgtgatgaccggccagtgagaatactgttgagggaaaagaaccagacgctaaaggagttccagacttttggcttactgccatgaaaacaaacgaggttttgtctgaggagatacaagagcgcgatgaagccgctttgaaatatctaaaagatatc

SEQ ID NO: 686 - DNA, 263 bp, Zea mays
  misc_feature: Incyte ID No: 700549653H1
ccaaggttcagccaacaacattgatcccaaagcaagttgggaatatgtatacagcatcactctatgctgctcttgcatcggttatacataatagacatgaaactctggcaggccagagattgttatgttttcgtatggcagtgggttgacatcaacaatgttctctttcaagattaatgaaggccatcaccctttcagcttgctaaacattgcaaacataatggatgtttccaagaaattgaaggcaagacatgtggtcccgc

SEQ ID NO: 687 - DNA, 263 bp, Zea mays
  misc_feature: Incyte ID No: 700549654H1
  unsure 22: a, t, c, g, or other
ggtcgactggtattggaactcntccattcgttgtggaatttatgaaacaaattggccaggctaatcgccgtgtcttggctactgatgaatggctaagggtccgtgaatgtgatggtgctatgcaataggtgactgtgctacaataaaccagaggaaagtaatggaggacatttcagaaatattcagagtcgcagataaagataagtctggaaccttgactgtgaaagaaattcaagatatccttgatgatatctacgtgaggt

SEQ ID NO: 688 - DNA, 265 bp, Zea mays
  misc_feature: Incyte ID No: 700549655H1
  unsure 156-178: a, t, c, g, or other
gactagttctagatcgccgcaactgcccgtctgctcctgcttttcatccagtcgcaaaacaaagagaagagatctccgcgtccgcaaccgcatcgcttccctcccggcagaagaagaaattcggttgggttgtttgtctcttgcaaaccgcaatgnnnnnnnnnnnnnnnnnnnnnnnggccgtggcgccggaggccggcgaccggaaggcggtggcaccgccggtcgacgcggtggatctggagctggagctggaggagaagca

SEQ ID NO: 689 - DNA, 265 bp, Zea mays
  misc_feature: Incyte ID No: 700549656H1
tcctcctccccgaggaaaagatagggactgcactactcaagctgtcatctttgagcatggttgacacttgacacaacacctgtggtccatatctgctatagaacagaattcgtgagctaacgatatcagctatagaacacctgtcatccttgattagttttgtatgatcatattccgagtgaatacttagtcctttggtattatgtgttagcattttctgttcagaagttgtcagcagctgtaacgtaacagtctgatctcttga

SEQ ID NO: 690 - DNA, 266 bp, Zea mays
  misc_feature: Incyte ID No: 700549659H1
  unsure 46: a, t, c, g, or other
ccctgctccgagcatcgtagtggccatcgccgcacccgtggcggcngagttcgtgaaacttcaccttccgtgccctgtatatgcgccgggctggtcctggcagcagggagatgactgtgcgggaaggccatccgaccagctgggcaggagagtcgtcactgacagccccgtgtacgacggccgtggcgccgacgcccgcctcgtggctcgcatacagggagtcacggtcctggtcggtaacgcagacgccttgttcaccatggtgt

SEQ ID NO: 691 - DNA, 267 bp, Zea mays
  misc_feature: Incyte ID No: 700549660H1
aaaagaattccctcccctagccgccgccgccgctcgtctccctgagaggtgccgggaccgaggaactggccgagttctaggtagagaatcggttttgcttgtctcagcacggggtctgctggtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagta

SEQ ID NO: 692 - DNA, 268 bp, Zea mays
  misc_feature: Incyte ID No: 700549661H1
  unsure 77, 136-137: a, t, c, g, or other
ctatgatgggatcacattgttaataggaaacagccagctccatttgatatggcacagtcgatacaccatagggtgangtgctatcataggaggcctaccctgtagaagatgatacatattcgagaatcacgaggannagatccaagtgcatcaggaccatatacttgaatgtgttctgcatcaccagggtaggcctcctatgatagcacctcaccctatgatggatcacattgttaataggaaacagccagctccatttgatatggca

SEQ ID NO: 693 - DNA, 270 bp, Zea mays
  misc_feature: Incyte ID No: 700549662H1
  unsure 114: a, t, c, g, or other
cttatggagtactaagccacactaaagaatttgggcttaagggtgaggttttgaaggtgactcttgcaacttacgtcgtgaactgagtgtgaatatctactgcatgggcaagcnagtttccaccccttgccctcccatcgattctgctgcctgccctacttgatccggctagagtttattgggactcgcagctacctcggagttcactgctgtaaatatgggtaacgccctgccagtgcacgatatgtcggaatccacaggtgcagcagc

SEQ ID NO: 694 - DNA, 271 bp, Zea mays
  misc_feature: Incyte ID No: 700549663H1
  unsure 46-47, 58, 68, 83, 88, 114, 147, 211, 219, 235: a, t, c, g, or other
cggaacttcaggcctgaaagtctccttggagaagggggttttgganntgtttttaaanggtggattgnagaaaatggaactgnacctntgaaacctggtacaagtctcacagtngctgtcaaacgctgaaccatgacgggcttcaanggcataaagaattggtggctgaagttgattttcttggaaatcttcaccatcccaatttggtcanattgattngatatgtgttgaagcngaccaaagttgctggtctatgaattcatgcctcgtg

SEQ ID NO: 695 - DNA, 271 bp, Zea mays
  misc_feature: Incyte ID No: 700549665H1
gtcttgttagaattcaagtaaatggattagccaagattgttatcatagttttacctttacatgactaaccttacacatggttttgtatgactttctttttcagatgtgacctgtttgatgtatgttggagatggatcgcatactgcgcccagaaggaactgccgttatacgggcctcgccagacgtagtagccaaggcagcacagatcgctcagtcgattcggtggaaggtacagtgcatgacagtgaaccagaatcaggcagtaccgaga

SEQ ID NO: 696 - DNA, 268 bp, Zea mays
  misc_feature: Incyte ID No: 700549666H1
agggcaggttctttgccttcggtcgtgtcttctcagggaaggttgctactggtatgaaggttcggatcatgggtcccaactatgtccccgggcagaagaaggatctgtatgtcaagagttccagcgtactgttatctggatgggaaagaaacaagagtcggttgaggatgttccgtgtggtaacactgttgctatggttggtctggatcagttcatcacgaagaatgctacactcactaatgagaaggaggctgacgcttgcccaatc

SEQ ID NO: 697 - DNA, 266 bp, Zea mays
  misc_feature: Incyte ID No: 700549667H1
  unsure 45: a, t, c, g, or other
ctctcttgctcgcactcgcggagatcgaagagaagcgcaggaggncccagcactagcgccgccccgccgccgcatcagacatggcgctggccgctcgcctcgtctcgcgctcccgtcagtatattcggttcaagccactttggggaatggaggtgtcactcaagttcgctcctttgccaaggatgcagctccagctgaccgtcctcctgtcagtggggatgatctcctgaagggcatattctttgaggtaaagaagaagtttgaga

SEQ ID NO: 698 - DNA, 264 bp, Zea mays
  misc_feature: Incyte ID No: 700549670H1
gccattaatgtatccatctgttgaggagatgctgttcccctgtaattcagtcgacaaatctgtttgcaaagggaagattgatgctcaaagtaagggaaaatctgttacgtcctcaggcatccaacctgctcctcattctcttcgtactcatgccccacctccaccacatccgtgcatttcagaatggtcccgagcacaaagaagccaacaccgtcaattgaaatttgaagacaatgcaaaaaccactaatgattctagatggcg

SEQ ID NO: 699 - DNA, 156 bp, Zea mays
  misc_feature: Incyte ID No: 700549672H1
ccatctcaagcttttacctaaggttgtgcatgttgagatgccatggaaatccattttgctgattatttggtttgtggtcggttcacaacattacatgtgcaccatgttttgctgggtatcactatataatgtttgtgtagtctacacaccgtgact

SEQ ID NO: 700 - DNA, 163 bp, Zea mays
  misc_feature: Incyte ID No: 700549674H1
cttgttatctatgccggatgacgtgtgatagaagtttcgagacgttgctcctttcaagttttgaaattttgactatatgccatgccaagtctgtgttatctttacacattccgagcatctgtatttattatgctgagacagactcatcaatttttgcttgtac

SEQ ID NO: 701 - DNA, 263 bp, Zea mays
  misc_feature: Incyte ID No: 700549675H1
  unsure 2, 163: a, t, c, g, or other
angttccggattctacctatgatatgattggaggccttgaccagcaaattaaagagatcaaagaggtcattgagcttccaatcaaacatccggaactgtttgagagccttggaattgacaaccaaagggtgtccttctttatggacctccgggcacaggaaanacattgttggcacgtgcggttgctcatcacactgactgcaccttcatcagggtgtctggttctgagttggttcagaagtatattggtgagggctcccgga

SEQ ID NO: 702 - DNA, 265 bp, Zea mays
  misc_feature: Incyte ID No: 700549676H1
tgatgacacagccgtgaaggtggttgatattgttgacacattccgtctacaggagcaacctccttttgacaagaaatcatttgtctcttacattaaaaaatacatcaagaatctcactgctgtgttggagccagagaaagcggatgagttcaaaaagggtgtcgagggtgcaaccaagtttctccttagcaagctgaaggaccttcaattttttgttggtgagagcatgaaggatgatgcgtccgtggtattcgcctattacaag

SEQ ID NO: 703 - DNA, 266 bp, Zea mays
  misc_feature: Incyte ID No: 700549677H1
gggaaagtttttataaaggtctgtgtctttctctgatattctcagtttctcagtctctactgtatatctgcttctaattatatgtgctcttatccctgttcttggtgcaaaaggtgatatgattttgtgggtggtttcattcattggaatgctcttcaattttcttacgcttatttacattggtgtaatgctttctctgttggttccaccactctatgagaagtaccaggaccaggttgatgagaaggttggtgtagcgtacagtg

SEQ ID NO: 704 - DNA, 207 bp, Zea mays
  misc_feature: Incyte ID No: 700549678H1
gcgccgtagcctagcataaatcgaacccttgttgctatcggattttcatggattgtcgctgtttgcacttaatgttctatatatagtactcaaaactatgcttggtgtctgagtgatgtagtggaactatggatcagctcttgtgtgcacttgctgaaccagatacccagcagtaagcttttgtttgttcgttttgagtggttggtt

SEQ ID NO: 705 - DNA, 271 bp, Zea mays
  misc_feature: Incyte ID No: 700549679H1
  unsure 50, 122: a, t, c, g, or other
tgagactgtatgtcactattatatgaggcaaaagatcattcggcgcgagnatttttcagaagagaaatggaaaaagatatactacttatcaaatggaaatggtgcagagatgagatggcttntgccttcgtttgaggtagatatactgtccctgaaggcaaaaatgcattttgctcccaaaaaattatttataatattgttctgtgttttacatcttgttaatgacaataatgatttgtaatcagttagtcatatataatttcagatggca

SEQ ID NO: 706 - DNA, 250 bp, Zea mays
  misc_feature: Incyte ID No: 700549680H1
  unsure 46-47, 71, 73, 139, 190, 241: a, t, c, g, or other
agaaggtcgccgcctgcaagactggcaaagccgcgccttgaggagnngttcaagaccggcaagaacaggtngntctttaccaagctccgcttctagatgctcggcctcccgaatagtcctgcttagctgtcgatttgtngtatcggacacactccatctctgttttcgattaccatgaatatttcgtgtntagtcctggggctctcagagataaatttgctaagatatgccgttgttgtgntacatgttt

SEQ ID NO: 707 - DNA, 177 bp, Zea mays
  misc_feature: Incyte ID No: 700549681H1
  unsure 4, 13, 76: a, t, c, g, or other
ctcncggaccacnaaagccttactcagcttaacgagcagcgcctgcacacgccctggcaacacaaagtcttcaccnaacttttgggcttgaattaccgcatccagtacagaagtggctctacaaccgtgctgctgacgccctgtcacggcatagttttgcagaatgtcaagccgtct

SEQ ID NO: 708 - DNA, 265 bp, Zea mays
  misc_feature: Incyte ID No: 700549683H1
  unsure 118-119: a, t, c, g, or other
cagggcagggaagtcaggaggaagatgatgcagcaggagccctggaacgccgccgccgccatggggctcctccgcccgaccaagtcggctccctgctcgcccatcaagccgccgccgnnaaccatgctgcggactcacttccacgtcgcgcacaaggtgccggtcggcgacacgccctacgtgcgagccaagcgcgtccagctggtggacaaggatccggagaaggcgatcgcgctgttctggagtgcgatcaacgccggagacc

SEQ ID NO: 709 - DNA, 262 bp, Zea mays
  misc_feature: Incyte ID No: 700549684H1
cgacactgagatgcggaggctgacggacgccgtcgaggggccaaggtctttgatggctcgccacttcgaggtcgaggtggttccgcctcccccatcgtcgactgctgtcgtacccctgctggtcctcctccgaccgcataggcctggtcgtcaccctgcaggttttttgagatttgtgtaaactatgccaagaacttatttgtttcgaattttaagctctagttgtttgtcgtgttatttttcctgctgttttgtgcctatt

SEQ ID NO: 710 - DNA, 259 bp, Zea mays
  misc_feature: Incyte ID No: 700549685H1
  unsure 115: a, t, c, g, or other
ccaacatgtatagttcatatggtggatttggcaacacttatggtaccggtggactcggaaatagcatgtactcgagttacggaggaggttatggtggtggcatgtacggtggtgnatgtatggaggcggcatgtatggtgggatgggaggttatggtggttatggcatgggcggaatgggtggtatgggcatgggtccatacggtaatcaggatccaaattcgatgggccctcctgcatccccgccaggcttctgggtg

SEQ ID NO: 711 - DNA, 262 bp, Zea mays
  misc_feature: Incyte ID No: 700549686H1
caatgccagctattacagataaaagtgagccttttttcatgtctaaaggttggagggagacactatgcaggtgtgaaacatgcttcaacttctatgcacaacgaggtattgcatacttattgacaaggaggattctattgaggaatacgagaagattgccaagcagaagagggagatgaaactggagcagcagcaaggagctgagacaaattttctgaattcacttaatcatgttcagaagatagagatgataagtggcatc

SEQ ID NO: 712 - DNA, 265 bp, Zea mays
  misc_feature: Incyte ID No: 700549688H1
  unsure 111-135: a, t, c, g, or other
gcaagacgctcgtcgccaggaacgtcatcccggccaactggaggcccaacaccttctaccgctccttcgtccagtacagctagctagctagctggtttgcgcccctagttnnnnnnnnnnnnnnnnnnnnnnnnnacccactagactactgcttctgctaccaaatactacggcggaacggaacggctggttgccgccgccgccgtcgtccttggaaaggttgaggcgtctcttggtcatccgtatcgttaccgttgtcatggtc

SEQ ID NO: 713 - DNA, 262 bp, Zea mays
  misc_feature: Incyte ID No: 700549689H1
aaatctgatttggcggaaaaagatatcccagctttggctgatatagttggtgatgaggacaaggctaaagaaattgttgaagcagcaaaggcttcaatgggccaggatctgtcaccgttgatttgatcaatgtccagcaatttgcccaaagggttatgaatctctctgagtatcgcaaaaacctttatgaatatctcgtgactaagatgaatgatattgcgcccaacctgacatcattgattggtgaagtagttggagctcg

SEQ ID NO: 714 - DNA, 264 bp, Zea mays
  misc_feature: Incyte ID No: 700549693H1
  unsure 7, 56, 113, 118-119, 142, 147, 157, 166, 201, 212, 216, 247, 254: a, t, c, g, or other
attttcntgttaatggaaaaccacctagttctccaaggttgggaaatggggtgaantatcctttggaagtagagttatgtggttgacaagatcttgaaaaactgcatatattnttttnnatatgagcatgtgcatccatttnctcanctcctggganattttctgncaataaatgcacgaaccacattaatgtttggtggngcaatttaacnaagnatcatcccaaatagcttcctatgtgtggtanggcagtngggcactgct

SEQ ID NO: 715 - DNA, 269 bp, Zea mays
  misc_feature: Incyte ID No: 700549694H1
  unsure 44, 89, 105, 143, 152, 178: a, t, c, g, or other
atcaaccgagaggtttatccaagcattggccttgccttccgcangatctataagacggatggtataggtggtttctatgctggcctgtntccaacgctgattggnatgattccttacacacatgttacttctttatgtatganacgatcaanacctcttactgccgcttgcataagangtcgtctctgagccgccctgagcttctacttatcggcgctctttcaggtcttactgcaagcacaatcagcttccctctggaagtagcaagg

SEQ ID NO: 716 - DNA, 269 bp, Zea mays
  misc_feature: Incyte ID No: 700549695H1
  unsure 135, 257: a, t, c, g, or other
ggaacagatgacccctctttctgagtttgaggacaagctctaaaatttttggctgattggtgatactgtttcatctgccggtttaatcatcaattcgtctactgtaatagcagcgacttcatattttattttgtnttagttgtcaaatgcacctgtttttgaacaatatttgtgatgtagtgccctgccgcgcttagagtctgagactattttgttatctgctgtgatgtttcagatgacacagagtgatgtctggnttagtaaatggt

SEQ ID NO: 717 - DNA, 271 bp, Zea mays
  misc_feature: Incyte ID No: 700549696H1
cggtgttgataccgtgccagtacttgttggaccagtctcgtacctgttgctctcaaagcccgccaagggtgtggagaagggattccctcttctttcccttcttagcagcatcctcccagtctaaaggaggtcattgctgagttgaaggcagctggggcttcatggattcagtttgatgagcccatcttgtcctcgaccttgattctgacaaattggctgcattctctgctgcatacgcagaacttgaatctgtatttctggattgaatgtg

SEQ ID NO: 718 - DNA, 288 bp, Zea mays
  misc_feature: Incyte ID No: 700549702H1
  unsure 72, 75, 77: a, t, c, g, or other
atttaagtctacaaatgctgaaattagaatgtatatataatatgaaacaatccaaacattaagtacaaaatnccntnttcgtgtctagtttttttaggtctcagtgtactggtgggccgacttagggtatgtcgcggcccacaagtaccacccactagatatgccgcggccttttgagtctaacaggactggcaagtatctggtgacaacgacagactaagagtatcaggctaacgtcaagtagcagacacaagatagcatggaatttctctatcataagagttgctc

SEQ ID NO: 719 - DNA, 158 bp, Zea mays
  misc_feature: Incyte ID No: 700549704H1
  unsure 53, 100, 109: a, t, c, g, or other
actgaaactgtggcttcgccaagcccttggtgagaggattaaggccagttctncacggtgaacaagatggacaggtgcttccttgagcttcaggttgagngtgaggaancgtatcagactttctcccgtgtcattgagaatgccaatgtcatcatggc

SEQ ID NO: 720 - DNA, 290 bp, Zea mays
  misc_feature: Incyte ID No: 700549705H1
  unsure 26: a, t, c, g, or other
cccaccgacaaggttgctgctgtganaaaggtcatagagaatatgcaagagcaggtttcctatccagctgaccaacaagtccttatacatcaaggaaaggtgctcagcgatgacaccacattagaggaaaatcaagtgactgagaataatttccttgttataatgctcagacagaacaagggatcatcaagtgcagcaccggctaagacaactgcgaatcaggcacctcctactcagacagtgcctgttgttccacctcaaacgtcagcagccccagctgcaccagcacc

SEQ ID NO: 721 - DNA, 159 bp, Zea mays
  misc_feature: Incyte ID No: 700549706H1
  unsure 43, 56, 58, 86, 134-136: a, t, c, g, or other
ctaaaaaagtctcaaattctaaaaatacgatctaaaaatgtcnaataaatgcaccnanaataagtttaagttaaaatataacaacnatatatgattacataatttgatagataaaataaacaatagcaaaaaannnggttttattttaactaactttat

SEQ ID NO: 722 - DNA, 287 bp, Zea mays
  misc_feature: Incyte ID No: 700549707H1
  unsure 8: a, t, c, g, or other
cagcgaanagggaagacatggttgatgtgaacttgaggtccggcaatgcaaactcgtcccagtctcaggctcaggctgggggatgcagttgttagttgcagtctctgacacttgcttgctcatgatctttgggactctgagcatcagaaggcgttatcactgatgcttctctcgggaagaagagttgattgcctcctcgccagtgaacacaccatagtctttacccggtgaatggaccgtttgcattggaacgatacgttttatgagttttctgttatttcctcagt

SEQ ID NO: 723 - DNA, 154 bp, Zea mays
  misc_feature: Incyte ID No: 700549708H1
  unsure 50, 100-101, 108: a, t, c, g, or other
acgcaattggaaaggatgttcaggccatgaaggcagtcgttggagaggangcactctcgtctgaggatctgctttacttagagttcctgacaagtttgannggaagtntgtgacacaaggagcatacgacacacggaacatcttccagtcactg

SEQ ID NO: 724 - DNA, 282 bp, Zea mays
  misc_feature: Incyte ID No: 700549709H1
  unsure 166, 190, 203, 219, 233, 242, 252, 260, 266, 268, 273: a, t, c, g, or other
gtggactgctgtttgattccagagtctccattttatctggatggagagggtggattgcttcaatatgtagagaagaggctgaaagagaacaagcacatggttattgttgttgctgagggagcagggcaggatcttatcgcgaaaagttagccacatcagatcaacnagatgcgtctggaaataagctgcntcctgatattggnctttggctgactcacnagtaaagggctacntccaaagcnaaaaggtggngttgcggnttaatncntaggntcctaccta

SEQ ID NO: 725 - DNA, 287 bp, Zea mays
  misc_feature: Incyte ID No: 700549711H1
  unsure 10, 38: a, t, c, g, or other
ggggtgggancaagaaaaaaccggcacccctggaaacnatgggttttcgatgtccttgagtccagatggtctgtttgtgtagtgcctcctagttcctcaatcactacaaagaaaggtttcagtatggttccattgtactacagggacaagatcgtgcttgttgcttttggagggaacaaaaaggaaccatccgacaaggttgaagtactagtggtgctgcaaaacgagcactgtttcagctggcggtctgcgcccgaggtggaacccttactgtacgacgagtctcc

SEQ ID NO: 726 - DNA, 153 bp, Zea mays
  misc_feature: Incyte ID No: 700549713H1
  unsure 11, 15, 37, 49, 100, 127: a, t, c, g, or other
aagctgtaatnatgntgcatcttccttccctggggcnagcctcgtcaantccgcttccggttctggcccattggcgttgcttcacatcgacgcgcctgcnccgccggtccgccgcgccttcccctcncttctcccccgcgtgccctcctattc

SEQ ID NO: 727 - DNA, 287 bp, Zea mays
  misc_feature: Incyte ID No: 700549714H1
gggcgaggtggaggctcctctgaggtcgaggtcgagtctatcttcccaggtcgaggtcgagttcgagccccgggtcgggcgaggcagagaccgtcgcctgaccgccatcgcagcaaaatcaaccaaaggacctccctacactgaccactcccctactgcccttgcccctttcgggtaaggtagacatccactagctttcctagttaatcagccaagggcgtcccattaaacccttgtggtagcactgttttcctgagtggtcgctccatgttcccattaacataata

SEQ ID NO: 728 - DNA, 154 bp, Zea mays
  misc_feature: Incyte ID No: 700549718H1
  unsure 17, 19, 31, 40, 70-71, 113, 135, 147, 150, 152: a, t, c, g, or other
gtaccacttgcaatatnanttgggtacccantgcaatatnaattgggtaccacattgccatctgcattgnncgatgccaatggcaagctcatgcttgcccatgctgccagtgnccaaggaatttcagttgttgancaaatatctggnaangntc

SEQ ID NO: 729 - DNA, 287 bp, Zea mays
  misc_feature: Incyte ID No: 700549720H1
  unsure 208, 227, 248, 282: a, t, c, g, or other
gcctgtgttcaacggtggagatggccaaatgcattgctgattctgatgtaatcatccaagtcattgaggagaagttcccgactccttctctggtcacccctccagaatatgcatcagtgggatcaaagattttcccagcctttgtcaagttcttgaagagcaaggatggtagtgatgggtcagagaaggcgcttctggatgagtgcangcactggatgatcatctcnaagctcatggcccctacatanatggggagaacgtgtcagcgactgatcttagccnggggc

SEQ ID NO: 730 - DNA, 286 bp, Zea mays
  misc_feature: Incyte ID No: 700549721H1
  unsure 24, 224: a, t, c, g, or other
gggcgatgtgaaattaacaatggnggatgctggaaagataccaagaatggtcggaacatactctgcctgtaatgatgatggctgcaaatgcccagatggattcaagggtgacggtaggcacaaatgtgaagatattgatgagtgtaaggaaaggactgcgtgtcaatgcaaagaatgcaaatgcaaaaacacatggggaagctatgagtgtggctgcagtggangcttgcttacatgaaggagcatgatacatgcataagcaaaagtggagcatcagaagcaggtt

SEQ ID NO: 731 - DNA, 156 bp, Zea mays
  misc_feature: Incyte ID No: 700549722H1
  unsure 14, 17, 41, 126: a, t, c, g, or other
gtggaactgtgganaanagagaagatattactgggatctancacaaatggcgaaatatgcaacctggatggagcaaagagagcaagttagttggtgtaaatgctatgcttgtccgtgttgttaagntgaggcaagaacccccacttcatggcgaag

SEQ ID NO: 732 - DNA, 284 bp, Zea mays
  misc_feature: Incyte ID No: 700549723H1
  unsure 2, 38, 55, 215: a, t, c, g, or other
cnaattgtcaaaacagatatgaacatccttgccaacanaaatgcacccttctacnaatctgttaactacgcatccaacaatccatttgttccagcaatgaactctactgtttcttttgaggatcctatcatgaatctgcactctgaccagggaagtaactcccttggctgctcagacttgggctgggagaatgatactaagacaccagacatcanatccattgctcccattcccactattgctgaaggcgatgagtctgtatttgtcaatccaattcaaacagc

SEQ ID NO: 733 - DNA, 273 bp, Zea mays
  misc_feature: Incyte ID No: 700549726H1
ggccagtggtgagacacaacccttcagaggtcaaggtgccatcaccgaccaacaaactgatagataccatacctcaggcacgttggatgctcttagggaaaggatgaaaagcattcaagcggcagtataggtcattttgacggtgctcaggctcggccgttggcaagtatgaacggaagtaatatggtgcatgggggaactcgattggaaggtgaaccccaacagcgaagtaatataccacccatggatgagcgagctctatctgggctgcaa

SEQ ID NO: 734 - DNA, 289 bp, Zea mays
  misc_feature: Incyte ID No: 700549732H1
  unsure 36: a, t, c, g, or other
gttgagttggtgaaggactttcaaatgggtgtctcnaacaaaactccagagttcctcaagatgaaccctattgggaagattcctgtcctggagactcctgatggtcctgtttttgagagcaatgcaattgcaagatatgttactcgcttgaaggctgataacccactttatggatcttcactgattgattatgcccatattgagcaatggattgactttgctgcaacagagattgatgcaaacattggaaagtggttgtacccacggatggggttttatccccatgctg

SEQ ID NO: 735 - DNA, 151 bp, Zea mays
  misc_feature: Incyte ID No: 700549733H1
  unsure 40, 60, 64, 71, 84-85, 101, 108, 123: a, t, c, g, or other
catgggtcatcttatgaggctgtaaatccgatgatctgcnccatgtcttacgagtagganggcntcattgngacctccagaggnnctcctactcgtaaganatgggtnatcttatgaggccgnaaatccgatgatctgccccccttttttt

SEQ ID NO: 736 - DNA, 286 bp, Zea mays
  misc_feature: Incyte ID No: 700549735H1
  unsure 15, 22, 27, 127, 161-162: a, t, c, g, or other
caagcctgtgaaganaaagaanatcanaagagaaattaaaattcttcagaatctttatgggaggccctaacattgtgaagctgcttgatattgttagagatcagcattcaaaaacaccaagcttganactttgagtatgtcaacaacacagatttcaaagnnttgtacccgacactaacagattatgacattcgatattacatctatgagttactcaaggcattagattactgccattcacaaggtattatgcaccgagatgtgaagccccacaatgttatgatag

SEQ ID NO: 737 - DNA, 152 bp, Zea mays
  misc_feature: Incyte ID No: 700549736H1
  unsure 22, 57, 69, 78, 82-83, 87, 126: a, t, c, g, or other
aaatgcaatacttcagccaagnccagagcatttcccgaagtatcaagagcaaccacntgccattccagnctggttcancccnnattntgttgatcatctgcatcgtagtttcaatggtcctcaatngtcggcaattcattgggctgcaacac

SEQ ID NO: 738 - DNA, 142 bp, Zea mays
  misc_feature: Incyte ID No: 700549740H1
  unsure 33, 93, 129: a, t, c, g, or other
ctcgcgcaccgctcctgtccaccctgccaccgncgacgccgcgccgccgcagcaactgtcaccgtcgctatggcccgtatcaaggtgcacganctccgggggaagagcaagacggacctgcaggcgcanttcaaggagctga

SEQ ID NO: 739 - DNA, 279 bp, Zea mays
  misc_feature: Incyte ID No: 700549742H1
gacaacatgaccaggtgtgtgaaacaaattaaatggttcttccatttctaccttcgtgattcagtattgtgcatattgtcatccatctgttacaaattacaggtcgttttagtttttctagatacatagttttcttatacacctagctacatacatagcaaaagctaaaatgatttgtaggcaccatgtagtcctttcatttggtcggtttgttttgctataaatctgccattattttttctaaccgcatgcaccatgtgttggaaggtgatgtggtgg

SEQ ID NO: 740 - DNA, 281 bp, Zea mays
  misc_feature: Incyte ID No: 700549745H1
gggcagcgtggcaacgagagcaacgaatattcaaaccgaaaacaatggagccggtgcggaagagcgtgtgcgtgaccggcgctggcggcttcgtcgcgtcggagctggtgaagctcctcctcacccggggccaatacgcggtccgcggcaccgtgcgcgaccctggtgctagcaagaatgcccatctcaaggtgctggaaggagctgaggaaaggttgcagcttctcaaggctgatctgatggactacaacagcattgcatcagcagttgccggctgtgag

SEQ ID NO: 741 - DNA, 288 bp, Zea mays
  misc_feature: Incyte ID No: 700549746H1
  unsure 19, 34, 40, 154, 246, 255, 261: a, t, c, g, or other
aacaccttcacctcctccngcgacgcacgcagcncccggngtggcgctcggcttatctccaatcatccaccgcgccgccgcagaggcctcgtcctcaccttccccgtaggaagccgaagtacagccagcagcgtcgccatcagcaccgatcatngccgactacgagcaggagcaggatatggaggtggaggcactgtaggccatcctcatggacgacatcaaggagatcgacccgagtgagagttngatcgccancaccgnccggtgcttccagatcctactctctcc

SEQ ID NO: 742 - DNA, 280 bp, Zea mays
  misc_feature: Incyte ID No: 700549749H1
  unsure 42, 69: a, t, c, g, or other
gaaacagaagtctgtgccccacctacataactcttttgattnttacagcctgcagcaaggtcaactggntcctggaggtcctagtgtggcctgcagcactgccaaagctgttgaatgggacgcatcctggtccaagaaccttgatccttctggccgtgctgctttgggtgttcacgatgctgcgtatgaagacactgcagggaaaactcctgcctctgctgatccgtctcagacaagggccttcgtccagctattggcgaaagctagggacaccgttgct

SEQ ID NO: 743 - DNA, 151 bp, Zea mays
  misc_feature: Incyte ID No: 700549751H1
acgataagtcatgtctggaagcccgcttcccaaccaaggagagttagtgctgatgctaagccacatacaaggaaggccagctatgcaatggaaacagagtcagtgaaattaaagcgtaatgcacggaggagctctgcagggccatttgaac

SEQ ID NO: 744 - DNA, 283 bp, Zea mays
  misc_feature: Incyte ID No: 700549752H1
  unsure 188, 246-247: a, t, c, g, or other
taaggattaattcagaagagtgtttaaatagttagttaagttgtttcgatccatacttcgattttggtgtcccaaaattatgattctaagtaattagtctttcggtgttcgctttagtcaaagagaaatgtggaactcatatgatctattcttttcctaatgactgagctaggtccttttaaacaganagcaagtgatgtatgagctacctccgaataggctggaaaggtgtaattattataattnnttatatatcgctagttagtatttgcttaatgcggta

SEQ ID NO: 745 - DNA, 60 bp, Zea mays
  misc_feature: Incyte ID No: 700549758H1
ggatttgcaaaagtgccctttcattctgaagcatttttttccaacaaaacaacctttatg

SEQ ID NO: 746 - DNA, 279 bp, Zea mays
  misc_feature: Incyte ID No: 700549759H1
aagctgaggtcgaatctcctcgggcacaaagtttgcaatatatgatacccagcccccatgcaatgcagcagaacccgggaaaacaagccgtcggttctactcccggaaggtgtcgccaaaggtctcctccagcacctacaacatagcgcaggtttcatatgagctgaatgtgttgggtactcggggccctaggcggatgaactgtgttatgcactccatccctacctcgtgccttgaggctggtggcactgttcccagccagctggacagcatccttgc

SEQ ID NO: 747 - DNA, 148 bp, Zea mays
  misc_feature: Incyte ID No: 700549761H1
catgatctctgagaccctgagcatcagaacgcgttaccactgatgcttctctcgggaaggagagttgatcggcattgaacacgcacacgctatagtttttacccggtgaatggaccattcgcattggaacgatacgtttgagttctct

SEQ ID NO: 748 - DNA, 284 bp, Zea mays
  misc_feature: Incyte ID No: 700549762H1
  unsure 2-3, 11, 32, 57, 59, 90, 98, 126, 133, 152, 160, 180, 202, 205, 217, 230,: a, t, c, g, or other
gnnagagctanggataaccctcgtccagcatnggcgaacgcccggtgatcatcaggnancggctgctgcggagtaagtcgtgtccgtcgngatgcctncacacgacgggtggaccaagaagtttantccccanagagggggaagatccgagnttgttttngtttcgccaactggcgaggnaattaagaacaagaggcaactnagncaatacctaaangcacaccctggangncctgntgcttcagattttgattggggaactggtgatacccaaggcgttctgt

SEQ ID NO: 749 - DNA, 284 bp, Zea mays
  misc_feature: Incyte ID No: 700549763H1
  unsure 270: a, t, c, g, or other
tttctttagagaagaagcagaagagccactgggattttgttctggaggagatggtctggatggcaaatgacttcacacaggagcgtttgtggaaaaatacagttgcagcacagatgtcccattggatttcttctagaggtcgagcggtatttgaagaagcaagcattcagagaaagcagaaatctgttgctagagttctagccaatggtattatgaacttttggtgttcagttcatactttacgagctagtggtggtattcctaaaccantaaaaatcgagcaa

SEQ ID NO: 750 - DNA, 279 bp, Zea mays
  misc_feature: Incyte ID No: 700549768H1
  unsure 27, 102, 112, 116, 172, 252: a, t, c, g, or other
atgggataacggcacgcccttcccggnaccctgcatcgaccgccttgccccgcacatcggcaagtacgaggcgttggcgtggctgtgcggagggctagggtncttcgctgcnctcngtatggctgctgttgtgaacgacaaggcctccaatataccatatactcccaaagtntacccgtacgacaacttgagagctgagcttggtgatagaccatagaaggttttttgtctgtttgacaaggcatttgatgnatatgatctgagatctatatctccttt

SEQ ID NO: 751 - DNA, 283 bp, Zea mays
  misc_feature: Incyte ID No: 700549769H1
  unsure 18, 51: a, t, c, g, or other
ctccgtggctctcggcanacgagaggcagggagctcgcagagcgagtgatngtcaccagggcttcacctgtacgggaaatggataaagaaatgcgaacatgccaagacgtacgagaagatctccgacgagaacctggcgctgatgcgggagcggctgatggagacggtcatctggccgaccgacgacagcagcacggagaagatcggctgatgcctgatgcctgccgagtcctttcgggttgctgatcaagcttagctccttctattagcatgtagagcagca

SEQ ID NO: 752 - DNA, 280 bp, Zea mays
  misc_feature: Incyte ID No: 700549771H1
atcagataagatttttcatctacacgggcgtgactcgtttcattcaaagccaatgctgaagcctgaagctaagcacagccaaatcctaaactgttggtctctcatcttttaaacctatccttttttcttcgtgagatggtaatgactattatccatacggacaaaccacttcgacagatctggtatagtagtagacatagcgttaatagggcaaccattgatcgggttggttctctgaaacctttttagtcatcatgtgctgcttcacagtagctgaaga

SEQ ID NO: 753 - DNA, 278 bp, Zea mays
  misc_feature: Incyte ID No: 700549772H1
aatcaagatttgtggtcgttgatataaagaagaaccatctgaaggttgttctgaagggccagccacctatcattgatggtgagctctataagccagttaaggttgatgattgcttctggagcatagaggatggaaaaactctttccatattgcttacaaagcacaaccaaatggagtggtggaagtctgttataaagggtggccctgaagttgatacccaaaaggtggaacctgagaacagcaaactctctgatttggatcctgagactagacaaact

SEQ ID NO: 754 - DNA, 147 bp, Zea mays
  misc_feature: Incyte ID No: 700549776H1
  unsure 83, 143: a, t, c, g, or other
aggatgcacctggtgaggctgctaaaagaggatggtagccccactgaggagggccgaagaggttgaagatgatgggtaaggcnatgaagctgacaatctttactcagtatatgacgatgcacttcttatcctactcataattngcac

SEQ ID NO: 755 - DNA, 81 bp, Zea mays
  misc_feature: Incyte ID No: 700549777H1
  unsure 5, 12, 43, 68: a, t, c, g, or other
gaaangaaccanagacgtaccatgatatgcaagcgagtgtgtngcgcgaggatgcgctcttcaatgtngctattctcagcc

SEQ ID NO: 756 - DNA, 278 bp, Zea mays
  misc_feature: Incyte ID No: 700549778H1
agacaccccaatgcagtgatgatatggaacagtgccatatctgcctaaccgaatatgaggacggagaccagataagaacccttccgtgcaagcacgagttccacctgcaatgcgttgacaagtggctgaaagaaatacacagggtgtgccctctgtgccgtggagacgtctgcgaagtcgcctcgtgaagaccttggcgctgccatccttccgttgcggcaccggtggatagggcaccaccgccagcgccagctgttccgtggttgaagctggttcgg

SEQ ID NO: 757 - DNA, 281 bp, Zea mays
  misc_feature: Incyte ID No: 700549780H1
  unsure 260: a, t, c, g, or other
aattggagcagcactacactcctccacgcctccacctccagcctcccactgatctggcctctctcgagttaatcctagatcaatatgagaaggggctacagttacagtccttcaccaccaaggggctacaggagaagggcccgcagtccaagtcctcatgatcattatggtggtcgtggtagggatctcccaaccagtcttctggtcaggaatctccgtcgggactgcaggccagaagacctccgtcgcccatttggacntttggtcgagttaaagatata

SEQ ID NO: 758 - DNA, 275 bp, Zea mays
  misc_feature: Incyte ID No: 700549782H1
  unsure 105, 242: a, t, c, g, or other
gatcgaggagaaatcttttaaaccttcaaagcaggtgcgcgatatggtattggtccttttgagaaaggctgggcagctcaagaagcacgaagagcttgttgaacngatggttgatcggggttttattagccagcctcctaatgatgcattgtggagtgcactatctgcttgctgatcttcatgtgccagattgttatggaagtgtagtcacacataaaaggtatcctttctatgtgttgtancccaaacaaggcttcctgagtaaaattcttggg

SEQ ID NO: 759 - DNA, 278 bp, Zea mays
  misc_feature: Incyte ID No: 700549785H1
  unsure 119: a, t, c, g, or other
catgacgagaacctcaagcaaattgaggctgaaaagaagaaagcccagaaagaagctgaaaaggaggcaaaccaggacaaaactcctgtaaaatcaaaaaatgggaatgcagataaatngccaagatcaccatcaaccttctaatgatgtacggcagaacttcacatggtcatcatttcttcctcaacgaatgcccgcctttgctggcctgggcacaatttcgcaagcatgaacagtatacaaatccataaattccttgtggacaaatgcttacaaga

SEQ ID NO: 760 - DNA, 276 bp, Zea mays
  misc_feature: Incyte ID No: 700549787H1
agaccttctcgctgcattctggaataaactcactgtgggatgatgccagcaaaattttgtccttgacaggtgttgttattgagggtgtaactggttcatcaattttgacagcactgtcatcatggatgtgtaaaccagggtatgcttcgttgccagttgcatatgccagagctggcagtgagcttctggatctaattcaagcaaagccttcaatgcatctgcctgtttcatcggatgaactatttagtttgctcgatgaagcaagtaaaaaaacat

SEQ ID NO: 761 - DNA, 276 bp, Zea mays
  misc_feature: Incyte ID No: 700549788H1
aaaacactgtcgcggagtgaagtttgaatgatgatgtggatgagtaagctgctggagatagcctaatgagtaagcacgaaccaactatcaaagaaacacaataactcaagtatgctttattacttacaaattaaaaactactccaattatgttcacagccgaagtctcagttaaggctgtcaatagcatcccaccaaccaactgaaatgtttatctctatgttagagaactagcatgttcaaaactaactacaataaatgaattagaattttaaat

SEQ ID NO: 762 - DNA, 274 bp, Zea mays
  misc_feature: Incyte ID No: 700549791H1
  unsure 24, 40, 45, 71, 74, 78, 118, 165, 172, 174, 183-185, 209, 250-252, 255: a, t, c, g, or other
ctcagaaataaattcggtttcagngcgtcttccaacatancactnggagaatgaagataaaggtgacaggnagnagtntcctggagaagcaatggacggtgttgaacaagttacttgnaatgggcattgttgctagagtggatattcttcaatgtcatggtccangaggcananatgtgttgnnngatgggaacataactgcgagtggncattcaatgccagtgctgtggtaccacttcacaatgtccannnttnagtgtcatgcaggtctcag

SEQ ID NO: 763 - DNA, 273 bp, Zea mays
  misc_feature: Incyte ID No: 700549792H1
  unsure 50, 98, 112, 151, 253: a, t, c, g, or other
gaatcaggtaagctcagagtatgcattgattttcgcaatttgaatagagnaactcctaaagatgaatatcccatgcccatagccgacacattgatcantaatgtgtcagganatagaattattagctttcttgatggtaatgctggatatnatcagattttcatggccaaagaagatgcgtctaaaacagcctttatatgtccaggcttcattggtttatttgagtgggttgtcatgacatttggtctgaaanatgctggtgctacttatcag

SEQ ID NO: 764 - DNA, 274 bp, Zea mays
  misc_feature: Incyte ID No: 700549793H1
  unsure 115: a, t, c, g, or other
gatcgaggagaaatcttttaaaccttcaaagcaggtgcgcgatatggtattggtcctttgagaaaggctgggcagctcaagaagcacgaagagcttgttgaactgatggttgatnggggttttattagccagcctcctaatgatgcattgtggagtgcactatctgcttgctgatcttcatgtgccagattgttatggaagtgtagtcacacataaaaggtatcctttcttatgtgttgtacccaaacaaggcttcctgagtaaaattctttgg

SEQ ID NO: 765 - DNA, 209 bp, Zea mays
  misc_feature: Incyte ID No: 700549795H1
  unsure 29, 37, 39, 52, 57, 71, 76, 85, 118, 153-154, 201: a, t, c, g, or other
gtgcatgtatctggtggggatggtggggnctgaggangnaaatggtgatatntaagnaaaggtgtttaccnatacnggctgatantcctgatcgagcaaatgtcacaacattgtcggntgtagaaaatgcattacctcactgcatacatagcnnaaatcacaaaaacatactttgaaaacattccttttatagagaaccgnaaaaaaag

SEQ ID NO: 766 - DNA, 164 bp, Zea mays
  misc_feature: Incyte ID No: 700549801H1
  unsure 23, 41, 65, 119, 127, 129, 161: a, t, c, g, or other
gtactcgactccagagtataagnacaacctgtctgccacangcttacaacagcaacatcagccanaaccacaaccactttcatcagtcatctctggttatggaggctttggaagctcangtaatatncnaggaaattttacccttagtcagtagtactggngcg

SEQ ID NO: 767 - DNA, 293 bp, Zea mays
  misc_feature: Incyte ID No: 700549802H1
  unsure 165: a, t, c, g, or other
aaagtatctcatcatacacagcattctctcgcattgtgcttattctacgtgcacttcatgtgaataatgagaaggcaaagatgttgctcaaacctgacaaaacaattgttactgaaccacatcatatatggccaactctgaatgatgaacagtggttgaaggttnaatgtgcactaagggacctcattctttccgattatgcaaagaaaaacaatgttaatacttctgcactcacacaatctgaaatgcgagatatcatccttggtgctgaaattgctccaccatcacagcag

SEQ ID NO: 768 - DNA, 295 bp, Zea mays
  misc_feature: Incyte ID No: 700549803H1
catgatcagatgatcatgttagaagcagctaaagctacaacagagactgttgatgcattgagaactggagctgcagctatgaaagcaatgcaaaaagcaacaaacattgatgatgtagacaagaccatggatgaaattaatgaacagactgaaaatatgaaacaaattcaggatgctttgtcagctcctctcggagcttctgctgatttcgatgaggatgaactggaagccgaacttgaagaactggagggagcagagttggaatctcagcttctggagcctgttgcagctcctc

SEQ ID NO: 769 - DNA, 295 bp, Zea mays
  misc_feature: Incyte ID No: 700549804H1
  unsure 3, 153, 156: a, t, c, g, or other
ggngcgagaagtggctgaaacctgaatacagatctactgggagatcaatgctgcataagagagcaaaagttgagttttaccctcttggagtgattggtgcgattgtatcttggaattatcccttccataatgtttttaatccagtgctagcancantattctccggtaatgcagcagttataaaggtctcagaacatgcgacttggtcgggctgcttttatgttcgtattatacaagcagctctttcagctgttggtgcacctgagaatctggtgcacataataactggtttgcg

SEQ ID NO: 770 - DNA, 294 bp, Zea mays
  misc_feature: Incyte ID No: 700549806H1
  unsure 97, 133, 170, 236, 271, 277: a, t, c, g, or other
cttcaagagacacacttggaggagcgcgatgttgacctttttaaaaacctggtacatgaatatgattacacctgttggtcatgcagtgttgcaaggnttggttattcaggaactgctgttatatcacgggtanaaccaatctcagttcaatatgggcttggcataccagngcatgatcaggaaggcaggcttattaccttggagtttgatgatttttacttggtcaatgcttatgncccaaattctggacgtggtttacgtagactgaatnacaggntccaatgattgggacca

SEQ ID NO: 771 - DNA, 295 bp, Zea mays
  misc_feature: Incyte ID No: 700549807H1
  unsure 145, 235, 248: a, t, c, g, or other
tactgacgctacagcaccgtcagatgcctgactttctcaaggagctatgaatcatgaatgttaagagaaccattttctcttcggtgcgtgcgctgttctagatcactatcgtgtgcctatgaagtgatcagtgtcacacaagcancagcattgtgggctaaagcatatctccacctttacttagcttggtacaggcaggagacttcccattgtcattaccgtgttctatgctgantcatgtgctgctnccgttggccgggtgaggtgtgcttgttggccagcggtcgtgaccact

SEQ ID NO: 772 - DNA, 299 bp, Zea mays
  misc_feature: Incyte ID No: 700549808H1
  unsure 92, 159, 175, 180, 182, 205, 213, 248, 284, 289, 296: a, t, c, g, or other
acatgtgatcctcatgccagcaagcttgtggtaaactcagatactcctcaggaggttgaagccgggaagggaatcatatttacctatgatgnaggcttcgaggagagtgatatcaagtgggcttctcgctgggacacctacttgttaatgatagatgancagattcactggttcnctatngngaactctctcatgatcgtactcntcttatcngggatggtggcaatgattatgctccgcaccctttntagagatatctctaggtacaatcagcttgaaactgnagaanaagcccnagt

SEQ ID NO: 773 - DNA, 299 bp, Zea mays
  misc_feature: Incyte ID No: 700549809H1
  unsure 278: a, t, c, g, or other
tagtgagcgcttcacaaacttctgtcaagggaaactcacaagcagcccatggtcagaattggacggtcatcgataatctttgtctctggttgaagaccagttggtgaatattaaccagaagggtttccttacaattaacagccaacctgctgtaaatggagagaaatccgactcgcctactgttggttggggtggtcctggaggctacgtttatcagaaggcctacctcgaatcttctgcgcaaaggagaagttggaccaactaattgagaagatcanagcattcccttctctcactta

SEQ ID NO: 774 - DNA, 301 bp, Zea mays
  misc_feature: Incyte ID No: 700549810H1
  unsure 21, 58, 84, 178, 217: a, t, c, g, or other
tgctgttctcatggtttgcanaacctgtgggaagaagggcgatcactggacctcaaantgtccgtacaaggacctggctaccancgactgaaactttcacggacaggcctccaacgtcagatggccctcctgcaccaggtggtcctgctaagggagcatatgttcctccaaccatganaggaggtgctgataggactggagactcgatgcgccgcangaacgacgagaattccgtccgtgtgaccaacctctcggaggacacccgcgagcctgacctccttgagctcttccgtgcctttgg

SEQ ID NO: 775 - DNA, 300 bp, Zea mays
  misc_feature: Incyte ID No: 700549811H1
aatctccagaagttcatctagactctcctttgtctcgacatttgatgcatttttatgaacgcatgggtgacacacttgctttacagtatggtggttcggctgctcacaataagatattctctgcgaaaagagggcacttgaagtttgccattcaatctcaagagttctttaggacactgcaacggtactacagtaatgcatatatggatgcttacaaacaagctgcgataaacttatttttaggatacttccagccacaggtgggaaaacctgcactttgggagccagaatctggtgatg

SEQ ID NO: 776 - DNA, 301 bp, Zea mays
  misc_feature: Incyte ID No: 700549816H1
  unsure 4, 11, 50, 121: a, t, c, g, or other
ccgngaggtgntgaagcccctcaagttcgacaaggcatcggcttaaggtngggagtgtcactgtggacatgaggactaccttcctctggctctgctgttacctgcaagcattgctgctgcnggatgtgtgtgtttgatcagtgactggctgctgctccatagaagatgaacggagagaaggatgatgaagggctttggcaatcgccgctgcaaactgcaacccatgccatgccggcttagtgattgggtataatttggcttggcagcagccagcattattatgtgctgatctgttaccttt

SEQ ID NO: 777 - DNA, 292 bp, Zea mays
  misc_feature: Incyte ID No: 700549817H1
  unsure 196: a, t, c, g, or other
ataatacgatgctgcggcgccttgttgcgggagccgccgccgtgcgttcgccgctgccgccgctgttctgtcgggtgcttcacaacggcagcggaggtagtgggtgtagctcgggggatccggagagcgtggcgtaccgcatgtcgatgctgcggcgcccctctaccgtccgcaagaaggggctcacctggaactnctgcagcctcatcggtcgccttgccgcaccggtgaggccgttcgacactagctttcttgaagtccccagtgcgtacaccttccactccgtcacctt

SEQ ID NO: 778 - DNA, 282 bp, Zea mays
  misc_feature: Incyte ID No: 700549818H1
  unsure 76, 97, 137, 139, 188: a, t, c, g, or other
caatgctcgatgaaagcacaagtcaggaattggccacaccttcgagggcaaacaaatccccttccaagcctacatncaaggattgcaaggaagatcnctccaagaaaattcaaaaagtgaatgtttttgtgtctacnanactatgatattggatgcttttgtaatcttaattaattagaacggaggcntttagatgatattttggcatatgtatggattgttgacattaaacttgttattgtgcttgctgttatgcttctgtatgggagtattgacattgga

SEQ ID NO: 779 - DNA, 292 bp, Zea mays
  misc_feature: Incyte ID No: 700549819H1
  unsure 264: a, t, c, g, or other
aaaatgatgtgtctgctatgggagataattctgggcttccatgaaaacaacatgggttctcttacggacctggatatggtgaatgactatgaactgaaggaaagcaatgattttgggagtgcaattaatggtgttgatacagattttctgaactacgacgatgacgacggcggggacttcgacgacgccaacgacgatgagccaaaccccaacgagtttcagtctctcgacaacagtggttggtcttctcgcaccagggcgttncaaggtacctcaaggctttattcgacgg

SEQ ID NO: 780 - DNA, 291 bp, Zea mays
  misc_feature: Incyte ID No: 700549820H1
  unsure 33, 162: a, t, c, g, or other
cgttgtcaaaagcaaggacatttggattgtggnattctttgcgccatggtgtgggcactgcaagaaattggcacctgaatggaaaaaggctgcgaagaacttgaagggccaagtgaagctaggccatgttgattgtgatgctgaaaagtccttgatgagcangtacaaggtggaaggttttccaactattttggtatttggtgctgataaggagagcccgttcccctaccagggggctagagttgcatctgccattgaatcctttgcatggagcattggaagccaactctg

SEQ ID NO: 781 - DNA, 162 bp, Zea mays
  misc_feature: Incyte ID No: 700549822H1
agcgagatcagcaagtgccagttctacctagacatgctgaacgagtgccgccgtggtggtgtgtctgtctaagctgcctctgggattattcatggattttcttttcggatgggtatctcattaataagacaccgtgaaacttcgaccatctccacagcttga

SEQ ID NO: 782 - DNA, 296 bp, Zea mays
  misc_feature: Incyte ID No: 700549823H1
acaagatcttgaaggcaaagaatatgagaatatagataacatacaagctgaaaatcaagttgaattttatggaagaaatcaacatggtggcagtgatgtttacatgcgtgatcggagaacagaggaagccacaggttctctttctaatattgatgagtatggtcacaacagttctgttaggtataatggattgggttctctccgaagtgcattgcctgctagtggaggtaaagagtcattagtactggggtacgtaagaggagcttctgaagtacgaagcggaagattgatagctc

SEQ ID NO: 783 - DNA, 302 bp, Zea mays
  misc_feature: Incyte ID No: 700549824H1
  unsure 53, 63, 71, 96, 112, 189, 193, 223, 245: a, t, c, g, or other
ataatcaaacataatggtaggctgatcatccatgctgtcaaaagggctggttnaggattacgnatcaaagnaaaattcagtgacgtttcagatttnaacaatgatatttgangcttgcggcgccaagcatgagatttatcctgactaccttcgcgagtctgatgtggatgacgttgtggtctctcttgncgancttagctaagaaaggtctggtggaagatanttacaactccaaagcataaggntcccaaaaaacttccagggaaaacatggtttcctttttgggacagcttaattattga

SEQ ID NO: 784 - DNA, 300 bp, Zea mays
  misc_feature: Incyte ID No: 700549825H1
tgttggactgcagcaacaaatcctcacaatatttaaaaagtacgagagctatattgatgttgaaatacaacagagagcagttgagtattttgaactaagcaggaaaggccctgctttggcagatgtgttggctgaaatgccaaaattccctgagcgtgagtctgcacttctgaagaaggctgaagacgctgagattgacacagcagagcaaagtgctataaagctacgcagtcagcaacaaaacatccagtgctcttgttgtagctgatcatcccctgcaaatggatctgcaccaccagt

SEQ ID NO: 785 - DNA, 298 bp, Zea mays
  misc_feature: Incyte ID No: 700549827H1
cagcaagtaaacgtgtcatccttggaggatgtcataaagcactttatgcagctttccaatgagaaagctgaacaagctaagagtcaggtagaagccctggaagatgctctggatgttgaagatctggaagcagacaagcgtcccgaggacctcatgctcagttttgttagtggggagaaaggaaaggaccgatcagataaagaggttgtaactccatggtttaagttcctctgggagacatacaggactgttctagagatactgaggaacaattcaaagcttgaagcgttatatgcta

SEQ ID NO: 786 - DNA, 299 bp, Zea mays
  misc_feature: Incyte ID No: 700549830H1
cttattctctgcaggactatgagtatgcgagttttaacccagttgcattcgacattgctaatcacttctgtgagatggctgctgattaccatacagcaacaccacatgtgttggattttacgaaatatcctgacactggggagcagagaagattcgttgaggcataccttagctctgcaggtgaaaagccaacggatggggaagttgaagaactgctagggttgattgcaaagttacactcttgcgagccatctcttctggggcctgtggggataatctcggtgagccaccgacactag

SEQ ID NO: 787 - DNA, 298 bp, Zea mays
  misc_feature: Incyte ID No: 700549832H1
  unsure 47: a, t, c, g, or other
ggaaggtacgatatcattgcacaattgtgccatgcaaaacgtctagnagaaaggcttcttcctgttgcaagaatggtagtacctcatggtgcacatctagtaagccatgaaagaccagacgaggtgaacaatgcacttatggatttgataaaggccaccaaatctgcgataaaacctgaagagtggtcagcccagcccgagaacacgtcggaaaccggggcgctcattctgtgagacccatcgccgtcacggtgcgaacagatgcaggcgtagacgtcaccgcagcggtctataactt

SEQ ID NO: 788 - DNA, 289 bp, Zea mays
  misc_feature: Incyte ID No: 700549833H1
cagctttgatgagcttgggacattactggggattgatccaaggaaggctgagaagatagcatctcggatgatttatgaggatagaatgcggggctcaattgatcaggttgaggctgtgatacattttgatgatgacacggaagagctgcagcaatgggatcagcagattgctggactgtgccaagccctgaacgacatccttgacagcatgtcaagcaagggaataactattccggtgtgaataaatatctcatgctgtcggtcgatggtgcatggcagaactgcttac

SEQ ID NO: 789 - DNA, 289 bp, Zea mays
  misc_feature: Incyte ID No: 700549834H1
gttgctagtactattggacaatatggtaatggtttcaagacgagtacaatgaggcttggtgctgatgttttggtcttctcccgtagtcctggaaaatcaggcaaaaggcctactcaaagcattggcatgctatcttatacatttcttaggagcactggcaaagaggacatcattgttcctatgattgattatgaatataaacaaggctgggaaagaatggtccggactacattggatgattggagcacaagcttccaaaccatcattacatggtctccatattcaactg

SEQ ID NO: 790 - DNA, 285 bp, Zea mays
  misc_feature: Incyte ID No: 700549835H1
  unsure 52, 62-63, 117, 203, 222, 253-254: a, t, c, g, or other
tggcctcaagcccctcaggcctcagctcaccaccacgaaccaaccgacaganagagggacgnntgacgagctctcagtgctgcgataacccgccggccctgaacccggcctgacggngagggcaaggtcgtcgacagcttcggcgggctcaaggcctacgtcgccggccccgaggactccaaggccgccgtcgtcctcgtcgncgagtcttcggattcgaancgccgattatgaggaagatagccgacaagtnncttcgtcaaggtattgttgtggtaccagatt

SEQ ID NO: 791 - DNA, 271 bp, Zea mays
  misc_feature: Incyte ID No: 700549838H1
  unsure 9, 27, 31, 70, 90, 92, 94, 100, 102, 137, 167-168, 173, 177, 205, 221, 246,: a, t, c, g, or other
gataaaganagatttatcatcacggcnaaanttccatgtcctgtcttatttgtttggagctgtatttcgngatgataaatctctcttggngntnattttngntgagaagaatgctgaagtgcgcaagatttctagcngattagatgatcttgatctgcagctaaggnnggagnaagngcaatgccacaggatgacctcaaaaatnaaaaagttcctaaagncccatgctcgctttttgaaagcacnggnagnntnanaagtcacangctcg

SEQ ID NO: 792 - DNA, 261 bp, Zea mays
  misc_feature: Incyte ID No: 700549839H1
  unsure 15, 31, 51, 170, 200, 213-214: a, t, c, g, or other
gaaggcacctgaaangcatttggagatccanaggcaaatggtttctcaagnggcaacacaagcatcctcagcctcaaatccaaggcaatcaaggaagaagaaggacaatgacttctggtacgatgtttgtggatgggtgatccttggcgccggcattgtcgcttgggttngattggcaagagcaagcatgcctcccccgncgccaccagccanntgagaatgatcgagtgacgagtgccaagaacgctttgcaaatgatgg

SEQ ID NO: 793 - DNA, 295 bp, Zea mays
  misc_feature: Incyte ID No: 700549840H1
tgagccacatcagattcatacgttttacgaatcagttggccatatgatccaagctgaatctgacaacactaatagggatgaatacctcaagagattgatgagccttcctaaccagaagtgggcagaaataatcggacaggcaagccaaagtattgatatcctgaagaaccaagatgttatccgatcagttctcaacattctacagacaaacacaagtgttgcgagctcacttgggccacacttcttcccacagatttcactaattttcttggacatgctaacagtctacagaatg

SEQ ID NO: 794 - DNA, 293 bp, Zea mays
  misc_feature: Incyte ID No: 700549842H1
  unsure 57, 66, 87, 143, 156, 239, 247, 253, 261-262, 274: a, t, c, g, or other
caggtttatgatagtacttgcagtagccaggactctgttccaggtttctatgtctcncaatctctntgaagcggtacatgtgtttgnctgtgccttgttggctttcactgctctgctgctcatctcctaactacgcctgcctntttcctcccccgnaggattgatgagctcggcgagcttgagcaccagcatgcagggggcaatcaccagggtgagggcccccttcacgccgccgcagnggatcganctggancaccaggnnctgatctacaantactgtccgcgaacagcct

SEQ ID NO: 795 - DNA, 299 bp, Zea mays
  misc_feature: Incyte ID No: 700549843H1
  unsure 108, 114, 164, 187, 193, 198, 217, 223, 228, 255, 282, 292: a, t, c, g, or other
cagctttgatgagcttgggacattactggggattgatccaaggaatcgctgagaatatagcatctcgggatgatttatgaggatagaatgcggggctcaattgatcangttgangctgtgatacattttgatgatgacacggaagagctgcagcaatgggatcngcaggttgcttgactgtgccaanccctgnacganctccctgacagcatgttcnagcaanggaanaaactatccggagtggaatagatatcncatggctgtcggtcgatggtgcatggnagaatgcttncatgccc

SEQ ID NO: 796 - DNA, 296 bp, Zea mays
  misc_feature: Incyte ID No: 700549845H1
  unsure 30, 246, 258: a, t, c, g, or other
cgatcgccgcatctccactcttactcgaangtggaggtctccttcagccgccttctacgtcatcgcaactgccggggtcggtggctgcctcgagcaccgtggcacctcacggaaccttacagtttcgtggacttctgttgcgaacaaacatggagaaaagatatctgtgatctcaactgaaatatggagccagtcaaactagttgaggggtacaactttgatgaccatactacaagtgatgtccgngtttgctttaanctgattgatgagcagccggaatggttttcctgccactc

SEQ ID NO: 797 - DNA, 297 bp, Zea mays
  misc_feature: Incyte ID No: 700549846H1
  unsure 33, 285, 290: a, t, c, g, or other
caaaaaggtgatcaagtaagctgtgatgttcanccaggtattgattcaatcactgcaccggagatgaatgttaaaccaagagtcccaagaagcacggattcatactcaagtcagagcatttcggatccaaacagcaagagtgaccctaaaacaaaaacgcgaaggagcaagaagagtcgtctcacaaaaccatttcggataaatctgagatttcttcagtacttctcagatctgtgacaagcaaaggcatggttcagaaccaacatcggcagcttttgaagcagnacaanctacctg

SEQ ID NO: 798 - DNA, 299 bp, Zea mays
  misc_feature: Incyte ID No: 700549847H1
ccccgtcttcgcgatccctttcaccaactagggcaccacaaagaaacagactatgattctaggctcaacttatccggacaaggcgcactgcctgtttcagacctcaactcaaacgtcgtcatctggaagcaggatctccttgttaaggtcaaagaacaaggggacgagattgcacagctgagaaggcatctttctgactactctgtcaaggaggcccaaatacttaatgagaaacatgtcctggaaaaacgcattgcatatatgcgcatggcatttgatcagcagcagcaagatctggt

SEQ ID NO: 799 - DNA, 286 bp, Zea mays
  misc_feature: Incyte ID No: 700549850H1
  unsure 105, 135, 144, 257, 262, 278: a, t, c, g, or other
gataaattcacaacagtaggaggttatgagcatactgcagaggtaatttatggggacactgattctgtgatggtacagtttggtgtttctacagttgaagatgcnatgaagttaggaagagaagctgcagattanattagtggnacctttaccaagcccatcaaactggagtttgagaaggtctattttccttaccttctaatcagcaagaagagatatgctggtttgtactggacgaatcctgagaaattgacaanatggntgccaaaggtattganactgtaag

SEQ ID NO: 800 - DNA, 291 bp, Zea mays
  misc_feature: Incyte ID No: 700549855H1
atcaggaaattgtgaatttattactctgtggagaggctgttccaaatgtatttgatggcaagatggaccttggtggtggcatgtccttgaagggcataccaaacaatgttgaagttggttttcttaccctcctggaatcactaaatctctgcaaggttggtcagtacttgaagtgcccaaagtggccgatatgggttgtgggaagtgaaagtcactacacagtcctttttgccttgaaccccaacgttcaagaggagaatgagctggaagagcgcgaatcaaaaataaggg

SEQ ID NO: 801 - DNA, 291 bp, Zea mays
  misc_feature: Incyte ID No: 700549858H1
aacaaagaaccagtgggcccgtgatgatcctgcatttgttgttattctgattcttttcctcgtgtttgcaacatcagcttactgtgcagcatatggagagagtgcctcacatgctgctctaacaatcacttcggttgtgtttctccatttcttgtttgctgggatagttttggccacactttgctggttccttacaaattcttacttgagagaggaacctaacagccatgttgttgagcaacgcgtggagtggctctatgcatttgacgttcattgtaactcgttctttcc

SEQ ID NO: 802 - DNA, 297 bp, Zea mays
  misc_feature: Incyte ID No: 700549860H1
  unsure 220, 228, 233, 248, 256, 265, 267, 273, 281, 291, 293: a, t, c, g, or other
ggttggcaagcctcacgtcgcggtgcgaggcgttctggactacctgggcgtggagataacgaggcacagaaagaaagaatgagatgctgtacacatgtggtgatggggagccagttcaatgctgatggcactgcggccataaccataatccacgcacgcttgttggcaactaggcatatccctttcacctctgaactgttggaatatccgggaatcctgntcccctangtgcnttaattacgaattcnagaattcnagatcatancngggtangtagatcnacttcttctngnctgg

SEQ ID NO: 803 - DNA, 293 bp, Zea mays
  misc_feature: Incyte ID No: 700549862H1
  unsure 45: a, t, c, g, or other
cataattgtacttttcttttctttttctatatactaaattttctngtttttattaacacaattgtgaaggcttatcattacacgtccatgtgtcattgtgctcacttggatcttactaaagacaaagtatgggctgagaaagttcattggcatttgagtttgcatggctggcctattttggtcgtattttctgatgtgtgttcttcttatcgagcaagtatgaacaagcttcattttttatacatatggaattgcactattacagttctgatgtcatactgaatgcattttct

SEQ ID NO: 804 - DNA, 173 bp, Zea mays
  misc_feature: Incyte ID No: 700549863H1
agcacttaaggctgtactgttgctgtcaaagatctcaaacaaaaacaaccttgttggggatccaatagaaagagaaaggttgcatgacgctattgattgccttctatcttttgcgaacaaagatggcaccttttctacatatgagtgcaaaagaacttattcttggttagaga

SEQ ID NO: 805 - DNA, 168 bp, Zea mays
  misc_feature: Incyte ID No: 700549867H1
  unsure 43, 93, 104, 111, 126, 139: a, t, c, g, or other
gtggcaagaaaaagaccgtcgaccctttctctaagaaggattngtatgacatcaaggcaccgtcggtgttacagtgtgcgcaacatcgggaanactactcgtanccagganacagggtaccaggantgcgtctgatggnctgaagcacagagtctttgaggtttgcct

SEQ ID NO: 806 - DNA, 284 bp, Zea mays
  misc_feature: Incyte ID No: 700549868H1
aatataagcgctttccaggccgcgtactagaaaatcgggatggacgttgtattttggatggtgggctaagcggcttgagaattaagcaaggtgtttgggtggacttatggcttagtttcaccaataagcgggaaataagcagatacaaacagggccttagtgaaggtaagcagtaggcccatgaacaatggattgtcaatacctttttcttcatatgcatttggactttggagatcataccagtgcctgcttttggcaattctttcctaagtaaatatggcaca

SEQ ID NO: 807 - DNA, 285 bp, Zea mays
  misc_feature: Incyte ID No: 700549869H1
aaagagaagatagggaaggagtccaaagatgtaaaaatgaaagataagtcagtgaaagaatccaaagatgtggaaatgaaagagaagcccgggaaggactcaacagatgtaaaaacgaaagagaaggcagggaaagagtccaaagacctggaagtgaaaggggaggcagggaaagaatccaaacatggcgaacgaagaagccagggaaggactcaaaagatgtaaaaacgaaagagaatgcggcaggcaaagagtcgaaagacgcggaatgaaagaaaaggcgtt

SEQ ID NO: 808 - DNA, 167 bp, Zea mays
  misc_feature: Incyte ID No: 700549870H1
gaaagcatgtgagttcattgccaccaaagcccttgaatagtgctgcagccgccgtgcagtctaagcctagtgttactccaaaggaacagtttgttactgctcggcggcaagatttgcctgtaagttcaaagcagggagcagacactaagtccgagaaggataatttc

SEQ ID NO: 809 - DNA, 288 bp, Zea mays
  misc_feature: Incyte ID No: 700549871H1
cctcgcccgcccaaatacgaaagcctcagatctcagtgaccagcgccgccgcttcgttcgtgtcgaggggagaagaggaaatggcggcgagcgagggcgtgctcctggggatgggcaaccccctcctcgacatctccgccgttgtcgatgacgccttcctagcaaagtatgacatcaagctgaacaatgccattctcgctgaggagaagcattgcctatgtatgatgagttggctagcaacagcaatgttgaatatattgctggaggagccacccagaactctatcag

SEQ ID NO: 810 - DNA, 288 bp, Zea mays
  misc_feature: Incyte ID No: 700549874H1
gatatgatagaaaggctcattgtggagtgcgacaggaaaattcagagggccctgaaacgacttgcggatgacgatgccaaggctgctattgcgatatccgtctcggaggttactctgacggatgacatactgcagctgtcaaaacagatcaaggaaaaaatggtagaagttgatgcctttgattttgaagggagaactgatgataaaataaaggcccaggaagtagtggaagaactcagaactaaaagagctgatatgcaggctaccctcttgcttgatgcttttaac

SEQ ID NO: 811 - DNA, 292 bp, Zea mays
  misc_feature: Incyte ID No: 700549876H1
  unsure 171-194: a, t, c, g, or other
cacttcatataccactccctaggaggacccagcaacacacacagccgagctttgtttaggcaagatgaacaggaagccaggagactgggactgcagggcgtgccagcacctcaacttcagccgccgagacatatgccagcgctgcagcgagccacgtggagttgctgatcnnnnnnnnnnnnnnnnnnnnnnnnactacgccagcttcggtggccgcggtggctcctccttcggcggcggctttggcgctgctggctccgacgtccgccctggtgactggtactgctcctgc

SEQ ID NO: 812 - DNA, 293 bp, Zea mays
  misc_feature: Incyte ID No: 700549877H1
  unsure 45, 49: a, t, c, g, or other
accatgagctgctgatagaaattgataaaataaatatggaaccanaganagtacagatcattcctgatgacatgtctgtagatatactgattgagaggatggagtcctccagagatacagtttgttctccaaccttgatatggctaattcagcaatgccaacaccagtctataatcaatgctttgagacgatcattggtgaatgatgctaatagttcgaggcattgttttgagtacttaaacaaaaaggagatgattgttgctcacttagatcgtggtattgatgtctccatc

SEQ ID NO: 813 - DNA, 291 bp, Zea mays
  misc_feature: Incyte ID No: 700549878H1
  unsure 274: a, t, c, g, or other
gaatccaacttcctgatggacgacatctggcttatgaagaacaaggagtctcagctaacagagcaagattttcactgattgctcctcattcttttctttcatcaaggctaacaggaattcctggaattagtgcatctcttctagaagaatttggagtacgacttgtgacctatgatcttcctggttttggtgaaagtgatccacatgtaggccggaatctcaattcttctgcatggacatgctctatctggctatgctctcaatattccagagnaagttctgggttgtggg

SEQ ID NO: 814 - DNA, 172 bp, Zea mays
  misc_feature: Incyte ID No: 700549879H1
gagaatcctcacatacaaggtttatgtggatggcacaacaaccatgtcgactcatgagaggaaagccagcatcaaagaattctatgctgtgatatttccttctttgctgcaactgcaaagggggatcactgatgtcgaggacaagaagcagaaggccgtatgcatggagaat

SEQ ID NO: 815 - DNA, 162 bp, Zea mays
  misc_feature: Incyte ID No: 700549881H1
cacaaagtagtgattgccttggtgctgagaatctaattagattgctcaagaattattccagaagccacgagctcaaactggcaattacggtgggtattgttggactccctaatgttggcaagagcagtctgatcaacagcctgaagaggtcccgagtggtta

SEQ ID NO: 816 - DNA, 281 bp, Zea mays
  misc_feature: Incyte ID No: 700549883H1
gcaagcaagtatagctacagggttgaccagtgtagaagtatgaatccttactttgttgggattcttgtccccgtcgcggtctccctgctgctccgcaagaagagaaaggccgaaaggatgaggggagtgccagttgaggttggtggggagcctggatatgcagtccgtaactatcgttttgaacaacctgttgagacacactgggagggggtgtccacacttgctgatctgtttgagcaatcttgcaaagagtatgtatacatgcactccttggcacaagg

SEQ ID NO: 817 - DNA, 171 bp, Zea mays
  misc_feature: Incyte ID No: 700549885H1
ggtgaaggaggtgcctgaagcggaaccggaagagaagaaagactcgtaattttgttgcgtgtcatatccattgtttgtgaagggtcgttgtgtgtttaccatacaccatgggagagacctggtcatctatgaacccctgatgttcctcattcgtttacatgtgctccagtt

SEQ ID NO: 818 - DNA, 286 bp, Zea mays
  misc_feature: Incyte ID No: 700549889H1
tgctgattcatcaaagtgtgttgtactagacattgaggggacaaccactccaatatcatttgtgactgatgtcatgttcccttatgctcgtgataatgtacgaaaacatctgacttctacatttgattttgaggaaactaaagaagacatcaaactattgcgcatccaaattgaagatgatctacgaaatggagttgctggggctgttccagttccacctgatgagggtggcaaagaagaggttatcaattcatggttgccaatgttgaatcaatgattaaagcag

SEQ ID NO: 819 - DNA, 239 bp, Zea mays
  misc_feature: Incyte ID No: 700549890H1
  unsure 25, 100, 123, 139, 169, 183, 187, 231-232: a, t, c, g, or other
gaaaagaactgctagaaagtaacgngcgaacaaggttaccagaaattgggcgatatagatttactaggtctggatctgtaatcctccctgcatagctctnattcgtaactcgctgtcggaacnaaagttggtgtgtgtnttagcagaatgctttctgtccgtgaaagtnaacttgaaactgcntatnacgactgaaatgatattgtcgttcccccctgcgccaaaaaagannaaaaaag

SEQ ID NO: 820 - DNA, 288 bp, Zea mays
  misc_feature: Incyte ID No: 700549891H1
aagctgtgtgaagatgttgcaataaacacagtggcaaatactttggcactggctgaacagcaccactgctatcagctaaaaactgtttgcttaaaatttgtggctctgcctgagaatttgaaagctgtcatgcaaaccgatgggtttgattatttgcagcaaagctgcccatccctcctgaccgagcttcttgaatatgtggccaagataggagagcactccgtgagcccctgcctgtattcaactgaagtccttgatggtggagatgccaatggacgacgcgtgaaa

SEQ ID NO: 821 - DNA, 291 bp, Zea mays
  misc_feature: Incyte ID No: 700549892H1
  unsure 17, 25, 45, 47, 76, 90-91, 109, 116, 122, 126, 128, 135, 137, 148, 152,: a, t, c, g, or other
ctttcttggcatcagangccaaganagcatggtacttcttgggcnancctcttaacaagctttcttggcatcagangccatcatcaagcnnattccccgtctccttggncctggtntcaacnaggnangcaagtncncgaacctggtnactnagcaggaatccctcgagtccaangtnnnngagantnaggcnnncgtcaagttcccagctccaganggttctttgcatgggtgttgccgttggcaattggcgatngnngagnagcagatccagcngancatccagatgag

SEQ ID NO: 822 - DNA, 291 bp, Zea mays
  misc_feature: Incyte ID No: 700549893H1
caaggagttttcgattacaagcatgaaaggtggttaccgccgagtgttccagcggcctattggttttgagtgggaactcataacttacacagatgatacttcatctttagcagaaactgatttggatgttctgtccagaaccaagcctaaagaagcaaacgagcttatttctaagcaggaatcgcaggataagttggaaaaggctcctgatacctctgtgccaactaatgggaatagctcccaagaaaagcttattggcagcccagatatacgaccaaagaaattggcctt

SEQ ID NO: 823 - DNA, 291 bp, Zea mays
  misc_feature: Incyte ID No: 700549894H1
  unsure 218, 251, 254, 267, 271: a, t, c, g, or other
ttatggtcggacggatcacccccagcaaggagccgccacccgccactccgccagagcattgcagcgccagccacctcgccccctctcgctgtcccgcaccacccgctccgagggaaggagaggtaaccggtggcgggcgcggcggcgagcggagatcccgggaactccgatcgagcggcaagcggcgggacctgcgggagcagagagcgcgcagggangagaaatgagtaagcgtggttcgatggtaaggnagncgggatactacgncgtnctggaatgaacccgacggct

SEQ ID NO: 824 - DNA, 289 bp, Zea mays
  misc_feature: Incyte ID No: 700549895H1
gggaggcagtgccaccgacgacgaacctctgaaggtaccaatgtggagctcgaagtactcgaaggcgtgaagtggctgttctggtattagtgcacacggtgctatacagaattcagcttggtaggcagaccgcagatactagggttggaaggcaaccctgttcctgttccatttttggcctcctattttttctcttcctggcacaaaatactataaatatgtgctgtcagtaaatgggatctcactcttgagaagatacctcagctcgagaccgagtgtctgttctgct

SEQ ID NO: 825 - DNA, 291 bp, Zea mays
  misc_feature: Incyte ID No: 700549896H1
  unsure 46: a, t, c, g, or other
acggcgtcatcgtctcgctcgttcctttcgtctctgagcatggaanggagtcttgcgagtttggatggaagccggaccagcaggccgttccagctactttagtggctctcagacagctagcacgccggagctgggcctggtgcaaaggagaaggtgcgctggcagggaggatgggactggtcggtgtgcaaccgggaagcaggtgccattgttcaaagaaaaggaagctaaaggataaggaggtccatcaaagtccctgcaattaagcaacaaggttgcagacatcccact

SEQ ID NO: 826 - DNA, 282 bp, Zea mays
  misc_feature: Incyte ID No: 700549901H1
gaaagcgccaggtaaaggattcagatcctatcaaacaaacatcgctagagatggtgttaagagagaacttaaaagcatgtgctgttttccatggggatgcagcattcaacgctgccatcggcaggatccatccatcttcgtttgctcagctgcaacaggccctgaatactgcataagagtgcatagctgcttactggattgtatggagcattacgtggagcaggcattgctttgtgaggtcatatagattggtgggtgataatagaaacccacaaaagactg

SEQ ID NO: 827 - DNA, 176 bp, Zea mays
  misc_feature: Incyte ID No: 700549903H1
  unsure 15, 33, 35, 91-92: a, t, c, g, or other
cggataatatttganacaaacattatccgtgtnanccaaatcgacgtagaccagaatatagaaattataagcgtacagcactcgcagacanntctgcgtgaagaaaagctagaacatggccgtattctggtctacgtcgatttggttgacacggataatgtttgtttcaaatattc

SEQ ID NO: 828 - DNA, 273 bp, Zea mays
  misc_feature: Incyte ID No: 700549906H1
cgtttcaggagacgggggatttcttctcgcccttttcctcgccttgcggctgcggaataccggggccggcctggatttgctcgagagtgagaggaaggcgtaacagtgtgaaggaggcgcgggggacaatatggctgcggaaatggtgaaagcggcgacgagcgacaagctcaaggagatggattgggcaaagaacatcgaaatctgcgagctcgtggcgcaggatcctgggaaagcgaaggatgtgatcaagtctgtaaagaatgtataggg

SEQ ID NO: 829 - DNA, 184 bp, Zea mays
  misc_feature: Incyte ID No: 700549907H1
ggtaacatgctgatcgacactagctagaatggttgatgcatggcaacttgcattgacatgtggctgtctcttatcaagacatgtgattctcttatctctctctcttttatataaaggtatcattgtgctgggcttaagaagttattctcctaagggctaacaaaacaatcatgcaacgaatcag

SEQ ID NO: 830 - DNA, 276 bp, Zea mays
  misc_feature: Incyte ID No: 700549908H1
  unsure 173, 249: a, t, c, g, or other
cgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgcgcctcacctccgccctcancctcctccagggggatcggatacgccacaggctgcgcgatggtgctgtgggtcttcggctacggctccctcatctnggaaccccggcttcgattcgacgacaa

SEQ ID NO: 831 - DNA, 280 bp, Zea mays
  misc_feature: Incyte ID No: 700549910H1
aggcgacgaggcaggcagagcgggcggcgactacagcggcagcagatctcacggcatggcggcgaaggcgatctcgagccccgtgccggtggagtggtatccgacgctggccgtcgtcatggtatccgtaggcctcatgttcaccgcctccttcttcatctatgaagctacttcatccaagcggagccgtagcctggcaaaggagatcacaacagcagctgttgcttctgttttactgggctttgggtctctgttcgtgctccttgcaagtggtgtttat

SEQ ID NO: 832 - DNA, 228 bp, Zea mays
  misc_feature: Incyte ID No: 700549912H1
agaagcaacaagagcgaacgcaaaaagtacggtacagctcctgagatggcggcgccggcgccgaagcaggaggagctgcagccgcacgccgtcagggaccagctgccttccgtctcctactgcctcaccagcccgcccccatggccggaggcgtcctcctcggcttccagcactacctcgtcatgctcggcaccaccgtcatcatccccagcgcgctcgtcccccaga

SEQ ID NO: 833 - DNA, 278 bp, Zea mays
  misc_feature: Incyte ID No: 700549913H1
  unsure 165, 169, 180, 196: a, t, c, g, or other
cgctgtgttgttgataatgaaattatagttaacaacaggaaaagggcagatctatttttggagctccggcacaagaattttgaccctttcccaaagaaaaaaaagaaggctgaaccaactgctgtaggtgctatagaagaggaggaaaatgaagagtctcctganactncagcaggagtngatcctagtgactatnagtatctcctctccatgtcaattggtaccttgactttggagaagatacaagagctcaatgctgagaaacaaaagttggtggc

SEQ ID NO: 834 - DNA, 278 bp, Zea mays
  misc_feature: Incyte ID No: 700549914H1
agctcaggcgcatcatggagaatgtccctgtgcgtgtcagtaacacatcagggtcatctgctggctctggctctggtgatttccaccagtatcggcaaatgaggaggagagagcaggaccgtctagcacgaatggatgcggactaccagaagagaaaagagatagctgagttcgaactgcggagggaggagaggatgaaagcagctgaggagcggacagccaagaagcgcctgaaacggcaaaagaagaaacagcgtaagaaagagaagcgagctaaa

SEQ ID NO: 835 - DNA, 284 bp, Zea mays
  misc_feature: Incyte ID No: 700549916H1
agtgaatcctcgcagagcgacggcggcggcaccgacgagtttatgctagtgaaattagcagagatacggaaggaggttcagtgccctatctgcttaggcattatccggaagacaaggacagttatggaatgtttgcaccggttctgtagagactgcatcgacaaatctatgcgactaggaaataacgaatgcccagcgtgtcgcacccattgtgcaagcagacgttctttgagggatgatcccaattatgatgcactgattgcagccctgtatccagatattga

SEQ ID NO: 836 - DNA, 274 bp, Zea mays
  misc_feature: Incyte ID No: 700549918H1
gcgccgcctgattggcgattgctgatagtctgccgccagtgccctcgcccgatttgctccgccgagaacaacatggggagaagctataatcacagtccatcgccaccaagaggctacaggagaagaactcgcagcccaagtcctcgtggtcggtatggaggccgtgatactgatagggacctcccaactagtcttttggtgaggaatcttcgtcgggattgtaggcctgatgaccttcgtagaccatttggaaaatttggccccgttaaagaca

SEQ ID NO: 837 - DNA, 275 bp, Zea mays
  misc_feature: Incyte ID No: 700549919H1
  unsure 258: a, t, c, g, or other
atctctcaagccttttgaggccaccaatggtgaaaaccgaggcggcggaggagcgggagcccctcttcccggacgccagcggcggacagtagcggtcgagggtagcggcagaaggaccgccacggcggtgatcgacctcagcagcagcgactctgattccgacggcgagggtgcggtcggaagcggtaagagggtgaggggcgttggtggagacggctccgcgactaagcgggctagggtttcagcggtctcgatctncccccgggtttcctcga

SEQ ID NO: 838 - DNA, 210 bp, Zea mays
  misc_feature: Incyte ID No: 700549920H1
  unsure 26: a, t, c, g, or other
gtcagcatagttcaccatgatgatanaaaaaagagaaagaagtttggagtagttttacatgtggaaacaaaactgcttgtaagaagagagaatgtgcagccccagagtgtgagcaattttacatgcttgagtgtacaggggtttggagtagtcttggacttgcttattttgaggcatgtattgcagtcataggttacttctgctcaatag

SEQ ID NO: 839 - DNA, 271 bp, Zea mays
  misc_feature: Incyte ID No: 700549923H1
caaccgagctattgtaatagatgaattagcttctgaattgggcctcagtccttcagtgccactgcatgtcgttctgcaagattggatcaggcatacggatgggaaattaagttttcttggatttgtcaagttgttgcatggcatgtccagcaggtccctgtcaaagatgagatagctgtcgataatctctaacgacagcgcgtgtttacaccgtcctgttgacttggttcacaggcaaattaacagggctaaagaatcgtacgattggagc

SEQ ID NO: 840 - DNA, 271 bp, Zea mays
  misc_feature: Incyte ID No: 700549924H1
  unsure 85, 173: a, t, c, g, or other
agctgacctatgactataacataatgtacagatttgtccagtttggagcagctcaagtttgtcattgtgggtctcgaactgcagnaaaatgctaggcacgaccgaagtattcaggaagctcacagaatcatcatgccaagaagaaaaagcggaaaacaagttgtgagaattgnatacagcagtttcttcggctgtggcatccacataaaaaaatgtatgttggttgttggataattgactcgatcaagaaactaaaatgcatactctgaag

SEQ ID NO: 841 - DNA, 277 bp, Zea mays
  misc_feature: Incyte ID No: 700549925H1
  unsure 243, 248, 250-251: a, t, c, g, or other
aaataatgttgctcaaatatgtgtttttgagcttaatggaacacacaaatttgtactcgggaatattcatgttttgtttaatccaaagcgcggtgatgtaaaactgggccagattcgcatgctacttgagaatgcaaatgctcttgctgaaaaatgggataaaattcccatcgtgcttgccggtgatttcaacagcacacctgatagtgctatctacaagttcttgtcgacaatgaagctgancattncnntgcacgatagaaggcatttatctgga

SEQ ID NO: 842 - DNA, 277 bp, Zea mays
  misc_feature: Incyte ID No: 700549926H1
cagcagactatgaatgcaatgaaggcagcaaacaaggagctcaagggaatgatgaaaactgtcaaaattgatgaaattgataatatgcaagatgaaatgacagatctgatggacgtgagcaatgagatacaagaaactcttggtagaagctacaacatccctgatgacgttgacgaggaagaactgatgggcgagctagatgctttggagtctgatatggaatttgactcagctgcagtcccctcatatcttcaaccagattctgactttgatgctg

SEQ ID NO: 843 - DNA, 267 bp, Zea mays
  misc_feature: Incyte ID No: 700549927H1
ggaagatatctacgctggtgctcatattgtaatagacacagctgctgctcatgagaaaatattggcactgattgaggcaggtaacatagaaccatcagaactaattgcagatatggatgcccagatagcaaaagcaaaggaagaagcattgagtagaaaagatatccttgataaagtagaaagatggatgtctgcgtgtgaagaagaaagctggctgaagattataaccgggatgacaacaggtataactctagccgaggtgcccac

SEQ ID NO: 844 - DNA, 274 bp, Zea mays
  misc_feature: Incyte ID No: 700549928H1
  unsure 67: a, t, c, g, or other
gactatttctttgacatttgaactcgccttatgtgaaacactcttccctaaatacattgcaattttncttacattatagatcttagtcatgttatatctgttctaagccactttactggtccaataatatgatatattccttggtagtgtatgctatctgcttgctgatattgtagcacacatgagttgatatacctttttttcattagggtgcaggaacatggtggtgaaaccatacttcctttcagctgtgctttgaacagaaactagtgga

SEQ ID NO: 845 - DNA, 275 bp, Zea mays
  misc_feature: Incyte ID No: 700549929H1
aacaaggagaaggaggaggacttcatggcgatgaagggctccaagctgccacagaggccaaagaagaggcccaagctgatgcagaagtgcttgcttatggtgagcccaggagcttggttatcagatctatctcatgagagatatgaagttagagagaagaagagttctaaaaagagggctagaggcttgaaggctttgagcatggcgagtgattcagaatagagtttgaggcgaatggatttttggacttgactttagctggtggcaagaatctg

SEQ ID NO: 846 - DNA, 269 bp, Zea mays
  misc_feature: Incyte ID No: 700549936H1
ggataacctggaactccaacaggatgtccctgatcagcacaggtggcgccgtggcgttgactggtcatggtacatacactagtaagtcggctgacgggctgaggcctttttacagtggaaaatatcagattctttcttaaatgtgctccttggagacgcatatggaagacacgggaaaccctgagatgcaagttctttatctgactagcagttaaaaacaagtgttggacgtctgacagacttgcaaaaaaaaggactacctcactctt

SEQ ID NO: 847 - DNA, 270 bp, Zea mays
  misc_feature: Incyte ID No: 700549937H1
attctttattgtgtccttatccgtaaacatggtaatgacactcataagtgcaatatagtaatcgcagtatggttgtatgaaacttagaggttgtacaagttgtactgacaataagctgggaatactgtaatctttcagctactgctaggacagtaggccacttgtccaagagcactgaagtgatgaaacttgtcaacagcctcatgaaagccccggaggttgcagccacaatgcaggaattcagcaaagagatgacaaaggctggtgtga

SEQ ID NO: 848 - DNA, 271 bp, Zea mays
  misc_feature: Incyte ID No: 700549939H1
atgaaagattcaaagcagttgagcgtccaagggagcgtgaagatttatttgagaactatcttgtggaactgcataagaaggaaaaagccaaggctgctgaagaacacaaaagatatgtagcagaatacagagcttttctagaatcatgtgacttcatcaaggcaagcactcagtggagaaaagttcaggaacgcctggaggacgatgaacgttattcccgacttgagaagtttgatcggttggatatttttcaagagtacattcgacacct

SEQ ID NO: 849 - DNA, 268 bp, Zea mays
  misc_feature: Incyte ID No: 700549940H1
gtcactttttatctgcatttttgctacgagcatcctagaaatgagatggagtggtgttggaattgatgactggtggaggaatgagcagttctgggtcattggaggtgtgtcctcacacctctttgctgtgttccagggacttctcaaggtcatagctggtgttgatacaagcttcaccgtgacatcaaagggtggagatgatgaggagttctcagagctatatacattcaaatggactaccttattgatacctcctaccaccttgctt

SEQ ID NO: 850 - DNA, 275 bp, Zea mays
  misc_feature: Incyte ID No: 700549941H1
ttgatgcctattatgtggatgcgaatgaattgcctcctggtacctcaacagacatcggtagttttcagattggcccattccaagcacatatggaagcttctaaagtcaaagtaaaaattcgtttgaatttacatggtttggtttcagttgaatctgctgctttgatagatgattatcaaaggaatgcaacttctgctgaccatatggaggtggataccagcggtgatgacatgggtcacaagtcaagaagtgaaaggtctatccagcggcaggag

SEQ ID NO: 851 - DNA, 272 bp, Zea mays
  misc_feature: Incyte ID No: 700549942H1
atgacaagttacctgaaaatgtggaatgtggcttccagtgtgcacttctctatactactgtatatggacaaaggaggatccgagtcataaacctttcactttcatgcacaaatttgcttgccaatcttttccggtatgctgatttggagacacagttttcatgcttcctgaagcaagctgctaatggcatcccgacatctccattacctcgtattcgggatgaagcaacaaatacatgcataaatatcttcaatcttaccgcaaacatgtgc

SEQ ID NO: 852 - DNA, 274 bp, Zea mays
  misc_feature: Incyte ID No: 700549943H1
  unsure 26: a, t, c, g, or other
atgacaagttacctgaaaatgtggancgtggcttccagtgtgcacttctctatactactgtatatggacaaaggaggatccgagtcataaacctttcactttcatgcacaaatttgcttgccaatcttttccggtatgctgatttggagacacagttttcatgcttcctgaagcaagctgctaatggcatcccgacatctccattacctcgtattcgggatgaagcaacaaatacatgcataaatattcttcaatcttaccgcaaacactgtgc

SEQ ID NO: 853 - DNA, 271 bp, Zea mays
  misc_feature: Incyte ID No: 700549944H1
gactatttctttgacatttgaactcgccttatgtgaaacactcttccctaaatacattgcaattttcttacattatagatcttagtcatgttatatctgttctaagccactttactggtccaataatatgatatattccttggtagtgtatgctatctgcttgctgatattgtagcacacatgagttgatatacctttttttcattagggtgcaggaacatggtggtgaaaccatacttcctttcagctgtgctttgaacagaaactagtg

SEQ ID NO: 854 - DNA, 272 bp, Zea mays
  misc_feature: Incyte ID No: 700549945H1
agagatcttgcaggcggctcgttggcagcagtttctgttcacgctgaaagtcaaggaggagatctataatgatgcgccgcaagtcaagtgcaacattactaaagcagagaagctggatccggcaatagagagttcttaccttctaggggtaatcaatggcctgttgcaggatgacactggctcatcttctggggcgcaaggtgccatggcctacaatgctggtatcagcaacactggcgctggacgaatgtgccaacctccaacagtgccta

SEQ ID NO: 855 - DNA, 275 bp, Zea mays
  misc_feature: Incyte ID No: 700549947H1
aaggaagccaaaaaggaggtcccgaagcctaaggaagctgagaaaccagcagaggaagaggaggctccaaagcctaagccaaagaatccccttgatttgcttcctccgagcaagttgattcttgacgattggaagaggctgtattctaacacgaaaaccaacttccgtgaggttgctattaaaggtttctgggacatgtatgacccagagggctactccctgtggttctgtgactacaagtacaatgacgagaacacagtgtcgtttgtgatatg

SEQ ID NO: 856 - DNA, 278 bp, Zea mays
  misc_feature: Incyte ID No: 700549948H1
  unsure 63, 240, 272: a, t, c, g, or other
accgaaacagttgcagtgattggccgttacataagtgagaactacaatggtgttgctctgcanccaattgattttatagatactagttctgggaagcttctggctgaggtgatggaccctgacataataacaatcagcccagtgaacaagctacatccgcaagatgacatcctagctacaggaagctcaaggtctattttcatatggaagccaaaaattgaagatgaacttactgaaganagagccaagcatgacaatagtagtgatgacgnctcagg

SEQ ID NO: 857 - DNA, 271 bp, Zea mays
  misc_feature: Incyte ID No: 700549949H1
  unsure 31: a, t, c, g, or other
gaacgactacctggctgtgactgcggcgaanacgcgacattcctgccgcactccgcggggcgctactccaagaagcggttccgcaaggcgcagtgcgccatcgtcgagcgcctcaccaactcgctcatgatgcacgggcgcaacaacggcaagaaggtcatggccgtccgcatcatgaagcacaccctggagatcatccacctgctcactgacgccaatcccatccaggtggtcgtggacgccattatcaacagtggaccacgtgaggatg

SEQ ID NO: 858 - DNA, 266 bp, Zea mays
  misc_feature: Incyte ID No: 700549950H1
catcagctagagatgcagaaatggctgtaaaagcaggagctgagcttataggcatgatactatggcccaactctaaacgctctgtctcgttattggaggcaaaagaaatatcaagagttgcgcaatcttatggcgctgaatcagttggtgtcttgtggatgataatgaagagagaattctacgggtgtctgattcatgtgaccttaactttgtccagcttcatggtgatgaatctcgtgcatggttcatactctttcaaagaataa

SEQ ID NO: 859 - DNA, 266 bp, Zea mays
  misc_feature: Incyte ID No: 700549951H1
ggcattaaagtacaaaacggctatggccttactgagacttctcctgttgttgctgctagacgaccattctgtaatgttcttgggacagttggtcacccaataaagcatactgaaatcaagatttttgacattgagactggtgaggtccttccagatggttcaaaggggattgtgaaaattaaaggaccacaagtaatgaagggatactataagaacccatcggctacaaatgaagctttgatcaagagggttggttcagcactgga

SEQ ID NO: 860 - DNA, 267 bp, Zea mays
  misc_feature: Incyte ID No: 700549956H1
gacaaggggagattcgtggggggcgttttgttaacccattcctcgaaggtctggttagaatagtctcccggatcacatttgtcttggatgatgatccggatatcattgctgttgctcgtgattacaatcttgcttcactcttcactgatctgcttcagatgaatgggcttgacgtagtccagattgtctctgctgtttcactagagaaactctcgcagcagtcaaaacatcttacgaagatactgcctgctcccagcccagggctgt

SEQ ID NO: 861 - DNA, 271 bp, Zea mays
  misc_feature: Incyte ID No: 700549957H1
  unsure 88, 236-237: a, t, c, g, or other
accttatcaaggttttctcctgttcttcggatagttgagatcctaagagcaccttttgctctgctatgtcctcacacaagagcatggncttcggctgatcagccgaagcagctttttcccttctgaacttgtattgctcacaagctttagctccatctatattatggattgcttttgagtctgtcaaatttccttcggcccttctggcagcttcctgacttccatgaatagcaagnnccccttggtccgaagtatcttcatgcaaagataa

SEQ ID NO: 862 - DNA, 269 bp, Zea mays
  misc_feature: Incyte ID No: 700549958H1
agaacaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcggttagtcctgccttca

SEQ ID NO: 863 - DNA, 269 bp, Zea mays
  misc_feature: Incyte ID No: 700549959H1
atcatcttgaagaaattttacaggcttatattgacaggagagagcaggttcgtcttatcaaggagctctacgggaaccaaattggcgagctgttccatagtcttccttataatatgatagagtttgtattggaggattttgagtgcaaggttacaatcagtatccgatattcggatctactgcagaccctgccgagtcaggcaagggtctggctggccacttcgctcggccaagaaaatatctacaagaagcagcagtgcatcagctgc

SEQ ID NO: 864 - DNA, 270 bp, Zea mays
  misc_feature: Incyte ID No: 700549961H1
  unsure 266: a, t, c, g, or other
actagttctagaatcactcccaactataggggcaatctttctggtttgaagtataattacacaaaggtggacgaggctatgaaatactacgagaaatctggattgaacaagaacaggaaagggaagttcccagatagcaattcataccaggacttggtgttccgttttttcacgaagagagggggcggctctggatatgcctcacctgtcacaattgggtcaatgttgtttgatggtaactctttggtggttcaagatccctttcntcgc

SEQ ID NO: 865 - DNA, 272 bp, Zea mays
  misc_feature: Incyte ID No: 700549962H1
gcttgatgacgccattcaatcgccgcgcggcccacgcctcttctccccacctgctccgcgcctgctcatccgcctcttataccatcgctctcgctcgcctccgacgccacttcacctcttctgcttccttctccccagcatacagtgccagacaggatacccacacattcatggaggtggttcaagaagtccttaggcatggctcagcagatagtgtccgtgctgtcataagagctaacaaaaagagctacagccttgtccagctcattgca

SEQ ID NO: 866 - DNA, 274 bp, Zea mays
  misc_feature: Incyte ID No: 700549963H1
agccttgaatgagctttatgtcgaagaggaggactacgagagactccgtgaatcagttgacatgcatgacaactttgaccagattggtcttgcccagaagcttgagaagcatgaaatgctggagatgaggaggatcgccgcctacatttacaagaaggctggcaggtggaagcagtcgattgctctatcgaagaaagacaacatgtacaaggactgcatggagacatgctcacaatctggcgaccgtgaactgtcagaggacttgctcgtgtat

SEQ ID NO: 867 - DNA, 275 bp, Zea mays
  misc_feature: Incyte ID No: 700549964H1
  unsure 90, 112, 175, 200: a, t, c, g, or other
gtctgctcgttcgatctgtgcagcagatctgaggtcccgggcgaccgtgaagcagcttcaatcgtcggcatggcgcttcgtattgcatantggggctggaaacaagaatgcnttcaaagcacttattgctgcagaatacagtgggatcaaggttgagttgaccaaggattttganatgggtgtctccaacaagacccctnagtttcttaagatgaacccccttgggaaggttcctgttctggagatcctgatggccctgtttttgagagtaatgc

SEQ ID NO: 868 - DNA, 280 bp, Zea mays
  misc_feature: Incyte ID No: 700549966H1
aacagattcagaaacagaaagtagttctgccgcaggagatgttgaaactgaatatctagatctaaagctactttctagatgtatgcctgatttaatggatgttgactcgcccaattgcttatcgaaaacaccagtgaaaaaaaagcatgtgactcttgtgcttgatttggacgagactctggtacattcaacattggatcactgcgacaatgctgattttaccctagaagttttctttaatatgaaaaatcacacagtgtatgtgagaaaaaggccttac

SEQ ID NO: 869 - DNA, 277 bp, Zea mays
  misc_feature: Incyte ID No: 700549968H1
  unsure 107, 187, 193-194, 214-215: a, t, c, g, or other
atgaaataggacattcatttcattgcaattataatatacttgaacggaatgagtcagtggttacatacatagtttcggagcatgtcgatcaaacaaacaaggtaganctacaaagttgcttatgataatgttcaaggtgacatatggtgcctctgccgtttgtaccaatccaaaggaatattgtgcngcatgnnctcactgtactgagacaggnncttgtgctgatgattccacaaaaatacatcattcatcgctggtgcaaggactgtaaacaaac

SEQ ID NO: 870 - DNA, 274 bp, Zea mays
  misc_feature: Incyte ID No: 700549969H1
  unsure 143, 256, 263: a, t, c, g, or other
agcgtagataaacgtcgaccattatgggaccttacagcaccgccgtcgccgtaagcgcatcgccggtcctgcaggcttcctcactcttgacgcgagcccgtggttcttggaggcccacggtggcggcgttgcggctttctgantccgtgaaatgccgtcggcgggcactcaccgtgacctgtgcgctcccggagaaagaacggcgggcggcattcaacatccggcccactgctctgctgtgccccgtgcccccgcnggacggnaaggaaggtgg

SEQ ID NO: 871 - DNA, 267 bp, Zea mays
  misc_feature: Incyte ID No: 700549975H1
  unsure 151, 156, 159, 162-163, 169, 187-190, 192-193, 201, 205-206, 209, 211-212,: a, t, c, g, or other
aagcaatgccacctcttttttttaaataagctttctaggaaagtaagcaataatttagctgtgctgttgttaattgtttttggccgatcaatttgcatcactcattaaattttgaacatgtgtttacatgcatcttattcaaatttaaatncggcnggncgnncgatanaaatttgaataaggggcnnnngnncacatgtncacnnttnanncgggatgcaaatncggaccgngnnnttacgngnancnaatcaccctnaaannggc

SEQ ID NO: 872 - DNA, 269 bp, Zea mays
  misc_feature: Incyte ID No: 700549976H1
  unsure 33: a, t, c, g, or other
atctcctcgcattttccttgcaaccgattgccnatccccctcccaaccaaagaccgatggcgcccaaggccgagaagaagcccgcggcgaagaagccggcggaggaggagcccgcggccgagaagacgaccgccgggaagaagcccaaggcggagaagcgggtccccgcgggcaagtccgccggcaaggagggcggcgagggcaagcgtggcaagaagaagggcaagaagagcgtggagacgtacaagatctacatcttcaaggtgctg

SEQ ID NO: 873 - DNA, 266 bp, Zea mays
  misc_feature: Incyte ID No: 700549978H1
ggctgcttttgatgaggccgagaaaaagaaggaagaagaggtatatatttaaacaccatatagtgtttttgtgacgggtgtatgcatgagtgtcccgtatattgggttttgctgtatgttgtgtctttgccatgcatcctggtttatgttgacgtaggggaatatcttgttaggttgaactgaatgaactataaccagtggcaagtgcatgtgagtttaacagataaaactatcgagtttaaccgtccgttgtgtttttttgtgtc

SEQ ID NO: 874 - DNA, 282 bp, Zea mays
  misc_feature: Incyte ID No: 700549982H1
atcaagaaaaggcagaagctgaagagagttctaaatgtggagatctagtggaagaaaaggagggtgcatcatgcagagtaggggtggagggagcacaaattgttcggaaagatgccgagttggaggttcctttgggagaagttacagagatggaaaaccaagggccggacatggtggagttggtggtcagtgaggaagaagttccaggacatgagaaagttgacgaagagatgatggggaggagatcaatcaacagctattctccctcggcaactctgaaag

SEQ ID NO: 875 - DNA, 280 bp, Zea mays
  misc_feature: Incyte ID No: 700549983H1
ctcgtgtaattcagttccggggttgctttattcatcactggcagagtggtagtgggtgctaatttctgcaggagttaaggctatgcatgctagtttgtcaggactttgcagtcatgacttttgttcccaacaaatcgatgaacattagaagtgaatgaatagttgccgttttgtaacgagtttgacgtacagtatgcatgtcggttgccaacttccaaagctatatcttgatccagcatacatgtttctgtatagattgtgatgaatgtttttttgttat

SEQ ID NO: 876 - DNA, 260 bp, Zea mays
  misc_feature: Incyte ID No: 700549985H1
  unsure 24, 86: a, t, c, g, or other
atcaaaaccagatatgctggttantgggaaaaggtaaaatcaacagaagacagagattttcaaagattcctggacaacgtgcaatnccaaaacaagtgggatattacgttacgagcgtgtctttggtgaaggttttgtgagcactggtggaatcgagacaacaaaggaatttgtgggcatgctcgatcttaaaccgggccagaaagtacttgatgtcggatgtggaattggaggcggcgacttttacatggctgcaaact

SEQ ID NO: 877 - DNA, 281 bp, Zea mays
  misc_feature: Incyte ID No: 700549987H1
caagtgtccttcctccatcttcctcctccactccactcccaagtccccaccacccccaaccccgtctctccactgcggcgcaggcttcgcttcggctccgctcggctcgagcagaagaaaatgcaacgggcagtgcaggccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaatgcc

SEQ ID NO: 878 - DNA, 266 bp, Zea mays
  misc_feature: Incyte ID No: 700549989H1
tcgagtactcgtgacagggggagaacttccacgaggagaacccgagctgctcctaagaataatgaccaattgttggcaatgagcacaatcacttctgaggttgatgatgagattgttgatgtaaagcccatagtatcaatgtctgttgaaggatggaatacttcaaattcaaagaaatctcactcaaggctagacaatattataatggaggctataaagaacttgaatgagcctacagggtcccacagaactactattgctattac

SEQ ID NO: 879 - DNA, 266 bp, Zea mays
  misc_feature: Incyte ID No: 700549992H1
ctctctcttgctcgcactcgcggagatcgaagagaagcgcaggaggccccagcactagcgccgccccgccgccgcatcagacatggcgctggccgctcgcctcgtctcgcgctcccgtcagctatattcggttcaagccactttggggaatggaggtgtcactcaagttcgctcctttgccaaggatgcagctccagctgaccgtcctcctgtcagtggggatgatctcctgaagggcatattctttgaggtaaagaagaagtttg

SEQ ID NO: 880 - DNA, 268 bp, Zea mays
  misc_feature: Incyte ID No: 700549994H1
gctatcgatgcttcagatgggctggacacgcttgcaaaccttgcgattcttggtgaaggtgaagctctcccttcacagccaacaacaaaacatccccgccatcgtccgggctgctcatgcatcgtctgcatccaaccaccaagcgggaagggtccaaagcacaagcaaacttgcacctgtaacgtttgtatgacggttcgccgccgtttcaggacactcatgcttcgacgcgagaagaaggcgacaaaggatctgtctcgcaagaaag

SEQ ID NO: 881 - DNA, 269 bp, Zea mays
  misc_feature: Incyte ID No: 700549995H1
gcaaggtgaccgtccacctggatgaactggtcaacaccattatggagtgtttcagcgaccccaaacctaagaagaaagctgcacgggagaacgccgcacaaggggcattatggtgccttgagcgctctggttatgtcaagtcatcttcagatgttcctgacctgtgcggccatcagcccttctgctagccagatctacccttgtaggagtattaatgttggtagacgggtgcagcttgttgctgtggcacagtggttatccatgcactg

SEQ ID NO: 882 - DNA, 281 bp, Zea mays
  misc_feature: Incyte ID No: 700550002H1
  unsure 244: a, t, c, g, or other
aggaaccaagacgtaccatgaatgcaagcgagtgtgttgcgcgaggatgcgctcttcaatgtgctattctcagccccactttcaaagtgcgagaattccaggtcaatgatgggtttcctttctcaattgcattgtcatggaatggagactcccagaatgcaccccaacaaacccttgtattccaaaaggggaatgcaattcctagcactaaagctcttaccatctttaaatccagcacatttgnagttgatgttttgtatgtcgacccagataactcacaa

SEQ ID NO: 883 - DNA, 282 bp, Zea mays
  misc_feature: Incyte ID No: 700550003H1
  unsure 64: a, t, c, g, or other
ggcaagagttctcggcttctcgcgagtcgcgagtcgcgacagagagagaggcggagttgcgganaagatgcagagcagcagcatgaagagggagatcagcgaggcccacgacaccattcgcttcggcatcaacgccggcgtcaaagccgacctcgccccgccgcacccgctccagtctaccatccaatcggagaccaagttctgggcggacaagaagaagttcgggacagatgccatatacggatccgccctcaacatccgcaaggatctcgatgcccaaat

SEQ ID NO: 884 - DNA, 278 bp, Zea mays
  misc_feature: Incyte ID No: 700550009H1
  unsure 66, 230: a, t, c, g, or other
gacattcatatcagcagatgatctccgaataaatttatggaacttggaaataaacagccagagctntaacattgttgatgtgaagcctacaaacatggaagatctaacagaggtgattacatgtgcggagttccatccatcccattgtaatacactggcctatagtagttcaaagggttctatccgacttattgatctgcgtcaatcagcactgtgtgacaaccattcanaaatatttgaggaacatgaagcacctggatcaagatccttctttacag

SEQ ID NO: 885 - DNA, 278 bp, Zea mays
  misc_feature: Incyte ID No: 700550010H1
ggactctaaaggatattttgacctactgatcaaggtttaccctgatggaaaaatgagtcagtattttgcaagtttgaagccaggagatgttgttgaagtcaaagggcccattgaaaagctcagatacaacccgaacatgaaaaaacaaattgggatgatcgctggtggttctggtataacaccaatgctgcaggttgtcagggctatcctcaaaaaccctaatgacaacactcaggtctccttaatttacgccaatgtgtcaccagatgatatattgc

SEQ ID NO: 886 - DNA, 275 bp, Zea mays
  misc_feature: Incyte ID No: 700550011H1
tggaatacccctggaacgatgaggtggtagctcagttctatgccaccctctggataaagaaagtagatgaggaagccgatgggtatgagtacccagtcatgtatttctttatccagggtaactggcacaaagtcagttatcgtcgttttgcccatattctaggcttctctgatacagacattcagggcagcaacatgcgagtgcatggcattcggctgcccatgcgggaagagacggaattcattcatgtctctactgagcgggagttctggaca

SEQ ID NO: 887 - DNA, 277 bp, Zea mays
  misc_feature: Incyte ID No: 700550014H1
  unsure 49, 52, 57, 125, 128, 171, 173, 179, 183, 195-197, 204, 236, 248, 258, 264: a, t, c, g, or other
tcgacagatcccagagcaccctcggcggggccgccgccagctgtggcgntanccgtngcatccccaagggtttcggctccgtgaacatggacgagctgctccagagcatctggaccgcagagganacncaggccaaggcctccgcctccgccgctatcgcaggagcgagcncngggatnccgnccacgccgatgnnncggcagngatcgtcgctcacactgccgcgcatgctcagnaccaagacggtncgacgaggcntggagnaatctcgtgcgcg

SEQ ID NO: 888 - DNA, 276 bp, Zea mays
  misc_feature: Incyte ID No: 700550015H1
  unsure 126, 267: a, t, c, g, or other
cacagccttggctagaatactttgagaatggagtccccatgtccagaacttttaaccataagttgtattaaattgacttctatcatgttttaaactgtattaaattgactgatatcatgttttttnattggcaaagcaatgaacgggagttgttaagtgtggggcagactaccatgactgggggtcagctggaaaagtacgtaaatgaaggtgacaatggtgatcaaaatactcagagcattcatcactgcttcacttgtgatgaanagttcaatc

SEQ ID NO: 889 - DNA, 267 bp, Zea mays
  misc_feature: Incyte ID No: 700550017H1
  unsure 231: a, t, c, g, or other
agcatgcagatgacgggtcaggagtcaagtatgcagaagacaagcgtgcagatgacggttcagaaataggtgctgccctgattgcagcctcgcaatctcagtagagagatgtcctgagtggtatagaggtagcaagtagctatgatttgtttccaacgtcttaactgtccagcgtctgcagtttagcatgctagagctggatgcgatctgtaaccaaaaccaggcttggcnttcctggctgttcataattccaataacagcagggtt

SEQ ID NO: 890 - DNA, 270 bp, Zea mays
  misc_feature: Incyte ID No: 700550018H1
  unsure 213-215, 218-221, 232-233, 236-237, 239-240, 242, 249, 251, 253, 261,: a, t, c, g, or other
ctaagaatatcattgtaaaggattacgcatgagtctggatatcatctccaaccaagaccgatatgaaaataccatcgtgatgttgtcaataccagccataagcgtgggtctgtctgattggggttactcgcattaatattgtactgtattgtattagaggttatgcggcatactcataatctgaataagataacaaaatttggcaaaaaaaannnaannnnaaacgaaacannganngnncnaggaacnantnaagtatgngaatnnnnc

SEQ ID NO: 891 - DNA, 277 bp, Zea mays
  misc_feature: Incyte ID No: 700550019H1
  unsure 4: a, t, c, g, or other
ctgngatcggatggaatttgcaaggattgtggtagaaaggcagacagcaaaggaagaattatctgtgacaggtgtgaagccgcgtaccatgtttcatgtctcaagcttgccattgatgaagaggccccagcaaaatggtactgtcccacctgcgtcgaaccagacgtacctttaaagagcaacaaccatggcagagcacatgaaggctgcgatgtatgcgagtggcttgaggtggagaagccagaagaacctgccgaagaacctgaattggccgtca

SEQ ID NO: 892 - DNA, 275 bp, Zea mays
  misc_feature: Incyte ID No: 700550022H1
taaggattaattcagaagagtgtttaaatagttagttaagttgtttcgatccatacttcgattttggtgtcccaaaattatgattctaagtaattagtctttcggtgttcgctttagtcaaagagaaatgtggaactcatatgatctattcttttcctaatgactgagctaggtccttttaaacagaaagcaagtgatgtatgagctacctccgaataggctggaaaggtgtaattattataattaattatatatcgctagttagtatttgctta

SEQ ID NO: 893 - DNA, 275 bp, Zea mays
  misc_feature: Incyte ID No: 700550024H1
  unsure 186, 216: a, t, c, g, or other
gaggaaatcgccagattacatgcaaaacttagtcaaacggaaattcatgctaccagtttgatctcgaggcttgaggccaccgaagcaaagttgaagagccacgagtcggattcgttggctttgaaggaggagatcagattattgactgataacctggagtctgttagaagtgaagcgatgtcgcgngagaaggaagtcaggatcctggaacagaanagaaccatcttgaggagaagtatctgtcacagtgcaaaaagtttgatgagatagatatt

SEQ ID NO: 894 - DNA, 273 bp, Zea mays
  misc_feature: Incyte ID No: 700550026H1
tagtgagcgcttcacaaacttctgtcaagggaaactcacaagcagcccatggtcagaattggacggtcatcgataatctttgtctctggttgaagaccagttggtgaatattaaccagaagggtttccttacaattaacagccaacctgctgtaaatggagagaaatccgactcgcctactgttggttggggtggtcctggaggctacgtttatcagaaggcctacctcgaattcttctgcgcaaaggagaagttggaccaactaattgagag

SEQ ID NO: 895 - DNA, 272 bp, Zea mays
  misc_feature: Incyte ID No: 700550027H1
cacagccttggctagaatactttgagaatggagtccccatgtccagaacttttaaccataagttgtattaaattgacttctatcatgttttaaactgtattaaattgactgatatcatgtttttttattggcaaagcaatgaacgggagttgttaagtgtggggcagactaccatgactgggggtcagctggaaaagtacgtaaatgaaggtgacaatggtgataaaatactcagagcattcatcacatgcttcacttgtgatgaaaagttc

SEQ ID NO: 896 - DNA, 196 bp, Zea mays
  misc_feature: Incyte ID No: 700550028H1
gcgtagtgtacgagaagcagaatggataaaaatccttccaataagaagtacatgtaaattaggcttgccgtataactcaagtgtgtatcggtacattatgtctccgtctgagctcttgctcgtgagcaagcagcacatggctgaccgtgtagcttgcatttccattgcataataggcttatgaagaatgctttggt

SEQ ID NO: 897 - DNA, 273 bp, Zea mays
  misc_feature: Incyte ID No: 700550031H1
actgaacaggagcaggctaatcctacactacgtcgccaaggccagcccaatgcaaggtaccacaggggaggtgggtcacacaggggaagggggggttatgacactgggaggccaaaccatgtcacaaatgtggagaggcggaagggtggcagccatcttgaataccagccagtcggaccccaaaacaaagctgcagacttccaacagagcctgggcatggaagaacgaaccgaggggcctcctgcttctggacaagcgttcaggcagcgtgga

SEQ ID NO: 898 - DNA, 273 bp, Zea mays
  misc_feature: Incyte ID No: 700550032H1
  unsure 43: a, t, c, g, or other
tctctttggcccgaaaccgagagctagtgcttgattcggtcgnttttgggcaccgaacacgttcttgggaccgccgccgccgccctacttccagtcccagctgctcaggtctccatcggcctcgagccctttgccggcgacgagcactcacaacaccagggtgtaacaatgtcttcttcaatggaatcgtcataccttcctgctacaactgagtcattagcccaagctcaagaggctaaggatgcttcagagtccattcaatcctttaccgtg

SEQ ID NO: 899 - DNA, 278 bp, Zea mays
  misc_feature: Incyte ID No: 700550033H1
  unsure 73, 76: a, t, c, g, or other
gaagggacgaccgagcggagtctagactcgagagcaacctcgacctcccggatctctctcccacccacgcctncgncggcgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtcttccgctcctacatcgccctcggctcctaccagctggtgatcagcgagat

SEQ ID NO: 900 - DNA, 271 bp, Zea mays
  misc_feature: Incyte ID No: 700550034H1
  unsure 24-25, 54, 78, 128, 165, 173, 176, 194, 203, 206-207, 209, 213, 227, 230,: a, t, c, g, or other
gctcccctccgacgtgtcccctcnnacgggaaacaaaggttttggtccggtgancatagtagcgtcaggtgagaaggngcctttataaggctgtcctaagaagtgggcgacatatgttgttgcatcgntatcgttatggtgcctgtaactgttgtgtgtgccgtntgcgtccngangaattggatggaatgganctcgtggcntgnngnagtncatcagagagtccngtncattctttcaagaaatttgactgggatnaattaaacnattg

SEQ ID NO: 901 - DNA, 284 bp, Zea mays
  misc_feature: Incyte ID No: 700550035H1
  unsure 58, 88, 119, 216, 221-222, 230, 233, 247, 262: a, t, c, g, or other
ggcaagatttctcgagcttctcgcgagtcgcgagtcgcgacagagaaagaggcggatngcggagaagatgcagagcagtcagcatgangagggagatcagcgaggcccacgacaccatncgcttcggcatcaacgccggcgtcaaagccgacctcgccccgccgcacccgctccagtactaccatccaatcggagaccaagttctgggcggacaanaagannttcggganagntgccatatacgganccgccctcaacatcngcaaggatctcgatgcccaaat

SEQ ID NO: 902 - DNA, 270 bp, Zea mays
  misc_feature: Incyte ID No: 700550036H1
  unsure 14, 34, 47, 76, 79, 98-99, 127, 131, 136, 141, 265-266: a, t, c, g, or other
attgttcttgcttnccgatttccagtcctctgtngtttgttgtcccntactcccatctgttctccgcgaggcgcancgnaggcacaaaacccttacanncatcaaacccgagcgctcgtgtccccgnttanctccngtcgncgctaccatgggctcagatgcggatatggaggactacgggttcgagtctcagacgaggagccggaagagcaggatgtcgatatcgagaaccatattacaatctaaaggtttggttgagacaganncaga

SEQ ID NO: 903 - DNA, 272 bp, Zea mays
  misc_feature: Incyte ID No: 700550037H1
ctccctaccagggaagcaacccaccacctccttaccagggaggcagcccaccagggccaccacctccctaccgaggaggcagcccaccagggccaccacctccctaccgaggaggcagccccaacgtaccgccatattcgggtggtggcaatcctggctaccctggtggcagccctggctaccagggtcaaggaggcaactcgaacttccagtgaacatgaccacgtggcacccctgtttcagagtagccttctgcaagagatggtgcgccg

SEQ ID NO: 904 - DNA, 271 bp, Zea mays
  misc_feature: Incyte ID No: 700550039H1
  unsure 127, 159, 180, 183, 195, 247: a, t, c, g, or other
acaacaggtttgacgacacaaatccggaagctgaaaagaaattgtccattggatgggatgggaaccctacaaagtaacatacacgagtgattatttccaacctttgtatgagcatgctgttgagttnattcggaaagggctagcctatgtggatcatcngaccgcagaagaaattaaggngtncagggaaaagangatgaatagtccatggagggataggccaattgaggagtcattgaatttattngaagacatgaggcgtgggttgatt

SEQ ID NO: 905 - DNA, 274 bp, Zea mays
  misc_feature: Incyte ID No: 700550041H1
ctcttagtttttctgtggagcgtctagttaaccgatgagctgcagggttggaaaaaagagacagtgatagcgaggtccgagggcggtgatcgggttgttcttgcaactgacgagaactcttgtatgtcgaaaagtaaggtcaaagaggtgatcacagtggtggagaaggagctgggatttggtgaagggaaactcctgcataagctttgcaaggtgtatctatacatatctgcacaaaggatcgtggggtgccttgtcactgaaccgataaaaa

SEQ ID NO: 906 - DNA, 269 bp, Zea mays
  misc_feature: Incyte ID No: 700550043H1
ggtttgatgataggacatggtacccccttggccgtgtgattggtggcactgtgtatcctgggttgacattgactgctggaactatgtggtggttgctgaactctcttaacatcccattgtcggtggagacagtttgtgtgttcacagctccaattttctcagcaaatgcatcatgggctacctacctgctaacaaaggaagcgaaaggtactggagctggattaatggcagcagccattttagcaatggtcccctcatatatttcaaga

SEQ ID NO: 907 - DNA, 268 bp, Zea mays
  misc_feature: Incyte ID No: 700550045H1
  unsure 134: a, t, c, g, or other
ttttcgacaaattatctctgttaagaagcttatcattggacattagccaaaaagaaaatagttatctgataagtacctgccttttctgtttggaagatgaatcaatttatcacctcttttttgaatgttactcnctccgtttctttttatttgtcgctgcaaataaaaagaaacggaggaagtacatagctaagagaatgtggaatgtgattaacaacctgttgaactggaacgtgggtgaggacttggaatatgtgctgctgtttta

SEQ ID NO: 908 - DNA, 106 bp, Zea mays
  misc_feature: Incyte ID No: 700550049H1
  unsure 36, 41, 50, 66-67, 87: a, t, c, g, or other
aacaaacactatgaacaaaggcacacgatattcctngtgtntgtttacangtgaaatcaacatganngagatggattatcatgttgntttcacttgtaaacaaaca

SEQ ID NO: 909 - DNA, 268 bp, Zea mays
  misc_feature: Incyte ID No: 700550051H1
caagaggagactgggtggaagtacattcacggtgatgtattccgtttccccaaacagaagtccgtttttgcagcaattattggttctggaactcagcttctcgcccttgcgattttcatcttcctcctcgctcttgtcggcgtcttctacccatacaaccggggagctctcttcactgccctcgttgtcatctacgctctcacgtccggtatcgctggatacacagccacttctttctatctgcaactggagggcacaaactgggtca

SEQ ID NO: 910 - DNA, 265 bp, Zea mays
  misc_feature: Incyte ID No: 700550053H1
ggtttgatgataggacatggtacccccttggccgtgtgattggtggcactgtgtatcctgggttgacattgactgctggaactatgtggtggttgctgaactctcttaacatcccattgtcggtggagacagtttgtgtgttcacagctccaattttctcagcaaatgcatcatgggctacctacctgctaacaaaggaagcgaaaggtactggagctggattaatggcagcagccattttagcaatggtcccctcatatatttc

SEQ ID NO: 911 - DNA, 265 bp, Zea mays
  misc_feature: Incyte ID No: 700550055H1
attatgacatggctgaatatctgaagctggaaatgctgaaggaaacaggatttgcacacatgagaatctgtgatggtgttggatcatttcttcagctttctggtctacttgccaagtttgcgcttgtgagggaaactgcaaaagcaccatgaactcgttgtattacagatgataatagcttgtgtcatgctgtgctatcatggtaacctagttcagttaatagcgctgtcatgcgtggcttaatttctacagacgtgatgtatct

SEQ ID NO: 912 - DNA, 265 bp, Zea mays
  misc_feature: Incyte ID No: 700550056H1
  unsure 54, 86: a, t, c, g, or other
agccagatacaacagtgatcttccgcaatgccaagattgatatgttcaagggcnccatgagactggcggtggacaagtggggccgncttgaggtgactgattcttctgttttcaaggtgaatgaagacaacaacatgtcactggtggagtacgagctggtggatgtggatgaagaggagtgagctgaagcgatattgcattgccatctgttgggccaagtcgtgctgcggatatgtatttccagctaaaggagggcggtacgttt

SEQ ID NO: 913 - DNA, 264 bp, Zea mays
  misc_feature: Incyte ID No: 700550057H1
gatattttggagatgattttcttcccagttgtgaatgaggcatgcagggttatggatgaaaatgttgtaattcgagcttctgatcttgatattgcttctgttcttggaatgggctttcctaaatacaggggtggtcttgtcttctgggctgacactgttggagcaccttacatacattctaagctaagcaagtgggctgaaatttatggccccttcttcaaaccatcatcatatttggaacagcgagctaagagtggtgtacca

SEQ ID NO: 914 - DNA, 264 bp, Zea mays
  misc_feature: Incyte ID No: 700550058H1
ggtgattgagagagcatataagaagctagcattggatgctttagttattcagcaaggacgattggcagagcagaaaactgtcaataaggatgaccttctgcaaatggtgcggtttggtgctgaaatggttttcagttctaaggacagcacaataactgatgaggacattgaccgtattatagctaaaggagaggagacaacagctgaacttgatgcaaaaatgaaaaagttcacagaggacgccattaaatttaagatggatga

SEQ ID NO: 915 - DNA, 264 bp, Zea mays
  misc_feature: Incyte ID No: 700550059H1
ggaggagaggaaccccgtgtttggcgtggagaagaaggcaagccgctcgacgctcgtcgatgtttgtagcgatgcacaaaccggaatcaccgtcgttcttgcaaacgtcgattgggtttgtttatggaccgagaaatgatgatcgtgcaagtgatgtggtgtcaaccacaagatgcagttggtggacgacccaaggaaggatggacataaccagtggatgctcgccaagcgagtacctctcccagcaaacactacctaagtgtt

SEQ ID NO: 916 - DNA, 263 bp, Zea mays
  misc_feature: Incyte ID No: 700550060H1
acagagtttgaaagctgcatttgcaactgcacccgctgatccaacagtagacctaaacatgcaactgacaaaactagcgcatggtttgctctctggtaaatattctgctccagcaaaggaggggcaagaagggatacgccctcgcatgtttaagtcagttatcactgcgaaccatcctgatttttcaagcatgagacaacaggatgtccttgaattcttccttcaccttattgacagagttgagaaggcaaaccctggagacc

SEQ ID NO: 917 - DNA, 264 bp, Zea mays
  misc_feature: Incyte ID No: 700550061H1
cagggaaggacttggctagcaaattcaagattgcgaagaaggcgctcgacaatactgccggagttctgatgtaactctgcccttgtcgaacattctgggcatctccaagtaaaacaaagttattagaacattctgctggagtcctctgttctcgttttgccttgttattagaatgcttctccaagagacctttcatgggttttgaatgcttacccaaaaaaaaggctttgatggtcatacattgtaccatttcttagaagtact

SEQ ID NO: 918 - DNA, 264 bp, Zea mays
  misc_feature: Incyte ID No: 700550062H1
tgtacatatacatgtgatgtccaaacgtccatctgcagattggacccctcaactgtgaagagattcctcccaggtggtcaccaatgtacagagcacacatgaagataaagagtagttgggattgtcggtagcatgctattcgtataggacaggagggataccactagtcacaacacacaaggctatttaattgtatattttcatgcagcggatgccctgcactttctgctgctggccaatgcggcaaggacagaagcatttttt

SEQ ID NO: 919 - DNA, 263 bp, Zea mays
  misc_feature: Incyte ID No: 700550063H1
  unsure 47-49, 262: a, t, c, g, or other
atatgttggaagctatctgtcccgggcaaggttcatttccgtaaatnnngttgtttctgtactcaaaaggctagtggactggtgtgattattattgtggccatcagctggacaatggggtgacagcaaatcctataaagcaccagctattttatgctagctgccaggctgtgatgtatgtcctatgctttcggttaagatctattatggactacccaaatcttaaacaacaactttttcgaatgcgaatccgggatatcttnc

SEQ ID NO: 920 - DNA, 267 bp, Zea mays
  misc_feature: Incyte ID No: 700550065H1
ggctaatgagtacagaaggttagctgttgattgtgtcagagtattgagattggaaatgcaactagaggcgatataccacatgcaggaaatgaccaaaagagaatacgtcgaagatcaagatgctgaagatcctgatgactttattatctcccttacaactcagattgcacgacgggatgaagaaatggctccttatatcacggaatcagaaaggaattacatatttggtgggatttccagtgttgctgctaatgcatcaataaaggc

SEQ ID NO: 921 - DNA, 248 bp, Zea mays
  misc_feature: Incyte ID No: 700550067H1
ggcgcatcgtactttagctgtgacagtgaggagttcaatgtggtcattgggccaggaatctagtggttgctgtcggtcgctcgttctagatggattatgggctatggaacctggagtgccgtggtgctgcaaacatctcatgtttcattctgaaatctttttagatgtataatacgtagtagttgaattttctgtaaaaaaacatgttgcttggtgtttgcctttccaattggctgataagcctggcc

SEQ ID NO: 922 - DNA, 264 bp, Zea mays
  misc_feature: Incyte ID No: 700550068H1
aggaacgtcgagaggcatataacagggacaggagcagactcatacgaactatttgaaaagtacaaggcgtgcaaaaactgtgggatttctatttttgagggattggattctctgctgcttaaagacagtgctgaaattgagcatccaagtttggctgttgagggagatgatcatgccttgaccaccgatacatcaggtccagatacaggaacccttgttaattcaggtggtcgtttttctttgttacagaagtgttcaaggctt

SEQ ID NO: 923 - DNA, 264 bp, Zea mays
  misc_feature: Incyte ID No: 700550070H1
gaagaagaagatgaaggatgactcagagatggacgaaccagatgatgaaggtgttcacatggatgaagagaatgatggagcagtcctggaatctgaggatggagtgtctaatgtggttgaactgcccaaagaatcaaaagggaagtatgtacctccgagtctgcgtaatgcttccaattcagaatcagaagaaattgcccagatgcgtcgcagagtaagaggacttctgaacagactttcagagtcaaatgtggagtccattac

SEQ ID NO: 924 - DNA, 262 bp, Zea mays
  misc_feature: Incyte ID No: 700550072H1
tatgttggaagctatctgtcccgggcaaggttcatttccgtaaatatagttgtttctgtactcaaaaggctagtggactggtgtgattattattgtggccatcagctggacaatggggtgacagcaaatcctataaagcaccagctattttatgctagctgccaggctgtgatgcatgtcctatgctttcggttaagatctattatggactacccaaatcttaaacaacaactttttcgaatgcgaatccgggatatcttgg

SEQ ID NO: 925 - DNA, 261 bp, Zea mays
  misc_feature: Incyte ID No: 700550074H1
tttggtaatgggatagttgccagcgacaatgattttctttcagcatcttctaatttgatggataatgctgtgcagtcaatcccaattccgcaactaccattgaataaacgaccatcatctgatcgtgggccttctttggttctgactaaagaaatttccagtggtgtcaccattaccaaacaagaaaataaggtcgaagtacacaagaggccagcgaggtcacgcagaaaaccagaggaaagaggtaaaagtaaaatatcc

SEQ ID NO: 926 - DNA, 262 bp, Zea mays
  misc_feature: Incyte ID No: 700550075H1
  unsure 132, 138-163: a, t, c, g, or other
caacgtttcttcctcgtctccgtctcgacacggcggcgccgccgcgccagctgctgccaggagccaagcccaagcctgagcgtaaaccatgcggattggttctcttttcgtctcgaggctggccaggtctanccatgnnnnnnnnnnnnnnnnnnnnnnnnnnatctctcaggcgcccaggccccagcacatcgcatctcctctattctccggccttggagcagcggctcgtgatttcagctcaagggctctatggaaggga

SEQ ID NO: 927 - DNA, 261 bp, Zea mays
  misc_feature: Incyte ID No: 700550076H1
ccaaaaggagaaattgtggcccatgttgcaaaagcttaatgttaccatgaaggctgatgagaaggagttgattggcaaagctttgatgaagcgtgttatgcaaacgtggcttccagccagcactgcacttcttgagatgatgatattccaccttccttccccggcaaaggctcaaaagtatcgtgtggagaacttgtatgagggaccccttgatgatgtttatgcaactgctatcagaaactgtgatccggagggtcctct

SEQ ID NO: 928 - DNA, 261 bp, Zea mays
  misc_feature: Incyte ID No: 700550078H1
cccagagggtgcacttgctggttttgatcaagtggtcagtatggagcctgaaaaggctgaatggggatttaaagctcttaaacaaactgtcaagctttactataagctggggaaatacaaagaaatgatggatgcatatagagagatgttaacatacataaaatctgcggtcacccggaactacagcgagaaatgtataaacaacataatggattttgtttctggatcagctagtcagaattttactcttctgcaagagtt

SEQ ID NO: 929 - DNA, 263 bp, Zea mays
  misc_feature: Incyte ID No: 700550080H1
caaataaagtgaatccggatgtttcactcaacattggtcaggaaaaaatctagatctggaataaaaactggtgctacagtgaaggctgttcgttttgacaggtttgttgctgctcagtttcggccagcatagctgctgcccagtcccagtttcggccagctgctgtccagttttggtcaggataactgctcagctttgtttccaatgcacttgcacatacatacacatattaacaactaagcaacaatggtgtacatacatac

SEQ ID NO: 930 - DNA, 259 bp, Zea mays
  misc_feature: Incyte ID No: 700550082H1
  unsure 5, 29, 64, 66, 172, 185: a, t, c, g, or other
aggancttgcagtaactatagagttatgngcaccagatacacagggaccatggtccgcacaaancnatgatgctcataactctatagttactgctagggctggaaaggaccttgtttccagcttggtgtctggattattgacaattggcccccgttttggcggagcaattgntgatgcagcccgntacttcaaagatgcatgtgataggggcctcacaccatacgagtttgttgaaggcatgaaaaagaagggaatccg

SEQ ID NO: 931 - DNA, 261 bp, Zea mays
  misc_feature: Incyte ID No: 700550084H1
  unsure 46, 69, 219: a, t, c, g, or other
ttaggtccaagcctttgttgatgctttagaagcacgcaagataacngttagcgttcgacggacccgtgngcttgacgctaacgcagcctgtgggcagctgaggaatgagtttcagaagaatccactacttgagattgaaccgtcaccctccacagagcggaccctcgtagctgcttaattgaaacacctatcaggttgatgcagcggttcaagcatatngaatcgtcatttaatttatggggacattaggtgttgtaaagt

SEQ ID NO: 932 - DNA, 246 bp, Zea mays
  misc_feature: Incyte ID No: 700550085H1
ccgttccatgtcccagggaagaagattgcttcaagaagctttggcgcaagagtaagcaccatcgttaaatccttcggttcagggtccagttgatcgaatgccacttttgtcagactttctgtaatcaaacatatgtgttctctctctgtttgacaaaattactccctaccgtgtactgcttgtctggtgaacgagatgctattggtactgattgctgaacaaagaaaaatagtggtttattcattc

SEQ ID NO: 933 - DNA, 260 bp, Zea mays
  misc_feature: Incyte ID No: 700550086H1
aaggatgacagcatcttggttgaccttgctgatgccatcacaaaggaaggaattagtgcttttcggtttgatttttctggaaatggggaaagtgatggtgaattccagtatggaagctacagaaaagaggcagctgatttgcgctctgtagtattacatttctcagaacagaaatatgacataattgctcttatcgggcatagcaaaggaggaaatgctgttcttctttatgcttccaagtaccatgatgtccctgccat

SEQ ID NO: 934 - DNA, 260 bp, Zea mays
  misc_feature: Incyte ID No: 700550087H1
  unsure 66: a, t, c, g, or other
gagaatccccagatcaaccgagaaatgatggagctgattgagactttgcaacgcaaggctgttgangaagccaagatggcttcagatgatgctgaggaatgcggtgatggtgattcggaggaaaatgatggtgatttggtgaaggaagaggatggtagtggtttgaatgagggagagcaagacagtgcagacgctgatgctaatgttgaaggttctgtgaagattgtggttgaaatcaaggaggaaggaaaagatgataa

SEQ ID NO: 935 - DNA, 252 bp, Zea mays
  misc_feature: Incyte ID No: 700550088H1
  unsure 52-53: a, t, c, g, or other
cttagttcttgattgagaagtatgtgccatccaggtatgaaagtctatctannattataaggcttgttattgtgtctggaactttgttatcctgtagttggagtcgacatgtaccgtgagaaatcagctgctttgttatagaccgtattactgaccggtttattatcgtttcctgcttgccaggcatatgacttggtcatagtgcttggcgcttggatcctgcatgtttgcttgatgtgctatttggctatt

SEQ ID NO: 936 - DNA, 260 bp, Zea mays
  misc_feature: Incyte ID No: 700550089H1
gacgcttgcagcatccattctaaggctttccaagattgtctcaacaactatggcagcgagatcagcaagtgccagttctacctagacatgctgaacgagtgccgccgtggtggtgtgtctgcctaagctgcctctggggttattcgtggattttctttcggtgatgctatctcattaataagataccgtgaaacttttgtctccacagcttgaagctaaacttcctgggattaatacattttgttatcctatgctgttgg

SEQ ID NO: 937 - DNA, 260 bp, Zea mays
  misc_feature: Incyte ID No: 700550090H1
gatgactacatcggctttaaggttaagacgacgagcccgaagaagtactgtgtccggcccaacagcggcatcgtgccacctcggtccaccagcgatgtcattgtgacaatgcaagcacaaaaggaggcgccaccagacatgcagtgcaaggacaagtttcttgtgcaaagtgtcgttgtggcggaagggaccttagtcaaggacatcactggcgatatgtttaccaaagaatcagctaatgtggtggatgaggttaagct

SEQ ID NO: 938 - DNA, 256 bp, Zea mays
  misc_feature: Incyte ID No: 700550092H1
  unsure 2, 11, 24, 147: a, t, c, g, or other
gnctttttatngcgttctgcgcanttcttctttgtcatactgaacaaaaccaaagctgcgcagaacgctataaaaagtcttaacgggatgcttataaatgataagcctgtttttgttggaccttttgttcgcaagcaagaaagaganccattcttttgacaagacaaaatttaacaatgtctttgtgaaaaatttgtctgagtctaccacaaaggaagatttactcaaaatctttggtgaatatggggatattaca

SEQ ID NO: 939 - DNA, 208 bp, Zea mays
  misc_feature: Incyte ID No: 700550093H1
gtcaaatgttagtgtagtttccacgtgttcttgagacgtgtgtatttgtatgtctgtgatgtgatccgtcagatctgttcttgtgcccttcaaaggccaaatcagggagctctctgcttcctgtgtatgcttgctttttccagtattccctgttattctactatgaaatcatccatcgtgccacaaagaactgatggttcctgatgtc

SEQ ID NO: 940 - DNA, 258 bp, Zea mays
  misc_feature: Incyte ID No: 700550095H1
aatgagctcatcttagcaagtgtactacatggtttttctgattctgttggtcttctactcaggggtgatgttgagaagcggactgcgcttgagaacttggatttgatacttctctgcattgatgaaattgtagatgggggaatcatcctggaaacagatgcaaacaccattgctggtaaggttgcaaccaatgctgttgatggttctgtgcccttttctgagcagacgatatctcaggcactagccacagctagggag

SEQ ID NO: 941 - DNA, 302 bp, Zea mays
  misc_feature: Incyte ID No: 700550105H1
  unsure 28, 30, 51, 63, 76-77, 95, 111, 132, 154, 159-160, 253, 283: a, t, c, g, or other
aagtgatggaatatgggcttggacaagnantcaatcaactgttcaattatnctcccacttcgntgccatgatagannagaaaataatctgcatgncatggaggcatagganggtcaataaacacagtggagnaaattgagaaacttgagaggcntatcnnaatggatgttggttccattgtcctcatggacctggctatggtctgatcctacagaaaatgatagtgtggagcgtttgagacctaatgcacganggcccggcttagtgacatttggggtgatcntaagagcccatgagtgtgt

SEQ ID NO: 942 - DNA, 243 bp, Zea mays
  misc_feature: Incyte ID No: 700550107H1
tccgtttcttccagcagttacctgttttcactacctcaattgtttccccacctcttcgtgaccgtattccagagtttaggttggccattcctgcactctaggtagccgccactggcaccatttgtgagagttaaactatggttgttggttgcattatctctgtggcctgtgatagcacccttaaagcatgattcttgccatgattcgtgtgctagtactcttctaagcatgatttttgctacc

SEQ ID NO: 943 - DNA, 300 bp, Zea mays
  misc_feature: Incyte ID No: 700550109H1
aaaggatgacagcatcttggttgaccttgctgatgccatcacaaaggaaggaattagtgcttttcggtttgatttttctggaaatggggaaagtgatggtgaattccagtatggaagctacagaaaagaggcagctgatttgcgctctgtagtattacatttctcagaacagaaatatgacataattgctcttatcgggcatagcaaaggaggaaatgctgttcttctttatgcttccaagtaccatgatgtccctgccattgtgaacatttctggccgctttgcattagagcgaggtat

SEQ ID NO: 944 - DNA, 298 bp, Zea mays
  misc_feature: Incyte ID No: 700550110H1
cggagacgtaccagttctggtagtgtcaacggtcaatgctcccaagagatccaaggccgagatggaggctctcaggggatctaaaggggtgacgaatttgtggaggtcgcaggcgctcttctaccgcaggaagaataccccttggcagtcgcggaggaactctacagcttcctgcaggaatcattcgcagcaagaaggtgaatgtgcgtgcgtgcgtgcgcacaactgtgccagaagacaggttctcaagtcccacacatcgtgagtaaattcgttagcctgctacagtgtactggag

SEQ ID NO: 945 - DNA, 195 bp, Zea mays
  misc_feature: Incyte ID No: 700550113H1
  unsure 2, 26, 40, 88, 93, 117, 126, 128, 165, 167: a, t, c, g, or other
cnaaccctaatgacctaatccccaangcccagccggcagncgccgagcaaaccagctcatccggtcggtcatccactcatcctcatcncctgnccatctgatccgatcggtcatctnatcctcatncnctacccgatcggatcccctgctctcccgccgagcacnancaggcagcaggctccagtcatcgagcac

SEQ ID NO: 946 - DNA, 294 bp, Zea mays
  misc_feature: Incyte ID No: 700550114H1
  unsure 152: a, t, c, g, or other
ccatcccggtgaagtacggcggcctgaagcgcgacggcgacaccgagttctccgcggacgacggcgaggtcgcggaggtcaccgtcaagggaagctccacggagaccatcgagatcgaagccactgaggctgatgccacgctgacatggganctgacggtgctggggtgggaggtgaactacaaggaggagttcgtgccggcggacgagggctcctacaccatcatcgtcaggaagggcaagaagatggcgtccggcgaggaggcggtccgcaatcgttccgcaccggtgagcc

SEQ ID NO: 947 - DNA, 295 bp, Zea mays
  misc_feature: Incyte ID No: 700550119H1
gaaaaattcctgagcatgttcggtgccaccaaaagactgagctggagaaggctaaagcaaccctgttattgggcaactctccctaagtcattaccttgcagggataaagaaatggaggagatatcgatatttgtaaaggatgcaatctgcaatgaccagtgcctaggacggtgcctttatatacatggtgtacctggtactggcaagactatgagtgtacttgctgttatgaggaggctgagatctgaatttgattctggaacactgaggccatattgttttattgaaattaatg

SEQ ID NO: 948 - DNA, 293 bp, Zea mays
  misc_feature: Incyte ID No: 700550120H1
aatccagcccatttcgaactctctctagacgcttcctcggtctctctgttcaccgccgccccgtaccatactcctcttcgcgccgtagaaatggcgctgccgaatcagcagggcgtggattaccccagcttcaagctcgtcatcgttggcgacggtggaactggtaaaaccacatttgtgaaaaggcatcttactggcgagtttgagaagaaatatgagcccaccattggtgttgaagttcaccctctggattttagcactaatgtggcaaaattcgcttttattgctgggac

SEQ ID NO: 949 - DNA, 296 bp, Zea mays
  misc_feature: Incyte ID No: 700550122H1
agtctggggctatgttgatcgtatcctgggtcagccatcactgataagggagtcatcacgtgggaaatatccctggtctggtttcctctcacgtgctacaagtaccctgactagcaaactgaagaatggaagcaacctagggaaggacagaaatgggtttggtgatgttattctaaatccttctctccagaagagagtgaagcagcttgctaatgccacggccaatacaaaacttcatcaagctcctttcaggaacatgcttttctatgggcctcctggcacagggaaaaccatgg

SEQ ID NO: 950 - DNA, 298 bp, Zea mays
  misc_feature: Incyte ID No: 700550124H1
ctaaaatggtgattgtacttgaagaagaaaaatcgaagaggtttgcaaagattcaagctctagcttcccagctatctgatctttggaacttaatggattctcctgtggaggaacagcaaccttttcgtcacgtaacatgcataatgtcctcaacattggatgatgtgatagttccaggagctctggctcttgatgtaattcagcaggcggaactcgaagttgaaaggcttgatcagctaaaagctagtaggatgaaggatattgcattcaagaaacagactgaacttgaagatatata

SEQ ID NO: 951 - DNA, 293 bp, Zea mays
  misc_feature: Incyte ID No: 700550126H1
ggtagtagccgcccacttgccttcattaagctttgctgaaatagtcgtgagcaattgagcatcacgcgggtttccactgattggttggacttgggggcggttcaggaggggtggaggtgggtgctcaaggcggccatcaggaagttcaaggcgcggcagcgcggtcccggcaggctcccctgctccagatggtcctccccatgctgtgatgatcgatcgatcgatctcgcgcgctcacacgaattgtgcttgccttttgtttccacttgttccatcacagttctattcatgca

SEQ ID NO: 952 - DNA, 291 bp, Zea mays
  misc_feature: Incyte ID No: 700550128H1
  unsure 73-90: a, t, c, g, or other
cctagacttcttccgttgcatcttctcttctgttctccacgacgcattcggctgccagacaaaaaccctaaannnnnnnnnnnnnnnnnntcttcctcgagatgggaggcaagtgcccgcaccgcaagtaaagaagcgccgcctatcccacaagacggctcgccgcggcaagttcctcctgaaggccgacgatgccgtctatgacgagctcgtcaagctggccgaccagggcaaggacgctgaagccaaggagtccccgtcgatgaggacctcccaggcctgggacagttt

SEQ ID NO: 953 - DNA, 295 bp, Zea mays
  misc_feature: Incyte ID No: 700550129H1
atgaaataggacattcatttcattggcaattataatatacttgaacggaatgagtcagtggttacatacatagtttcggagcatgtcgatcaaacaaacaaggtagactacaaagttgcttatgataatgttcaaggtgacatatggtgcctctgccgtttgtaccaatccaaaggaatattgtgcaggcatgcactcactgtactgagacaggagcttgtgctgatgattccacaaaaatacatcattcatcgctggtgcaaggactgtaaacaaacttgtgcttccatatccc

SEQ ID NO: 954 - DNA, 294 bp, Zea mays
  misc_feature: Incyte ID No: 700550131H1
  unsure 52: a, t, c, g, or other
cttcactatgggaggaattacagggctctaaaaacagaagttactagagctnccatccaactattggaaccattgattaagggatcaggtggagtggagtacctgcagaagtctttgctggtcgctgtggttccccttctgatgcgttagttctctcccttcaactgcccggtggattttctctttgaaagatgtcgtggaagaacaatggaatgaacatgtcagctcgttatcaattctgccagaagcagaccatgttcagacacttgttgccaccctccgaactggccatgc

SEQ ID NO: 955 - DNA, 249 bp, Zea mays
  misc_feature: Incyte ID No: 700550133H1
  unsure 237: a, t, c, g, or other
ccaatactagtgatcacaaagacagcacaaactcgttggtagataagaaagaggagcaagcagcggagcctgttaactgtgaaacagagggcagtatggaacaagaagcagcagctgaaaatgatttggccgacgataaggaggttgctttggctgcagccaaggatggtaacggtgaatccagttttgaagcatcgactccaaaggcaagcaatgggaccagccagaagggaagtncaagctgcttct

SEQ ID NO: 956 - DNA, 293 bp, Zea mays
  misc_feature: Incyte ID No: 700550134H1
attgttcttgcttcccgatttccagtcctctgtcgtttgttgtcccatactcccatctgttctccgcgaggcgcaacgaaggcacaaaacccttacctccatcaaaccctagcgctcgtgtccccgtttagctcccgtcgccgctaccatgggctcagatgcggatatggaggactacgggttcgagtactcagacgaggagccggaggagcaggatgtcgatatcgagaaccagtattacaactctaaaggtttggttgagacagacccagagggtgcacttgctggttttg

SEQ ID NO: 957 - DNA, 292 bp, Zea mays
  misc_feature: Incyte ID No: 700550135H1
ttcagtgtgatagtgaagcaggtgctggggctgtcgccagaggagccggtcactgcaaggatactggaggacttcctggccttcatgaagggactcatctccttccccctctacatcccagggaccccatatgccaaggctgtccgggcgagagagaggatatccagcactgtgaagggcatcatcaaggagcggaggagcgctgggtcatggaacaagcagggcgacttccttgacgtgctgctgtcaagcaacgagctatctgacgaggagaaagtgagctttgtgctgg

SEQ ID NO: 958 - DNA, 293 bp, Zea mays
  misc_feature: Incyte ID No: 700550136H1
ccaagggaaggaaactggtggatgcagtttggcaaggaatacgtcctgggctactggccgtccttcctcttctcctacctcgcggacagcgcgtcgatgatcgaatggggcggggaggtggtgaactcggagcccgacggcacgcacacatcgacccagatgggcagcgggcacttcccggaggaagggttcagcaaggcgagctacttcaagaacgttcaggtggtggacagcagcaaccagctcagcgcccccaagggcgtgggcaccttcacagagcagtccaactgcta

SEQ ID NO: 959 - DNA, 292 bp, Zea mays
  misc_feature: Incyte ID No: 700550142H1
gcagcttctgtcgcgtctccccctccctgaccgagcgatccagcgagagggagcgagtagcagccgcagccggaggagctcgccgaggccgccgaagacgaccatggggttctgggcgacgacgctcatcttcgtcctcgccggcgtcgccgcatccctcttcacgctcctctgctgcaaccgcgggccctccacaaacctgttccatttgaccttggtgactacagctgtaattgttgctggatgatgtatgcaatcgtctaccttgctcagatgaagccattgatcgacc

SEQ ID NO: 960 - DNA, 291 bp, Zea mays
  misc_feature: Incyte ID No: 700550143H1
  unsure 226: a, t, c, g, or other
agatgggatttgatgacacagagatgaacaaggagctgcttgcgaagaatgagggaagcatcaagcgagctgtgatggagctcattgccagggagaagaaggacaagtgaagatcgtgtgctatctaagtatatattcgtaaataatgagacggctgtgccactgcggtgcagccctggtgcgtctcagagcttgcttatggtgaactcttcgtgttaggtttctnccttatatctgtcgtgtctgcggtgtcgatgaactatctagtatgtggagcgtgtgcgtctcagc

SEQ ID NO: 961 - DNA, 292 bp, Zea mays
  misc_feature: Incyte ID No: 700550144H1
ggggcaagaggcgggttcaggtgccactgaaggcagtgacaggaggactttcaacactgggcgggttcagaagggacgggagcctgtggatgcagaggagggtggactataattcgctgccagagccagccccaagggagcttcccaggaatgaggacccaagtttggtgaggaggaataagaggatgctggggcagcttcttgtcggtacattagagaaatttcaacaagaggataaaaagctatccaactctgaggcttttctgcgcagatcagagactcagcgaaaggc

SEQ ID NO: 962 - DNA, 292 bp, Zea mays
  misc_feature: Incyte ID No: 700550145H1
aaaaatttgcctcaaatgtcatcgagaagtgcttagtctttggaaatcctgtagaacgtcaggttctgattggtgagatgcttggatccactagcgaaagcgaaacctcttgaggtaatgatgaaagaccagtttggaaactatgtggtgcagaaggtgttagaaacttgtgacgatcagcagagagagatgatcctaacaaggataaagacacacctgaacacactcaagaagtacacatatgggaagcacatagtagcacgcgtagagaagcttgttgctgctggagaga

SEQ ID NO: 963 - DNA, 289 bp, Zea mays
  misc_feature: Incyte ID No: 700550146H1
atctgcgacgacctcctccctcccgatcccgctccgtctccccccaccgccaccgctgccgtgccgcctcccccaccgaggtcttgtcttcgggcgatccagccggagcccgcggcggcgacgatgtacgggtgggagatgctgtcgttcaacatacacgatgggttcctggaggccatcgtgcggggcaaccgctcgggcctcctcaccgccgccgactacaacaacctctgccagtgcgagaccctcgacgacatcaagatgcacctcacgccaccgagtagggcct

SEQ ID NO: 964 - DNA, 277 bp, Zea mays
  misc_feature: Incyte ID No: 700550148H1
  unsure 247, 276: a, t, c, g, or other
gactctgctagctggcggggcggctcgctctcgcgccacaatggaggtcgaggacgacgacaacacggcggcgcgagcgcgtggccgagttcatccaggcgtcgcaacctcctccagttccttctccacgcctccatgaggctcgacctccggcccatcgtcaagtacgccgcgctacttcttcgctggacgctcctccggcactccgaggaagatggggttctgcggcgcgcgaaggccgaatagnaggtcctggttctcgagccctgaggacana

SEQ ID NO: 965 - DNA, 291 bp, Zea mays
  misc_feature: Incyte ID No: 700550149H1
aacccgttctccttttccgtctcctcgacgcaactcgtcgccgtcttctccaactcgcacctcgttcctcgccccaccatttgccgctcccgcctacgatgtcgacgagtgaggtgtggagcttgtccgatttcgaaatcagcaagtacatcggtgagggcaggttcggcaaggtctacctcgcccgcgagaagcagagcgggtacgtggtggcgctcaaggtgatatttaaggcgaaactgcagaagtaccacttccacgcgcacctgcggcgggagatcgagatccagc

SEQ ID NO: 966 - DNA, 285 bp, Zea mays
  misc_feature: Incyte ID No: 700550152H1
  unsure 12, 26, 181, 192, 259, 276: a, t, c, g, or other
acagcaggtganagaaagtgaggcancccctttgatctcagactctttgagcaaagttgaaaatgggggcggtgttgttgatgacgagcctttgaaggtacccatgtggagctcaaagtattcgcgggagtgaaattttctaccgcttgacggtggcatcatacaggattcagtttagtangcagatagtanggttggaagccaacccagagtgtaatgaacattgagttacatttcttggccttttttagcgtcacgntctactactggtaaaanggtctgttt

SEQ ID NO: 967 - DNA, 291 bp, Zea mays
  misc_feature: Incyte ID No: 700550154H1
gaacagcagcactggaaagaacttacctacctgtacatacaatatgatgaatttgacaatgctgccaccactattatgaaccactctccagatgcatgggatcatatgcagttcaaggatgtttgtgttaaagttgcaaatgttgagctatactacaaggcagttcacttctatttgcaggagcatcctgatctcatcaatgatatgctgaatgtgcttgcacttcgtttagatcataccagagttgtagacataatgcgcaaggctggtcaattgcatcttgtgaaacca

SEQ ID NO: 968 - DNA, 197 bp, Zea mays
  misc_feature: Incyte ID No: 700550155H1
  unsure 3, 33, 40, 57, 61, 72, 90, 104, 106, 115-116, 118, 127, 144-145, 159, 163,: a, t, c, g, or other
canaagggtttcaactagagagttcggtgaganatgaacnagagcagcgaaggctgntggnagaaaaccagngaatggagatgaagaggntcagagtagaatcntnaaagctcanncntgtaatganagaggatcctttcccanntccggagaaagagngggnaanntntcagnggattgaanagtttgtgttgcat

SEQ ID NO: 969 - DNA, 291 bp, Zea mays
  misc_feature: Incyte ID No: 700550157H1
tgaagatttggaagaggatgaaattgcaaattatgctttaaacctcgaaaaggtcttggctgaacttccagctccagttctaaatggtacaacacttacagtcgaggattttcatcaagaactaaaatgcagtatcaacatcaaacacagggacgagtttgatgaagaaaaggagcctgacggaatggttcttgctgggtggtctggcccagttgataagcaaattaccagtaatggtgagaatagatcagttccatcttcatccaatacagaagatgttgatggtactgc

SEQ ID NO: 970 - DNA, 287 bp, Zea mays
  misc_feature: Incyte ID No: 700550158H1
  unsure 3, 7, 14, 20, 30, 32, 38-39, 48-49, 80-81, 207-209, 263, 277: a, t, c, g, or other
atnctcnttccctntccgcngcagcgattntnaagggnntaaccttcnntgttcgtagatatgcgcggttactgattagnngatgatagctgtcgacaaatttcacatggaaagagaacgaacacggaaacgccctcgtcttgcatgggacgttgcccctccctcagtgtccgaggcgcaacgggctctgccagtgcccggtgacgnnncttcgaaagaaagcacgttcgcctccgaaaagggacgacgatcgagagggccantatgtcttcaatcntggcgaaaac

SEQ ID NO: 971 - DNA, 290 bp, Zea mays
  misc_feature: Incyte ID No: 700550162H1
cttcattgaggccaagggacaaaaagaacaaaaagaggtcagcaaaaacaaaagcttctactgtgaaggctccatcacctgttgtttcctttgatccaccagctatttcgatgccttctgaaaagggaaagtctgccaagcaagcacaacaggagttagaaatattgccagctccaccaagtggtccatcgtttggagattttgttctttggaagagtgatcagactagctctgtgcctgctccagcatggtctaatgactcagcaaaggtgcagaaacctttgtctttg

SEQ ID NO: 972 - DNA, 288 bp, Zea mays
  misc_feature: Incyte ID No: 700550164H1
  unsure 197: a, t, c, g, or other
aagaagaattttcaaatgatgtcaattctaggcatatttcaccaggtgctgtaggaaggctcatgggtcttgattcgttgccctcatctggaatccataataagcatagacataccaaaagtcatgcaccaaagacttcacctagtagttttcatggtcgaactggtttgcatgacattccacacaggaggagtgancataccattaatgtttttgaaggtatggaagccacaaaaacaaatatgcaccggagtccaagatctaaaattggaagtacaacttccagat

SEQ ID NO: 973 - DNA, 188 bp, Zea mays
  misc_feature: Incyte ID No: 700550165H1
  unsure 23, 33, 41, 66, 87, 92, 100, 102, 118, 131, 151, 155-156, 165-166, 174,: a, t, c, g, or other
tctaccatggcatcaactctctncttggcagantgacagtngatgtcatggtaccatggcatcaantgtcattctaccatgggcatnaaaancacctgcnanggagagagttgatgcnatggtagaatganagttgatgccatggtaccanggcnncaactgtanncgtaccanggcatcnnntngtg

SEQ ID NO: 974 - DNA, 286 bp, Zea mays
  misc_feature: Incyte ID No: 700550166H1
gtctgagtggattcccacgagatatgagctttcagttgtgcaattggttgacacgataagatgcaagctgatggagatgatgtacacacgcagagagtcttccaatgcatggactgaggtattaacaccggcagccaatcagaaacttcaggaagaggtgaacaaagcccacaccctcaatgtccttccagcagaaaacggtgaaaatggcaatgtgtttaaggtctgtgatgactcagttaatgttgtcaaccttgacacatgggaatgcacctgccaaaggtgg

SEQ ID NO: 975 - DNA, 286 bp, Zea mays
  misc_feature: Incyte ID No: 700550167H1
  unsure 87, 101, 103, 129, 149, 179-180, 184, 186, 190, 201, 204, 219, 225,: a, t, c, g, or other
ggaaatctcccaaaattgttcctctcaatctggttcttaaaaaggctaagagatgcaatgctgttaaactccgtaagacagaaagcncccacttgtatgangngaaaagctcagattgttctgtgaacnggttccgattattctatagnaaagtattccggtggatgattgaaatttgnngccnanaagntgattaggacntgnaggattcaaaaaggngtaggnatccacctattgnnntggggnncntgtggcnctccanaaaggacnttntggtggacccang

SEQ ID NO: 976 - DNA, 286 bp, Zea mays
  misc_feature: Incyte ID No: 700550168H1
gtctcgacgtctcgtctcgtctcgtctcgcctgcccgcagccccttggcttcgttccatccggcttctcggcggcggcggagaggagggggatggcgcaccggctgctgcgggacgcgcaggcggacgggtgggagcggtcggacttccccatcatctgcgagtcatgcctcggcgacaacccctacgtccggatgttaagagctgaatatgacaaagaatgcaaaatttgtgcacgtccttttactgtattccggtggcgtcctgggcgagatgcaaggtacaag

SEQ ID NO: 977 - DNA, 289 bp, Zea mays
  misc_feature: Incyte ID No: 700550171H1
gggcagcagcaatctggttatctttatgcatctggtgacatgtcttccatcttgatatgggatcttgacaaggaacaacaactcagcactattcagtcatctagtgatagtgccatttcttcactgtctgcatctcaggtctgctctggacattttgctgctggttttgctgctggttctgtcaggatatatgacgttcgctctcctgatagggttgtctatacggccaggccacacgcaccaagaacagaaaaggttgtaggcatagggtttcaacctgggtttgatc

SEQ ID NO: 978 - DNA, 290 bp, Zea mays
  misc_feature: Incyte ID No: 700550172H1
caacaagaagcccaccatcacctcccgtgagatccagacctccgtgcgcctcgtcctccccggggagctcgccaagcacgccgtctccgagggcaccaaggccgtcaccaagttcacctcgtcctaggctgcgtggcctccgcttgcaggcttccctcgtatgttcgcgtgtcttgctgtagttaggtgctgctgtgtctggtctcctccggtagcaactgttatctgatggaacagtaacaatgcttattgaatccagctagttgcttatttgtggatcctctctcttt

SEQ ID NO: 979 - DNA, 288 bp, Zea mays
  misc_feature: Incyte ID No: 700550173H1
  unsure 93: a, t, c, g, or other
aatctagtttctctgcatgatcaaatttgtgattgtgacaatattttgttacaaatggaaacagttctgactggattccagacagaaattggntccataagttcagagataaaggtccttcaggagaaatctatggacatgggattaaagctgaaaaatcgtaaggctgcagaatctaaattgtcaaaatttgtcgaggatataatagtacctccaagaatgattgacataattgttgatggagaggtcaatgatgaatacatgaaaacacttgagactctaagcaaa

SEQ ID NO: 980 - DNA, 288 bp, Zea mays
  misc_feature: Incyte ID No: 700550174H1
cgaaggacatatgtaaacttccttcattcttgtctagtgtccttttcaagaaaatcgatgttgaatgcactagaactgtctcaagggatgcatttgttgagtactggattaacgacaataaggttacaatggatatggctagtcaaatatttgaaatattaagaaagccaggttacacatatctcacccaggatgatttcaagcctgtcctgaaagaactactggcaacacaccctggcttagagtttttacaagggacccccgagtttcaggagagatatgcggagt

SEQ ID NO: 981 - DNA, 287 bp, Zea mays
  misc_feature: Incyte ID No: 700550176H1
  unsure 37-38, 41, 43, 74, 80, 84, 92, 94, 98, 100, 128, 216, 252, 255, 267, 281: a, t, c, g, or other
aacatatctcctcgcattttccttgcaaccgattgcnnctncncctcccaaccaaagaccgatgggcgcccaangccganaagnagcccgcngngaanangccggcggaggaggagcccgcggccganaagacgaccgccgggaagaagcccaatgcggagaagcgggtccccgcgggcaagtccgtcggcaaggagggcggcgagggcaagcgtngcaagaagaagggcaagaagagcgtggagacgtacnagntctacatcttcnaggtgctgaagcangtgcac

SEQ ID NO: 982 - DNA, 287 bp, Zea mays
  misc_feature: Incyte ID No: 700550177H1
gggaggaacaacaagaggttcctggacaccaaagcccgcagatgtctattgttagttctgttactggttttagcacagccagttcttttgggcctcttcatcgtggttcatggtgcactccaccaagattattcctggaagaccagtttgatgccattcctccagagattggcatttcacggaattcaggcagtaagaaaactaaggaagaggaaggagcaaggagaaaagctggagcagtgaaaatcagtccatggacattggcgcggcttaatgcagaggaagtc

SEQ ID NO: 983 - DNA, 286 bp, Zea mays
  misc_feature: Incyte ID No: 700550178H1
  unsure 74: a, t, c, g, or other
gcatgatgcagccctggggccatcaggtgggccaacagcttgggccacattttcggttgaattgattagcgcanattactacctggtccgggagcaaaagaaaccccaatgtttctgtgttacatgaattaaatgttttttgaggggtttatcaaagagcagactgtctaagcttccccattatagaaggtttgagggagtaccactgtcagataacgataaactggagatgttacagcagaggtgtgaaagcgatagtagctagtaagaatccgatttttttcta

SEQ ID NO: 984 - DNA, 133 bp, Zea mays
  misc_feature: Incyte ID No: 700550181H1
atgacatcgttcttgattgatgtgtgcgacatgaatgatggatttttttaacatcctgaccatcattgtgtcgctcattatcgtattttgtatatcatttatgggttcacggatatgaaatgacaggtttctt

SEQ ID NO: 985 - DNA, 283 bp, Zea mays
  misc_feature: Incyte ID No: 700550182H1
  unsure 126-157: a, t, c, g, or other
aggaaatgccactaacagtaacaatgaaatggttgtgattaccgatgagaggcctgcaatttctggacctaattgtcaggaaaatatcccaaacagtattgaggagtcatacataatgactccatnnnnnnnnnnnnnnnnnnnnnnnnnnnnnnnnttcgaacatatagaacattcaaggcgtaggaggaaattggttccttcatgggctcggggagagaacttggagaaaatcttgttatccaattatgttttggaccctaggaaaatctttgcacgaaaa

SEQ ID NO: 986 - DNA, 283 bp, Zea mays
  misc_feature: Incyte ID No: 700550184H1
  unsure 282: a, t, c, g, or other
agaagtttgaacgtgggacaagtatgggccctgtacaacaacattgataaactccccaagttctatgcctgggtaagaaaagtcaggggaagagccgtttagagtcgaggtgatctgggctcgaggcctgccccgaacaggaccaggagaaacagtggctggagcaggacatacccatcagctgcgggacattcaagatccgaaaatggagagccgagtacggcacaaacgacaccttctctcatcagtaatgccagagaaaccggcgcaaatgggcgtcgnt

SEQ ID NO: 987 - DNA, 286 bp, Zea mays
  misc_feature: Incyte ID No: 700550186H1
accatatcgacatcgacgccagcgagccaaggacagaacagccggcgcccggccctaaaactgccgtgcagcgtgagagaagcgagggaaagatggaccggtaccagagagtggagaagcagagggaggaggcacccatcaaggaaaacgagatccgcattaccacgcaggggaggatgcgcaactacatcacctacgccaccggcttgcttcaggttctgatgaggttgtattcaaggccatggggagggctatcaataagactgtcatggttgtggaattgatc

SEQ ID NO: 988 - DNA, 286 bp, Zea mays
  misc_feature: Incyte ID No: 700550188H1
  unsure 9, 15-16, 22-23, 26, 31-33, 35, 62, 73, 85, 99-100, 115, 137, 147, 153,: a, t, c, g, or other
accagcatnttcaannggatcnncancattnnntnattctgcatctgcaggagttccatatnttccaactctntcctcctctctngttgggccagccgnngcgttgccttcccancattcaaggcagtatgccatanatcatgctgncggtancagcagtagtgtacgtnacggtaatcggaaatgggaaagtcanggccttnatcttaactcnggccctggaagtatagatttagaaggaaaggatgaacggatgcctttaccagtcagacaaaatttgatccca

SEQ ID NO: 989 - DNA, 287 bp, Zea mays
  misc_feature: Incyte ID No: 700550189H1
gggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgagt

SEQ ID NO: 990 - DNA, 101 bp, Zea mays
  misc_feature: Incyte ID No: 700550192H1
agtcagagctcgttgtgtactaatgttcccccatgttctgtttctcgttctgattctgcaattcgtcatattgttgaatttaatggttatgtggaatcact

SEQ ID NO: 991 - DNA, 141 bp, Zea mays
  misc_feature: Incyte ID No: 700550193H1
  unsure 21, 35, 39, 53, 59, 63, 68, 73-74, 90, 99, 104, 110, 125, 134: a, t, c, g, or other
cgtggcccagacacttctgtntcacggttggtgtntgcncatgtagctgtatnaagagnatcngtgcntacannaaccgtggcccagaanccttctgtncaggnggtcantgtttgttcagtgtnatccgtgtnggattat

SEQ ID NO: 992 - DNA, 280 bp, Zea mays
  misc_feature: Incyte ID No: 700550195H1
  unsure 203: a, t, c, g, or other
tgtaaacaagaacaatgtgaatgttacgaaatcttgtttgcctgatgagtataagcctgagaagtggatgttagctgatctggagtcaagggcgttgagccaactgaaccttgcaatagtcggtcatgttgattccggcaagtcgacactatctgggagattactgcatctcttaggaaggatatccaaaaaatatatgcacnagaatgaaaaggagtcgaaagaaaaggggaaggggtcattgcttttgcatgggccatggatgagagcatgaagaaag

SEQ ID NO: 993 - DNA, 186 bp, Zea mays
  misc_feature: Incyte ID No: 700550196H1
  unsure 39, 42, 58, 83, 86, 132, 137: a, t, c, g, or other
cttcttgtgatcctgatagctctaacatataccagaganggnaatattgtgatcctgntagctctaaacatatacagagattnaangatcacaatatgtccttcttgtcttgaaaatgatacaggttgcttncatgntgcataaggaaaacattacttttgacacatcgtaacaaagttctttctg

SEQ ID NO: 994 - DNA, 148 bp, Zea mays
  misc_feature: Incyte ID No: 700550202H1
  unsure 112: a, t, c, g, or other
agagcgtgcaagaagagaaggcccgtgtcaggcggcggctataggtgcaaggataggcaacaagtgttcaaaaacacgtctgtggatcaattgacttgtatttcagcctttnagttgaggttaaagtggaggtttaagaagcttgaga

SEQ ID NO: 995 - DNA, 272 bp, Zea mays
  misc_feature: Incyte ID No: 700550207H1
  unsure 11, 23, 32, 46, 70, 76, 87, 90-91, 98-99, 103, 107, 127, 134, 164, 176,: a, t, c, g, or other
cgccaagggancctcgccgttgnctctccacncaaaagcccaaagnctagacccggggagcacagcggcngccgcntctccgctacnctnntccagcnnccgntacnagtgcgacgatggcgccgcntaccggngctccgctcagtagagtgaggcggcggcgnagccacgtcganaacganggcgcgnannaccgganatagcctggagnaaggagctctgcaatcggtgggtcattgggactgtangcaccgacgtagagtgcggcactg

SEQ ID NO: 996 - DNA, 280 bp, Zea mays
  misc_feature: Incyte ID No: 700550213H1
ccttgaatccctaaatctgggaatttgtccaaaattaagtattctgtgcattgaggccccaaatatgtctataatggagctgaagggttgtggtgtgctttccgaggcttccatcaattgccctcgcttgacatctttagatgcctctttctgcaggcagcttgtggatgattcactgacttgtatgaccgaggcatgtcctctgattgaacatcttatcctgtcatcatgcctatccattggcatcgatggattgtcttcattgcattgccttcataag

SEQ ID NO: 997 - DNA, 279 bp, Zea mays
  misc_feature: Incyte ID No: 700550214H1
cgagcacggagatctacaacaaaaacatggagctacgacgcgattcccaaggtacaatcgtaattatgttcaaacaatttttaagtcgtcctgcgctccttctattacgagcaacgtttatattctgtgcttgcataataaatcgaagaaatcctgacaccaatcgaactgaagatcctgaaacgcacgttaataccgttgacgtccgcttcacccagctcgattttcagtcttgtaataataattgagaactccaatgaactgagagttactaatcgc

SEQ ID NO: 998 - DNA, 280 bp, Zea mays
  misc_feature: Incyte ID No: 700550215H1
  unsure 110: a, t, c, g, or other
acgagacccttcgaccttcgcaacgccgccccaatccccagcaaccactgctccgccgcctccgggaccgccggagcccgtggtggaggaggacgtggagagggaagatntcgccagtccaaggaggtggggacaagatggtgagctcctcgtcgtcggtggttaacgtgtacccgctcgccaactacacgttcggcaccaaggagcccaagatggagaaggacacctccgtcgccgaccgcctcgcccgcatgaaggtcaatacatgaaagaaggaatg

SEQ ID NO: 999 - DNA, 281 bp, Zea mays
  misc_feature: Incyte ID No: 700550218H1
ggaaaacaagaatggttcaacatcacacaagaaaaacggtttctcaagaccactcttgaaatgtgcagaagaggtcctactgaatggcgatgttgcaagtacatctgggaaatccattgcaagcttacaggtggaagcatctgatttggcaaacttccttaccatggatcggaatgggggttaccgaggttcacaaactcttctaagatctgtattatcagagaaacaagagctgtgcttctctgttgtctcattgctctggcagaagctcatagcttctc

SEQ ID NO: 1000 - DNA, 270 bp, Zea mays
  misc_feature: Incyte ID No: 700550221H1
  unsure 49: a, t, c, g, or other
agggtaatgatgatagatacttggtggttgtaagatatggtcaggatcntgggagaggtgtaggttgtaggtgaagcatcttcagaagcttagacggttgaaggtgataggccctgttaggtgttattaaggtggggtctgggtcgaggatggggttgcacggcagttggtagtattcacctatatgcttccttcatctcttaggtgtaggatttaaacctttttaaaaacagcatcatttgcatccacagtacctgttctgagctggcg

SEQ ID NO: 1001 - DNA, 271 bp, Zea mays
  misc_feature: Incyte ID No: 700550222H1
  unsure 189: a, t, c, g, or other
ctccgcatctactgctgctgctagagaggcacccggctaccagtccgcctcgtcgcttaactccgacaactgctgatgccttggcagctagctggtcgtcccaagtagtagagaacaaggcaaatgtatccatagatctccttgtagcggagttaatgcctttttttcccctttctaatatgcattggntgagcccgtagcgcaccgtagtagtatctaaagctggtgttctgagttggttggaccttcctgcagttttggtttctccttc

SEQ ID NO: 1002 - DNA, 271 bp, Zea mays
  misc_feature: Incyte ID No: 700550223H1
  unsure 11, 13, 15, 40, 81, 122, 127, 168, 174, 181-183, 195, 201-202, 210, 224,: a, t, c, g, or other
ccataaaatgnananatgttatctctggtgatagtcctgntgatattgttgaaattcgagctgaatatgatccttgaaganttctaaactgaagggtgttcttcactggttgctgagccagnacctngtgtagagccattgaacgtggaagtaaagattattcgaganattgtncatgtcnnngaatcctgctgnattggnngattggcntggcgatcttaacncacactcggaagaggtgataaaggatacttatgctgtaccatcacnt

SEQ ID NO: 1003 - DNA, 274 bp, Zea mays
  misc_feature: Incyte ID No: 700550224H1
  unsure 24, 58: a, t, c, g, or other
acggagactgacaaggcagatatncagaagggatattgagagtctgcactcattgagncagagtttgaaggaacgtcgagaggcatataacagggacaggagcagactcatcgaactatttgaaaagtacaaggcgtgcaaaaactgtgggatttctatttttgagggattggattctctgctgcttaaagacagtgctgaaattgagcatccaagtttggctgttgagggagatgatcatgccttgaccaccgatacatcaggtccagataca

SEQ ID NO: 1004 - DNA, 267 bp, Zea mays
  misc_feature: Incyte ID No: 700550225H1
  unsure 201, 243-244: a, t, c, g, or other
acagcgtcatcatggctcgaatgaccaccaagatatccatcacagcttcaaatgatcccttggaccatgacctctcggttgccgataaaatcagtgacgagaatgacagctccaatgcagttcaacatggttttgattggaagtggttggtggttgggggtgcagtggctgcggtttgtgtgctcaacaccggtctggtangcaaggccgtcttgcttggagcagcgagaaggcaagcaaagnngtgatatgaggagcagccttcca

SEQ ID NO: 1005 - DNA, 277 bp, Zea mays
  misc_feature: Incyte ID No: 700550226H1
  unsure 82: a, t, c, g, or other
catcaggaaggaatatgctgctcgtgctgcatcgtatgaggaggcagaaaatactaaacatacagcaagattcaaaaaagangaggtgaagattgaagcttgggagggtcgtcaagagcaaaaattgaatatgaaatgagaagaatagaggaatttgctgagagaatgagaagtgaggccatggaaaagatggccgaaaagctagagatgacgcgccgcatagccgaagagaaacgagcttcggccaacgccaaaatgaaccagcaagcagctatag

SEQ ID NO: 1006 - DNA, 277 bp, Zea mays
  misc_feature: Incyte ID No: 700550230H1
  unsure 44: a, t, c, g, or other
ctgcaagtatcattctcagaagaggtgctggggcattggcttcngcctgcggttcagagtggtctcgctcgacctgaccttcaggaagctttccttggagaacatccttatggcataccggagagccaagacacgggcaattctgctggactacgatggcacgctgatgccacaggcgattaacaagagcccgtccactgaatctgtgcggatcctgaacagcttgtgccgagacaaggacaatgtggtgtacctatgcagcgggtatgaccggcgc

SEQ ID NO: 1007 - DNA, 288 bp, Zea mays
  misc_feature: Incyte ID No: 700550232H1
  unsure 17, 48, 60, 67, 89, 121, 124, 128, 159, 172, 251, 278-279: a, t, c, g, or other
gtcaagtagagaagagnaggatttgaagagggtgcttctaatactggnagatttgaattngtaaganacaatctggtcagatcatgagnaaattggacaggtatgcttataggctcactancancgtnataacagtggaagtcattattgtgcataatntgattctgtcttnaaaaaaaatgtaagagcattatatgaagtagttctaacctcacctgatataataatgtggtactttctcacatagcacnaagcccacatgtgggcagttagatggnntacttctct

SEQ ID NO: 1008 - DNA, 281 bp, Zea mays
  misc_feature: Incyte ID No: 700550233H1
  unsure 35: a, t, c, g, or other
cgagcacggagatctacaacaaaaacatggagctncgacgcgattcccaaggtacaatcgtaattatgttcaaacaatttttaagtcgtcctgcgctccttctattacgagcaacgtttatattctgtgcttgcataataaatcgaagaaatcctgacaccaatcgaactgaagatcctgaaacgcacgttaataccgttgacgtccgcttcacccagctcgattttcagtcttgtaataataattgagaactccaatgaactgagagttactaatcgctc

SEQ ID NO: 1009 - DNA, 269 bp, Zea mays
  misc_feature: Incyte ID No: 700550234H1
  unsure 12-13, 38, 54, 163, 173, 191, 206-207, 217, 226, 233, 240, 248-249, 256,: a, t, c, g, or other
ctccaagcccannggactggaatggttctgaatcagangaccaaatgagagganggtcagcagttcttcatgctgctcttgagctgtgtttcaacctcgtagtgccgtatcaatcgtatcagaggaggtttatggaaaatatcccatgtcgcttgtgtggctncctttcaggntgacgtgctcccattctnctccacatttcctgnnacatgttcgncatgtaaangccatanctaaagnggccctgnntgggcanangggttactnaa

SEQ ID NO: 1010 - DNA, 270 bp, Zea mays
  misc_feature: Incyte ID No: 700550236H1
actagttctagaatcactcccaactataggggcaatctttctggtttgaagtataattacacaaaggtggacgaggctatgaaatactacgagaaatctggattgaacagaacaggaaagggaagttcccagatagcaattcataccaggacttggtgttccgttttttcgtgaagagagggggcggctctggatatgcctcacctgtcacaattgggtcaatgttgtttgatggtaactctttggtggttcaagatcccttttctcgcc

SEQ ID NO: 1011 - DNA, 270 bp, Zea mays
  misc_feature: Incyte ID No: 700550237H1
  unsure 115, 217: a, t, c, g, or other
tagactacgacagcgtccgtcgaaccggagggtcggaggcggaggcgaagatgaggaagaagctcggcacccggttccccgcggctcgaatcaaaaagataatgcaagcagatgnggatgttggaaagattgcattagcagtgcctgttttagtctcgagggctcttgaattgtttttacaagatttaattgaccggacttatgaaattactcttcntagtggagcaaagacactgaattccttccacctgaagcaatgtgtgaagaggt

SEQ ID NO: 1012 - DNA, 272 bp, Zea mays
  misc_feature: Incyte ID No: 700550238H1
  unsure 110: a, t, c, g, or other
caatgacatcaagcttaggggatgatctcattgcagtgccaattaaaagagctcctgatcaaactctggaattgacaagtgaagtggtcgatttcttgagagggatattnaacatgtttgacattgataacgatggagctttactacctgctgagctggaggacctattctcaacagcacctgaaaacccatggtcttgcgatccatataaagactgtgctgaaaagaatgtgttgggtggtctgtcacttgaagggtttctctcaaagtgg

SEQ ID NO: 1013 - DNA, 222 bp, Zea mays
  misc_feature: Incyte ID No: 700550239H1
  unsure 5, 74, 154, 186, 193, 219: a, t, c, g, or other
cctcncaaacagactggatttcatcaagataatcctgaaactggagccaacaagcagacagagaaagaagagcnagaagaccggctcccagccgatacaaggtaggagtgagcagcgttagatcagttttcatcacattgatcgatatggtganagtgagagaggagactcgcaaggggccatggncagagcnggaggacctgcaactggtatgcactntcc

SEQ ID NO: 1014 - DNA, 272 bp, Zea mays
  misc_feature: Incyte ID No: 700550240H1
  unsure 2, 17, 21-22, 24, 57, 82, 147, 183, 255-256: a, t, c, g, or other
gnggccttctctgtgangggnntnggcctccaccggtgcgctccggcttcgctactncgttgaccttcggcgaggtctgccnggcgcggcgagcgttccgcggcctcgtctcagggccgctaccgtcgtcgcccccaagtatacaanacttaagcccttggctgatagagtgcttgtaaagantaactcttccgagaagaagacaactggtggaatcttgctccctacgactgctcagtccagacctcaaggttnngaggtagttgctgttt

SEQ ID NO: 1015 - DNA, 275 bp, Zea mays
  misc_feature: Incyte ID No: 700550241H1
  unsure 159, 188, 198: a, t, c, g, or other
cacgccgcatttgccaccaggagcaatcaaagacactagcattttgcagtttcaagtacaaccagagtgtggaggaaagtgagactcacttaatacgtctgctagatcatcagacttttgagtccctgtgtgtgtatcctctagaccagtatgaatgtngctgctccatcattagctgttcgtttgtngatgacaatnatgtctattactgtgtgggaactgcatatgttatacctgaagaaaatgaaccaaccaagggccgaatccttgtattt

SEQ ID NO: 1016 - DNA, 273 bp, Zea mays
  misc_feature: Incyte ID No: 700550242H1
  unsure 50: a, t, c, g, or other
aaataatagcacatgtacaagcaatacttatacagtcaaatagtggccanggaatgtcaggtggttggggcaaagttctgggctgccaacttctccttcaggggctgctgaatcctcaggtcccaaccaagcgaacagtgctgcaactggcatcaatgccactaactttgtttctaggagtggttactcctgccaacaattgtctgttttgatgattcaagcatgtggtcttctgctggcacaactcccaccagaattccacatgcaactata

SEQ ID NO: 1017 - DNA, 274 bp, Zea mays
  misc_feature: Incyte ID No: 700550244H1
  unsure 7, 27, 31, 33, 36, 42: a, t, c, g, or other
tgtgcancgcatgtgccggcgttttcnacgntnttncgaggngctggtgagcaggtgggcggcggagtcccttggctccgacagctcgtgcgagctggacgtctggccggagtgcagaacctgacgggagacgtcatttctcgcaccgcgttcagcagcagctacagcgaagggagaaggatcttccagctacaggccgagcaagcttcgcttgtcatgaccaacattcggaagatcatgatcctcggctacatgtacttgcctaccgcgaaca

SEQ ID NO: 1018 - DNA, 275 bp, Zea mays
  misc_feature: Incyte ID No: 700550245H1
catgcatccaactatgctgatccaaacaatcctgacttttggaagaagtggaatgattttgagattcagcacggtaacgaagatacattcagggagatgcttcgtatcaaacgcacagtggctgctagccgcagtcagacacatttcatactgccagagtacttgatgcagagggatcagaagttaaacctggacgaagcagttgacactctgaagcgtgctggcgtccctgaggacgagatggcagctttggaaaggcaactggctaccggacc

SEQ ID NO: 1019 - DNA, 93 bp, Zea mays
  misc_feature: Incyte ID No: 700550246H1
  unsure 22-23, 26-27, 84: a, t, c, g, or other
ttcttgcttcttgtttgtctgnntgnngttctccaaggttgtactgcttgaccttacttgttggatctaatctacatatccagncagcagggt

SEQ ID NO: 1020 - DNA, 189 bp, Zea mays
  misc_feature: Incyte ID No: 700550247H1
tccattttgtaacaagtttttggtttcctcgtcgcctaacttttgcttcatagtgttctggacatcatggtctttgttagaatttacttgtaaaaaccaagtgaatatgccttcagcacatattattgtattatgatttgttcatgctacaaacgaagtgaatacgccttttgtgatttgttcatttgt

SEQ ID NO: 1021 - DNA, 284 bp, Zea mays
  misc_feature: Incyte ID No: 700550248H1
  unsure 94, 106, 232, 240, 250, 268: a, t, c, g, or other
cccgattgcctcctcagcaacttccatacccccagctcggcggtgccggaacgagcagagcaagccggagggcctgtcggatccgccgccgtcnagatgaatgacnccgatgtacccaagcagatccagcagatggtgcggttcatccgccaagaggccgacgagaaggccaacgagatctccgtctccgccgaggaggaattcaacattgagaagttgcagcttgttgaantgagaaanagaagatccnggcaagagtatgaacgcnaagagaagcagttgat

SEQ ID NO: 1022 - DNA, 269 bp, Zea mays
  misc_feature: Incyte ID No: 700550252H1
agcgccagcatcttcaatccactgttgaagctcttcaagaagaaaagaagctcctatattctaaattgaggaacattcctgtgaatgagagggcaactactgtagagaaaccttcagttgataaaaaagatgcatcaaccgtgacagaagatttagatactggggaaatcagctcttcagagacactgaccagcactgttgacatattggaagacgctggaacatctgttttgcgttccaacattgtgtctgattttccttcctcggaa

SEQ ID NO: 1023 - DNA, 267 bp, Zea mays
  misc_feature: Incyte ID No: 700550254H1
  unsure 182-184: a, t, c, g, or other
gaacactcatcagaagccattaaagacttcctttcagatgcctcgttagtgcgatttcttcgagcaaggaactggaatgtgcagaaagctagtaaaatgatgaaagagctgtgaagtggcggcttgcattcaaacctgaaaacatctgttgggatgatattgcagaggaagcagagactggnnnccatatatagggcggattataaggacaaacatggcagaactgttcttgtattgaggcctggcttagagaacactactcagcca

SEQ ID NO: 1024 - DNA, 269 bp, Zea mays
  misc_feature: Incyte ID No: 700550256H1
ccagcaaatagaggagcatgatttcgctctgccatgaatctgagggaaagaaagtccaaaagttagccaatgcagcagccttatacgacccatgcatagcttatgaagaagggtccaggagccgcgtgccgccgtgccggtcatcattcattttttttcttggccgccaactcgaacgatctgacagattgctctacaattgcgccgttagatttcagtgtcatggtctgtagcctgttcgacgtgactcgaaaaatgaacctatggat

SEQ ID NO: 1025 - DNA, 274 bp, Zea mays
  misc_feature: Incyte ID No: 700550257H1
  unsure 50, 215: a, t, c, g, or other
cacaagatcaccaagcaggtggaatactattttagtgacatcaaaccttnctactacagaacatctgatgagattcattaccaaggattctgagggatttgtgccaatatcagtaattgctggctttaagaaagtaaaaacttctgtgcgcaataatgtgatgcttgctgcggctctccgaacctcatcaaaacttgttgtaagcgatgacggtnagagagtcaaaaggcagcagccatttacagaatctgatttgcaggagctccagtcccgg

SEQ ID NO: 1026 - DNA, 276 bp, Zea mays
  misc_feature: Incyte ID No: 700550258H1
  unsure 14, 18, 26, 30, 52, 59, 64, 69, 71, 78-79, 88, 94, 121, 196, 198, 201, 204,: a, t, c, g, or other
caaccccatccaancaancaacccgntcgncgacgttggatcccctcccttnctttgcngtgtncccgncnccaaacnnccgtagcgnccgcanagcaatcgctgccgccgctggaggccnggccgtgggggctgaaatgaaggaggtggtgctcccacgtgtatgacgtgaccaacagtgactccgagaagacgnanaanacnatnctncagatcaaccgcatctttcaaggacngcatcggcctcggggcatcttccacagcgccgtgcangtc

SEQ ID NO: 1027 - DNA, 274 bp, Zea mays
  misc_feature: Incyte ID No: 700550259H1
  unsure 50, 82, 165: a, t, c, g, or other
agaccacagtaaaaggatatgaagatcaacagcagcatgatgacccatcnagttccaagcaaagctaaacagaaaaagaggnaaatttcagatttagatcccaaatggagcaggatgaacttacacgcttttatgaagcctaccgtcaacatgggaaggattggnaaaagatcagcatagcgataggcggtaagtcgtcggacatggtgcggtctctttacagtgcacatcggactttcttatctcttccagaacatcaagctactgccatggg

SEQ ID NO: 1028 - DNA, 264 bp, Zea mays
  misc_feature: Incyte ID No: 700550260H1
  unsure 12, 41, 209: a, t, c, g, or other
ctccaagcccanaggctggaatggttctgaatcagagaccnaatgagaggacagtcagcagttcttcatgctgctcttgagctgtgtttcaacctcgtagtgccgttatcaaatgtatcagaggaggtttatggaaaatatcccatgtcgcttgtgtggctgcctttcaggctgacgtgctcccattctgctcctcatttcctttccanatgttcgtcatgtaaatgccaatactaaagtgtcatgcatgggcagaagtgttac

SEQ ID NO: 1029 - DNA, 274 bp, Zea mays
  misc_feature: Incyte ID No: 700550262H1
  unsure 105, 112: a, t, c, g, or other
aattcaatgtgtggtactgttgaatacatgggccccagaaattgttcagggccgaggtcatgataaggctgcagactggtggagtgtgggagtccttctttttgnaatgctnacaggaaagccaccgtttgttggtggaaacagagacaagattcagcagaagatagtaaaggagaagataaagctgccaacatatttatctagtgaagttcactcaatgttgaaaggattattgcacaaagaagctggcagaaggctgggaacggaccaggcg

SEQ ID NO: 1030 - DNA, 277 bp, Zea mays
  misc_feature: Incyte ID No: 700550263H1
  unsure 184-205, 271: a, t, c, g, or other
atagcgacacctcctttcctctccctcgaggtgtctctcccagaaacgcacagcacagtcgcataacaggaaggcagagagcagcgccgcgatgagaggaggaggagcggggccactgcggcgttcatgtccgacgagccgcctccagccgacgcggaagaggtggaggagaactccagcgccnnnnnnnnnnnnnnnnnnnnnntggtggagcaggacgacgacgagctggagctggggctctgcctcggctccaagcaacagcagcagnagcatc

SEQ ID NO: 1031 - DNA, 274 bp, Zea mays
  misc_feature: Incyte ID No: 700550266H1
gccatttatgtgccgccatctcagcagggcacaattgatctgcagagtgggatccttcatgctgaagagaaggattacaagactgcttacagctacttcttcgaagcatttgaagctttcagttcactggaagatcccaaggctatcttcagcttgaagtacatgcttctgtgcaagataatggtcaaccaagctgatgatgttgcaggaatcatctcatcgaaggctggcctcaagtatctgggtcctgatgttgatgctatgaaagctgtgg

SEQ ID NO: 1032 - DNA, 277 bp, Zea mays; identical to SEQ ID NO: 212
  misc_feature: Incyte ID No: 700550267H1

SEQ ID NO: 1033 - DNA, 277 bp, Zea mays
  misc_feature: Incyte ID No: 700550268H1
  unsure 186, 190, 248, 268: a, t, c, g, or other
gactagttctagatctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaanaagnggttccgcaaggcgcagtgcccgatcgtcgagcgcctcacaaactccctcatgatgcncgggcgcaacaacggcaagnaggtcatgg

SEQ ID NO: 1034 - DNA, 277 bp, Zea mays
  misc_feature: Incyte ID No: 700550270H1
  unsure 109, 114, 138, 197: a, t, c, g, or other
gcgttcagcatattgtcgcgcgtggcggagatactgctggaggatgacctgatcaagaagccgaacacccccatgaccacgctgaagttcgacctctcctctgacgtgnacttngccggcatcaccgagacgccaccnggacacatccggcggtccctgatggaccagatcagcatggtggacgggcgctacgatanccgttgttggcaagaagaaagaagtgaagcagctgaggtggtgagggcagtcagcagctgttgtgtgaatcttttgccga

SEQ ID NO: 1035 - DNA, 276 bp, Zea mays
  misc_feature: Incyte ID No: 700550271H1
  unsure 6, 28, 56, 118, 144, 182, 237, 245, 256: a, t, c, g, or other
tcagcnctagaaaggctccatatgaggnttcatctggtatattctgggataatganagtttagctggtcttttggctattgaacttaaagcagatctccttgttctactaagtgatgnagatggtctatacagcggtccaccanagcgaaccgggatcaaagatcattcatacctacatcanagataaacattacagtggaataacttttggggataagtcacgtgtaggtagaggnggaatganagctaaagtgnaggctgcttttgtggcttcg

SEQ ID NO: 1036 - DNA, 263 bp, Zea mays
  misc_feature: Incyte ID No: 700550273H1
  unsure 5, 20, 58, 90, 111, 145, 229-231, 247, 249, 251: a, t, c, g, or other
cacgngcagagggagattgnctctcatgggctgaatgcaacatgaaactcatgatcgngttgttacgaagaacggtgaaacacagatcancgttcttcgtaacaacggtgntaagaaggttcgcacggcagaggagattgctctnatggctgaatgcaacatgaaactcatgatcgccacgagtatcatggaagagtgtttcctgcctattctagatcccaggacaggnnntagacattattccctncnanaatgtataactg

SEQ ID NO: 1037 - DNA, 274 bp, Zea mays
  misc_feature: Incyte ID No: 700550275H1
  unsure 6, 9, 11, 26-28, 46, 49, 52-53, 69, 105, 150, 208, 221, 229, 238, 264: a, t, c, g, or other
tgtgcngcntnagaaacgagttggtnnnctttgttgtgcgaatacncantcnnacgtttggaggtgcangctctaatcagatcccaaatgatcaactttgtgctnctcatgagtcgccaagggaaggtgagattgacaaaatggtactcnccttattctcagaaagaaaggagtaaggtaatcggtgagctcagtggaatgattcttntcccgtgcgcccnagcaatgnaattttgtnggaatggcgaggacataaagttgttnataaaaggta

SEQ ID NO: 1038 - DNA, 274 bp, Zea mays
  misc_feature: Incyte ID No: 700550279H1
  unsure 47, 116: a, t, c, g, or other
ctcacaaaaccctcgcttcgctccccaccaccccgccgcgccgccgnctgtaccagctgcgtcaagatgagtcggcaccctgaggtgaagtgggctcagaggatcgacaaggttanatcactgtacagttacctgacgcaaaggatgctaaggtcaatttggatccagatggtgtactcacattctctggcagtgctggtacaaacttgtatgaattgaaactagatctgaatgacaaagtaaacgttgaggctagcaaaataagtgtgggggt

SEQ ID NO: 1039 - DNA, 270 bp, Zea mays
  misc_feature: Incyte ID No: 700550282H1
cgaagatcagccctgggagaccaagccatgttgtcttcgggaaatcaactattaagcaagggcagattgatgcttcggagagtggctaatccggacacagtaggcaaatacagctgaagtgggaaggaccttttctcgtggtaccttcgtcaaggcctggttcttacaggttgaaggatatggacgacaacgatattcctagatcttggaatgcggatgagcttcgacgatattatgtgtaatttgatgtaatcttttttcatttttttc

SEQ ID NO: 1040 - DNA, 278 bp, Zea mays
  misc_feature: Incyte ID No: 700550285H1
  unsure 52: a, t, c, g, or other
cgggttgcggggatggccctcggcatcgcacctggcgccacacacacacganacgtacaacgatgcccggtggatggtgtgttgttgcatgagctcatggggctagaattgtcagagtcatgaattatattttctagtgtagtctatatgacaatattataaggaataaaacttctctaatcagtaatcatagatttaaccttttggaaagaaaaatttaagatcaagaattattcttgcatatgacttgaaactatgtttgagccattgtgttggcc

SEQ ID NO: 1041 - DNA, 266 bp, Zea mays
  misc_feature: Incyte ID No: 700550289H1
  unsure 66, 148, 226: a, t, c, g, or other
agatgactacatcggctttaaggttaagacgacgagcccgaagaagtactgtgtccggcccaacancggcatcgtgccacctcggtccaccagcgatgtcattgtgcaatgcaagcacaaaaggaggcgccaccagacatgcagtgcnaggacaagtttcttgtgcaaagtgtcgttgtggcggaagggaccttagtcaaggacatcatggcgatatgtttaccanagaatcagctaatgtggtggatgaggttaactgaaggtcg

SEQ ID NO: 1042 - DNA, 266 bp, Zea mays
  misc_feature: Incyte ID No: 700550290H1
  unsure 75, 229: a, t, c, g, or other
ttgtcatgtgggagttgcttactggggaagagccatactctggcatgcgtgctgctgaaattattgggggcattntaaacgattccctacgtcctcaaattccttcatggtgtgatcctgagtggaagggattgatggaaagctgttggtccagtgatccagctgagagaccgtccttcacggatatatctcaaaggttgaggaaaatggccgccgcaatgaatgtgangtaaaggtccggaagccatatttgtcttgtatgtgtg

SEQ ID NO: 1043 - DNA, 213 bp, Zea mays
  misc_feature: Incyte ID No: 700550292H1
  unsure 2, 100, 136: a, t, c, g, or other
gngtgggagacccgcgagaggctgccgtgtagggaccgtagactcagcgactgcgaaggagggataaggggatggccgggatcggaccgatcaggcaggnctgggagccggtcgttgtgcggaagaaggcacccancgccgccgccaagaaggatgagaaggccgtcaacgccgcgcgccgcgccggtgcggagatcgataccatgaagaagt

SEQ ID NO: 1044 - DNA, 269 bp, Zea mays
  misc_feature: Incyte ID No: 700550293H1
  unsure 193, 246, 251: a, t, c, g, or other
tgtcagatcaaaatacgactgctttcaaagaagttgcaataattcgtcatccacgaattggtgaatatgcatttggattcataacatcaactgtggtccttcagactgacaaaggcgatgaagaactgtgtagtgtgtatgtgccaacaaatcatctatacatcggtgacatatttctggtgaactctgaggngatcataagacctaatttatccattcgagaaggaattgaaataattgtgtcangaggnatgaccatgcctcaggtg

SEQ ID NO: 1045 - DNA, 202 bp, Zea mays
  misc_feature: Incyte ID No: 700550295H1
  unsure 24, 34, 39, 41, 46, 64, 68, 72, 85, 87, 93, 95-96, 112-113, 127, 133, 147,: a, t, c, g, or other
gaactagttctagatcccctagcncctgccctcncctcntngcagnggcccgtaggtccctttncccntacnctccctccctctncnccgcangnngccagaggaatttcgnnctcgattcgacgcngattcntccgcccacgaccnggatgccctcggcaaagcgnggatctgaacgntgcgcttccgtgtcgnnggntng

SEQ ID NO: 1046 - DNA, 214 bp, Zea mays
  misc_feature: Incyte ID No: 700550296H1
  unsure 49-50: a, t, c, g, or other
ggaaaaaatgtttttcatatttctcccttttcccagatgattataaatnngataagtctgagattattcgtttatgggattcaataggaatcataggttctagtatacagcaaagaaaatagaggacataggatcggattattttgatgaactattagatagtggttttcttataaaagggagcaatgatttttatgtaatgcatgatttaatc

SEQ ID NO: 1047 - DNA, 282 bp, Zea mays
  misc_feature: Incyte ID No: 700550301H1
gaggagcaattattccccagtgtgctagtccaagccatgagtcttgagaagctggttatagccccagaccttgcaattattagaaaacatatcaatgatggagtaaacggacttctgtttccaagaaagaatattggcatgttagctcaagttcttcttcgagcagtgtcaaatagtaaagtgtctctttcagggcaaaaaattgcttcagctgggaaggctcatgccaagaatcttatggcttctgagaccattgaaggctatgctagctattgaaaaatg

SEQ ID NO: 1048 - DNA, 277 bp, Zea mays
  misc_feature: Incyte ID No: 700550303H1
atttcaggtcattgtccgcaacaagaagagagtaggatataactatgaactaagcttgagatttagcggtgaatggttaatcaaagaagaaaacaagaagatcaaagggcatctagacattcccgagttttcattcggcgagatcgatgacttggaggtacaagtaaggttcggcgatgacaagggcctcgcgtctgatgatagaacacggatctgcaaggatctcaagtccttttggcgccgatccaggagaaaatgcgcatgttgaagaagaact

SEQ ID NO: 1049 - DNA, 279 bp, Zea mays
  misc_feature: Incyte ID No: 700550304H1
  unsure 15, 129: a, t, c, g, or other
gaaaactacgcgaancaagggcaagattgttcagcggaggagcgcaatgattttattaggagaaaatacgaggctcaacaatttttgactaacccccagctttcatgtcctccacgacgcaacgagaancataatcaccaacagcatagtactagttcaagtcgacatggtttaggccattcattcaggaacagctggaggagaaaagagcacgaggccaaatcaacaaagaaaacaatcgaggtgggcatggtagagtttgtcggattgattaagatc

SEQ ID NO: 1050 - DNA, 277 bp, Zea mays
  misc_feature: Incyte ID No: 700550305H1
agcgtactatgcttgaacttctaaaccagctcgatggttttgaagcatcaaacaaaattaaggttttgatggcaacgaacagaatagacattttggatcaagcccttctgaggcctggccgcatagacaggaagattgaatttccaaatcctaacgaggattcacgtttcgatatcttgaagatccattcaagaaaaatgaacttgatgcgtggcattgatctgaaaaagatcgcggaaaagatgaatggggcctcaggagctgagctcaaggccgt

SEQ ID NO: 1051 - DNA, 275 bp, Zea mays
  misc_feature: Incyte ID No: 700550306H1
gtacacagcaaacactatggcatctgctatcgaaactttgggcatgagtcttccatacagttcttcgacacctgctgaggacccactaaaactagaagagtgccgtcttgctgggaagtatcttttagagttgctaaagatggatttgaagcctaaggacattatcactgagaagtcattgcgaaatgcaatggttattgttatggcacttggtggttcgactaatgctgttctgcatttgattgccattgctcggtccgttgtttgcattgact

SEQ ID NO: 1052 - DNA, 154 bp, Zea mays
  misc_feature: Incyte ID No: 700550309H1
atatcaagccgatgaaagctttatgatgcacgaggaacctgtgctgtgtgttgattttagtagggattctgaaatgctggcatctggatcacaggatggaaagattaaggtttggcgtatacgaactggtcatgctgcggagccttgagcgtgc

SEQ ID NO: 1053 - DNA, 151 bp, Zea mays
  misc_feature: Incyte ID No: 700550310H1
atatcaagccgatgaaagctttatgatgcacgaggaacctgtgctgtgtgttgattttagtagggattctgaaatgctggcatctggatcacaggatggaaagataaggtttggcgtatacgaactggtcatgctgcgacgcctgagcgtg

SEQ ID NO: 1054 - DNA, 274 bp, Zea mays
  misc_feature: Incyte ID No: 700550311H1
agaaaatacagtgtctggattggtggctcgatccttgcgtcgctcagtacgttccagcagatgtggatatccaaggatgagtacgatgagtctggccctgctatcgtccaccgaaaatgcttctgagcttagctatctgccgcgcctttcatagcgtgtcaagctgttgagatctgcgttgttgagttgagtgtctctatggagtatcacatactttctgcatgaggggggaagagtatacccaactaagcgcagcctttcgatgccctgcttc

SEQ ID NO: 1055 - DNA, 278 bp, Zea mays
  misc_feature: Incyte ID No: 700550312H1
aaggaaaaggatgcaccagggaaaaaaggttctacgaaacgtgcatcaaagccttctcaaaacagtaaaaatgagcctgaggtagagataaaaaaggttggcaagagagaaaagagttcaaaagaaactgacgtgtcaccagattcaaataagtcaaacaagaagatttctaaatccaaaaagggtgatggaaaagaaacccaaaataataaagctgccaggtcatccaataagagtaaaggtaaagtcaaaggtgggtcagtggtgggactgcccca

SEQ ID NO: 1056 - DNA, 282 bp, Zea mays
  misc_feature: Incyte ID No: 700550313H1
  unsure 80, 93, 97: a, t, c, g, or other
ggatgaatgaacgtgagttatctgcgctgaaatctgtcattaagtgcattgaagagcacaaacttgagcagcagtaaccngtgggatcccacnttcnagaaaagggttttgcagctagagaaagccaaagggcagacaagaggatggctgttgaagcagcaaagccgcagtcccaagagggcctcgtgccatggatcggctttgcaacccgtgctacaggctttgctgacaagagcttctatcagcaaccccagagaggcatccatcaaccttgcgagaggc

SEQ ID NO: 1057 - DNA, 276 bp, Zea mays
  misc_feature: Incyte ID No: 700550314H1
  unsure 76, 199, 275: a, t, c, g, or other
gacaaggtgtaccccgaaggaacttcacctgatgatcccgtgggatcgaaagggcgatcatctacgacgtccgcgnccgaaccaaaccttgtcgagagcaacctccggaaagccggggaccttccagatggtgagaattggtcttcgtgtcttactcgacccatgccaagatcagctacctaaaatctacaggaattgngggagaattcatgagagagttctgcttcatcattcagaaacattcaaagctgtggttgctcataatgccagccagng

SEQ ID NO: 1058 - DNA, 280 bp, Zea mays
  misc_feature: Incyte ID No: 700550315H1
cgcatctcctccaacatcgaacggcgacaaggtggacaacaagagcgaactcaaggcgatggggaaggcctcggttgcgccactcgatccggccaaggcggctgtggtatcatccccgggccacctgacttgcaaggggaggaaggggaaaggcgcggctgaccggagcgcagagatgagccggagcgatgctccggtgaaggtgaagacggccggtccgtcgccgccgcgaggctccaagtcgggcaacgttgggaaaccgaaacttacagcgcccagg

SEQ ID NO: 1059 - DNA, 183 bp, Zea mays
  misc_feature: Incyte ID No: 700550316H1
gtagtgcgtggcattttgtgtgcttgtgttttcatgcctgatgcagatccttttgtatttgcgtaaagaagctatgtagttgatgaaagatgtttatttaatatatatattaatggatggattcgtggaccgagtatcagcaagtttgttgttctggaatgtaagcttgctcgctatgctatt

SEQ ID NO: 1060 - DNA, 277 bp, Zea mays
  misc_feature: Incyte ID No: 700550318H1
  unsure 183-184: a, t, c, g, or other
gagacgccctgaagtctgggttctatgacctccaattggctagagatgagtacaggctctcttgtggtgcagcaggcatgaaccgtgatctgttgtggcgatttatggatgtccagaccaggcttatcacccccatttgcccacactatgccgagcacgtgtggcagaagatcatgaagaaannaggctttgcaataaaagctggctggccagtcgcggacaccccggatcctacactgagaattgcaaataaatacctgcagattccatagttttg

SEQ ID NO: 1061 - DNA, 274 bp, Zea mays
  misc_feature: Incyte ID No: 700550321H1
tccaaacatagttaaatttaaggaggttgtgctaactcccacacatttgggccatagttatggaatatgctgctggtggtgagctatttgaaaggatctgtaatgctggaagatttagtgaggatgaggcgagatttttcttccaacaactgatttcaggagttagttattgccactcaatgcaaatatgccatagagatttgaaactagaaaacactctcctggatgatagtatagcacctcggctaaagatatgtgattggttactccaagt

SEQ ID NO: 1062 - DNA, 270 bp, Zea mays
  misc_feature: Incyte ID No: 700550322H1
  unsure 152, 258: a, t, c, g, or other
ccttcagactatgtaacatggttactatgatcccatatggccatatgggaagcgtaattagtagcattgtgatctttaacattgttctgcagactgcatggatccagtaacaatagtgttttcaatgcagtaggagtattgattaaactatntataaccctgctggttgtatatttctttgtgatgtggtaagtgagaccatagactgtgttttttagccttcttattgagtgtgcttgagtatgtcgaagatgaacntgtagttctgaa

SEQ ID NO: 1063 - DNA, 274 bp, Zea mays
  misc_feature: Incyte ID No: 700550324H1
  unsure 87-88, 223, 225: a, t, c, g, or other
tgacgtacatttacctgattgggtatgcttaaactgtgtgtctagagaaaatgatatcatgttaaaagaaaatgataccaatggttnncgggtttgtagtgaactagataatggttcctgtgggaaaacttcagccctttgtatgattttgaatcgacccggacttgatgttacacaaaccacatctgtacctgaccggttatcttcgtcttttgagaaaganantgaaaatgtggcaacaagcagtgtcaaagagacaaacctttggctcagc

SEQ ID NO: 1064 - DNA, 256 bp, Zea mays
  misc_feature: Incyte ID No: 700550326H1
  unsure 8, 19, 38, 54, 56, 61-62, 64, 68, 89, 106, 112, 124, 210, 250: a, t, c, g, or other
agggcgtntggaggacaancatcaaggattgcattcanggaaaggtatggcaantnatggnngntggnaatacaacaatcaacaatagnctttacggcaaaaatantggcantacacggctggntgactggatgttggtagttcgtgagcagatgatatcctcagaaggctgagttcgtcgtagctgtggtttctacgtgctggattgtncttgtctgtctgtcccatgctctaatcgtgagctgttcancgtctg

SEQ ID NO: 1065 - DNA, 276 bp, Zea mays
  misc_feature: Incyte ID No: 700550327H1
  unsure 196-199, 214, 268: a, t, c, g, or other
atctcctcgcattttccttgcaaccgattgcctatccccctcccaaccaaagaccgatggcgcccaaggccgagaagaagcccgcggcgaagaagccggcggaggaggagcccgcggccgagaagacgaccgccgggaagaagcccaaggcggagaagcgggtccccgcgggcaagtccgccggcaaggagggcgnnnnccgcaagcgtggcangaagaagggcaagaagagcgtggagacgtacaagatctacatcttcaagtgctnaagcaggt

SEQ ID NO: 1066 - DNA, 273 bp, Zea mays
  misc_feature: Incyte ID No: 700550328H1
  unsure 41, 46-48: a, t, c, g, or other
cagcaactttggctgatattctcagacaattaggggccccntttcnnnatggacctcatggacagaaaagcagaagtgaaacgcatcatagaagatgtaataaatagcatgtctgatgatgaaggtgaagaaggctcggaagatgaagcagaagacaacggcaaggtggagaagtcaaagagtgatcccgatggaggagaagagaagtgattctgtggaccggatgtgccatggtggtttggattgaacctggaaggactatttccggccatt

SEQ ID NO: 1067 - DNA, 276 bp, Zea mays
  misc_feature: Incyte ID No: 700550329H1
  unsure 91, 100: a, t, c, g, or other
agatagctgaacttgtaccctgtaggcaagcagggatttcatggtccaaccggtgaagtttgtggcagaagttaagattggatgctgtagncagacagancaggtgctctaaagccgtctggtttaaatcacctaattcgcgaaaaggcctggtccgagttagattctccgttgaaataaatttgaagctgacgttaaaaaaaaatccgcttttgctccacgttaaattctggctccatagtggtcggactagggtgctgagaaagggtattgaga

SEQ ID NO: 1068 - DNA, 277 bp, Zea mays
  misc_feature: Incyte ID No: 700550330H1
tgctaacaaatcctggcttcaaagggatgctgaatctatgggattgattttggatgctagtgacagtgaagaagaccatgtgcagggacacaagaaacgaaaggctacttctgcacatctccaaaagcttcaacaggagttgagtgatctcttgcaatgcccattgcagcctaagactttttctcgacgctatttggctggggctggtgtctcgccattacttcagaagcaactagaagagttggccaagagaaacgcaagcacaatagcagcaaga

SEQ ID NO: 1069 - DNA, 136 bp, Zea mays
  misc_feature: Incyte ID No: 700550331H1
  unsure 33, 48, 52, 59, 70, 73, 78, 82, 102, 127: a, t, c, g, or other
gtgatacgaccgtcaagctcccagagggatctntaactggtggagccngtgnctcttgnagagcatgccnccntgtanatanttttgcaaaaacgaggtgtntgtacatatgttcgtcgtgtcgtgncgtgtcatg

SEQ ID NO: 1070 - DNA, 279 bp, Zea mays
  misc_feature: Incyte ID No: 700550332H1
  unsure 51, 66: a, t, c, g, or other
gtgatacgaccgccagcgctcccacagcgacctgtaactgtggagcaagtngcgcctggctagaanaggccgccttgtacatacttttgcaaaaaacgaggtgtctgtacatattgttcgtcgtgtcgtgtcgtgtcagtgtgcctgatggcaacgggctaatacgtccgtgccaacgtgtgcatggtatcccacggaccctgtggtagtaaggagcagttgtaaatatgccgtgcttcctctccatgtggggtgctgctgtataaaagatggtgcatg

SEQ ID NO: 1071 - DNA, 279 bp, Zea mays
  misc_feature: Incyte ID No: 700550333H1
  unsure 48, 70, 138, 176: a, t, c, g, or other
cttcacaaacgccggcgcaaaactctcgccccgagccccgacagatcntcaattcccccattccgcccancgatcgaccactcacgccaagtctcggtctcttccgaaggcgtcgcgcgcggttgtttgagaggagangaggaagatgagggagtgcatctccgtccacatcgggnaaggccggcatccaagtcgggcaacgcgtgctgggaatttactgcctcgagcaggcatccagctgatggccaagtgctggagataagacggggacatcagatg

SEQ ID NO: 1072 - DNA, 274 bp, Zea mays
  misc_feature: Incyte ID No: 700550335H1
  unsure 56-57, 113: a, t, c, g, or other
cccgagccgcagttcagttccgaggactacatgatgctctacacgacgatatacanncatgtgcacgcagaagccgccgcaggactactcacagcagctctacgacaagtatncggagtcgttcgaggagtacatcgcctccatggtactaccttcattaagggagaaacatgacgagtttatgctgagggagctagtgcaaaggtggtcaaaccataaagtcatggttcgctggctgtcacgcttctttattaccttgacgatacttcatatc

SEQ ID NO: 1073 - DNA, 271 bp, Zea mays
  misc_feature: Incyte ID No: 700550337H1
  unsure 229: a, t, c, g, or other
gcacttcgcatcatttctggtgttcataatccttcacgtggttgctcttgtgtattatatcaaagggcttttgactcctaggctgttcaaagttgctatgactcttgtcatatctgttggcttagctgtttgttttgcagtagtagccatacttgttgcattggtggcatctagtccaacgaaaggctggagtggccgcagtttgagtctacttgacccaacttatgcnagcaagtacatccccatcattgctagtgtagtgaacaccaac

SEQ ID NO: 1074 - DNA, 218 bp, Zea mays
  misc_feature: Incyte ID No: 700550338H1
taccattcgcgccatggaagtaggtcgtgtttattgcctgtggtgggacccatgtccgtgccaacgccaattgccagccgcgtagccgttgatgaagaaaaagccattcgcttggccgctctttaccttgtagcgttaaagggtaaggtggtgtttgggaacaaagtttttctgcggttttggaagaatactgcagtattctcaaatactgcagtatt

SEQ ID NO: 1075 - DNA, 275 bp, Zea mays
  misc_feature: Incyte ID No: 700550340H1
aggcggaggcggaagctggatcgatcttggctcctccagggtcccgcccacgcacccgcacttcctccaaaccaccgagctcgccagagagatagctcggctgctcgactgcaccacatggacgggagccggccctgggctcatggatgctgccatccaaggcgcctttgaggcagacaagcctgtcggtggcttgaggattgcaaaggaagcgggtgaatggacaagctcaggcttccatccttacttgccaccggagactacctcacatgcag

SEQ ID NO: 1076 - DNA, 276 bp, Zea mays
  misc_feature: Incyte ID No: 700550341H1
  unsure 5: a, t, c, g, or other
ctcantgggtacactaggctacagttcatctgctttgccactatctgacatgccaattgctccctatcctattagcttctccgttgccacgttggctccatcttcgtcttccccagaatatatttcaactaaagatccatctatcaatcatgtagtatcaccagtggcaggacccgcgcctgttggagcaatcttgccaaaaggggtattccatcatgataccattatgcaaactcagactcctacaagtgccggcagttcagccctggtggtggg

SEQ ID NO: 1077 - DNA, 269 bp, Zea mays
  misc_feature: Incyte ID No: 700550343H1
gatggattctaacagatgtaacagacctacagtagggatgctaggccaaggagttaaaatatatccacatgttagaatatttcgtaactgtagtaacttcaacattatatagattaatcatgaacttttagttgtattaaacaaataagctctgtatgttcattgttgtagaactaagtttattgtgaatttgtgaacacatatatttgttcatgaaactgcatggattggactaacaaagtttgtgtatgtgatagtttttagtctgg

SEQ ID NO: 1078 - DNA, 277 bp, Zea mays
  misc_feature: Incyte ID No: 700550347H1
gagacggccgtcatccctcgcgcaggcgggctaatcgttcgacacggagacgaccgccgccggcagccgagctgatcagtctgtatctatttcccacgggagcaaaagcaaggttggcgaatgtcaaggaggatgacaggtagtctgtagcgccctggcccctgggtcgccgattctgttggggtatacagggaactccgatgataaccacagcttgtttgagccccctaacttacttgcgtctcgtttttttccttttcccgattttatgagctgg

SEQ ID NO: 1079 - DNA, 279 bp, Zea mays
  misc_feature: Incyte ID No: 700550348H1
ggaagaagcagagggtactcccccgccgctgcccgccaccggcgagcccgcaaccacggcaagggcgcagcaattatctgcagcacaattcctctcctggaagcagcgcaagtaggatgcagaggtagccgcaaggaaagctgaagcagctgagaagcgagctgatgatatcgcttcgggagcggtgcagatgaacggccgcgagctgttccaacatgagccctgggtgttcgacaacaacatttactgagatcgtgtggggctatgttcgtgcattag

SEQ ID NO: 1080 - DNA, 225 bp, Zea mays
  misc_feature: Incyte ID No: 700550352H1
  unsure 7, 157, 165: a, t, c, g, or other
tgcgganaagggaatcaaggacgagccgccgagaggactagggtttagccatggcggccgaggaccagactccttgtaccaagctccgccccggcaaggcaaagacgcggaagaagacgaagagggacaagtggggccagcctatctccgccgccgncgccgatnaggagccgtcggtggagccggagcaagagcacccggcgggggtagttgaggcggcagtac

SEQ ID NO: 1081 - DNA, 270 bp, Zea mays
  misc_feature: Incyte ID No: 700550353H1
agatcactttgtgcaacctgttgcggagaaccctctgaaatcagtggacatgttgtcgtttgaggagtctctttcagaaaggtcactttatgcaaagtcagggcagttggcacaagagggatcagctaatctgggtactttacccaacagtattgagaacactggaaattttaaccttagaccaggatctggatcaatgtttgagcagaagcatttcctggaattgacgatgttcaaagtgacttttcagagaccacggtggtagaacat

SEQ ID NO: 1082 - DNA, 271 bp, Zea mays
  misc_feature: Incyte ID No: 700550355H1
  unsure 17, 25, 53, 68, 91-92, 164: a, t, c, g, or other
tttgaagagatacctgngttcttcntgtgcaagcttaccaatttttgcatgcnattgatcatttgttnttcttatgcagttatatctttcnnttcctaaaatagcctgtagttttgctgccaacttagtctctttgtctccattgtagatcagggccaaggtanccacatttggatttggaggaccaactgaggttacttctggtggcaacgccttgaagttttatgcatctgttcgcttgaacatcaggcgtattggttggtaaagaaag

SEQ ID NO: 1083 - DNA, 267 bp, Zea mays
  misc_feature: Incyte ID No: 700550360H1
  unsure 39-40, 42: a, t, c, g, or other
gactagttctagatccgcctcgtctaaccaccaccacgnntncgagttaaagtcgccagtacagaagagtgaaggggagagggttgctgggtccgattcggtgggctcatcgccgtcgggtccacgaattggtgcctaggagtctcgcgtgcttcggggacataatcgatggtctcgctgcggtgggttggtggctggagacctcagaatcgtcgtcatagtgcgagctcctccgcgtgtgcaccgtgcgccgtggcagggtgtctg

SEQ ID NO: 1084 - DNA, 179 bp, Zea mays
  misc_feature: Incyte ID No: 700550362H1
  unsure 20, 22: a, t, c, g, or other
atttttcataaccaaataananccacataacacaaacaagaaaagtacaggttatagcaagtgtcacagatagatatcaaatattggagtgaagtcacactcccacgaaacagtacttttcttgtttgtgttatgtggtttttatttggttatgaaaaataaaaaggcatgtcgcagat

SEQ ID NO: 1085 - DNA, 272 bp, Zea mays
  misc_feature: Incyte ID No: 700550363H1
  unsure 43, 239-240: a, t, c, g, or other
atatgggtttagaatttcctgtaagacaaactgatgtctgtgngcattcttcaccgccgggagatggaattgaaaaggctggctgtggatagttcttttggaagaaaagcatatatggcttttatcccagaaggattcggaaatatgctggactgggatcaagttatgaagtttcagaggaagagacgatcattgttcagcactcctccacaactgctgttgcattaatccacaaatanncgaccaagcccttcaataccaaattgctgtca

SEQ ID NO: 1086 - DNA, 210 bp, Zea mays
  misc_feature: Incyte ID No: 700550364H1
gaaccatacgaatcaataagaaatgagctgtgttcactttccagtttcctccgtgcaagtggcgcaacggccaggttctagatgtaaaattcgtcctctaatacagaggttggtattgtatgttagtgtaggatgcgctgctcgcattgcactgttattgtgctctgtttggtggaaataaagattggtcgaaatctgagggccagattg

SEQ ID NO: 1087 - DNA, 213 bp, Zea mays
  misc_feature: Incyte ID No: 700550365H1
  unsure 60, 71: a, t, c, g, or other
gcaagtggaatccgtggtgatcttaacaaagcctcacaacacttcggaaggatgcagaantgatggagatngaagcaaaaaaggatcaaatgcaagagttacaagagaagtctgttgttgagttgactagacttggttttgggggtagtgaactgctcaaagccgctgctgtttttgtgaaggtccctaatcagatgacgatgctttcgcgct

SEQ ID NO: 1088 - DNA, 104 bp, Zea mays
  misc_feature: Incyte ID No: 700550367H1
  unsure 2, 8, 46, 52, 79: a, t, c, g, or other
anagggcnctcacttcggacaggtcactgctctaactccaacctanccagcntcggccaggccaccttccccgtcgctncttcacgctcttcgtgcccgccgcc

SEQ ID NO: 1089 - DNA, 266 bp, Zea mays
  misc_feature: Incyte ID No: 700550369H1
taatgccagtgcacaattctgtggtgttgctgagatgattggaccagtggactttgagaaaagtgtggattactggcagcaagataagtggactggtcaattccctgtgaagtggcacatagtgaaggatgttcccaataatctttccgacatataattcttgaaaacaacgacaataaacctgtaacaaacagcagagatacacaggaggtgaaactagagcaaggatggagatgctgaagatcttaagacctgatgatgatgca

SEQ ID NO: 1090 - DNA, 271 bp, Zea mays
  misc_feature: Incyte ID No: 700550371H1
  unsure 73: a, t, c, g, or other
accatccgacaaggttgaagtactagtggtgctgcaaaacgagcactgtttcagctggcggtctgcgcccgangtggaacccttactgtacgacgagtctcctccaggctcaagggaactcgccgaccatctcagcagctgcgctccaccgtatcctactagctccgcggcgaggagcggtctcgccgccacagcggagaactcctgcgggaggaaacccctcccggactcactgctacggacctcgaacctcgggggtcctcgctccgca

SEQ ID NO: 1091 - DNA, 268 bp, Zea mays
  misc_feature: Incyte ID No: 700550376H1
aatatgaagagtgtccatattccagtggattattgtttcattcgcctcctaaaagcacttgtgacgtgggctggaaccacagatgcctcatcagttaccatgacagcatcctgcttatgtgtaatgctgttggacatgacgtcagaagagtttctattgagctgctctcattttgacggcaatatcctgggagtttgtctgagatcatcatcagaagtttgcagcaggatatccctggacgatgacagtgagcaatcaagcagaagca

SEQ ID NO: 1092 - DNA, 273 bp, Zea mays
  misc_feature: Incyte ID No: 700550377H1
  unsure 70, 84, 93, 126, 132: a, t, c, g, or other
ctacccccatccacccacccaccccgcccgccgacgcttggatcccttccttgtttgccgtgtccccgcncaaaccccgtagcngccgccatngcaatcgctgccggcgctggaggccgggccgtnggggcngaaatgaaggaggtggtgctccacgtgtatgacgtgaccaacagtgactccgagaagacgaacaaacaccatccttccagatcaaccgcatcttcaaggaccgcatcggcctcggcggcatcttccaagcgccgtgcaggt

SEQ ID NO: 1093 - DNA, 272 bp, Zea mays
  misc_feature: Incyte ID No: 700550378H1
  unsure 7, 46, 109, 204, 265: a, t, c, g, or other
agcatcntggatgggattcgcgcgctgatggcggcccactcgccgncggttccacgggctggtcgtcccctccgaggatgcccaccagagcgagtacgtgtcggagcangataaacggcgggagttcatctccgggttcacagggagcgctggcttggctcttatcaccatgaaagaggcatgttgtaagacggatggccgctnacttcttgcaggcaacacagcaactgagcgatcgttggaaattatgcgcatgggaaagatncaccatt

SEQ ID NO: 1094 - DNA, 120 bp, Zea mays
  misc_feature: Incyte ID No: 700550380H1
aaacgcttaagaagggactgctggagccatagactcatcgtgagctgacaattgaaatgttaaattgctgagatcatcatgggcggtaaatcatgtatgctatatcaaatatgcttggtg

SEQ ID NO: 1095 - DNA, 268 bp, Zea mays
  misc_feature: Incyte ID No: 700550382H1
  unsure 24, 74: a, t, c, g, or other
gggaggttgcctcaggtgcggagngttcgccggcggcgaccatcggtgtctgagatgaaggagagaggcggctnctagggcggcagtggacgagcgctacgcgcagtggaagtcgctcatccccgttctctacgactggtttgccaaccacaacctcgtttggccatccctctcctgccggtgggggccacagtttgagaaagctacctacaagaatcgtcaacgcctttacctatctgaacagaccgatgggattgctaatactctg

SEQ ID NO: 1096 - DNA, 270 bp, Zea mays
  misc_feature: Incyte ID No: 700550383H1
  unsure 17, 71, 248: a, t, c, g, or other
gactcctgctagctggnggggcggctcgcctctcgcgccacaatggaggtcgaggacgacgacaacacggnggcgccgagcgcgtggccgagttcatccaggcgtcgccacctcctccagttccttctccacgcctccatgaggctcgacctccggcccatcgtcaagtacgccgcgcttaccttcttcgctggacgcttcctcccggcactcccgaggaagatggggttctgcggcgcgcgaaggcncgaatagtcaggtcctggctcc

SEQ ID NO: 1097 - DNA, 268 bp, Zea mays
  misc_feature: Incyte ID No: 700550384H1
  unsure 256: a, t, c, g, or other
actgaaacctcctcacagttttgatgcttgtttcatggacatacagatgcctgaaatggatggatttgaagccacaaaaaggattagagtgatggaaagagatctaaatgagcaaatagaacgtggagaagccccaccggaatgcgcagggctccggcagtggcgaactccaatattagccatgacagcagatgttatccaggcgacgcacgaacagtgcttaaaatctgaaatggacggttatgtatccaagccntcgagggcgagc

SEQ ID NO: 1098 - DNA, 269 bp, Zea mays
  misc_feature: Incyte ID No: 700550385H1
  unsure 4, 7-8, 119, 138, 142, 149, 158-159, 168, 212, 234, 266: a, t, c, g, or other
ggancanncagcaggacaaggcaacaggctgttggaatatggaccaacaaggcatgcatgaccatgaaggggtccacgttgttggatttgaagtcccgccttcaccggattccagctangacaaccctgttcctgggnatgnagacganggccgggannccccactgntgccacctcatctgcagcacacgctgctgagcttcccaccaagncaagacgagtcgagcccgctgncccagccccagaccgtggttctgaaccacctntac

SEQ ID NO: 1099 - DNA, 265 bp, Zea mays
  misc_feature: Incyte ID No: 700550387H1
  unsure 8, 29, 92, 254-258: a, t, c, g, or other
tttgaagngatacctggttcttcctgtgnaagcttaccgtttttgcatgcaattgatcatttgttttcttatgcagttatatcctttctttnccttaaaatagcctgtagttttgctgccaacttagtctctttgtctccattgtagatcagggccaaggtagccacatttggatttggaggaccaactgaggttacttctggtggcaagccttgaagttttatgcatctgttcgctgaacatcagcgtatggnnnnnaagaaag

SEQ ID NO: 1100 - DNA, 215 bp, Zea mays
  misc_feature: Incyte ID No: 700550388H1
caagtacaacaacaattggcccagcgtagatggcccgtggtggtggcgtcatcgtgtctccccgatcccctctccgttcctccctcgtcgcctcatcaattcaagatccaatctttgctgctgccactcggcgatccgatcgttctcgagcaaggtcggtggccatggctcgctgccgccatcacctcctcctcctttccgtcttacttgccttg

SEQ ID NO: 1101 - DNA, 269 bp, Zea mays
  misc_feature: Incyte ID No: 700550389H1
  unsure 19-20, 247: a, t, c, g, or other
ggagaagcctccccaagcnntcgaatcgctatgcagcccgtcaaggtgtacgccgaccggcggtcgcaaccctcccgagctgtcatcatcttctgcagggtgaaccagatcgatttcgaggaggtcacggtggatctgttcaagtctcagcaccttcacacccgaattcaaaaaaataaacccaatgggacaggtacctgcaattgttgatggaagatcaaactatttgaaagtcatgcgatttgangtatcttgcacggtttccctgg

SEQ ID NO: 1102 - DNA, 165 bp, Zea mays
  misc_feature: Incyte ID No: 700550390H1
ctttttctccttgggacttgttgcaacttttgagtgtggaaatggattggaatagtcgccatgaatttgctggctactttatacatgtcttgttcataaaccttgttttaagatgaagttgtggcaatcctcttagtgctaatataatgttctattgtcagctgt

SEQ ID NO: 1103 - DNA, 268 bp, Zea mays
  misc_feature: Incyte ID No: 700550391H1
  unsure 188-191: a, t, c, g, or other
gacagaagaagaaggggccccttctccttggttgcgttgcgcctccctcctgtctgcgtgcgtgcaatcgacgcagaggcgcgggcgtcgcaccaccacaaccacgacccgatggctttcatgcgctcccgctcaaatgcatcttctggcatgggagttgctcctaacattagggagacattcgttgnnnnctcaaatgaagaagggcattccgatatgttatcttcaaaatcgaagagaagcaaaagcaggtggtgtggagaagaca

SEQ ID NO: 1104 - DNA, 268 bp, Zea mays
  misc_feature: Incyte ID No: 700550392H1
  unsure 36, 166-197: a, t, c, g, or other
gaaaattctatgctgcaatctggtttctcttgggcncctgaacagaacagaggagcccctactacagatttctggaaaaatgttgaaagtcaggcgtcatcggtttccatgccaataaatggagcgcctctttcaagctttccagcaaatgtcagattccaaaatnnnnnnnnnnnnnnnnnnnnnnnnnnnnnnnntttgccaccacaggttgctccaaccgaaacaggttccgatcagtctgggttggccttcaatcccttttcgg

SEQ ID NO: 1105 - DNA, 267 bp, Zea mays
  misc_feature: Incyte ID No: 700550393H1
  unsure 80-81, 89-90, 218: a, t, c, g, or other
ccgcaagaagctcattcagatcgatgtgagctcggatacagtgtgcccttggtgctttgtcggtaaaaagaaccttgagnnagcaatgnncgcaaagcaagggcaagtttgatttcgaggtccgttggcatccattctttctgaaccccgacgcgcctaaggagggcgtcaagaaatctgacttcttcaagatgaagttcggtcctgtccaatatganggtgcgatgtctcgcatggactgagatattcgaggaccggcttgaatac

SEQ ID NO: 1106 - DNA, 269 bp, Zea mays
  misc_feature: Incyte ID No: 700550394H1
  unsure 157, 201, 246: a, t, c, g, or other
aataaagaagcttccaatccctgattacattgttccaagatgtgcacacagcacggaatctaatgtaatcagggattggaagcttccgtgctgtgtgcacatcttggaacaatgtctgcaaggatgtgtcatactgtccaagggtggacccatggcncatgctccccccaaaccagaatcctcttggtgctcagttcttangcatcctgaaagaaagaatcaaagtatccgcctccctaacaccgnctcactgttcgaatcggtctggg

SEQ ID NO: 1107 - DNA, 273 bp, Zea mays
  misc_feature: Incyte ID No: 700550396H1
gaagcattgcgcaagaatggagcttgcgccaagaatcgtgtccgaaaccctgagaacaattagttactagtggctaggaatacccttgccatttctgagcaaacttgagcagtcaataagaaagcaaaagagaggcatcgactctgcattttattctctctacgctgtcttttgcctgtggcagtgaatagcgcattagcatcatagaagtattagcttgatcaatggaagttgttcatgcgctcttcatcgctgcaaggttgtcatcttgtc

SEQ ID NO: 1108 - DNA, 279 bp, Zea mays
  misc_feature: Incyte ID No: 700550401H1
  unsure 67: a, t, c, g, or other
tggagcgggccgccggccgccggcggcgttcgagggcaacctgaagtgggtgtcgagggatcacgtngtccgcagcccgatcgtgataccgccggcgaaggccgccgcgtaggcgtagtcccagcccaattgatgagtgccccggcattggtcggcaaacggcatgtatccctccctccaacaaggtcagtagcggtagccggtaggtggtaatcttgagtcagtgtgaccggtgtacgtatggcgaagaataggcagcgatgtgtatagcagcagagg

SEQ ID NO: 1109 - DNA, 301 bp, Zea mays
  misc_feature: Incyte ID No: 700550407H1
  unsure 58, 95, 260, 264, 290: a, t, c, g, or other
gctctaggtgcattcttgagtgcaacagctcaagatatccgcacaatgattattggcncgattgctgctggaattggtatcggggtctcatctgnctcttgtacccctttacatatctgagatctcaccaactgaaattcgtggaacacttggtaccgttaatcaactttttatttgcattggaattcttgcagctttgttagctggattgcctctggcaggaaatcctggcctggtggaggacaatgtttggaattgcngtcnttccatccattctgctgggcttaggnatggccctttc

SEQ ID NO: 1110 - DNA, 307 bp, Zea mays
  misc_feature: Incyte ID No: 700550408H1
  unsure 20, 30, 44, 51, 56, 59, 62, 94, 176, 199, 247, 253, 264, 281, 291, 303: a, t, c, g, or other
gggatactgctgttgtcacncgtgcaccanttagcgatggatgnaggagcnactgnganacncaaggttgatttgggtaacaaggtgtcaatgnatgatgaagagcacaatagttctgataccatgaatgaggactgcaagcccatcgtatcaaaaccaaacaatcaggtacctgnggttagtaccagatttagggtcncaaattaagtgtgagtccgatttctactgataatctatcatctaacanaaagantatatacaagntaatttaaatgctaatnatttcgattnagaattagcggntcac

SEQ ID NO: 1111 - DNA, 300 bp, Zea mays
  misc_feature: Incyte ID No: 700550409H1
gtagttgcactgccatccatggcatggcttggccctcgatccctcgaggacgacacggtggaggcgacgagccgcaggaggtgatctaaactccagtggtgcctaggcttggagcctagatccgccgctgatacaggtatatgatcaaaggttgacctgacagaggataaggagattaatgtggaattcctatactcagccaagtggaaggaatgaaggattaaggggactgatcagatagcagctacctaaaagttccctatgtttctccttgtcttctccattgctcggctccgtctt

SEQ ID NO: 1112 - DNA, 302 bp, Zea mays
  misc_feature: Incyte ID No: 700550412H1
  unsure 45, 71, 133: a, t, c, g, or other
cttagaatatacaggcctgctgaatcgacaacaagtcggcatctnccttgcagccatgagctatgccaatncggttccaggctgcacaaacccaaagcagccttgcccatacaacattgactacttttcaganaatactaccagctctggtttgctaattgaggatacactacacttgaactacagggaggaccatgtacccgtgaatgcttcagttattattggctgtggtcaaaagcaaagtggtgattatctggatggtattgcaccggatggactccttggcttggaatggcagatat

SEQ ID NO: 1113 - DNA, 306 bp, Zea mays
  misc_feature: Incyte ID No: 700550414H1
  unsure 3, 8, 31, 34, 52, 62, 83, 85-86, 102, 108, 116, 121, 148, 153, 190, 194,: a, t, c, g, or other
aanaagancagtcggcgtggtgttcacttcncgnacgtgctgggcctgcgtncagagggttnattttggcacccgatgaagtnanngcctgcattgtaactngtggangcctgtgncctgngcttaacactgttatcagggaactggngtgtngcttgtcacacatgtacaatgtcagcagcatttttgnaatncnagaatgggtacaagggttnctattctagcacctaccttcccctgacaccaaagagcgtcaatgacgtccacaaaaggggtggtacagttcttggacatcacgcggtggcc

SEQ ID NO: 1114 - DNA, 301 bp, Zea mays
  misc_feature: Incyte ID No: 700550415H1
  unsure 3, 290: a, t, c, g, or other
ganagcaagtgcccatgtggacgaagaagttgacatgccttcgttaaaagaccgtctggctgcttttaatatcagcgactcctctccggatcattctgccatggaaactgaagtaacagaattgacagaacagcagaatgaaaacaaagcgacagagggagcaagcaaaagaggcggacgaaagaaggcgtcatcatcctggcgacgataccatctgatgttgatgaggaagtcctagaggtccaagcttcagaagaaaggtagaggaaggaagcctgctgccgtttganagcccaggctc

SEQ ID NO: 1115 - DNA, 297 bp, Zea mays
  misc_feature: Incyte ID No: 700550416H1
  unsure 89, 277, 279-281, 287, 290-291, 293-295: a, t, c, g, or other
ctccaagcccacaggctggaatggttctgaatcagagaccaaatgagaggacggtcagcagttcttcatggctgctcttgagctgtgtntcaacctcgtagtgccgttatcaaatgtatcagaggaggtttatggaaaatatcccatgtcgcttgtgtggctgcctttcaggctgacgtgctcccattctgctcctcatttcctttcacatgttcgtcatgtaaatgccaatactaaagtgtcactgcatgggcagaagtgttaccaaaaaaaaaanannnagaaanaanngnnncc

SEQ ID NO: 1116 - DNA, 279 bp, Zea mays
  misc_feature: Incyte ID No: 700550417H1
  unsure 3, 13, 17, 32, 34, 52, 124, 140, 263: a, t, c, g, or other
ttncttaattatntgantgaggatgggcagtnanttgaacgcacctggtatntgccaatccttcccatggtattggtcaatggaagtgaaggaattggaactggatggagcacatatattccanactacaatccaaggcnacattgttgctaacgtcaggcggttgttgaatgaagagtctactgtaccaatgcatcctggtataggggattcaaggggtctatagagaagacagtcaatacgaaggtagctggttccacgtnaccgtcacggaatcat

SEQ ID NO: 1117 - DNA, 295 bp, Zea mays
  misc_feature: Incyte ID No: 700550419H1
  unsure 22-23, 31, 49, 228, 248: a, t, c, g, or other
gaaggagcatgtgcggacaagnncggtttgntgggcttgatccaaaagnccgcataggctgagcaccgtctagtcgtcgccagtttcgttccgctgcagcagcggcagcgctcccctcctcgacgccgcggcttctcctcatcctcgcccgctccgtccgctgactggaagtggtctacacagaaggttaccatattgttaagttaaagttggatcattggaacaatnccgccccataagattgagangggcatcaagatgtggtccatgatattgccaggattatacgggaagc

SEQ ID NO: 1118 - DNA, 298 bp, Zea mays
  misc_feature: Incyte ID No: 700550420H1
  unsure 47, 124-143: a, t, c, g, or other
actatcttcatcaggtacttcgcgatcctactgaagtattccccgcngccgctgccatggccaccctcaaccctttcgaacttcctcggcgccgacgacaacgacgacccgacgcagctgattnnnnnnnnnnnnnnnnnnnntcagaaagccgaggcgaagaagtccgccgtggcgcctgctgggaaggctgcccagcctgcggcgaaccaccaagttcccgaccaagcccgctcctccctacgcagacggttcgggatgcacgcggcggtggctcatcagtctggaggtttggccg

SEQ ID NO: 1119 - DNA, 278 bp, Zea mays
  misc_feature: Incyte ID No: 700550421H1
  unsure 89, 255: a, t, c, g, or other
caaatactcatgcaaaataaacggtgacttttgttatatgactgcatgatggtgcaacagtaatcgttggacttgtatatagtattganatgttagctgcatccatatgttgcacaggttaaacacatgcactggtatcaggttggagatacagtttcaccctgtgagtgtcgatgtagtagggctcgattgccacctagcaggtatacaattttactatgctgctgtgcggccagttgcatcaagctggatatnctttctgattaatcggaccatgc

SEQ ID NO: 1120 - DNA, 293 bp, Zea mays
  misc_feature: Incyte ID No: 700550422H1
  unsure 5, 27, 29, 33, 45-46, 48, 54, 60, 75, 93, 165, 175, 222, 240, 256, 264, 292: a, t, c, g, or other
ctccnactactcacgctactacccctncncctnggccacgtccannancctcanccaatncgtgcctttggcttncgctggcgagcggcggangctggtgaaggcaggaattggtgagcgctccaattcggggattggcggaggctggtgcgcaccacggcaggnattggcggtngactggtgcgcgccagttcggggaatcggctgcagctcacagagganacacgacgtgtgtttccntgccgtcggttgtaanggctgcancaaatctgggcctgttttccattgtctnc

SEQ ID NO: 1121 - DNA, 302 bp, Zea mays
  misc_feature: Incyte ID No: 700550423H1
  unsure 27, 45, 187, 296, 301: a, t, c, g, or other
aagcaatgcagtacttggagagaaganagtgtgagtacgaccagnaagatatccattgatttctacaaggaaggagatcccttgaaaccaggctgtgacaggcgtcttagtgttcgtttccactccagatccaattggcaacaagtactatcttgggccctgctcctttgcaggatatggcaaggcnaattgcttacagccaatggccctactggctataatagggattacctgttctcaatggagaaggcattagccagcattagccacgaagatgattcgatctagagcttgcnaacgng

SEQ ID NO: 1122 - DNA, 297 bp, Zea mays
  misc_feature: Incyte ID No: 700550424H1
tggaaggtcttctgtgacaattacctagatggtggatatcatgttccatatgcacatggggctcttgcatcgggtactgcagcttcaatcctatgaaacacttacatatgaaagagttagtgttcaaagatgtgaaagtgcaccagcagaaccagatgacttcgatcgcttagggacaaaagctctctatgcctttgtttatccaaactttatgatcaacagatatggtccatggatggacactaatctagctgtcccattagattcaaccagtgcaaggtgtattgattattttct

SEQ ID NO: 1123 - DNA, 295 bp, Zea mays
  misc_feature: Incyte ID No: 700550425H1
  unsure 201, 283: a, t, c, g, or other
gagcggccaacccaacccaacccaacccaccactgcctccctccccgttccccagtccccaccccgaccggctgctcctcctcctttccccgcgccatcctcgaggcatcaccggcgccgcaacttcgttgaggaggaagcccgcacccgcccccgatccgatggccaacagcaacctcccgcggcggatcatcaaggagntgcagcgactgctcagcgagccagcgccggggatcagcgcgtcgccctcggaggagaacatgcgctattcaacgttatgtcntgggccggcgca

SEQ ID NO: 1124 - DNA, 297 bp, Zea mays
  misc_feature: Incyte ID No: 700550426H1
gggacagcatatcaaaagtaatatccgtgaccataacggcgcggtgaagggtgctgctccagctggtactggcccaagcaatgtgatcaacaacaacacagccagcatgccccccggcagaaacaacagcttcaagtcggtgagcagcagtccagctgctgctaccggtggcattgcggtgaactcgaaggtcgacgactccttccatcaactggaggacctcgacctcgacggcttgatcacaaacgaactgatggagagcgggttgttcggcgccggaaagggtggtgagcatgt

SEQ ID NO: 1125 - DNA, 294 bp, Zea mays
  misc_feature: Incyte ID No: 700550427H1
  unsure 8, 75: a, t, c, g, or other
tgattacnaaatcaatgtatgacaaacagcttgatagtgggaaaggaactcttcttcacttatgcgatgacgtgntacagcaagaagttaaagaggtcataatttgttactacattttaatggagcagggaaaagccactatacaagatcttgatttacggtgtgaagagctaatcaaagaagagtttggcgcagattgcaattttgatgttcatgatgctataaagaagttagagaagctagcattgttcatcgggatcgatggaaggatctatgcgtccgttgaagcgtgcg

SEQ ID NO: 1126 - DNA, 297 bp, Zea mays
  misc_feature: Incyte ID No: 700550430H1
  unsure 50, 277: a, t, c, g, or other
gatcagtgaaattctttgacatctagccgagaatttttgtttggttatcntaattcactctcattcatgtgagatattgtgctctgcttatttattgatagctgacactggtcacccaggagcacgagattagcgcgttgatgtacttagtactgtgaaatcaaactggaggaggctgcaattctgcattacacctacaaaaaattctcaaacctaacctcaagaagggatagatgtggctgcaaaccaactaaagaagatgtgaagcaatgttttntctggaatttgaccgtttgg

SEQ ID NO: 1127 - DNA, 302 bp, Zea mays
  misc_feature: Incyte ID No: 700550431H1
  unsure 11: a, t, c, g, or other
tgatcagtganattctttgacatctagccgagaatttttgtttggttatcgataattcactctcattccatgtgagatattgtgctctgcttatttattgatagctgacactggtcacccaggagcacgagattagcgcgttgatgtacttagtactgtgaaatcaaactggaggaggctgcaattctgcattacacctacaaaaaattctcaaacctaacctcaagaagggatagatgtggctgcaaaccaactaaagaagatgtgaagcaatgttttatcttggatttgaccgtttggta

SEQ ID NO: 1128 - DNA, 297 bp, Zea mays; identical to SEQ ID NO: 1124
  misc_feature: Incyte ID No: 700550433H1

SEQ ID NO: 1129 - DNA, 282 bp, Zea mays
  misc_feature: Incyte ID No: 700550434H1
  unsure 37, 227, 265-266, 268, 275: a, t, c, g, or other
gaagatggcactgtgcgagtgtggaaccttgcaaccnaaaaatgtgttgctgttctaaagagcatttttcagcagtccacttcattggcattgtctgatgatggacaaacattgctcagcgctgggagggataagattgttaccgcatgggatattcgtaagtacagctcaaagaagacaataccgacatatgaaatgctagaagctgtttcctcattggatcaggnagtgagctctggcttgtttgggcatagaactggcaaannanaggagantctgctg

SEQ ID NO: 1130 - DNA, 293 bp, Zea mays
  misc_feature: Incyte ID No: 700550436H1
  unsure 10, 258, 277: a, t, c, g, or other
ggctctgttnagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatccagaggccatcatcaagcagattccccgtctccttggtcctggtctcaacaaggcaggcaattcccgacnctggttactcaccaggaancctcgagtccaggtga

SEQ ID NO: 1131 - DNA, 228 bp, Zea mays
  misc_feature: Incyte ID No: 700550437H1
  unsure 9, 190, 196-197, 206, 215: a, t, c, g, or other
agagagtcntcagcttgtgtttggtgataatagtcaccaatatttgtgacactggtggctagaccttgccatcgtgtcattgttgtggtgactgtatactttcattcaatctgctagcgtttctgttagacaccctcgggggtatgaaacgctagcgttttaggaaattcatctactcttggtttgtgtntaaaannaaaaaaaangggcggccnccggctagtaagc

SEQ ID NO: 1132 - DNA, 292 bp, Zea mays
  misc_feature: Incyte ID No: 700550440H1
  unsure 182: a, t, c, g, or other
aggttgagttgaccaaggattttgagatgggtgtctccaacaagacccctgagtttcttaagatgaacccccttgggaaggttcctgttctggagactcctgatggccctgtttttgagagtaatgctatcgcacgctatgttgctcgcttgaaggatgacaaccctctttttgggtcttcncgtattgaacaagcccacgttgagcaatggatggattttgccgcaacagaagttgatcctggtgttgcatggtacttgtatccaaggctgggtactcccttatgttagca

SEQ ID NO: 1133 - DNA, 152 bp, Zea mays
  misc_feature: Incyte ID No: 700550441H1
gcgatgctatgcatgggtgtcgctgatcctgatgtcccattagtttcttgtttggtggtgctgcacacgattgccggaacgatgtaattttagaatttgatttttttgggccccttaaaatataaaatacaaagatagaaggtggtgtccgc

SEQ ID NO: 1134 - DNA, 302 bp, Zea mays
  misc_feature: Incyte ID No: 700550442H1
  unsure 3, 10, 30, 33, 39-41, 48, 50, 66, 69, 75, 99, 101, 107, 147, 158, 162, 169,: a, t, c, g, or other
ganaatcctngtgcccgcgatcctgcaagncantgccgnnnatgcaantngcaccactgacaaggnccncatcgngggatgcttccctccatccatgancnccaccntctcggaggcctcttcctttagatgctgacgatactattnagcccagagcnacanaagccanaggnccctgtcttggaggaacatactngttggccaactcaagcaaggaggaacaagatnacanggatgcnaagtttnaatgaagtncantccgctgatnaganngtcnaagattggagaagnantcntgantc

SEQ ID NO: 1135 - DNA, 292 bp, Zea mays
  misc_feature: Incyte ID No: 700550444H1
  unsure 48, 58, 65, 72, 80, 104, 116, 120, 130, 171, 178-179, 240: a, t, c, g, or other
atccgaattcccaggcaggcaggtcggcgaggagggcaggaagaacgnagaccgagcngtgcggnggctcgngacgggancgggacaggacaccaaaatctcanatccttcctgcncgcncgcccgtgcncgtcgacgcgtcgttcttgccggccgcgcctcacctccgcnctctccnnctccagggggatcggatacgccacaggctgcgcgatggtgctgtgggtcttcggctacggntcctcatctggaaccccggcttcgattcgacgacaaatcctcggcttcatca

SEQ ID NO: 1136 - DNA, 297 bp, Zea mays
  misc_feature: Incyte ID No: 700550445H1
aaaaagaaaggctcccaaatcctttgtaaataaaggagagcctctggaaataaataagaatgagaaaagatgagattttacttgtcctcgaggaaagacttgtatatttgtattgtttttcccccctcttgcaagcagcaggataaagaagttttaaatattttgtcgagaagcaaagcagttactagaaggataaaggttttaggatcatagatgatgggaaggactggctgtagattctccttttttccttgggtttcatcagtcagtgtataagtacaatgtccatgctgatgt

SEQ ID NO: 1137 - DNA, 295 bp, Zea mays
  misc_feature: Incyte ID No: 700550446H1
cggagagtacagaatggagctaccagagtacaacacgattgaaccttatgcgaaaatgaacgagaatgtccgtccttgcccccaacgtacaaacgacccgcacgctgctgactacgagattgtctactatgtatctttctgcagctgctgcctttacacagtggcattagagtgttgttgctatgttctgtaaataaaagacactatatatataggtgcttggtagatggtagttcttaccagtaatgtagctgcgatgtatcaggttcacggttttcatcgatcagttctgaag

SEQ ID NO: 1138 - DNA, 292 bp, Zea mays
  misc_feature: Incyte ID No: 700550449H1
ggtctttacagacgatttcgtgtcattctattatagaatgtaattgagaatgattgcacatggaacgtgtgttcgtacacacgcttgtaggaatcagtttattggcgcacatatgacgagaattttttttttctccttgttcaggtgaatggcacaaagaagaacagaatccactattcgggaccactgatgcctcacggagcgaatatggatgagatcttagagagcacgagcgacagatccaacaggcggtacgaagagcccgccttgacaagggaaggggaagcacaac

SEQ ID NO: 1139 - DNA, 291 bp, Zea mays
  misc_feature: Incyte ID No: 700550451H1
aaatgattctccttcatggccagatagcaatttgagggtaaattttcagacgggagatgaaagagaagtaattggtggggactggatagataaggttgtagtgaacaacaataattcagtcggtgactgggagggtgacaatgcagctttacctgacttcttttaccagagatatcattcaggtatgagggagaagcagtaccagaggaataacacaagacaaaaggatgaccatgagtatgaagagcaaaggtctcgattttactctaccaatactgatgattctgatgc

SEQ ID NO: 1140 - DNA, 289 bp, Zea mays
  misc_feature: Incyte ID No: 700550452H1
  unsure 183, 196, 203, 206, 220, 232, 237, 254, 267: a, t, c, g, or other
gcgagaggggatcaccctggcgtaacccccctacaatgcttaatagaatctctcggatatccattaagaagcacttgagtcgaagaagaatcaagcaggtctgcctatgtagagttcttacacaaagaatcagctgaacgagcattgtcgttgaatggcacatcatttatgacccgtattctnaaggttgtccggncgaagtnctnatgaagcagctcantttaatggttgncctgntagtggacggtcatcantatatgggaggcnggtagcatggcatacccaagag

SEQ ID NO: 1141 - DNA, 291 bp, Zea mays
  misc_feature: Incyte ID No: 700550454H1
  unsure 230, 239: a, t, c, g, or other
tgagaatttcaccagttcaagcaaacaagaaactcccaaacttaagatcgacatggaagccaaattacgagcatggttggaatcaaaggggaaaacaaagagcatccaaagaatggatggtcttttctccccaattgccagcaagactccattgtctgtgagccatatgaagcaaccaacatcttcaagaattccttgtagagttaaggcatggatcaggatggtggtanaatcaagangatactttttgatccagtagtccatgttcccactgaaaatataccacgagag

SEQ ID NO: 1142 - DNA, 289 bp, Zea mays
  misc_feature: Incyte ID No: 700550455H1
  unsure 7, 19, 59, 88, 204, 219, 226, 235, 258, 261, 264-265, 268-270, 274, 276,: a, t, c, g, or other
aatctgntgtggatgatcngcaatggctcacgtactgggtgtgtactcatttatcactnctattcgagctcaacctttgctccggtantcgaatggcttcctttctggtcttatgcaaagctgtttctcaattgctgctgcacagaggtacattgagcaaaatggatcaaaagcgtttgagaatcttgttaacaaggttaaganttcgaacccaagcgncaattcnggaagaagnaaaagttaaaaggaaggccaggntcnacnngannnggancngaggaantgaacc

SEQ ID NO: 1143 - DNA, 293 bp, Zea mays
  misc_feature: Incyte ID No: 700550456H1
  unsure 53, 165, 210, 291: a, t, c, g, or other
gagatggatcggttggaggagcggaacattaagaagggggagagggagatggnggaggcgcgcaaggaagaggagcggaaggaggaggcgggggacaggaatacccaggagccgcagcaaggtcaaggcctcagcctctcactcgccaacggcagcgacagcggncaggtctgcaatgttgccgatgtcgaacccttcagctaatcccanacagcttacaattttctatggtggatcagtatgtgtgtatgactcggtgccaccagaaaaggctcagcaatcatgcttatnct

SEQ ID NO: 1144 - DNA, 286 bp, Zea mays
  misc_feature: Incyte ID No: 700550457H1
  unsure 16, 71, 255, 274: a, t, c, g, or other
gctcttctaacttctntcggccagccttgatgatcccaacactttcggtaacaggattcacaggatgctgnagcttggactgagcattgatgaagatgctggtgaagcagatgctgacatgcctcctctcgaggacgccgatgctgatgccgatgctgagggtagcaagatggaagaagttgattaaatctaactaattattgatttgccttgtgtttttagaaacaatgcatggggaacagtctttactatgtntatgttttgaatttcgaantttggatgttgg

SEQ ID NO: 1145 - DNA, 289 bp, Zea mays
  misc_feature: Incyte ID No: 700550458H1
ggtgtggaatggcgctttcgccacatattcagaggtcaaccacgaaggcatcttttgcagagtggctggagtgtttttgttagtgccaaacgtcttgttgctggcgatgccttcatctttctaagaggtgatagtggggagcttcgtgtaggagtcaggcgtgccatgaggcagcaagcaaatgttccgtcttcagtaatatcaagccacagcatgcatcttggtgttcttgctacagcatggcatgctgttaacactgggaccatgtttattctatcacaagcctagg

SEQ ID NO: 1146 - DNA, 288 bp, Zea mays
  misc_feature: Incyte ID No: 700550459H1
  unsure 51: a, t, c, g, or other
actgtagctaatcatgaccggagtagcagtccttgtggtcgacagacttgngcaggagaccattgcttattggaggtgtcagtggaattactgttgccttatttttgctgtcctcctactacactttactgaaagatgcctcctatgtggctgtaatagcgcttctactatatgttggttgttatcagctctcatttggtcctattggctggcttatgatctcagaggttttcccgctgaggctgcgagggcgtggactgggcgttgctgttctgtcaatttgcgtcc

SEQ ID NO: 1147 - DNA, 292 bp, Zea mays
  misc_feature: Incyte ID No: 700550461H1
caatgacatcaagcttagggatgatctcattgcagtgccaattaaaagagctcctgatcaaactctggaattgacaagtgaagtggtcgatttcttgagagggatattcaacatgtttgacattgataacgatggagctttactacctgctgagctggaggacctattctcaacagcacctgaaaacccatggtcttgcgatccatataaagactgtgctgaaaagaatgtgttgggtggtctgtcacttgaagggtttctctcaaagtgggctctatgacactgctagacc

SEQ ID NO: 1148 - DNA, 294 bp, Zea mays
  misc_feature: Incyte ID No: 700550462H1
  unsure 2, 39, 70: a, t, c, g, or other
cnaaaactcccagggcgctactcttcgttgataaaaggnacacccctgcttcccttcctgcctgcacacncacatctcaatctttgctgcgagctcccgatctgtggtacttccggcatcgcgaactgaagtttaccaccgatccgttggctccttggcattccttttcctccagcagcggcaaagcctccatctttttgccaaccgacttgaggaatggggtgcatgaagctgcttggagtagacgcaagctttatggaagatttctagtacttcatcccaacaagcaatcag

SEQ ID NO: 1149 - DNA, 292 bp, Zea mays
  misc_feature: Incyte ID No: 700550463H1
gattgcacggaaatatgatatagttgttgatgcaactgacaaccttcctactaggtatatgatcagcgattgctgtgttttgctgaacaagccacttgtatctggtgcggcattaggcttagaagggcagttgactgtttatcatcataatggaagcccatgctatcggtgcctctttccaactccaccacctgtggcagcctgccagagatgctcagacagtggtgtccttggggttgttccgggagtgatggttgcttacaagctctggaggcataaaggttgcaactgg

SEQ ID NO: 1150 - DNA, 285 bp, Zea mays
  misc_feature: Incyte ID No: 700550465H1
aacacaaggtggtctagaagaccagtggaagaggcgcacagtgctccaaacagagggttccttcccgctttggtgaaccgtctgccagttatcaaatctgaatctctggagttctctcctgtcgagaatgcgattggaatgatcgaaacaaggacagctgcattgagaaatgagctagaagaaccacggagttctgaaggtgatcaactcccaaggcttcagagcttgcaaaggatactccaaggaagtgtggctgtgcagtcaacatgggtataatgtgtgcat

SEQ ID NO: 1151 - DNA, 287 bp, Zea mays
  misc_feature: Incyte ID No: 700550468H1
  unsure 9-10, 37, 46, 48, 64, 193: a, t, c, g, or other
gatcttggnntccgtctcctacccccagcacaagcanttgcagctncnaagcagccagccagangcctcggtctcggagtcggagggacgcagccagccggcgccgcgcctggcgggcgggagagtgcgcttcaggcggcttcagtccagtccagtccactcccgccaagacgcaaaagcctgtctgttcctncaccttctggttgctccagaaaacacagcgatgcaccaagacagtttcaggtcggtggtctgcagatccatctcgaagacctgcccccaagagc

SEQ ID NO: 1152 - DNA, 284 bp, Zea mays
  misc_feature: Incyte ID No: 700550469H1
catacagcaccgccaagtcgtccgatggcatggagtcaccgaggattgaggtgacagcggagggcaaggcccagtaacttgaaaggtccccgcggagtcccatcggtgaaggctgacgttgtgggaaggggcagggacgcgctgttgttgccttatgttatgtggcggcggcagcgtggaaccgcactaataatgtggaccggaacctctgttaccgtcgtttgtgctgtcgcgtgctaggtttatgctgaatggatctttactccgcacaccgaactgtgtct

SEQ ID NO: 1153 - DNA, 286 bp, Zea mays
  misc_feature: Incyte ID No: 700550470H1
tttcattgctccagaggttctatgacccagatgtaggccacatactactagatggcgtggacatacgcaagttccagcttcggtggttaaggcagcaaatgggcctggtcagtcaagaaccggccttgtttaacgacacgataagggcaaacattgcctatggaaaagatggacaggcaacagaatctgagatcgtatctgccgcacaactggcaaacgctcacaagttcatcagctcggcgctccagggatatgacacaatggttggaagcgtggagctcagctg

SEQ ID NO: 1154 - DNA, 286 bp, Zea mays
  misc_feature: Incyte ID No: 700550471H1
gatagaaagaaagtggttacagagaaggcctgcctatggaatggagcaaagagaccatgctacctgtttgcgagaaagttctaccctgagtccataaacaatctcttgacctccttcgcgaattatacacttatttgagcttctaggtggcgcttagaggctacacaggaaacattttgttatacaaaacctgtacattggatagcaacagagtaggacattaattaacagaatagcaatagctattggtgaggagaaggcttcgctgcagcaacacagtggcttc

SEQ ID NO: 1155 - DNA, 288 bp, Zea mays
  misc_feature: Incyte ID No: 700550472H1
aaagcccatggagtaaagttcagtgtgagatgattctagcattcctctcattcgctgagtatttccgtcccagattctttctgttagaaaatgttcggaactttgtttccttcaacaaagggcagaccttccgtttggcagttgcatctcttctggagatgggataccaggtccggtttggaattctagaagcaggggcttttggtgttgcccagtccaggaaaagggcgtttatttgggctgctgcacctggagagatgctcctgattggccagagccgatgcatgt

SEQ ID NO: 1156 - DNA, 287 bp, Zea mays
  misc_feature: Incyte ID No: 700550474H1
attcaggtttacaagtcaggatcagtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccgtgggagtcatttgtgaatagtgtatggtacatcaagatactttcacctgaggatgtgcataagatgggaaagccaggaacgatccacgctaccta

SEQ ID NO: 1157 - DNA, 289 bp, Zea mays
  misc_feature: Incyte ID No: 700550475H1
  unsure 8, 30, 38, 45, 50, 66, 70, 74, 81-82, 84, 103, 143, 150, 155, 160, 177,: a, t, c, g, or other
gagagacngaacaagaacataagggatccncagcggcnataacanaagancaagagaaatgggtcnagtnagancgaaganngngaagaaatcctctcggcangtgatagagcgtcactactcgcgcatggaccctggacttncacacgnacaanaagcntctggaggaagtggcgntaatcccgtcgnaangctaaggaacaagatcgcggggttctcgacgcacctnatgnagcgccancccgaagggnctgttgcgcggcnntctccctcaagctccaggagggcg

SEQ ID NO: 1158 - DNA, 191 bp, Zea mays
  misc_feature: Incyte ID No: 700550476H1
  unsure 2, 4, 12-13, 189: a, t, c, g, or other
anangccaaggnngccttatgagaaggagcgccttgatgctgagttgaaattagtgggtgaatactgcacacgccacagctcacgcttgcacctcaggctccttctcataaggccgccttggcttcttgaaagtcttaccatagttgcgatagaagttcacgtgcaccatggatgacgctgcccacgcngc

SEQ ID NO: 1159 - DNA, 287 bp, Zea mays
  misc_feature: Incyte ID No: 700550477H1
  unsure 72, 180-181, 256, 277, 283: a, t, c, g, or other
tgggggaagttgaagagcaaattgagcaaactctagctatggtttgtgagaattacaagtccgctagatgantctataccgttgggtttggcggaagattttaggcctccaactggattggctgctgctgctctggaaccagctattaagttgtacagtcttctacacgacgtcctatcnnccggaagctcaactaagattgtgtggttacttccaggcagctgccaggaagcgtacgaggcgttacatgattganactgatgcgtagtatcagaantcaganggct

SEQ ID NO: 1160 - DNA, 293 bp, Zea mays
  misc_feature: Incyte ID No: 700550478H1
  unsure 112, 231: a, t, c, g, or other
gactagttctagagcgcgcgtcgcggttcgcacgcgtaccaccgccgtgggctctgggccatcaaggccaagaacggcggcgtcttccccaaggccgagaagcccgccgccnccgcggaacccaagttctaccccgccgacgacgtcaagcctcgcgttcccagcacccgcaagcctaaacccaccaagctcaggtcgagcatcacgcctgggacggtgctgatcctcctncgcggggcgcttcatggggaagagagtggtgttcctcaagcagctcaactccggcctgctcc

SEQ ID NO: 1161 - DNA, 291 bp, Zea mays
  misc_feature: Incyte ID No: 700550479H1
ctatttcaataccttgccgctgtatttgcaactgatttacactctagagcttttctgcgccttccaaaaactcttggagtggacttccgtgcttcgtgtttctgccataagaagactattgacatgggatatgtctgttcaatttgtttgtcaatattctgcaagaatcagaagaagtgttcaacctgcgggtcagaattcagtcgtgccatgcctgatttgaactccgtgccggatcaaagcaagtagtgtccagtgcgaagttaacccatcacagacaatgcttttctc

SEQ ID NO: 1162 - DNA, 90 bp, Zea mays
  misc_feature: Incyte ID No: 700550483H1
ggcatttttgcgtacaatgctgtaactgtacagttacagcattgttacagttgtgtgtgaagtccaaatgggcagggctggcattaactc

SEQ ID NO: 1163 - DNA, 108 bp, Zea mays
  misc_feature: Incyte ID No: 700550484H1
atctttttgaatcaatttattttgtaaccaactccgatgatatatattgtaatcttgttgtaacttgtaaccattttgtaataaataatttatttccgctgcaaaaaa

SEQ ID NO: 1164 - DNA, 263 bp, Zea mays
  misc_feature: Incyte ID No: 700550485H1
  unsure 50: a, t, c, g, or other
tctgtaccgggagattctcagggacgagaccgtgcagaggctcaaggagntgggcaagatatctgatggggatggctaccttgaaaggacgtttctgagtccggcctctatcagagccactggtgtcatcgtcagctggatgaaagacgctgggcttacgacgtgggtcgatcagatggggaatattcatggtcgatatgagccggcaaattctaccagagatgccttgttgattggatctcatatggacactgtcgttgatg

SEQ ID NO: 1165 - DNA, 282 bp, Zea mays
  misc_feature: Incyte ID No: 700550487H1
gaagcacacaccaaagcctgaattgttggatacgcgggtctcgaagttcacctattcttttaactggagaaggtgatgatggtgacatcgagtccgtggaatttccaaagtgtgtggtggcaagtaattaggcacatggtcacatactcacatggaggagatggaggagagggagagataggacccgagagaggagacatgagaggcacatggtcaatatattttgttggcgtattgtaagcctgtaattgttggttgcaaccgtgctaacctggcatattt

SEQ ID NO: 1166 - DNA, 287 bp, Zea mays
  misc_feature: Incyte ID No: 700550488H1
gtcgaagaggaggactacgagagactccgtgaatcagttgacatgcatgacaactttgaccagattggtcttgcccagaagcttgagaagcatgaattgctggagatgaggaggatcgccgcctacatttacaagaaggctggcaggtggaagcagtcgattgctctatgcgaagaaagacaacatgtacaaggactgcatggagacatgctcacaatctggcgaccgtgaactgtcagaggacttgctcgtgtatttcattgagcagggaagaaagaatgttttgc

SEQ ID NO: 1167 - DNA, 284 bp, Zea mays
  misc_feature: Incyte ID No: 700550489H1
acgtctaccaatggtgagcaggtggatcccaagactgaaactagcacatccaccagtaacgtgcacaatgaatctcaaggggctgatggcagttctggatcaaataactcaattggtaacggccctgaacaaaccggtaaaactgaaaggcagtgataccactatctagacacgaacattgttttagtataaagatttgtttcctggagattgaagaggctagtactgaaccaagaaaaactgttcacattgtggcttatggtgatttagttgatactgctgaa

SEQ ID NO: 1168 - DNA, 282 bp, Zea mays
  misc_feature: Incyte ID No: 700550490H1
  unsure 38: a, t, c, g, or other
cttctgagtatataaaagttccaagtacaaagaagaantcgcaaggtgaaatgcatttcaagtgcttgccgaagtccagtgccataaagctgatagattttggcagtaccgcctttgataatcggaaccataactcgattgtttctacgaggcattatagggcacctgaaataatattaggtttaggctggagttttccatgtgatatttggagtgttggctgtattcttgttgagctatgctctggggaagcatgtttcagacaacgagaatctggaacac

SEQ ID NO: 1169 - DNA, 285 bp, Zea mays
  misc_feature: Incyte ID No: 700550492H1
aagcttctttcaggcgcgtttctttttccagcaactcatatcaggggtcagctactgccattccatgcaagtatgccatcgcgacttgaagctagagaacaccctgttggacgggagcaccgcgcctcgcctcaagatatgtgattttggctactcaaagtcatcagttctacactcgcagccgaaatctacagtgggaactcctgcatacattgctcctgaggttcttctgaagaaggaatacgatggaaaggtcgctgatgtgtggcatgtggagtaacgctg

SEQ ID NO: 1170 - DNA, 290 bp, Zea mays
  misc_feature: Incyte ID No: 700550494H1
  unsure 9, 20, 23, 35, 41, 47, 56-57, 67-68, 79, 138, 152, 187, 245: a, t, c, g, or other
cttccatangtcagtcgtcnaangtcagacacctnaacttngtcgantgcttgggnngtcgcagaanntggccaggtgncattgaagttctggtggaaagtggaagacctattgatgcaattaatttggcttatgtgnttgagcttactgancaatttgaaccactacaccttcttaaagcatatcnaagggatgttaagaaaatgtcacacgccaggaatgtcaaaacttctcctggagcacanaatgagatgaatgaacgtgagttatctgcgctgaaatctgtcatt

SEQ ID NO: 1171 - DNA, 291 bp, Zea mays
  misc_feature: Incyte ID No: 700550495H1
  unsure 14, 22, 64, 71, 106, 114, 276: a, t, c, g, or other
gtgcaatgcagggnacgctcgncctgtgtctgcctactccctcctccggatcccgcgaaggagntccaagnagcagcaggagcgtcgagctcgagcagcagccatngatggcgnggaggttggcaggaggggtattcctactctggctgaagccgtcttcctcctccagcgacggcagtgccggggaacaagagcacatcgcttctgacgtcactcagctcataggatggacgccgctggtcgaattgaagcgaatcgccagcgaggctgggatcntgcgcggatcgtcgg

SEQ ID NO: 1172 - DNA, 289 bp, Zea mays
  misc_feature: Incyte ID No: 700550496H1
cgcagacaagtagagtactgagaagaaaagacatgggtcaagcactcggcttgattcaagtggatcaatcgacagtagccatcaaggaaacttttgggaagtttgacgaggtcctagagcctggatgccacttcttgccatggtgcatagggaagcaaattgctgggtatctgtcactgcgtgtgcagcagcttgatgtccgctgcgaaacaaagacaaaggataatgtcttcgtcaatgttgtggcatctgtgcaatatcgtgcccttgccataaggcatctgatgca

SEQ ID NO: 1173 - DNA, 122 bp, Zea mays
  misc_feature: Incyte ID No: 700550501H1
  unsure 67: a, t, c, g, or other
aaaccgccaccgtttcttgatctcccatcttcatcttcttcgtagcgtcggcgctccatcttctgtnccctcccttagtcgcgctcagcacgcgggtgacggcggcagcggcgacgtcatga

SEQ ID NO: 1174 - DNA, 280 bp, Zea mays
  misc_feature: Incyte ID No: 700550504H1
caaagattcgctgtctgctgtcctgctaaaaaggagactgtggatcgggtttgtgatattgtcaagaagcagcttgcacttcctgagggcactgaggtctgtggctcctctaagtttcaagacctcggtgctgattcgttggacactgttgagattttatgggccttgaggaggctttcaagatcactgtagaggagtcgagcgcgcagtcaatcgcaactgtggaagatgctgctaatctcatcgacgaacttgttgcaggagcagcaaaatcgtgtta

SEQ ID NO: 1175 - DNA, 279 bp, Zea mays
  misc_feature: Incyte ID No: 700550505H1
  unsure 276-277: a, t, c, g, or other
aaggcgatagataagaggaaggaaagaacataggcagccgaagcgactgtcgcgaggcaaggccatcgtccgccatgacgctctccctctccacctctttcctccccatccccgccgccgcgaggaccaccgcccgcaccctacgctccgtcgtccctcccaggggatgcgctgctcgatgcgcaagaaggggttgcacccggagatctacgaggacgcgaaggtgtactgcaacggcgagctggtgctggtgaggggggcaacaagccggagtanngg

SEQ ID NO: 1176 - DNA, 104 bp, Zea mays
  misc_feature: Incyte ID No: 700550506H1
  unsure 11, 53, 56, 89, 92, 95-96, 100, 102: a, t, c, g, or other
cagcaagcganaatctcccgatcccctctagtctccgcggcgaagatgtcggngcncggcaagggcgggaagggcctgaggcaagggcnaanggnngttnantc

SEQ ID NO: 1177 - DNA, 208 bp, Zea mays
  misc_feature: Incyte ID No: 700550507H1
  unsure 157: a, t, c, g, or other
gtcaaatgttagtgtagtttccacgtgttcttgagacgtgtgtatttgtatgtctgtgatgtgatccgtcagatctgttcttgtgcccttcaaaggccaaatcagggagctctctgcttcctgtgtatgcttgctttttccagtattccctgttatnctactatgaaatcatccatcgtgccacaaagaactgatggttcctgatgtc

SEQ ID NO: 1178 - DNA, 281 bp, Zea mays
  misc_feature: Incyte ID No: 700550508H1
gacatcgtagtcgagttcatcaagaacgaggattacaagtatgttcgtgttctcggggccttctacctgcgtctcactggcacaattgctgacgtctaccagtatcttgagccgctctacaacgactaccgcaagatcaggcacaagctcagcgatggacagttcacacttacccatgttgatgagttcattgatgagttgctgaccaaggattactcctgtgatacagccatgcctcgcatccagaaaagatgggttcttgaagcgtctggaatctggaa

SEQ ID NO: 1179 - DNA, 281 bp, Zea mays
  misc_feature: Incyte ID No: 700550509H1
gggctgcccggtgtaggcaagtcaaccatcatgagcgagctttattaatatgatgcaagctacctggtttggtggtaatgcttatgtgattggtgattctgcaaagcataagcagaagtggcacgtctactatgccaccactgagcacccctgaggagcttgttgttactcttgagatgtgcatgactaggctggacaagaagagagcttatgtcttcttcaagacctctattgatggttacacatcttgtgctaaggatatgaccaagccttcagtgatt

SEQ ID NO: 1180 - DNA, 277 bp, Zea mays
  misc_feature: Incyte ID No: 700550511H1
  unsure 114: a, t, c, g, or other
gagatgtcggtggccggggacaggctgctgtacaaggtccccggcgagcgccggggagccgacggcgtgtggtgcctaacgttcgggaacgcggacatggtgcccctgacggcntacgtgatcgggcaccaccaccagatgaacctatgggtcgagtacgacctggagcgcggtcgcgttgggatcgcgcctgtcaagtgcgacgtcgccagcgagcggctcggcctgatgttgtgacgtggcctggcgaaccgtaaccgctctggctcgggggttt

SEQ ID NO: 1181 - DNA, 277 bp, Zea mays
  misc_feature: Incyte ID No: 700550512H1
cacatcactaaatctgagctatgctactgtacgaggccctgaactgattaaattcattagcagatgcaaaaatttgcaactcttatgggtgatggacttgattgaagaccatggtcttgctgttgtggcatcgtcttgtaacaaactgcaggagttgcgggttttcccttctgctcctttcgaagcagctgagcaggtctctttgactgaaagaggtcttgttgatgtatctgccagttgcccaatgctggagtcagtcctctacttttgcagacgg

SEQ ID NO: 1182 - DNA, 279 bp, Zea mays
  misc_feature: Incyte ID No: 700550513H1
tgacacttgggctgccttatttgcagtactatcacatcaacgcccgggacaatgatttctttgatttcatcctttggtaaattttcgtattaacaaattctatgaagactttctgctggttcaggtgcgaatcatggggaagtttatgcatgacaatccaatgctatcatgtagtgaagtaaacagacatcactatagtcttgcggcagttgctgtcggtttgggactaggagttgccgggttatgcaaggcattgtatagtggtctgtccataccatg

SEQ ID NO: 1183 - DNA, 277 bp, Zea mays
  misc_feature: Incyte ID No: 700550514H1
cagaagaacagtcggcgtggtgttcacttccgtcgtgctgggcctcgtcagagggtttattttggcaccgatgaagtgaaagcctgcattgtaacttgtggaggcctgtgccctgggcttaacactgttatcagggaactggtgtgtggcttgtcacacatgtacaatgtcagcagcatttttggaatacagaatgggtacaagggtttctattctagcaactaccttcccctgacaccaaagagcgtcaatgacatccacaaaaggggtggtacag

SEQ ID NO: 1184 - DNA, 279 bp, Zea mays
  misc_feature: Incyte ID No: 700550516H1
  unsure 232: a, t, c, g, or other
ctaataactccaatatacaatgaatatggcgaggttgaaggacgaggaataagaatggcaaaaagagtagtccgtgctctgggtttgatttttggatgtgtgttcactgcatccctggcttatacagcagctagtaacatggttgagctttcattgcagtatactccccgtatgttttactactatcaggagctgattgttactgcggctgcctccgttcttctgtacatcncggcttcatgctaccgataaacacgagaagcaattatgcctggctag

SEQ ID NO: 1185 - DNA, 292 bp, Zea mays
  misc_feature: Incyte ID No: 700550518H1
  unsure 200, 202: a, t, c, g, or other
aatgaaagaaattggtaatggagatccttcaggaatgctcgttgttgtaactggtgcgagtacatgtaatgtatgggccacgaggaattggcgttcctgctaggatatctaaaaagatgcaaaagaaaaatcaagttgtgatacttcttgatcctgagaggcaaagtataaggagagaaggtgaaatccctgtagctgantnctatggtactctgctgccaagccatgcagtcggaattgctttgatcgtgctgaaattgctagagttatgaatgctgctggcaggaggcgt

SEQ ID NO: 1186 - DNA, 277 bp, Zea mays
  misc_feature: Incyte ID No: 700550519H1
  unsure 42, 175, 219, 232, 243: a, t, c, g, or other
gcagcggagtgcagagagcggacgcaacgcaacaccgcccantctctatcactgacgatcgaagcgaggagcgcactgaagccagccgccgatgagtcgcctcctctcgcggcagaaccttgccgccgtccgtcgatctgcaccctttgcgtgcgttccaggtggctgcacacgncgtcattcgcgacggtgtctccgcaagaggtttcaggttccagnccagcggaagtgncgaatttgtgnaggcagctggacagcatctgctaactggaatgga

SEQ ID NO: 1187 - DNA, 280 bp, Zea mays
  misc_feature: Incyte ID No: 700550520H1
  unsure 12, 194, 254, 266: a, t, c, g, or other
gaatcgttcagntcaaggaagatgaattccgggaactaactcaaggtggaagatccatcagcgagtacgtgcacaaattcacagaattatcccgctacgcgcctgatgatgtcatctcagaggccaagaagatggcccgcttcttgaaatggctcagaccagaactcaagaccatcctagccagccaagacttnctcagcttctcgcacctctcaaacaaagccatacaagtggaaagggccagggaagaaganaagggtcactanaagagggaattcca

SEQ ID NO: 1188 - DNA, 274 bp, Zea mays
  misc_feature: Incyte ID No: 700550521H1
  unsure 256: a, t, c, g, or other
acgctttactggagatctggcaaaagaagctgggcacgttctggctctagacttcattgaaagtgtgattaagaagaaccaaagcataaatgggcatcacaagaacataaccttcaggtgtgctgatgtgacatctaacgacttgaagattgaaataactctgttgatctgatattttcaaactggctattaatgtaccttcagatgaggaggtccaaaagcttgtggggaaatggtaaatggctaaaagtcggangccatattttctttagag

SEQ ID NO: 1189 - DNA, 277 bp, Zea mays
  misc_feature: Incyte ID No: 700550522H1
  unsure 21: a, t, c, g, or other
aagcaatgcagtacttggagngaagagagtgtgagtacgaccagaagatatccattgatttctacaaggaaggagatcccttgaaaccagctgtgacaggcgtcttagtgttcgtttccactccagatccaattggcaacaagtactatcttggccctgctccttgcaggatatggcaaggcaaattgctacagccaatggccctactggctataatagggattacctgttctcatggagaaggcattagccagcattagccacgaagatgattcga

SEQ ID NO: 1190 - DNA, 280 bp, Zea mays
  misc_feature: Incyte ID No: 700550523H1
aagggccatggaatgatccttatatattgaagctgatccacaatttggaagctggatgcatgagggaaaccaccaaacccgtttctgagggcggagaaagaagcagctcttcctttcggttggaacagatgaaatggcagggcatgttaagcgatacatcaaatgctgaatcaggatccgatgttgatgattttggtccatcatttgttcataaagtttcaggctatggttgcttgactccggttcgtgaggaggtaaagggcacagattgtgcaacata

SEQ ID NO: 1191 - DNA, 280 bp, Zea mays
  misc_feature: Incyte ID No: 700550524H1
  unsure 63, 157: a, t, c, g, or other
tgcactgcagggtacgctcgtctgtgtctgcctactccctcctccggctcccgcgaaggactnccaagaagcagcaggagcgtcgagctcgagcagcagccatggatggcgaggaggttggcaggaggggtattcctactctgctgaagccgtcttntcctccagcgacggcagtgccggggaacaagagcacatcgcttctgacgtcactcagctcataggatggacgccgctggtcgaattgaagcgatcgccagcgaggctgggatcgatgcgcgga

SEQ ID NO: 1192 - DNA, 277 bp, Zea mays
  misc_feature: Incyte ID No: 700550526H1
  unsure 7, 9, 14, 95, 108, 114, 138, 198, 259: a, t, c, g, or other
ggccggngngccgnggaagaagtcggtgacgaggtccgtcaaggccgggctgcagtttcccgtacggccgcatcgggcggtacctgaagaagggncggtacgcgcagncgtacngcacgggcgcccccgtctacctgnccgccgtcctcgagtactggccgccgaggtgctggagctggccggcaacgctgccaaggncaacaagaagacccgcatcatcccgcgccacgtgctccttgccatccgcaacgacgagganctcggcaagctgctgtcc

SEQ ID NO: 1193 - DNA, 275 bp, Zea mays
  misc_feature: Incyte ID No: 700550527H1
gtggaattcgcttaatatagcaatgcactagggtttactgtgcaccactaggctactgcctctgctattaggaagccgacatctgttgtttccgaagtctttcaagtctctgttgggtggcgttgctattgtgggtgtgataacatgataaagcaatttcttggacgtctccccaagaagccatccaaatctggagataaggatcctattggccggcccagcccctcggtgtcgcaccagccattgggtccgagagctggagacagggccaccaa

SEQ ID NO: 1194 - DNA, 196 bp, Zea mays
  misc_feature: Incyte ID No: 700550528H1
ttccatttggaataaaatttttattgcacatgattgattttcggatatttagtagcatttcttcttaaataaaaatcctagtaaataatatatataataatattagtctaaaaataaatattttatttataaataattttggtttaattattataatttttagggttatttaaaaattatttcgactttagaacgg

SEQ ID NO: 1195 - DNA, 273 bp, Zea mays
  misc_feature: Incyte ID No: 700550529H1
attgttctttgatgactgatttagtatgcttaggtagctgtgtgttattgttcatgtaatgattatttgttgttgagatgtttatgccttttcttgtgtctagtgttttatcagcaaaacaaattactttgtggcactgccagtgatgattgtctgcaaaatggatgtcctgtggactcaagtcccctgtttcagggagaacctactcgaggaaacatggtacataatatgacatcatctgattaaactgaggcattacagaagaaccttatt

SEQ ID NO: 1196 - DNA, 145 bp, Zea mays
  misc_feature: Incyte ID No: 700550530H1
  unsure 28: a, t, c, g, or other
tgatcagtgaaattctttgacatctagncgagaatttttgtttggttatcgataattcactctcattcatgtgagatattgtgctctgcttatttattgatagctgacactggtcacccaggagcacgagattagcgcgttgatg

SEQ ID NO: 1197 - DNA, 277 bp, Zea mays
  misc_feature: Incyte ID No: 700550531H1
actgaaacctcctcacagttttgatgcttgtttcatggacatacagatgcctgaaatggatggatttgaagccacaaaaaggattagagtgatggaaagagatctaaatgagcaaatagaacgtggagaagccccaccggaatgcgcagggctcggcagtggcgaactccaatattagccatgacagcagatgttatccaggcgacgcacgaacagtgcttaaaatctgaatggacggttatgtatccaagccattcgagggcgagcattgtacaga

SEQ ID NO: 1198 - DNA, 278 bp, Zea mays
  misc_feature: Incyte ID No: 700550532H1
  unsure 277: a, t, c, g, or other
caagcgggcatacaaagagcgcgtgcgcactgcgcagtgcttggaataggtgggtcgaacttcgaaggggttcgaggacttcagctatggcatctgtgggacgtgcaggacgaggagggaaaggagatggagggaagggagaagggtcgctggctcgcagggcgtggaggcagtacctgctccagctccagcaacatcctctccgcacaaagatgatcacggcggggtgcctcgccggcgtcatgactccgtggcgcaaaagctctctgggttccana

SEQ ID NO: 1199 - DNA, 280 bp, Zea mays
  misc_feature: Incyte ID No: 700550535H1
  unsure 89, 112, 119, 132, 138, 152, 268: a, t, c, g, or other
ggctctcggtgccctagcccgcctcctccgccttgcgcccacccctacgcctcgcgcgccccttcgctgcaaaggtccgtgcgtctcgnccgcaggaaccggagcttccgtnggaggangacaacgacttcnccggcngcgagctcaccgcncccaccgagggcatcggcaagccgctcgccgaggtgctcaaagagctcgggaagagggttccggactcccttgtcaagacccgcgtcgagaataatggttcgtatcaagtacatcncatggcacattg

SEQ ID NO: 1200 - DNA, 273 bp, Zea mays
  misc_feature: Incyte ID No: 700550537H1
ggaactccggatccaccgctaccgccgccgcgtctaaaccctccaccgccgcggtgcgtcagaggcagaggcagagaggcagaggcagaggcagccatggggagccgcctcgggcgccgcgtgatccactttgccaacctcccgctgaaggtcatgctgccccccgcgccgctctcctccgtgcaggagttcgccgtgcggaccgtcccctccgttccaaagtggacatcggcgctggcttcgagtccatgtacggttttccgtggcgagtcg

SEQ ID NO: 1201 - DNA, 274 bp, Zea mays
  misc_feature: Incyte ID No: 700550538H1
  unsure 234, 242, 245, 249, 253-255, 262, 264-265, 268-269: a, t, c, g, or other
taccattcgcgccatggaagtaggtcgtgtttattgcctgtggtgggacccatgtccgtgccaacgccaattgccagccgcgtagccgttgatgaagaaaaagccattcgcttggccgctctttaccttgtagcgttaaagggtaaggtggtgtttgggaacaaagtttttctgcggttttgggaagaatactgcagtattctcaaatactgcagtattatataaaaaaagaanaagaaaanaanaagnacannnaaggaananngannaaaga

SEQ ID NO: 1202 - DNA, 284 bp, Zea mays
  misc_feature: Incyte ID No: 700550539H1
  unsure 15, 21, 23, 43, 53, 65, 68, 80, 100, 118, 120, 131, 137, 155, 162, 166,: a, t, c, g, or other
aattttcctggttcngaaatnanttttggttgcagttattggnattatcagtncggggtactgantanacctctaatggncaagaacaacaagatagtanttgggataccatggcccngntttacatccantcgtcnagcaactttcttattgancctgcanaagncataatnatttgaacanttcnttggtttctttnaccagangttgtagtaaacaagcttgtgttaaagggcccatctttatttcnaacacnatcaggagantcnctttggagaaatccc

SEQ ID NO: 1203 - DNA, 278 bp, Zea mays
  misc_feature: Incyte ID No: 700550540H1
agcgtgccattgtttagaaactgaaatgttcagtcgatcagtgtaattctttgacatctaactatttatcattatatggaatgggaggaactgttgtagatttgtagaactacaaaaaaactgtgtatccctaacaagtttgtagcaaagggggtacattattacagtttgagatgaggacatcatgtatactgtttgagacgaggacattatgtatatacttggtacattagaaggccaccgaaaacaaattttgcatctggtttttgaaagcatgt

SEQ ID NO: 1204 - DNA, 278 bp, Zea mays
  misc_feature: Incyte ID No: 700550541H1
ggtgcaaagccatcctgtaaggaagtgattagttcaaaatcaaagcctacaaaactacttgttgaaaaatcatcaccatgtatcaacgtggattacgaatatgtgaatttattggctgataccccaggtatcaaaagaggactcgaatctccatctgcatggaagtctccttggtatatcgatatgcacatgcactttcagggttttgtcagcccagcagacagaacttatgacgcgttaggattagtgaatcgtttaagcaagcacagtgctgctgc

SEQ ID NO: 1205 - DNA, 272 bp, Zea mays
  misc_feature: Incyte ID No: 700550543H1
  unsure 62, 67, 265: a, t, c, g, or other
gcccgcgcagccccgaggcggagatcggccaccgggtggaggacctctgggaggtggcggancgcanctctcgccgtcggagaagctcaactcctgcttcgaggacatccccgtcgcgtccttcccgcgcacgcacccgtcccaagtcatgagattccttcagatgcaagtcttgctgaaactgtagaaatattatccaaaaacaaaatcttgagtgcacccataagaaatgttgaggctccagaagatgctagttggatggacnaatacat

SEQ ID NO: 1206 - DNA, 272 bp, Zea mays
  misc_feature: Incyte ID No: 700550545H1
catccctccaacccttacgagaggcagtttgtgtatggtgctgaggctcatcttcctccaatgatgagttcagcgtcttacccgatgcaacctgcccatggaccttattacggcaatggctacccagtacagtaccaggtcccgtatatcactaatggagacagccaggtgcaggtgctctttcctaactatctagcttagcctgctgccccttgttgtagtcctatcagttactctgctagtttgcctagatggaaatagttggaccactc

SEQ ID NO: 1207 - DNA, 275 bp, Zea mays
  misc_feature: Incyte ID No: 700550547H1
aaagatgcgtaaccataccgcaacaaacagaatgactggtgtaggtaacacgttgaaaagacattacgagacatacttgttggaatatgagttggcacatgatgacgtggatggcgaatgctgcttactttgtcacagtagcgcacctggagattgggtgaactgcggtttatgtggtgaatgggctcactttggttgcgacagacgacaaggactaggcactttcaaggattacgctaagacagatggtttggaatacatctgcccccactgta

SEQ ID NO: 1208 - DNA, 276 bp, Zea mays
  misc_feature: Incyte ID No: 700550548H1
gcaaggaggagggagatgcagggcgccagccacatgctcctggaggagcccttccgcctcgcctccgtcctctcccccgccaagcctaaagtattcccatcactcaccaagatagttgggacgctcgggcccaattcacactcggttgagattttcaggaatgcctcactgctggaatgtcagttgcacggtttgatttctcatggatggatgctgcgtatcaccaggagacccttgataatttgaggaaagcggcacagaatgtgaagaagttgt

SEQ ID NO: 1209 - DNA, 108 bp, Zea mays
  misc_feature: Incyte ID No: 700550549H1
attcgttttctataggatcacactttacccatgtagttgagcaggcacctagctatacatttcacagtcaatcatctggttctagctgttgtccaatattattggtaa

SEQ ID NO: 1210 - DNA, 176 bp, Zea mays
  misc_feature: Incyte ID No: 700550553H1
aaggcagagcagtcaccagcatacataagcttagtgtgaataagaaaacaaagtgttccataggtggtcaccgttggacacgtgcttcggttttgttttaagcttagtgtgaataagaaaacaaagtgttccataggtgatcaccgttggacacgtgcttcggttttttttttttt

SEQ ID NO: 1211 - DNA, 278 bp, Zea mays
  misc_feature: Incyte ID No: 700550556H1
  unsure 76-77, 82-83, 85, 92, 95, 98, 103, 105, 110-112, 114, 118, 124, 126-127,: a, t, c, g, or other
aacacatctcctcgcatttcttcccatccgatccccccttcgcaaccaaaaccccaactcgccccgcatcgatggnncccanncnccgaganganccnccgcngngaagnnncnggcngaggangnntcgctgncgaganggngcccgctgggncgaagccgaagggnaagaagcggntccccgctggcaagtnngctgccaaggaaggcnncgagggcaagaggggcaagaagaagggcntgaagagcgtggngacctacaagatctacatcttcaa

SEQ ID NO: 1212 - DNA, 270 bp, Zea mays
  misc_feature: Incyte ID No: 700550557H1
ctgcagtgagccccgagcgagctcgtcccaagaagaagaggtcaccagtgaggttcctgcttgcccctcttgctctggttctgttgatggctgcagcgtttgtctgtgttccaccgccgccgggttatccggtcatgctgaacacctcatgtcaaaggtgtcagtcttactttcagttcaagaattgcatcctgtggagttggctgctaggctgaagcaatggtctagcagttcgttggacttcgtcacgtcctactgggaggctattgc

SEQ ID NO: 1213 - DNA, 270 bp, Zea mays
  misc_feature: Incyte ID No: 700550558H1
  unsure 32: a, t, c, g, or other
gggaggagattcagcgcatcaaagctgcgaancagatatccctcacagggaggccttcagcatggctgccaagaattgggcgaagtgtgacccgcgctgctcgacgactgcctctactgccacttctaacagcgctcctgagcctgctgagtcgtcgtgcccactcctcatgtaactgagccacgctttgatctggaggatagggccaaggagcatgtcattgagagcttcgacatcttcaagcagattgagcgcaacatctagatgtct

SEQ ID NO: 1214 - DNA, 269 bp, Zea mays
  misc_feature: Incyte ID No: 700550561H1
gttgatgaaactacaaaatatgcatgctagaatgaatgttgaattgtctctaatgtccataatctatatgctgaaattctgaatttttgaataatcgggtcaggtatggatacccatgggtatttagtacccggtcgggtatgcgtatgggaggtttttttgtacccgaggtcgggttcggggatgggggcgggtctatgttcatgggtacgggtctagggagttaatccccactggggaattccccattgacatctctagtccggtgc

SEQ ID NO: 1215 - DNA, 271 bp, Zea mays
  misc_feature: Incyte ID No: 700550562H1
  unsure 204, 239-241, 243, 248: a, t, c, g, or other
cagcaaacttagcatcagcattggcccatcggtcttgaacaatgtattgcccgacgggattctgaatgggcttgaggttatgaagataagtaccggaggttctgctttcactgtcgggtctggcagtggaaacaaaaaatggggtgtgattcttggcgcagccctcggaggtgttggactgtttataattgttgtggtcctggnactccttgccggaggaaaaaaccccggaaaagcannntncaaanaccgggaggccttccctaacaaa

SEQ ID NO: 1216 - DNA, 274 bp, Zea mays
  misc_feature: Incyte ID No: 700550563H1
  unsure 12, 145: a, t, c, g, or other
atggcatgtgancgaccaactcaaagggagggcagcattttagaggtagttaacaggaacaactatggtaatgatcattgtgccaaagaatttggtattaaggtgacaaatgaacttgccttggttgatgcacgtgtgctgccanctccgacgcttaagtaccatgactctggacgagaaaaggtgtgtagtccttccgttggtcagtggaacatgaacaacaagagattgatcgatggagtatccattcagtattgggcttgtgtgacttttg

SEQ ID NO: 1217 - DNA, 108 bp, Zea mays
  misc_feature: Incyte ID No: 700550565H1
  unsure 25, 27-28, 46, 103, 105: a, t, c, g, or other
cttgtaactgagaccgatacaagtncnnctagaggatatgcattcnttgagtatgtgcacacacgagacatgaaaaatgcctacaagcaagcagatgggaganantgg

SEQ ID NO: 1218 - DNA, 285 bp, Zea mays
  misc_feature: Incyte ID No: 700550566H1
  unsure 101, 156, 195, 246, 249, 279, 284: a, t, c, g, or other
gaatgggttgtggatggaggattggtcctataaataacctgccacgcacaggttgctgcaacctacgccaaggagaaattgcaaacctgtcactagcgaanataacttcgtcgagcacactcttgcaattaatccaccgagttcggtttagtagcntagcatcgacaataaatgtcgctcgtgagtcggcgcaanaagcaaacgtgttcggaccccttctcctcgacctctgggaccccttcgacngtnccgctccatggtccggtcgggggcttctcnggggng

SEQ ID NO: 1219 - DNA, 94 bp, Zea mays
  misc_feature: Incyte ID No: 700550570H1
  unsure 7, 25, 43, 52, 55, 60, 73: a, t, c, g, or other
gcagcangctctactccccattggncatatactgagctacgtnagtctacantgncgctnctgaaaccttggncatttacctttgtattacccc

SEQ ID NO: 1220 - DNA, 268 bp, Zea mays
  misc_feature: Incyte ID No: 700550571H1
  unsure 4, 136: a, t, c, g, or other
aggnggaggcggctgcggaacggtcgaccatgacactccacgatgatgacgccgccttcgtcaagctcgaggagggcgactacggatacgtgctcgacgacgtcccgcacctcaccgactacctcccggacctccncacttttcctatcctctgcaagatcatccggcgtattcaatgtcagcaatattttgtcatgcagatgatacagtccctgaaaaggtagttgttcagaagaaccagtccacgaggagttcattccgtcgtgct

SEQ ID NO: 1221 - DNA, 272 bp, Zea mays
  misc_feature: Incyte ID No: 700550572H1
aggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaacgacaagagactcactgccttccatcctgaaatcgaggagctcatctacagcgacgtcgagaactccgagcacaagttcgtgctgaaggacaagaagaagccgatcatcttctcgatggcgcgtc

SEQ ID NO: 1222 - DNA, 272 bp, Zea mays
  misc_feature: Incyte ID No: 700550573H1
tggcctcgccacaaggacaagacgcccaagaagtcagaggacagcagcccgctggggtcgatcagcaggctgaacgagcacggggccgagacccctgctccgctgaggcagaagtttaccaagacgacggcgctcaacggcaagcggaccctagcggtgaagagctccaccccgagctcctcatccaccaagaagaagctcaacacgaagctcatccacggcatcatggaggccatgccacagctggcgccatctacggcgcggtccgcgtc

SEQ ID NO: 1223 - DNA, 88 bp, Zea mays
  misc_feature: Incyte ID No: 700550574H1
  unsure 2, 4, 7, 10, 12, 34, 37, 48: a, t, c, g, or other
gngnccnacnanacaagcaagagcgtgcatcatnctncggcgacagcnggtgcggccggcttccctgtccctttgccacacaagatat

SEQ ID NO: 1224 - DNA, 269 bp, Zea mays
  misc_feature: Incyte ID No: 700550575H1
acagagttgctttgtttgcaaaacaaaaaccaacagatgttggaacagaatgaacaactaaggaatggattacaggaaagcagtgaaagggaggaggtgctgaaaactgaagtattcatcacacaagagaaactatcttgcttgagagagtcctaccagacatcacaagatgtaattttcaacctgaccgaaaaaaatgagtccttgtctaaggaataccagtccttgagtgagaagtacaattccttggaagatgagaatgatactgt

SEQ ID NO: 1225 - DNA, 267 bp, Zea mays
  misc_feature: Incyte ID No: 700550576H1
ggatggcgcagagccagggcagtaaatgtgctatcctataggcattagtacttgctagaaattggtggagctatcgtgctgacgcgtctcttgtacgtagtactttctctgttccaaaaatatatagttcaatacaccttagtaggatgactacgagagtatccaaacaagacctcgtcggacatgttagcctgaagcttgcttatggacatattggatatagtttttgggtgagaacttttgaacaacttccttgtttttttctct

SEQ ID NO: 1226 - DNA, 267 bp, Zea mays
  misc_feature: Incyte ID No: 700550577H1
caatgaacctacagcagccgctctgtcttatggaatgaacaacaaggaaggcttgatagcggtatttgatcttgcaggagacagctgaatcttaccttggcaagtctatctcaaaggcagtgattactgttccagcttatttcaagacgctcagcgtcaggccacaaaggatgcaggccgcattgctggccttgatgttgaaaggatcatcaatgaacctacagcagccgctctgtcttatggaatgaacaacaaggaaggcttgat

SEQ ID NO: 1227 - DNA, 269 bp, Zea mays
  misc_feature: Incyte ID No: 700550579H1
catggatctttgcttggacacaaacaaggttccatctgcctgtctggcttggatttggtgcagcgataaagcacatcatgcagaaggacatcaggaacatccatatactgagagaaatgtacaatgagtggccattcttcagggtccccttgatttgcttgagatggttttcgcgaagggagacccgggaatcgcagctgtgtacgacaaattgctagtggctgatgatttgcaatccttcggcgagcaactgaggaagaactatgagg

SEQ ID NO: 1228 - DNA, 269 bp, Zea mays
  misc_feature: Incyte ID No: 700550580H1
tgtaaacaagaacaatgtgaatgttacgaaatcttgtttgcctgatgagtataagcctgagaagtggatgttagctgatctggagtcaagggcgttgagccaactgaaccttgcaatagtcggtcatgttgattccggcaagtcgacactatctgggagattactgcatctcttaggaaggatatcaaaaaaatatatggcacaagaatgaaaaggagtcgaaagaaaaggggaaggggtctttgcttttgcatgggccatggatgaga

SEQ ID NO: 1229 - DNA, 278 bp, Zea mays
  misc_feature: Incyte ID No: 700550582H1
  unsure 49, 53, 117, 191, 270: a, t, c, g, or other
gactagttctagatcgggcgctacttgaagaagggccgctacgcgcagntgtncggcaccggcgcccccgtctacctcgccgctgtcctcgaatacctcgccgctgaggttctgganctcgccggtaatgctgccagggacaacaagaaaacttcgcattattccgcgccaagtgcttctggcgatccggntacgacgaggagcttgggaagctgttgggcggcgtgactatcgctcacggcggtgtgctccccaatatcaacctgttcnggtggcca

SEQ ID NO: 1230 - DNA, 270 bp, Zea mays
  misc_feature: Incyte ID No: 700550584H1
  unsure 253: a, t, c, g, or other
actgaaacctcctcacagttttgatgcttgtttcatggacatacagatgcctgaaatggatggatttgaagccacaaaaaggattagagtgatggaaagagatctaaatgagcaaatagaacgtggagaagccccaccggaatgcgcagggctccggcagtggcgaactccaatattagccatgacagcagatgttatccaggcgacgcacgaacatgcttaaaatctgaaatgggacggttatgtatcccanccattcgagggcgagca

SEQ ID NO: 1231 - DNA, 251 bp, Zea mays
  misc_feature: Incyte ID No: 700550585H1
  unsure 103, 129: a, t, c, g, or other
gagtgggagacccgcgagaggctgccgtgtagggaccgtagactcagcgactgcgaaggagggataaggggatggccgggatcggaccgatcaggcaggactnggagccggtcgttgtgcggaagaagncacccaccgccgccgccaagaaggatgagaaggccgtcaacgccgcgcgccgcgccggtgcggagatcgataccatgaagaatacaacgctggtacgaacaaggcggcatccacggtacatc

SEQ ID NO: 1232 - DNA, 266 bp, Zea mays
  misc_feature: Incyte ID No: 700550586H1
ccaagatcaccttgtggcctggttgaacggaccctttcacccaccttccacatacgtgtttgttgcattaatgatggctcagattgaggtccttaggaagaagggccactcttactcagagataattaacgagagcctgatcgatccgtggactcgttgaacccgttcatgcatgctcgcggtgtggccttcatggtcgataactgctccacaactgctcgtttgggatctaggaaatgggcaccacgcttcgattacatcttgac

SEQ ID NO: 1233 - DNA, 272 bp, Zea mays
  misc_feature: Incyte ID No: 700550588H1
  unsure 102, 104, 116-117, 150, 233, 236, 238, 241, 246, 252, 254, 256, 259, 261: a, t, c, g, or other
gtgatgaagaacatgagtgtgtgtgttgctcatcgcacctccagatgcaccacgaccaacacacacactcatgttcttcatcacaagctaaacacactcccncnccagatgcacgnnaagaacacgagtgtgtgtgttggtcgtggtgcntctggaggtgcgatgagcatgtgatgaaaaaaaaccaaacggctctatggtgatgtatgcaaaaagttgctttcgaacttganaananaanacaanaaaaanananaancntcagagggggg

SEQ ID NO: 1234 - DNA, 266 bp, Zea mays
  misc_feature: Incyte ID No: 700550589H1
  unsure 35, 40, 96: a, t, c, g, or other
ctagcacctcccgccatgaacaggaagctgctgtncatcnacgctacaggactctgagcgttgtgaatggctgcctcccgcagcacagcgcaacanagcgcgtcagagttctcttatgagccacgatacatggcttcgcgattctttgcgcttgtagtttacgtccgcccattctttccctattgcattggtgagtagtagcctcaggtttgtagcgggactcttgttgtttattgcttgtgagcccctagctttctggttgcctg

SEQ ID NO: 1235 - DNA, 265 bp, Zea mays
  misc_feature: Incyte ID No: 700550591H1
gaatctgatatcaagaaatcatataggagactttctattcagtaccatcctgataaaaatcctgatccagaggctcataaatacttcattgaatatatatccaaggcatatcaagcattaactgatcctatatctcgtgagaatatgagaaatatggtcaccctgatgggcggcaggggctgcaaatgggcattgctttgcccaagtttttactaaatattgatggtgcatctggtgggataatgcttcttggaatagtcggatt

SEQ ID NO: 1236 - DNA, 113 bp, Zea mays
  misc_feature: Incyte ID No: 700550593H1
gtaaaataggagtgctagcaaatagagaaacctcagggttggctttgttgcaaagatatgtgtatgttgttttaaagctttataagtttcaactgggcagatactgccagttg

SEQ ID NO: 1237 - DNA, 267 bp, Zea mays
  misc_feature: Incyte ID No: 700550594H1
  unsure 37, 78, 98: a, t, c, g, or other
ttgtcatgtgggagttgcttactggggaagagccacncctctggcatgcgtgctgctgaaattattgggggcattgtnaacgattccctacgtcctcnaattccttcatggtgtgatcctgagtggaagggattgatggaaagctgttggtccagtgatccagctgagagaccgtccttcacggatatatctcaaaggttgaggaaaatggccgccgcaatgaatgtgaagtaaaggtccggaagccatatttgtcttgtatgtgtg

SEQ ID NO: 1238 - DNA, 262 bp, Zea mays
  misc_feature: Incyte ID No: 700550595H1
  unsure 21-22, 42, 58, 65, 87, 96-97, 102, 105, 117, 123, 131, 140, 150, 162, 169,: a, t, c, g, or other
aaaattgtcagacctgtgagnnaagaagcttaaaataaaganagttttcaatatcctnggtcctnctactgaattccagcaagggtncctcatgcnnttatnggngtttaccatgcnaatatngttaccangatggctanggccgctagnaatttggctgangagagcnttggncgtccattcaaagggtactgctgctacatgcgtncttgngcccgatncngnnncccagncgaccgnnnaacacgggttgcanntatgg

SEQ ID NO: 1239 - DNA, 267 bp, Zea mays
  misc_feature: Incyte ID No: 700550596H1
attattgctttggcttacatgttagaagctgagatccatgggagtagccatttgcgggagcaccctcctcctctgcttgaggtgaatgtcagaaagctgtcagaagctccactgcctggttggggctctaatgtgcctaacctgaaagagtgggaagaattggatcagatgtcagaagctggtggagatatcaattctagaatacttcctctgaaggacattgagaatcaagatctcccgatgagcgagaccaacatgtgtgtgagg

SEQ ID NO: 1240 - DNA, 285 bp, Zea mays
  misc_feature: Incyte ID No: 700550601H1
ggatcactgtcaaaacaggaacttggtgatggcatagaggggactattccagcaactataggatctgggggtctggatgcacctccagaaattccccaacctgaggtggtggtggcaacaacagcaatcacacagtttaacaaggacatggaggatgtgttacctccagcaattgaggatggtgcactacaagcaaccctcgaacatgctgttggcatactggagttacacctggtgatggcttggggaatgttgcaccttcttcaggtatgacatggagttatc

SEQ ID NO: 1241 - DNA, 283 bp, Zea mays
  misc_feature: Incyte ID No: 700550602H1
  unsure 255, 266: a, t, c, g, or other
aaattatttaggctagtgagcacttgcgggaggctcctcaatgactaccaaagtttagagagggaaggcaaccaggggaagctgaatagtgtttctctacttgtgctccacagtggtggttctatgtccatagaagccgctaaaaaggcaatgcagaagtccatagacgtgtctaggagagacttgctaagattggttctcaggaaagaaagtgctgttcctaggccatgcaaggagctcttctggaagatgtgnaagatacttcnctgttttactctcagaa

SEQ ID NO: 1242 - DNA, 283 bp, Zea mays
  misc_feature: Incyte ID No: 700550605H1
agcgagagcttctgcataagaacaacaaatcaaaagcgtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaggagttcagctataacaagatcctcaagatctgaagaaggatt

SEQ ID NO: 1243 - DNA, 282 bp, Zea mays
  misc_feature: Incyte ID No: 700550606H1
gctggagccatctcccctctctccgacccccaaccatggatgaggcgcaagttgtggagtcaaaggatggaaccatctcggttgcttctgcatttgctggttatcaggaagctgtgcaagacagggatcacaaattcttgacaaaagcagtggaagaagcatatcgaggagtcgattgcggtgacggaggtccattcggagcagttgtcgtctgtaatgacgaatagtagtcagctgccataacatggttctgaagcacactgacctactgcgcatgctgaa

SEQ ID NO: 1244 - DNA, 284 bp, Zea mays
  misc_feature: Incyte ID No: 700550608H1
cagctgcattgcagggtattgatatcaaggaaatgctagctggtgcagctttaatggatgaggaaacccggaacactgtggttaaagaaaatccagcagcattgcttgcattatgttggtattgggcatcagaagggataggcaataaggatatggttgtacttccttacaaggatagtttgttgcttttgagtagatatttgcaacaacttgtcatggaatctcttgggaaagaatttgatctggatggcaaccgggtaaatcaaggctatctgtatatggaa

SEQ ID NO: 1245 - DNA, 284 bp, Zea mays
  misc_feature: Incyte ID No: 700550609H1
ggccggaacccacctgctgcgcacctgcaagcctcgagtggagctcttccacggccgcggtggagatggcggcgaatctggaggacgtgccgtcactggatctgatgcacgagctgctccgccgcatgaagtgcagctccaagcccgacaagcgcctcatcctcatcggtccacctggctctggaaagggaactcagtctcctattatcaaggatgaatattgcttgtgccatttagccactggtgacatgctgagggctgctgtggggccaagacacctctag

SEQ ID NO: 1246 - DNA, 141 bp, Zea mays
  misc_feature: Incyte ID No: 700550611H1
cgttatttcctgatcaaataattttgcctatggcacattctgtggaaactttgacggatctttgcctgcttttctatgtgatgtaagctgctgaaacctgcactcatcaaatgttgtgtatgcagatggtaccatgcattt

SEQ ID NO: 1247 - DNA, 285 bp, Zea mays
  misc_feature: Incyte ID No: 700550614H1
aaaagaacagtacaccatacaagataacaaataaagtgaatatgcatcaagtatgacattcgataacgcatttgttatggttagaaagaaacgggaaaggtctcgcagggggttaaatcttatgcactaatgacacaattggtttttaacaaaataattctgttatatatatttatatatactaatggaaacctaatcacttttagttgatcaacattgcacagggtaaacaattaactacgtgaatcaatagcataacggaattttaattaaacttcctatttt

SEQ ID NO: 1248 - DNA, 288 bp, Zea mays
  misc_feature: Incyte ID No: 700550615H1
catcaggaaggaatatgctgctcgtgctgcatcgtatgaggaggcagaaaatactaaacatacagcaagattcaaaaaagaagaggtgaagattgaagcttgggagggtcgtcaaagagcaaaaattgaatatgaaatgagaagaatagaggaatttgctgagagaatgagaagtgaggccatggaaaagatggccgaaaagctagagatgacgcgccgcatagccgaagagaaacgagcttcggccaacgccaaaatgaaccagcaagcactatagcggttcagaag

SEQ ID NO: 1249 - DNA, 203 bp, Zea mays
  misc_feature: Incyte ID No: 700550616H1
  unsure 36-37, 44-45, 48, 61-62, 89, 135-136, 169, 172-173, 175, 180, 183, 186,: a, t, c, g, or other
atcatgtacatattatttggaaatgatctcgtcacnnccccacnngtnctgcattccaggnntactcagtgacaacttatagaactcancttcctggaatgcagaacttatgggctgtgacgagatcatgtacannttatttggaaatgacttttttgatgccatcganaannanaaaanaanggncggcngcnnnttgttnc

SEQ ID NO: 1250 - DNA, 280 bp, Zea mays
  misc_feature: Incyte ID No: 700550617H1
  unsure 75: a, t, c, g, or other
gatatgtctgtaaggaggatgaaatattgttatattggattaaatagagtattggaggtccaagttttggagctnctttgatagctcatttatgtagactctcaaagattgcagtttgttccaaggtagttctgggtaaggtgctctgggtaattaatcgcttagaggatctgtgtgctgatgggtcctgtgaactgtctgacttcagtggagaaattaagaaggcctgtgataccaaccgtattggcgataatctgattggcacatcaacaatttgttt

SEQ ID NO: 1251 - DNA, 278 bp, Zea mays
  misc_feature: Incyte ID No: 700550619H1
attgaactttatagtacacttagtatcattacattggtccttttaggatggagggtgaactattagagttattattaagatggtggatgttagctacgctttcatggtggatgtttactatgttttgtcatgtaaacaactgcatgtctttaaatttgtctatcagtataaatagtcactgcacatgcttaataaggttagattacaacatctggtgcagtcctctccatatctgatatttttctgttgcatcgatagccccatggttattaaaaaat

SEQ ID NO: 1252 - DNA, 284 bp, Zea mays
  misc_feature: Incyte ID No: 700550621H1
  unsure 162: a, t, c, g, or other
cagaagcgctgaagcagcgcgtttgcagactgcaaagacccctgtgaatttgtgatgtactgaggtgttgtccagccaacagtccttgctcccaagattcttccgtactcccccctccatcggaccatcctctaccatagatctcccgaactccgccgtaanccggacgaatcccgcgcgtgctcttgctccctgtcgttctccgcggccggcgcgagtgccggtggttcgttgccgtcgacctcgtctggccgctcctctgccctgccagctgccggattcct

SEQ ID NO: 1253 - DNA, 282 bp, Zea mays
  misc_feature: Incyte ID No: 700550623H1
  unsure 248: a, t, c, g, or other
ccttcagaaactgaagaaagaacaggaagaagagcaaataaagcgattggagaggctcaaattggagcggcaaaagaggatcgccgcaagaggtaatggaaagggtccagggaatggttctcctaaagcgaatggtacgaatggactcagtaaatcagttccaaccttcactgggttgaaaaaggagaaaaatggaacaactgaatcactcagcgatcgactgaagaggctttctgaacccaaaagcntgctggggcagagcattcttgatccaaagtcaat

SEQ ID NO: 1254 - DNA, 281 bp, Zea mays
  misc_feature: Incyte ID No: 700550624H1
gagaaagtgggatgcaggtgctatagcgaaggctattgagaataatggagggggttggcatgggtttggttggttggggagagggaaatggacagtggcacactcaaatatcaacgagaatggtgtctgccttgcttgtggagaaaagctggctattatagatcttgacccaaaagaaacagaagattttgccacatttgtggcaaaattagctattaagagagagaggaaatcgaactttgagaacttccagaaatggctgaaagcatgggcctttgagg

SEQ ID NO: 1255 - DNA, 279 bp, Zea mays
  misc_feature: Incyte ID No: 700550626H1
  unsure 263: a, t, c, g, or other
gatatgtctgtaaggaggatgaaatattgttatattggattaaatagagtattggaggtccaagttttggagctttctttgatagctcatttatgtagactctcaaagattgcagtttgttccaaggtagttctgggtaaggtgctctgggtaattaatcgcttagaggatctgtgtgctgatgggtcctgtgaactgtctgacttcagtggagaaattaagaaggcctgtgataccaaccgtattggcgataatctgattgnaacatcaacaattgtt

SEQ ID NO: 1256 - DNA, 282 bp, Zea mays
  misc_feature: Incyte ID No: 700550629H1
tgctaacaaatcctggcttcaaaggaatgctgaatctatgggattgattttggatgctagtgacagtgaagaagaccatgtgcagggacacaagaaacgaaaggctacttctgcacatctccaaaagcttcaacaggagttgagtgatctcttgcaatgcccattgcagcctaagactttttctcgacgctatttggctggggctggtgtctcgccattacttcagaagcaactagaagagttggccaagagaaacgcaagcaacatagcagcaagagtaag

SEQ ID NO: 1257 - DNA, 280 bp, Zea mays
  misc_feature: Incyte ID No: 700550630H1
  unsure 274: a, t, c, g, or other
attgttcttgcttcccgatttccagtcctctgtcgtttgttgtcccatactcccatctgttctccgcgaggcgcaacgaaggcacaaaacccttacctccatcaaaccctagcgctcgtgtccccgtttagctcccgtcgccgctaccatgggctcagatgcggatatggaggactacgggttcgagtactcagacgaggagccggaggagcaggatgtcgatatcgagaaccagtattacaatctaaaggtttggttgagacaacccagaggntgcatt

SEQ ID NO: 1258 - DNA, 285 bp, Zea mays
  misc_feature: Incyte ID No: 700550632H1
  unsure 44, 242-243, 268: a, t, c, g, or other
attgtggtttcatccgtcatcagtggcaatccattatctttgangaatcaagcttactccttgtgctctctgccttctttctcttccatttgagatatatttggatagagagcacaaggagtaagcttgattcttcaaccttttctgatttgtaacttcaattggacagatctcttgtgagattgaccaggataacgttaatgcagtctgtttgaaattaggaacttttacatggattattnngagtgataccaagtgtgaggctgantattggtaacagctcta

SEQ ID NO: 1259 - DNA, 280 bp, Zea mays
  misc_feature: Incyte ID No: 700550633H1
  unsure 38, 75-76, 234, 256: a, t, c, g, or other
gaagaaaaccagaacctgaagaaccataacttgatgcngtcggtggagcatgataacctgaaagcacttccatcnntaacttagatattgagtgctgtcaactgaaggcaaccattgcagaaaccaaagctgaaaatgaatcattgaccacagaaaatcattcagctgaaagaaaactccagcattgagggtagaaatagatggcttgatggctgagaccacagtgataatgancaatcggacaaggaacgtagtnctgcagcaaggaaaagaaggctcc

SEQ ID NO: 1260 - DNA, 269 bp, Zea mays
  misc_feature: Incyte ID No: 700550635H1
ctcgcctctcgctgtctcgcctctccaagacacccagatcgccgccttcgactacaggcaccttgccgcctccgtccgctgcccgtggcttccatccacctccacctcactcacccactacatcgccgaccaagcgcagcaccgcgcgtggaccagacgccgcccgtggcttccgtggaccagacgccgctcgtggcttccgtggacgcagcaccgtgcgtggaccagccgctgctacatcgccgaccagggtactaacaaatgggttt

SEQ ID NO: 1261 - DNA, 276 bp, Zea mays
  misc_feature: Incyte ID No: 700550636H1
ctctaaaatttcccccactcgccagtcgcagcagcacctgtagcagccatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagccgtgggcactggcgcccccgtctacctcgccgccgtcctggagtactcgccccgaggttctggagttg

SEQ ID NO: 1262 - DNA, 277 bp, Zea mays
  misc_feature: Incyte ID No: 700550637H1
ggcaggggcattgacattgagcgtgtcaacattgtgataaactatgacatgccagactcagctgatacttatttgcacagggttggaagggctggacgttttggcacgaagggacttgcaatcacctttgtttcctctgcttcggattctgatgttcttaaccaggtgcaagaaaggtttgaggtagacataaaggaactgcctgagcaaattgacacctcgacctacatgccatcataaatgggaaggacaactgagaaagaggaggataggggat

SEQ ID NO: 1263 - DNA, 279 bp, Zea mays
  misc_feature: Incyte ID No: 700550638H1
accggttgcgatccgccgccatcgcttcaagcagcgaaccctagccgccctcagcgacggattgcagatctcccagccatgacgttcaagcggaggaacggcggacgcaacaagcacgggcgcggccacgtcaagtacatacgctgctccaactgcgccaagtgctgtccaaaggataaggctatcaagcggttcttggtgaggaacattgttgagcaggctgctgtgagggacgtgcaggaggcttgtgtgcatgatggattgttcttcccaaattgt

SEQ ID NO: 1264 - DNA, 280 bp, Zea mays
  misc_feature: Incyte ID No: 700550639H1
  unsure 264: a, t, c, g, or other
tgtttatcctccagcaaacaccctaaaaaggtctgttcctcctcagcctgcatcaagtacaccacaatctgaagcaagtagctccaatcatcagtcacaaaaagaccaagaaatgcagtcccgaaacagcagcgatggtttagtgcctctgcctcttaatgcagatggtgctgttggttcaggaacaagcacaagggaccttgaaaattcacttcagaaggcacaagaaaactttattaagagccagattgagatgttacagancaactgcaaatggtgc

SEQ ID NO: 1265 - DNA, 220 bp, Zea mays
  misc_feature: Incyte ID No: 700550640H1
gtcaataacctgcttgacagatccttcgtcgactgcttgactttggttaaggttctcataactttctatatacctattatcttgtgtctactttataagtagcagtaaaaccttttgatgagtgtatttgttgaactaagacctactgtcttttcttgtgtggtaaaaaggcatcgtcctgcactgcttaaacgactcggccgactacggctttcagttc

SEQ ID NO: 1266 - DNA, 279 bp, Zea mays
  misc_feature: Incyte ID No: 700550641H1
ccaagaaatgtgcagaaggcagttctagaaggattgttttctcttggtagggcacaagtctcagactatatcctgaatgagaaaaatcccattgggtcgttgagactagcaagattgagaagtattctcgatgaaggcaaaagtcttcagctgcagttccctgcagaggatcttggcttccactatgcagaaggtgctctagttgttgaagctagttgtgagaagactcatgaaggagaaaaactacagcattctaagagggatcaagagagtacatcc

SEQ ID NO: 1267 - DNA, 279 bp, Zea mays
  misc_feature: Incyte ID No: 700550642H1
cctgcatttgtcatggtaatgcatcagatttgaagttcccctctgtcatgaaaatatagctttgaacaagatgtgtttattgcaaatttttcagcttagattccaaagatttgaaacgtcagcacactatgaatgagatttagcagggttgtagctatattgccttcaagtctatactggaaccttaattctttgcatgttgccatattctaccagtaggaaatagggaacacatccatagcttgatgccgttatgttgaatttgataggaaattgtaa

SEQ ID NO: 1268 - DNA, 277 bp, Zea mays
  misc_feature: Incyte ID No: 700550644H1
  unsure 61, 197: a, t, c, g, or other
gccgtcgtggcctccgatgggccaggggagtatcctgtggtcacggagtcgagggcgggcnacgacgccctcggcgtggtcgtcgtccccggcacggtcgcctacgtcaccaccggagggccggttcccgatggcgccgatgccgtcgtgcaggtggaggacaccgagcagctccctggcggacggatgggtccaanagggttaggattcttgcgcgggcctcccaaggacaggacatccgcagtgtgggatgtgacataagaaggattcgattgtg

SEQ ID NO: 1269 - DNA, 279 bp, Zea mays
  misc_feature: Incyte ID No: 700550645H1
gccgcctgtactgcatgaggtggggactggcctccaatgccaaattcagggagtgcgcttggaagaacctctacatacagagagatagagaggatatggttgaatttgtgaggaatactcctacagagttcaaggagtactatattcagatgcaggctgcaaaaaggagtcaagctccccgtccgtcagaagtcaacgacgacaaggttatgcttgataagacagtagctgaccaggtatctagttggaaaaacagccggggcttactgatgaagctgt

SEQ ID NO: 1270 - DNA, 281 bp, Zea mays
  misc_feature: Incyte ID No: 700550647H1
gaaggacggctcagggtcacaggaccaggggcacaggttgtggcccatgctgtcctacgcttgcggcgagctatgtgtgatcatgctgctctacgtggctgcctttgcatcccatgcagccacaaggctggcgcgcatctgcgggctcaggccaccatgcatcctgtgcacgaggctggaccgcgccctccatggaaacttgccatggttctccgcggacctggtctgttccgtgcatcggtccgaggtctcgtctctggctcatgcaagagccatggccg

SEQ ID NO: 1271 - DNA, 283 bp, Zea mays
  misc_feature: Incyte ID No: 700550648H1
cttgaccaatcttcacaagctctacaagaatcgactagagtgagccaagacatgggaattgaaacaccaattccgatcagcgtgaagctgagagatttgaacaacattttctgcagaatcgtgcatgctgcgcagacctccatttgagcattccagagactgaaactggaaaagcacgtcggcaatatcggcaacttctaaaccgttcgctaatggttgtctctgttggagctgctgttgcagttgttggattagctgcttatcggtttatgcagctcggaag

SEQ ID NO: 1272 - DNA, 278 bp, Zea mays
  misc_feature: Incyte ID No: 700550649H1
  unsure 143: a, t, c, g, or other
aagaagatctcccatttctttgccaatcaaaccattatgaatgctgtggagaaggcgaagaaagtccacatcgtggactatggtatatactacggctttcagtggccgtgcctcattcaacggctctctaccaggcctggtgncccctccgaggctccggatcacggcaatcgacacaccgcaccctggttttcgcccagcagagcgcatagaggagacgggaaggtatctaaaagattatgctgagaccttcaatgtgccttcgagttccgagccat

SEQ ID NO: 1273 - DNA, 274 bp, Zea mays
  misc_feature: Incyte ID No: 700550651H1
atcgcggtcccttactctggatcttttgaagtcataaggtacagactgaaacaaatatacgagagcgtggagtcagcaacagaggaatctgatgttccgacgttaatcgtgcatgaaagagtgacggttcgcctggattcagaaagttatgttacactgcagtggtcgtccgatcccatcagcgacatggtgtctgattctgtggtggctatggtcttgaacatcggtcgggaaggccccaaagttgttccggtcgagaagcggtgaagaccaa

SEQ ID NO: 1274 - DNA, 275 bp, Zea mays
  misc_feature: Incyte ID No: 700550652H1
gatacaggctgtggaattggtccacaggatctacctcatgtatttacaaagtttgctcatcctcaaagcggaggaaaccgagggtttaatggtagtggtcttggccttgccatatgcaagaggtttgttagtctcatgggagggcacatctggattgacagcgaaggaaccggaagaggttgcaccgcaacattcgtcgtcaagctcggcgtgtgtgacaacacaaacacctaccagcagcagctgatccctctagtatgccaagcagcgcagac

SEQ ID NO: 1275 - DNA, 278 bp, Zea mays
  misc_feature: Incyte ID No: 700550653H1
gagcagtctgcagtcgccgagccgcgtgtccgccgggccggcggtttaccaagctcaccaaaaatctttccaggttcgaggccgcccatgttcgcctgcaggtctctcctcgcaagggctagtcggctcactcggcctgcgattccaagcgccgccggttcgccgcttcgttacctctaccagggatcatattgtcgaaataagttggcctcattcgtgatggaaggggcgcaaggatcaagcaatgtgacaaaacacaataaaaggcagtctcctgt

SEQ ID NO: 1276 - DNA, 279 bp, Zea mays
  misc_feature: Incyte ID No: 700550656H1
  unsure 223, 258: a, t, c, g, or other
gtgcaacaagaagggcggcatacgtttcaccatcaacggccactccctacttcaaccttgtgctggtgaccaacgtgggaggcgccggcgacgtgcacgctgttgccgtgaaggccgagcgctcccccgggtggcaggccctgtcgcgcaactggggccagaactggcagagcaacacgctccttgacgggcaggccctgtccttccgcgtcaccaccagcgncggccgctccgtgctctccaacaacgccgcccccnccggtggtctttcggccagat

SEQ ID NO: 1277 - DNA, 73 bp, Zea mays
  misc_feature: Incyte ID No: 700550658H1
  unsure 9, 11-13, 19, 27, 48, 50: a, t, c, g, or other
acgtgcagncnnncgaggnggtccgcnattaacactggaaaacgttangncgagggcatgcctacaattgctt

SEQ ID NO: 1278 - DNA, 275 bp, Zea mays
  misc_feature: Incyte ID No: 700550659H1
gactagttctagatccgcctcgtctaaccaccaccacgagggagagttaaagtcgccagtacagaagagtgaaggggagagggttgctgggtccgattcggtgggctcatcgccgtcgggtccacgaattggtgcctaggagtctcgcgtgcttcggggacataatcgatggtctcgctgcggtgggttggtggctggagacctcagaattcgtcgtcatagtgcgagctcctccgcgtgtgcaccgtgcgccgtggccggggtgtctgcgctgc

SEQ ID NO: 1279 - DNA, 275 bp, Zea mays
  misc_feature: Incyte ID No: 700550660H1
gactagttctagatccgcctcgtctaaccaccaccacgagggagagttaaagtcgccagtacagaagagtgaaggggagagggttgctgggtccgattcggtgggctcatcgccgtcgggtccacgaattggtgcctaggagtctcgcgtgcttcggggacataatcgatggtctcgctgcggtgggttggtggctggagacctcagaattcgtcgtcatagtgcgagctcctccgcgtgtgcaccgtgcgccgtggcaggggtgtctgcgctgc

SEQ ID NO: 1280 - DNA, 235 bp, Zea mays
  misc_feature: Incyte ID No: 700550661H1
accaagcacgccgcgttgaggagctctttgggaagatctggccacctcccaatgtttaacaacggcgttgagagcaatagcaatgtgatttgcctggcaggctcacaatgctgcgcggaagacgctttgcttcttctttttggataatacacgaagcactcccgtgtttacgttgacttgacttgcagtgtgcattattctgttttttttttgtaattcaaatgattgctggatc

SEQ ID NO: 1281 - DNA, 280 bp, Zea mays
  misc_feature: Incyte ID No: 700550662H1
  unsure 44, 47, 137, 139, 230: a, t, c, g, or other
gaaaaagaaaagctatactttcaacattccggtatgtattcttngancagaaagtatagcttttctttttcttgggcatcgaggcaatatcccagaaaaagaaaagctatactttctggtcgaagaatacataccgncntgttgaaagcttggagaaatttattaatgtctctcgactcgattggtcctcgtgtttcaagataattcaggggatagcaaagggcttacangcttacataagcatcatattctctatatggattgaatccagccaacatcc

SEQ ID NO: 1282 - DNA, 280 bp, Zea mays
  misc_feature: Incyte ID No: 700550663H1
  unsure 129, 161, 167, 172, 175, 179-180, 190, 193, 202, 205-206, 213, 217, 228,: a, t, c, g, or other
actccatttctaacccaagaaacacctccctctccctcacacacatctcttgcctctcccatttcaaatctttggagaggaatctttgagtgagcttgagagctgcggttttgtggtccaatctcaaantctctcttgctcttcttcattcgagctttggnatacancgagntcnttgnnggttcaatanccntgggggttnaanncccaaancggntagggggcccntgggngtctccaaatcttgtggaagaccacaagaagtttgtattacccgcnc

SEQ ID NO: 1283 - DNA, 281 bp, Zea mays
  misc_feature: Incyte ID No: 700550664H1
gtggcaagtcgaagcaaagcaggagtgagaagaagagccgcaaggccatgctgaagcttggcatgaagcccatcactggtgtcagccgggtcactgtgaagaaaagcaagaatatgctttttgtcatctcgaagccagatgtgttcaagagcccaaactcggacacctatgtcatattcggcgaggcgaagatcgaggacctcagctcccagctgcagacccaagctgcagagcagttcaaggctcctgacctgagccaaatgatccgaagctgagacatc

SEQ ID NO: 1284 - DNA, 271 bp, Zea mays
  misc_feature: Incyte ID No: 700550667H1
  unsure 2, 56, 60, 64, 75, 154, 158, 173, 203, 206, 220, 225, 227, 245, 260: a, t, c, g, or other
cncaccgcctccgccgccgacaacagcgtagtgtagtgtagttccggagagggttnggcnaaantagtagtgatncgcaatgtcgacggaggatgcagttgtggctgaggtcccggtgaccgaagtgccagcggaggtcccggcggcacaggtngccnaggcgcccaaggcgnagaaggtgcccaaggagaagaaggcgcctnagnagaagaagccgtcngcggncntgaagccggcggcgcacnctccctacgctagangatgtagaggc

SEQ ID NO: 1285 - DNA, 274 bp, Zea mays
  misc_feature: Incyte ID No: 700550671H1
gggaaaaagaaagagctctgagattaaacaaggaacgtcgtctagcccaggtaaggaagaatgccgtcatgttggatgagtaacaaggtcacgaggaagggaaaacaacatcgatttctgtatctcatttcatccgggcctttgtctctgcctgtgtaaactattacaggcacatcccattgtctttgcctttgtctttaaggatactggagttttatagtgcatctaaccgatatgcaagttcgtgcatattgaacgtatatgatttgtggga

SEQ ID NO: 1286 - DNA, 272 bp, Zea mays
  misc_feature: Incyte ID No: 700550673H1
gccaaactaatggattacaaggatacccatgtaactactgctgttagatgaagacttcgaagctgtggtgggggatttcggtttggccaaactaatggattacaaggatacccatgtaactactgctgttcgaggaacaattgggcacattgcacctgaatacctttcaacaggaaaatcctctgagaaaactgatgtatttggctatggaattactcttttagagcttattacaggacaacgtgccttcgatctgctcgtcttgctaatga

SEQ ID NO: 1287 - DNA, 273 bp, Zea mays
  misc_feature: Incyte ID No: 700550674H1
gtccgcgtgcagaaggtcagaaagagatgcaaactggctgcagttttcgccgaggtcgaccgtgtactgaggccacagggcaagctgatcgtgagggacaccgcggacacgataaatgagctggagagcatggccaagtccctgcagtgggaggtgcggatgacctacaccaagggcagcgaggggctgctctgcgtcgagaagtcgatgtggcggcccaaggaactcgacgctagcacgtgaaatgtgtcgaggaaatgctaccacgtaggg

SEQ ID NO: 1288 - DNA, 274 bp, Zea mays
  misc_feature: Incyte ID No: 700550676H1
  unsure 17, 24, 28, 31, 105, 185: a, t, c, g, or other
ggggttccgcgacctcngcctgcnggcngangtcgcggaaccccaccgatggcggcgtccaggggcgcggtgacgttgggttccgcgacctctgcctgcaggcantctacgcggggtccgtatccgtcgctgcctgccgcgacggcgtgcagtggtcgctctaccccgacggctccgtacgcccncccgcgtggctcctccttcaatggcagtgcctggctgctgatgccagcgggggtgtgacggtgaaatctgcgacggggctggatcgtct

SEQ ID NO: 1289 - DNA, 274 bp, Zea mays
  misc_feature: Incyte ID No: 700550678H1
gtgatccaagatttcacttacatatacagccaaatgtgcagtctcaccaaaacatgagatttgcagaccatatgcaggatggtttgaaccatatgaatgataatagatttttaggtcagaaccatggtcctctatccccttatgtgcagattccgcaacaacccagaaactcgcaggttacaaatggtcactgggatgggtggagtgattcgagacaagggaatagcactcctatgtcagacatgtcgaggatattattccaagtgaagtgaac

SEQ ID NO: 1290 - DNA, 270 bp, Zea mays
  misc_feature: Incyte ID No: 700550682H1
  unsure 4, 37, 40, 50, 55, 73, 96, 110, 115-117, 154, 171, 215-218, 220, 222, 231,: a, t, c, g, or other
aagntccggaacacagtctcggaggcccttgaggacntcncggctctganactangacgaggatcgcgacganatctacactggcaaccggcacgnccttgtccatgtgnggtcnnnctgaaagctgaaactgcggggcggctttcaaccgtancacggtgatctggtctncacctgtgcgcgtattaacagctactagtgcctcacgtggcacnnnntnantggcacganananggancccccaagccactcagtgacagttcttattt

SEQ ID NO: 1291 - DNA, 268 bp, Zea mays
  misc_feature: Incyte ID No: 700550685H1
  unsure 29, 66, 171: a, t, c, g, or other
aggaccttgcagtaactatagagttatgngcaccagatacacagggaccatggtccgcacaaaganttgatgctcataactctatagttactgctagggctggaaaggaccttgtttccagcttggtgtctggattattgacaattggcccccgttttggcggagcaattnctgatgcagcccgatacttcaaagatgcatgtgataggggcctcacaccatacgagtttgttgaaggcatgaaaaagaaggaatccgtgtgcctggg

SEQ ID NO: 1292 - DNA, 271 bp, Zea mays
  misc_feature: Incyte ID No: 700550686H1
atccagaacaaggattgacaatgtatggtgtcacaaagactgctctctttggtctcacgaaggctcttgctggtgagatgggacccgatactcgtgttaactgtatagcccctggttttgttcctacacggtttgctagtttcctcacagaaaatgagaccattaggaaagagcttaacgagaggaccaagcttaagagattgggtactgtggaagacatggctgcggctgcggctttcctggcatctgacgaccatcatacattacggct

SEQ ID NO: 1293 - DNA, 153 bp, Zea mays
  misc_feature: Incyte ID No: 700550690H1
cgttatttcctgatcaaataattttgcctatggcacattctgtggaaactttgacggatctttgcctgcttttctatgtgatgtaagctgctgaaacctgcactcatcaaatgttgtgtatgcagatggtaccatgcatttgtttcaaaaaaa

SEQ ID NO: 1294 - DNA, 271 bp, Zea mays
  misc_feature: Incyte ID No: 700550691H1
ctatgaaggtggctactgcaaactgcacctcacattttcacgccatactgagcttaatgttaaggttaacaatgagcgaggtagagattataccaaggggaatgccactccaagcagtgatcaaccttccattcttggtcctcagccaataccaagcgttggtgctgctattccaccagcacagggtagtgttccttctgcagccaccaattcagtaatgccaccaggggatccatcagttgctctaccttctatccttccagtgagccac

SEQ ID NO: 1295 - DNA, 269 bp, Zea mays
  misc_feature: Incyte ID No: 700550692H1
gtcgacacttggctcgcgtcgagctcgtcgtgcccggtctgccgcgccgaggtggagccgccgccgccgacgggttgggctcagctcggttcgtgcaggagaaagtgcaggacgctgtgaagcaggaagccggcagctccactccggaccgggggatcggtgcctgtgcgtcgctcatcaagatgttgagcagggagaggccggcgccgcgaaggccccagggcgcctacgccgacgccggggacttggacgcttggaacggcagcagt

SEQ ID NO: 1296 - DNA, 213 bp, Zea mays
  misc_feature: Incyte ID No: 700550696H1
  unsure 2, 5, 46-47, 51, 143, 152, 178, 182, 191, 202-203, 205, 208: a, t, c, g, or other
gncantcgaactcgaatcctcatcagcctgtcgtggacgtcgcggnngcgncgtcgattgctcggctgatatccttgcccataaggctgactgaaagctcgcattgatcccgcggggcgagggaggcgtgcgaacgacgaaanactatcgangagagacgcgaggcccgatcgacttngatntatgagcanggctaattctnnangantccag

SEQ ID NO: 1297 - DNA, 218 bp, Zea mays
  misc_feature: Incyte ID No: 700550701H1
cactgagtggtggtcgccgtatgtgctgctctagttcctgatctgtttcttggcgatcgtggagtcctgaaaatgtattgtgtggttgggtgtctactgctggattgaaacgatgatgaaatggaatcgaattgattatatctgaaatgggagtcgaattgatgatatctttgtgtaatcctttgaattttatgaacatattgcattttgggactgtc

SEQ ID NO: 1298 - DNA, 301 bp, Zea mays
  misc_feature: Incyte ID No: 700550703H1
aatgcctacggtattgcatgcatgactgttatgcttgttactacattcttgatggcattaatagtcatctttgtttggcaaaggaacataatattttccctagttttcctggttttctttggatccattgaagctgtatatctttcgtcatctctcatgaggttcctcagggaggatgggtgcctcttgtgcttgcattcatattcatgtcagtcatgtacatctggcactatgggtcaaggaggaagtaccagtttgacctacagaacaaagtatcaatgagatccatcctatctctcgg

SEQ ID NO: 1299 - DNA, 299 bp, Zea mays
  misc_feature: Incyte ID No: 700550704H1
atgagattctgaactccccagacaaagcttgcaaccttgcaaagcaggcgtttgatgaagctatctcccagttagacacccttggggaggagtcatacaaagatagcactctgatcatgcagctccttagggacaacttgaccctttggacctctgacacacggaggatggtgctgatgagggcaaagaagccccgaaaggtgaggctggtgacggacagtaatcttgggagagcgcatattgttcgagcccatgttttagatgctctatgctgtcgaagctgaagctgtgccgtgcta

SEQ ID NO: 1300 - DNA, 298 bp, Zea mays
  misc_feature: Incyte ID No: 700550706H1
gcggtgtggatgaaaatgcagctggtgcatgtgcacagcttgtgtttgcacccatcgatgaatcttttgccgacgatgcgccactgctaccctcaggcttccgtgtcattccactggatgcaaagacggatccaccatcaggcacacgcacacttgacttgcatctaccctcgaggttggatctggtgggacaacgcgtgcttcgagtgacgcctccagcacctgcaacacaagatcagtgctgaccattgctttccagttctcatatgaaaatcacctacgagagagcgtcgcagcc

SEQ ID NO: 1301 - DNA, 296 bp, Zea mays
  misc_feature: Incyte ID No: 700550707H1
ctgacgtacatttacctgattgggtatgcttaaactgtgtgtctagagaaaatgatatcatgttaaaagaaaatgataccaatggttcctgggtttgtagtgaactagataatggttcctgtgggaaaacttcagccctttgtatgattttgaatcacccggacttgatgttacacaaaccacatctgtacctgaccggttatcttcgtcttttgagaaagaaagtgaaaatgtggcaacaagcagtgtcaaagagacaaaaccttttggctcagctgtttgtgaggttgacagaa

SEQ ID NO: 1302 - DNA, 288 bp, Zea mays
  misc_feature: Incyte ID No: 700550708H1
aatttggtactataacaatcacagcattatgggttggtctttaaaacaacatagcattcactgatagcccactgttgtctctagactagacttctagtgaagctgtatggcctactttatatacaaaaacatgacagtgtaatactaattatgtcattttcgcctagtgtttcttatatgaccaccaagatgacccctggaataaatgtttgttgacattatgcctctctaacaatatgttgttttgtatggtacctcacattatctcaactttagaactgggtgtag

SEQ ID NO: 1303 - DNA, 299 bp, Zea mays
  misc_feature: Incyte ID No: 700550709H1
agtggaaatgcataataaatgttgtatctatgagcaaagaaagatgtgttccataggagtcaaaatgaagcagttggtcatatttaggtcgctgaactgctagctatccacttgacacatctaacagtaaaaatcctgcagggctgtttgttttgctgtgcagcaatactcattgcattgattgcatctagcccaacaaaaggctggagtggtcgcagtttgagtctgctggatccaacctatgcaagcaagtacatccctataattgctagtgtgagcgaacaccaaccaccaactgg

SEQ ID NO: 1304 - DNA, 298 bp, Zea mays
  misc_feature: Incyte ID No: 700550711H1
agatgaagaagcacagaaattcaagaaaaaaatagaagaaacgcgagatcagttggctgatgcactatatcaaaagtgtcttgcattggctgagattgaatcactgaagtctgatgagtcaattgaggtatctgctaaagatatttttgaggagaattcaaagaattgattaaatgggttgatgtcaaatctgcaaaatatggcacttcgactgttttgcgtgaaaaacgctgtggaagacctggtacagcattgaagatctaaatgatttgattccaaatgaatctgaaccaagaaa

SEQ ID NO: 1305 - DNA, 174 bp, Zea mays
  misc_feature: Incyte ID No: 700550712H1
cgttattagcgtggtgaacattgatctctggagcggactggaggacgtagtactgtctccaactgttgtaacgtgacgttgtttgtgttgctgccttgtgttattgaacttattatgatccataaataaaagccataagcgtggcagggtcattccctgccaccttcaggcacc

SEQ ID NO: 1306 - DNA, 303 bp, Zea mays
  misc_feature: Incyte ID No: 700550713H1
gaaagctcgtattgggaactacagttccagtactccaaagtgtactccagaaataaacaagagatgttttgctgctcttgttcgccataacattgatttaatctacttgaagaaatctttggttgtggatctactaagggagccggatacatttggcagcaagttattggctgttttgtgagaataaagattgatctcaacgattatagtttctacatgcataaaaaggtgcaccaacatagaaagttgtatcagcttggactagtaacaggcaccagtaaatcccctgaagaatacaagata

SEQ ID NO: 1307 - DNA, 165 bp, Zea mays
  misc_feature: Incyte ID No: 700550714H1
atgtaaatctgtacagattgtaatgaatcacgtggtctataatctggcaagctgaatttgccttccaacagtgattgtctgatcctaaccggttctcagcacaggtagagatgggaaccggttaggatcagacaatcactacctgtgctgagaatattgtagcgc

SEQ ID NO: 1308 - DNA, 304 bp, Zea mays
  misc_feature: Incyte ID No: 700550715H1
  unsure 218: a, t, c, g, or other
gatgaaactgctgaggaaaagggatgttcctgatgagaagtacaccaatgccttccttggctttgggccagagaacaccaactttgcagttgaattgacatacaactatggcgttgacaagtatgacattggaacgggctttgggcatttcgcaattgctaatatgatgtgtacaagttagctgagaatatcaaatccaagggtggtaagatcacccncgaacctggtcctgtcaaggaggatccactgttatgccttcgcacaggatcctgatggctacatgtttgagctatccagagggctg

SEQ ID NO: 1309 - DNA, 306 bp, Zea mays
  misc_feature: Incyte ID No: 700550716H1
  unsure 123, 164, 197-198: a, t, c, g, or other
caatggtaatgtgatgggtgctgtagagacttgcatggagacattccattaccattgaggttgatagtgaacaattctgacaagtccttctgaacaacaatatcaacctcaatggtaatgtgntgggtgctgtagagacttgcatggagacattccacagattnataagtatcttaaccattcccaccctctaatcnntgctcattttgaccctgatgcatgcggctgggcattggtatgaacgtgcttgatctggttgaatggaggaacaagaatgtgacaggcatatatcatatggcaggagcg

SEQ ID NO: 1310 - DNA, 300 bp, Zea mays
  misc_feature: Incyte ID No: 700550718H1
cgcagttggtagggttctagccatggcgtggagcgccgccgccgtctccaggttcgcagccgcctccccacccgcggcacccatactccgtcaggcttggagccgccgcttctcgctcgtccctgtccttctccagtgggcgccgacgccccgtggccggtccctctcgacctctgccaccgctgtaaaggaggctgttcagacagagaaggcaccaccagcactaggcccttattctcaggccatcaaagcaaataatcttgtgtttgtttctggagttcttggcttgaatcccgagac

SEQ ID NO: 1311 - DNA, 299 bp, Zea mays
  misc_feature: Incyte ID No: 700550719H1
gtggcaagtcgaagcaaagcaggagtgagaagaagagccgcaaggccatgctgaagcttggcatgaagcccatcactggtgtcagccgggtcactgtgaagaaaagcaagaatatgctttttgtcatctcgaagccagatgtgttcaagagcccaaaccggacacctatgtcatattcggcgaggcgaagatcgaggacctcagctcccagctgcagacccaagctgcagagcagttcaaggctcctgacctgagccaaatgatcccgaagcctgagacatctggcctgggcctggagg

SEQ ID NO: 1312 - DNA, 297 bp, Zea mays
  misc_feature: Incyte ID No: 700550720H1
  unsure 273-275, 289: a, t, c, g, or other
gaaagatcccgcggcgcagcagccacccttctctcctctccgctcccaatctttgtcgtcgcctccctcgaagtcgccgctgccttcattccaccatggcgcttcacgccccggtcctcgtgatgaaggactcgctgaagcgggagtctggcgcgaagttcacaaagccaacatccaggcggccaaagctgttgctgacatcattcgcactacattgggtcccagatccatgctgaaaatgcttctggacgctggacgctggtggccttttannnaataaatttgtaantatatccc

SEQ ID NO: 1313 - DNA, 295 bp, Zea mays
  misc_feature: Incyte ID No: 700550722H1
cctgtatctagctctcagtggtcttgaggctggtatccagggcagtgctaattcaaccaacaacaaagccttgggtactgttcttaatcagcagttcatcatacagcttggcttcttcactgcattgccaatgattatagagaactctcttgaacaggtttcctacctgctatctgggatttcttcacaatgcaaatgaatttttcatctgtgttctacacattttccatgggaactaagagccattactatggccggacaatccttcaggtggtgcaaaataccgtgctactgg

SEQ ID NO: 1314 - DNA, 296 bp, Zea mays
  misc_feature: Incyte ID No: 700550724H1
  unsure 72, 223: a, t, c, g, or other
ccgagagagcagaggcgctcagcacggagcgagtccggagcatagcaacctcgctgggctcgggcccgcggngccgggatatactccagggaagtcgagcaaggagagcgtggattgtggactacaggggtaaagatcgagtgagcatcgctgcacatgcgcccttctatctgctgtgcacctctttttcttctgctactattacatttggcatttgctaganctctctttcctctaccgagtaagacaaagaatgaagagaagaagcccatacagacgtttcggccatataacat

SEQ ID NO: 1315 - DNA, 297 bp, Zea mays
  misc_feature: Incyte ID No: 700550728H1
tggagaggatacaatctgaagatttggaatctacattagggttggctggttcagctgataggcattttgagttgtcacctgaggcgcgtgctcaggctgatttgaagtttacatatgtggttacctgccaaatttatggaaaacagaagggggaaggaaggctgaagctgcagacatagccttactaatgcaaaggaatgaagctcttagagttgcttacattgcacgaattgagaatgctaagaacggaaaacccatcaccgagtattactcaaagcttgtcaaagctgatattca

SEQ ID NO: 1316 - DNA, 301 bp, Zea mays
  misc_feature: Incyte ID No: 700550731H1
cttcaatgagagagttttgccttcaatcatccatgaaacactgaaagctgttgttgctcaatataatgctagtcagctgatcacacagagagagactgtgagtagggagattaggaagatactgactgagagggctagattcttcaacattgctcttgatgcgtctccatcacaagcctgagctttgggaaggagtttactcatgccattgaagcgaacaggttgctgcacaggaagctgagcgtgctaagttcatgtcgagaaagctgaacaagataagagaagtgcattatcagggctc

SEQ ID NO: 1317 - DNA, 174 bp, Zea mays
  misc_feature: Incyte ID No: 700550733H1
cccagcgccggcagtcgccgtcatcgatcgatcgccggaaaactaacccctaacgatgtctggagccggcgaggaggacaagaagcccgcggagggcggcgcccacatcaaccttaaggtcaagggacaggatggcaatgaggtgttctttcgcataaaaggtccacccagctg

SEQ ID NO: 1318 - DNA, 168 bp, Zea mays
  misc_feature: Incyte ID No: 700550734H1
  unsure 31: a, t, c, g, or other
ccagcgccggcagtcgccgtcatcgatcgancgccggaaaactaacccctaacgatgtctggagccggcgaggaggacaagaagcccgcggagggcggcgcccacatcaaccttaaggtcaagggacaggatggcaatgaggtgttctttcgcataagaggtccaccc

SEQ ID NO: 1319 - DNA, 295 bp, Zea mays
  misc_feature: Incyte ID No: 700550735H1
ctctgcgcctaattactgtgaccagatgggcaacaagggtgcatttattcgcttcacagctccagaaatgaaaccagatattgttactttctcagctgtgccacatcctgatgtgaagccgatggcatatgcaaataacttcctcaggatgtttaatgacagaatataacaacattgtttagcaattttaatcagatgagtctgttgtttgtcagctcccaattcacatttcttgctaggtttaagtatatgctcccttgtacaacaaatcaaatgatgcaagggatcaactgtc

SEQ ID NO: 1320 - DNA, 291 bp, Zea mays
  misc_feature: Incyte ID No: 700550736H1
  unsure 130, 181, 245, 269-270: a, t, c, g, or other
ctgccttctgcctcgcttgccagatctcttctctctgatggggggttcggtggtggaggacaaccacgacctcgaccacgacctcgacctcgacgatactcccttagcatctgcctcttctaaatcccancagcaattccatagcttcgatttcaggatacaagtgttctagatttgcggngctcatccatctttaacataacacgtatgagcaggagtatttattttgtcttaattaaagccangatcaacctcttgcttccctttgnnccatcgccatctcctacatac

SEQ ID NO: 1321 - DNA, 289 bp, Zea mays
  misc_feature: Incyte ID No: 700550738H1
  unsure 263: a, t, c, g, or other
tttgagagggttataagaggccttgtcgatggtgggttttcggaggaggcaaataaattctacaaaatgatgaaatcctgtggctttgaaccatcaaaaacaatcgaggtcgctgttaaggctctcaggattaggggcggttctcatcgcacggtaggtagagcctgtacgctggcagagtggcagtgatctactgggcacgcagtacaggcaaagagggattctggtgtgagaacctgtggcactgacacggtacaatcaantgacaaaactcatgctgaaagatggt

SEQ ID NO: 1322 - DNA, 290 bp, Zea mays
  misc_feature: Incyte ID No: 700550740H1
cttcaatgagagagttttgccttcaatcatccatgaaacactgaaagctgttgttgctcaatataatgctagtcagctgatcacacagagagagactgtgagtagggagattaggaagatactgactgagagggctagattcttcaacattgtcttgatgacgtctccatcacaagcctgagctttgggaaggagtttactcatgccattgaagcgaacaggttgctgcacaggaagctgagcgtgctaagttcatgtcgagaaagctggaacaagataagagaatgcaa

SEQ ID NO: 1323 - DNA, 298 bp, Zea mays
  misc_feature: Incyte ID No: 700550743H1
  unsure 11, 207, 212, 217, 233, 235, 258, 263: a, t, c, g, or other
cccagcgccgngcagtcgccgtcatcgatcgatcgccggaaaactaacccctaacgatgtctggagccggcgaggaggacaagaagcccgcggagggcggcgcccacatcaaccttaaggtcaagggacaggatggcaatgaggtgttctttcgctaaagaggtccacccagctgaagaagctgatgaacgcttattgtgcaccgcncagtnctgtngacatgaatgctcatncngttcctgtttgatggccgcagtntcgcngcgagcagaaccctgatgagctggagatggaggac

SEQ ID NO: 1324 - DNA, 291 bp, Zea mays
  misc_feature: Incyte ID No: 700550745H1
  unsure 95, 100, 141, 256: a, t, c, g, or other
agtactctctccgtcccaaaatattagttgtttaaactttttaacttttatgtctatgttcaaatagatgatgatgaatatagagacatatatanaatanatacattagttattgtatgaataactaaaaaggtaaaatanattttattttgggcggaggaagtatatatagagatagttcggtgagatcttctctgatatgcaatgtggactttctgttaatcaaagatgacattttgcataaaaagatcttgtntgtatctgaataatcacaggggatcacttttttgt

SEQ ID NO: 1325 - DNA, 298 bp, Zea mays
  misc_feature: Incyte ID No: 700550746H1
  unsure 25-27, 118, 121-122, 189, 212: a, t, c, g, or other
tcttattattttagttatacttatnnngatcataggtaaaactaaaataataagatctgaactaaggtttggtcaaagttgaagagttcaaatcttattattttagttttacctatgntcnncataagtatagttattggctggtggcagggagcttagctttctgtgtaccaactgctctcattcaanccttttacatctgaggtgatacnctcatgtactgtgcaccattgtaatcgtattttaagattctgtagccttcaaagtgcttaacatggatagctctcctacttaaata

SEQ ID NO: 1326 - DNA, 211 bp, Zea mays
  misc_feature: Incyte ID No: 700550749H1
agcgagatcagcaagtgccagttctacctagacatgctgaacgagtgccgccgtggtggtgtgtctgtctaagctgcctctgggattattcatggattttcttttcggatgggtatctcattaataagacaccgtgaaacttcgaccatctccaagcttgaaaccaaacttcctgggattaatttattttgttatcctatggtgttggaac

SEQ ID NO: 1327 - DNA, 292 bp, Zea mays
  misc_feature: Incyte ID No: 700550750H1
agagagacctgattgttatcgaggaactccagaagaacttatctcaagttaaagatgaaaaggtgaaggtcctgatggaattaacaaaactaaaagaacaatatttgctattgaagggctctgctgtcaaggaaggtcatgatactggtgatcatctaaactcattcctgggcatgaccaacaagggatgctgaagactatgctgaagaggacatctttaagacactggatgaggaaagaaagtaatactattggacatgggagctctgatggaaatgatcatacagtttgc

SEQ ID NO: 1328 - DNA, 290 bp, Zea mays
  misc_feature: Incyte ID No: 700550751H1
  unsure 184, 186: a, t, c, g, or other
ggatccttgaaggaaaatcgtgcatcagagcaagtgggcgctccaagtgatcaaaaggggagcggtgagccaaaacgcaaggtcatcaagcatagcaagcttgagaaggacaaagagttatttcaactagcccagcaataccacaaagtggtgcagaaagggatcaagccattgcagtcaaagntngactagaatctctttgtagggatttcagcgtcaaaacaaaatgctaaaggaagagtgccaaagggtatcgacagagggacagaacatgcgtacggattgtctga

SEQ ID NO: 1329 - DNA, 288 bp, Zea mays
  misc_feature: Incyte ID No: 700550752H1
  unsure 263-265: a, t, c, g, or other
attgtgaagcctgggtgctctcaggatgtccttaaggcggcgctgagcgccatgtcttctgtgacggagacactgaacatcatgacctcatcgtccaccggccagactgcactgtgactcgtttggtgccgttttgtggtgcggatcagatccccactttttccatggtgtcgattgacaaagttaggagcagtaatcctgtggtgcggatcagaatccccactttttccatggtgccacacgggtcatcttttgtagcttcnnnggagagttctatcagttttgaat

SEQ ID NO: 1330 - DNA, 288 bp, Zea mays
  misc_feature: Incyte ID No: 700550753H1
ggtgggctcgtccgagtctgccctgctcgccaagctgggtatccgccccttctcgtacggcctccaggtcaccagtgtctacgaggatgggtccgtgttcagccctgaggtgcttgacctttccgaggaggacctgattgagaagtttgcactggtgtctccatggttgcctccctgtcactggcgatctcgtacccgacccttgctgctgtgccccacatgttcatcaattcgtacaagaatgtgcttgctgttgctgtcgagacagactactcgtacccacatgct

SEQ ID NO: 1331 - DNA, 286 bp, Zea mays
  misc_feature: Incyte ID No: 700550755H1
tcggaactattcattaatgcgagagttggataaaagtttgcatggtgtgcaactagaaaatgagcagcgctgtcaacaagaaatagaggacattaagcatggacttgaatctggaagtattacatatgacccagcaaaattgaaattttcgaagaagcaatggaggagcagaaacattgtgttagaattgctgacgagaaggtggctttagccactacagactatgacttagttctgctgcataatcatggctcagacgcctctgcactgttgctaaatgtgatgt

SEQ ID NO: 1332 - DNA, 288 bp, Zea mays
  misc_feature: Incyte ID No: 700550757H1
  unsure 259: a, t, c, g, or other
gttgtgacaggaatactagaagccaagaaaagcgatggtggaatatatagggaaaaaaaaggagtcgagtgtcagcatagtgttagctcccttctgttctagtaccttttttagaggatagttctactaaaccacaagagaagaagatgcattagccttgattaagaaaacggcagcatatgcagtattgccagatataagtatatatattatatatacaaataatccagtgtcacccctagtttttagagagagatanatataaatagtatctgtactaatgtttac

SEQ ID NO: 1333 - DNA, 288 bp, Zea mays
  misc_feature: Incyte ID No: 700550758H1
  unsure 57, 150: a, t, c, g, or other
taatctcctaaataatctcaactaatcttctaatcttatctctaactatccttatcnaatcccccttagggcccatggctgctgctaccgcagcccctctgtgggcctccttaggtcctgacagtcgttttattctataggtgtttggtntcattcaacatttcttattgcaggtgaaggctgcagataatagagtgatacaagatcagctgaatgagaagataactgaatgcatggaatgcatgctgaagttactcatctcaaagaacagctgtcccaagctcttga

SEQ ID NO: 1334 - DNA, 291 bp, Zea mays
  misc_feature: Incyte ID No: 700550759H1
ctgctaatggtaattgcatacgacaaatggtcccgcatactgctacagaatggtgataaatctgctcgtacagttttgccattcattctacttgaatagtactgtgatgcacatgatcagggacatgcgtcttcagtttggtaccttgttacagacattggacttatagatcttcctaaagatactctgaggcacaaggtgggcagtagaaaaaataatctcgagagctggttttctaatatgtctcttccattcaatgcctatgctcgctgcacctcggttataagtcgg

SEQ ID NO: 1335 - DNA, 295 bp, Zea mays
  misc_feature: Incyte ID No: 700550761H1
  unsure 206-207, 209: a, t, c, g, or other
ctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggagaaggttttggtggactacttggtgaagttccgatggatcctcgtgatcttcnntngtccttcctatttcaactctgatctacttcaacatcttcctgggcgacatgtggtccgccatgaagtcggagaagaagcgccagaa

SEQ ID NO: 1336 - DNA, 295 bp, Zea mays
  misc_feature: Incyte ID No: 700550763H1
  unsure 291: a, t, c, g, or other
gtaagacgaacctattacacctaattagtccatgattcgctcgtgtgatgctacagtaaacatttgttaattatagattaattaggcttaataaatttatcttatcgtttagtcttcaattgtttaattaattttataattagattatatttaattatttaatggacattcaaacatttagtgtgacaaactttagtctctggaaccaaacactcccagtcataacctatggtctacaatcttagtccaaacagtgtgatctctgaatctggaggcagtattgcgaacggnaata

SEQ ID NO: 1337 - DNA, 297 bp, Zea mays
  misc_feature: Incyte ID No: 700550764H1
  unsure 247, 293: a, t, c, g, or other
gggaaaccgagttctcgacacgatgtccgccgggtggacggacgagagacacatgctgtatataagctccatggaggcttctttcgtcgaccagctatacaaccatggaaaccatccgcacgacgcaaatggcgccggcttcaaggttctccgcagggggtgtgggagtacatcaagtatgagaagaccagtgcccctgtgcgaatggggctaaatgctgcgtctctgcaaatccttggatccggcnttcaggccacgtgatgcggtagtaacgcacagagtgacgcgtcgangctt

SEQ ID NO: 1338 - DNA, 293 bp, Zea mays
  misc_feature: Incyte ID No: 700550765H1
gtaagacgaacctattacacctaattagtccatgattcgctcgtgtgatgctacagtaaacatttgttaattatagattaattaggcttaataaatttatcttatcgtttagtcttcaattgtttaattaattttataattagattatatttatatatttaatggacattcaaacatttagtgtgacaaactttagtctctggaaccaaacactcccagtcataacctatggtctacaatcttagtccaaacagtgtgatctctgaatctggaggcaagtatgcgaacggtaa

SEQ ID NO: 1339 - DNA, 288 bp, Zea mays
  misc_feature: Incyte ID No: 700550766H1
  unsure 150: a, t, c, g, or other
aagttgaaactttcggagcttacctgccgggaaggcattgttgaagttgcaaagataatttatggagtgcatgacgaagcgaaggacaaagcttttgagttggagttgagctggatctgtgatgaatcgaaccgtcagcatcagaaggtncaaatgaactgttggagcaggccaaagctgctgctcaggcagctacttgaggagatggatgctgactaagaaacaggacgattgcccagactggtgtttttggtgctgttgaaatctccgatcccttggggtgaccca

SEQ ID NO: 1340 - DNA, 289 bp, Zea mays
  misc_feature: Incyte ID No: 700550767H1
gttagatgaagtgttggaatgcacaacatcagtgtcttctggtatgacaagcagcttagtggaaccaagccaagttgatggtggttcttcatcttcagttacaaaagaagatgtttctctggacagcttggtgatgtgtcaggctggtaatcaaaaacaattgctgatgcaatctcctctaagttggctgccatacaccacgtatctcaagctatcaaatcccttagatggaatcgacagctgcagaataatactcagcatggttgcggggacagtgcagataccattg

SEQ ID NO: 1341 - DNA, 284 bp, Zea mays
  misc_feature: Incyte ID No: 700550770H1
agacaaggtcaccgtgcacgaccaggttgctcagaacctcaggaagtttgtgtcggagcaggattgcccgcacctgttgttctatgggccgtcggggtccgggaagaaaaccctaatcctagcgctcatcaagcagatgttcggcgcggcgcggagaaggttaagctggagaacaagacatggaaaatcgatactggaacaaggacatttgagatagaattggcgatgttgtcaatgctcaccatgtggagatgacccccatgatgctggctttcaggacaggt

SEQ ID NO: 1342 - DNA, 284 bp, Zea mays
  misc_feature: Incyte ID No: 700550771H1
catgaatatgttgccataaaagttgttcgcagtatccgcaagtaccgtgatgctgcaatgattgagatagatgtgctcaatcgccttgcagaaaatgaaaagtacagatctctttgtgttcaaatgcagagatggtttgactatcgtatcatatatgcattgtttttgagaagcttgggccaagcttgtatgattttctaaagagaaatagataccaacctttccctgtggaactgtgcgggagtttggacggcaactgttggaatctgtagcatatatgcaga

SEQ ID NO: 1343 - DNA, 286 bp, Zea mays
  misc_feature: Incyte ID No: 700550772H1
acgtcaaattctgaaggaccataaatttatatcggcagatttgtctttcataaaacgctatccgcatatagtcaatgaacaagagtgtgcttggtctgctcgggagaccactctccgtgagtccctagaaatgagcactactttggcaagaagaccatgaattcaaccagacctaatgttgcttctaaagggcctcattcaaatatgagcaagggcagggatggcccatctcaaggaagtgatgaccttgcgcgatctgttttgggcatgttttcactgccaataa

SEQ ID NO: 1344 - DNA, 277 bp, Zea mays
  misc_feature: Incyte ID No: 700550773H1
  unsure 139: a, t, c, g, or other
gccagtggtgagacacaacccttcagaggtcaaggtgccatcaccgaccaacaaactgatagataccatacctcaggcacgttggatgctcttagggaaaggatgaaaagcattcaagcggcagctataggtcattttncggtgctcaggctcggccgttggcaagtatgaacggaagtaatatggtgcatgggggaactcgattggaaggtgaaccccaacagcgaataatataccacccatggatgagcgagctctatctgggctgcaagcacga

SEQ ID NO: 1345 - DNA, 281 bp, Zea mays
  misc_feature: Incyte ID No: 700550774H1
  unsure 62: a, t, c, g, or other
gagaaggcacaagtaatgcaagtgatactcatagcaatgtatggtggttgcagagccatatncagggttcggattgttagtcagaaactaagcaagaggctgtacttgatgaagggtaaggttgtcgatgtggtggggcctacaaaagtgacatcatgatggatgatggatcagagttggtgcagggcgtggagcaggatatgcttgaaactgtactccacggacgaacgggcgggtgcttgtgctttatgggaagcacaaggtttatatgggcactggta

SEQ ID NO: 1346 - DNA, 288 bp, Zea mays
  misc_feature: Incyte ID No: 700550775H1
tctcatccgccgtgaccctgcccgaattgctgcccaaggtggcgtcatacatcctatcactcggtatgttatgaactatctccgagctgcgtgtgggtcgcggcagacattggaagaggtgatggaaggtgactttggggctaatggggtgcgcctgttgctgttgatcctgaccgttcccacatcatcccttgctgtgcacattgcttggatcatggatgttcttcaaaagaatctggatatgaagtctaagatctaccgtgatccatctcttgcttctatcttcta

SEQ ID NO: 1347 - DNA, 290 bp, Zea mays
  misc_feature: Incyte ID No: 700550777H1
  unsure 202-204, 206: a, t, c, g, or other
tgtcaattatttcactagttgctttccatttgcagacccggcatcctccaatattgcctgcgttctctgacttgttaaaagatgggttagattgcgaaagcattgagaggaatgctttacggtttagggattttgggagtagaaataaagatctgtcgctgaactgtttgtatcattgataagtaaactattgtcagcagannntnctatgggagcagggctgtgcgcaagcaattttgaagcgtcaggatctcaaagacctggaagaaaggagtaggcaattaagtgtt

SEQ ID NO: 1348 - DNA, 296 bp, Zea mays
  misc_feature: Incyte ID No: 700550782H1
  unsure 95, 138, 208, 236, 248, 251: a, t, c, g, or other
atggtccttgatgactggaagaggctatactcaaacacaaagactaacttccgggaggttgccatacaaaggtttctgggacatgtacgacccanagggctactctttgtggttctgtgactacaagtacaatgatgngaacaccgtctccttttgaccctgaacaaggttggtggattcctgcagcggatgggacctgtgccgcaantacgcctttgggaagatgctcgtgatangctctgagccanccntcaagctggaaggggctttagctcttccgtggccaggatgtccca

SEQ ID NO: 1349 - DNA, 272 bp, Zea mays
  misc_feature: Incyte ID No: 700550783H1
  unsure 81, 123-145, 237, 239, 270: a, t, c, g, or other
tcagcgttaataaaagccttgcgacgttccattgcaggtgaagaacaacagacccttcaggatggtcatagattatatctntttcttcttcttatatggagagagtattcctatgttagaatnnnnnnnnnnnnnnnnnnnnnnntgagtagttctgaaatctggacgccattcagcatgctcagatatttgagtagcatgtgaactgacccttaataaccccgcatactggggaangnagagatgaggccacgattggtgccttcatgncc

SEQ ID NO: 1350 - DNA, 123 bp, Zea mays
  misc_feature: Incyte ID No: 700550785H1
  unsure 4-5, 9, 17, 44, 61, 106: a, t, c, g, or other
gatnntttncatctggntaatctgtaaagccttgcaaatatatnatgagttcaatgttctntctggttcttgaatggaatctatattctttctgttgatgtactgnaacactcccttccctct

SEQ ID NO: 1351 - DNA, 283 bp, Zea mays
  misc_feature: Incyte ID No: 700550791H1
gatgcttgggagacagttggaagaaagaacaaatctgcaatagttagaacacatagttttgttccctctgagctaagtgctatttttggagggcagctacagagcgttgtgaaagctgcaggtaacaaagcatcagctactgttcaccctttctactgcttcatcttgatatattcccagatgctgttcagacacttaatgatgcacttcgtctgttctctacccctgaatcttggaaggatacagaaccactgctggaaaggctggtttggtgacagctaga

SEQ ID NO: 1352 - DNA, 285 bp, Zea mays
  misc_feature: Incyte ID No: 700550792H1
tctttggagatggttcacgactggtgttccgcctctctggaaccggttctgttggtgccaccatccgtgtctacatcgagcagtacgagagggactcctctaagaccggcagggattcacaggacgcccttgctccgctggttgatttgcgctcaagctctccaagatgcaagagtacactggacgctctgcccccaccgtcatcacataaattttgaagagtgttttagaatgagttgaggcgcttacacaaatttcattccggcctcttgttccatatttttc

SEQ ID NO: 1353 - DNA, 100 bp, Zea mays
  misc_feature: Incyte ID No: 700550793H1
  unsure 9, 90, 99: a, t, c, g, or other
aggcgatcncctgccctcaaggagaggaaggggtcgagctcggtggccatcagcaagtacgtccgaggggaagcatggcggcaagctccncacaaaatnc

SEQ ID NO: 1354 - DNA, 289 bp, Zea mays
  misc_feature: Incyte ID No: 700550794H1
gttgataatgtattggtccgtgttgcagatccaacattcctaggatacttcattgacagaggtgtatctgctgctgctaaggttgtcaggaaggcatatccacaagagaaagttggagtatttgttcagcgtggaaagggtggaccccctctgtagttgaatacagtgaaatggatgcagctatgacaactgaaatcaatcaaactactggccgccttcgttattgctggagcaatatctgcttgcatatgtttactttggatttctgaaccaagtgacaaacagtctt

SEQ ID NO: 1355 - DNA, 164 bp, Zea mays
  misc_feature: Incyte ID No: 700550795H1
  unsure 19, 36-37, 65, 68, 107, 152, 159, 162: a, t, c, g, or other
attggttttcctagttttngtacataaacatttggnntatgcgttagtgtactctcacattatcngcnatataacattacaattaagattcatcctaaattctggtnatttgaaagcgacagaaataaaacttgtagatgaattattgtctncataggnaanag

SEQ ID NO: 1356 - DNA, 304 bp, Zea mays
  misc_feature: Incyte ID No: 700550803H1
caacgaattattcaaaccgaaaacaatggagccggtgcggaagagcgtgtgcgtgaccggcgctggcggcttcgtcgcgtcggagctggtgaagctcctcctctcccggggccaatacgcggtccgcggcaccgtgcgcgaccctggtgctagcaagaatgcccatctcaaggtgctggaaggagctgaggaaaggttgcagcttctcaaggctgatctgatggactacaacagcattgcatcagcagttgccggctgtgagggtgtcttccatgtagccagtcctgtcctttcccatcgaccc

SEQ ID NO: 1357 - DNA, 305 bp, Zea mays
  misc_feature: Incyte ID No: 700550805H1
  unsure 292: a, t, c, g, or other
gtttttttcttggctcataggaataggataattgaaacagctcatctcatgagggatatgtattacaaaaggaacccaccagcaagaggttcaagctctaatatttcagtaaaaagttactttgagatgcttgccatggatgagcatgcatctgctttctctagaggacctgctgaagcttttcagtggattgggcacccaatgagggctaccttgtgccgtatgaagagtggtttaattttaactggagttggagataagattctccgcctttggtctgctgaaagctgcnaattcatgaatgg

SEQ ID NO: 1358 - DNA, 304 bp, Zea mays
  misc_feature: Incyte ID No: 700550806H1
  unsure 201-232, 254: a, t, c, g, or other
aaagaaccccctttcccctccccttccgctcgagtctgctctagggtttttgccaagccgccgtccgccgtcgctctgccttcgtatcccctcccacgacaccgagacaccaagatgacggcgcagaccgcggaggagctcgccacccagatcgagcagcagaagctcgaggagcagaagaccgaggcagaggaagttgtnnnnnnnnnnnnnnnnnnnnnnnnnnnnnnnnatgacgatgatgacaaggatgntgatgaatcgatggggatgccagtggcaagtcaaagcaagcaggagtgag

SEQ ID NO: 1359 - DNA, 300 bp, Zea mays
  misc_feature: Incyte ID No: 700550807H1
gttccagctagctaggagagagctttatttaggcggcggcaacaagatgaacaggaagccaggagactgggactgcagggcgtgccagcacctcaacttcagccgtcgggacgcatgccagcgctgcagtgaaccacgtggagttggtgatcgtagcggcggtggtggcgacttgggtgggcgtggtggttcctccttcggcggtggctttggtgctggctctgatgtccgccctggtgactggtatgctcctgcggcgcacacaattcgccagccgctccaactgcttcagtgctctgc

SEQ ID NO: 1360 - DNA, 303 bp, Zea mays
  misc_feature: Incyte ID No: 700550808H1
aaaccacagcccgtcaaatatcgaggagtggtgtatctgtcggacatgctcatccactacaatcagacgtctgacatcttgtattatgaagtgttggatataccactgccagaattgcagttcctaaaaaccctgaaagttgcatttcaccatcctacgaaggatgaggttgttattcatagcatcaggcttccaaaaaatagcaccattgctgatgtaataaatgacttgaaaactaaggttgaatgtccagtcctaatgctgaactacgtgtactagaagtcttctaccacaagatctata

SEQ ID NO: 1361 - DNA, 300 bp, Zea mays
  misc_feature: Incyte ID No: 700550809H1
atccgtctgtcgagccatggcgaagggaagggcacacccgtcgaagcgacccacccaccaacttatcctcgcggctgtcctatccgtttccgttctcctcccgctgctcgtgccggcggcggcaactgtggctgtggcggtggcggaggggggcgggaagcagttggcggtcgggaaggacgagggaaaactggtcgcggagggggatgctggtggaggcgggttagtggaggagaatgagttcgcgggtggcttcggctccctcgacagcatgctgcagtgggcgatcggaaattctga

SEQ ID NO: 1362 - DNA, 297 bp, Zea mays
  misc_feature: Incyte ID No: 700550810H1
  unsure 221: a, t, c, g, or other
ggtggcccatgctgcaggccgaggtggccttcgcgcgtgtcttcgagttgtgcgcgctgctgcaggggtggcccgtgctggaggccgaggtggccttcgcgctgcatcagcgcgatctcctgctcgaagtcctgggaccttctgctcttcgtcgcgtatcatctgccgcactttggctagtgcggacacgcgctggcgcttggcctccagtatctctttcngcctctggggattgcggttcttgaggcgcaggtgtcacacccggttttaaaggacaaagccgggtgcatctcatac

SEQ ID NO: 1363 - DNA, 300 bp, Zea mays
  misc_feature: Incyte ID No: 700550812H1
aggagaaggagctacgtgcccaaataattgctgaagcagaagaattcaagaaagctttttttgagaagaggatacagaactgtgcgtcgaatatggtcaacaacagagaaagggagaagatttttgtagccagccaggagaaattccacgccaacgcagacaagcagtactggaaatcgatctcggatctcatcccgcatgaaatagccaccattgagaagcggggaaagaaagacaaggacaagaagccatccgtcacagttattcagggccccaagcctggcaagcccaccgacctct

SEQ ID NO: 1364 - DNA, 284 bp, Zea mays
  misc_feature: Incyte ID No: 700550813H1
  unsure 138, 163-164, 178, 181, 185, 193, 198, 200, 215-216, 236: a, t, c, g, or other
ggatattagagagctgatttcattgggatgatgttatggaggagattgggttggggccaaatggcggtctcatctactgcatggagcaccttgaagacagcttggatgattggttgatgacagctagagactactagngatgataacctggggttgatgcccnnggcagatggactcntcncacntggtccangtctncnggacttgtcgagcannggaacggaaaaattcaacgnttgcgccgttacttcttgatcacagtttgtcagcgagtaacaaaatac

SEQ ID NO: 1365 - DNA, 299 bp, Zea mays
  misc_feature: Incyte ID No: 700550814H1
  unsure 9, 21, 84, 103, 110: a, t, c, g, or other
caaaagcantgcatacttgtngctgcaagtaatccttatcctctgccaacacctgtatactgtcttcctactcaaagtactganccacaaagagaacattganacatcanaagaaccttcaattgctgatgctgagaccgttgcaaagtcatttgctcagtgctctgtctcattgtcagtgatatctccaaaacagcttccaacattaaaggcaatatacaatgcgggcaagcgaaatcttcgggctgctgatccatcagtcgaccatgcgaaaaatccacacttccttgttttctctc

SEQ ID NO: 1366 - DNA, 301 bp, Zea mays
  misc_feature: Incyte ID No: 700550817H1
agctaattcaacaactggcggtgttcaaaggatattcagctgcattctgtgctctaaagcttgctggaaagaagtacccatcctcaacaagtttacacatccagcttctaggaatgcagattctacatgagcgcgcacttcatcgagggcatctaaaagtcgcgcaacaaatctgtgatgagtttggggtgttatcatctgctgtttctggagtagacattgagctaaagacagaatttagtgtacggcgtgctcgcactctccttgccgcaaaacagtttagccaggccgcagctgtggc

SEQ ID NO: 1367 - DNA, 298 bp, Zea mays
  misc_feature: Incyte ID No: 700550819H1
  unsure 108: a, t, c, g, or other
cttctacttggactctgatacagctttgtctgtagctgctgaaatggttgaacaattggagttagcagactgcgatgttaccttcattgctgattttattgatctttngatagtgaatcttattccgggttggagacctgtaaatgatgcggcaacaaactcgtatacgcaatctgaaagtgaacttgcaatcacttcccataacaatctatcgaagttggtgcctgattatgcataattgatggtatgatgcatccaaaagatgtgaatgtatcaactggttttcttgatctgtatc

SEQ ID NO: 1368 - DNA, 299 bp, Zea mays
  misc_feature: Incyte ID No: 700550821H1
gtatgacaaaactttctcaatgaaccaggcacgttccatcaggatgaacgtgagcactggtgctgctcgtccaaatcctcaaggatcatttcactatgggtctatcaatgtgagccaagtttacaagctgaggaatgaaccacctgttatcatcaatgggaagaaacggactacactgagtggtatttctattccccacccgacactcctctgagttggcagatctgtacgacaagaaggatgtctacacactcgacttccctacaatgccattgatggaccgccagtgatcagaacat

SEQ ID NO: 1369 - DNA, 151 bp, Zea mays
  misc_feature: Incyte ID No: 700550823H1
cacaaaggtgtcctgttggtcgtcctcgaatgagtttggttctaccacaaaatcagcttctaatatcgatttgcatatcgtacatacaaaaggaaccatacaccaaataaataaacatccaccattacataaacaatcacattccacacaa

SEQ ID NO: 1370 - DNA, 300 bp, Zea mays
  misc_feature: Incyte ID No: 700550824H1
aaacttccttaccatggatcggaatgggggttaccgaggttcacaaactcttctaagatctgtattatcagagaaacaagagctgtgcttctctgttgtctcattgctctggcagaagctcatagcttctcctgaaatgcagatgtctgcagaaagtacatcagctcaccaaggatggaggaaggttgttgatgcactttgtgatgtcgtttcagcctcaccaaccaaggcatcagctgctatcgttctccaggccgagaaggacttgcagccttggattgctagagatgacgaacaagg

SEQ ID NO: 1371 - DNA, 297 bp, Zea mays
  misc_feature: Incyte ID No: 700550825H1
gatattagagagctgatttcattgggatgatgttatggaggagattgggttggggccaaatggcggtctcatctactgcatggagcaccttgaagacagcttggatgattggtttgatgaacagctagagaactacttagatgatgattatcttgtgtttgattgccctggccagattgaactcttcacacatgttccagttctgcggaactttgtcgagcacctgaaacgaaaaaatttcaacgtttgcgctgtttaccttcttgattcacagtttgtcagcgatgtaacaaaata

SEQ ID NO: 1372 - DNA, 295 bp, Zea mays
  misc_feature: Incyte ID No: 700550827H1
caaaccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagattaaggaaaaccaagagaaaattaagtcaaca

SEQ ID NO: 1373 - DNA, 294 bp, Zea mays
  misc_feature: Incyte ID No: 700550828H1
ttgggatgccatagatgttcgaacccatggatttagtagggatggaattcctgaagctggtgacacagttcggatagatgtgtttggaggctttgtattgcaacggattacaaaagaaagaagctttttcagggcaatagctaatatggatatcaagctagattttgttccaccatggttgatcaacttcatgtcaaggcaactaataggcagcgggcataagctgtatcaaaaggcagtcagcaccgtggccagtcatgatgatgactacaggaaagcttgagaggaccgctc

SEQ ID NO: 1374 - DNA, 297 bp, Zea mays
  misc_feature: Incyte ID No: 700550830H1
  unsure 48, 51, 78, 152, 156-157, 159, 166, 246, 251, 257, 259, 271, 277, 291: a, t, c, g, or other
agagggtcattcatctggaacagcagcacctggttggtcatttcagangtngcttttaaattaactccaggtgctgcngttccagatgaatgaccctctgtgacaacaggaggcctaagctttggaacagcagcacctggagttaatttaanagcnncntgctganatgaccaacccagagaaaaggttttaagccatctgggctcggaggcccacacccaagattggttattttgatgctgaganatacntgaccnanacatcggtgacngctacnaccacaaccttcanaggtcc

SEQ ID NO: 1375 - DNA, 299 bp, Zea mays
  misc_feature: Incyte ID No: 700550831H1
catctatttttcagattttgcaatataattatcattgaagattcatgtagttctcttataatgctatataattagcacaatacagtgcactcactttattatttcctgatgaaaagtgagtgatatagccaccttatttggaggtttttacacaagatagcatgtaactgaaatactaagatagtatgaatcaataaatgcacatactgaattggcttcgttgtttaggtttggctacaaatggataagtcatcaaatctcctgaggacagtacttcagcaacttgcacgatcaactgg

SEQ ID NO: 1376 - DNA, 296 bp, Zea mays
  misc_feature: Incyte ID No: 700550832H1
  unsure 238, 244, 253, 260, 264, 270, 272, 276, 283, 290, 292: a, t, c, g, or other
tggaagcatagatggctttaatgagctgaaaagaggggccaagaagtggtatgtacaaaaaccagctgggggttgaagctactaacccaagcaccagcaaaagagcaggatctttgtttgctaatggtccacatcctgccatgaagggtcagtataatcaggctgactttgcggaaacatactcagacgctaaattctcatattaaatctacagtggagatgatgttcacaagagcgntaagtnccatgtgtnggccagnactnccaatngnaatnaggaacntgatgcngncctc

SEQ ID NO: 1377 - DNA, 296 bp, Zea mays
  misc_feature: Incyte ID No: 700550836H1
  unsure 270: a, t, c, g, or other
ggtaattggtgatggtggagatccagatggccatgacgatgaagatgatggacatcactaaggatgccttgtggttctgaaaataagaatctgatgaggcagatgagtccatcacacttcttttttcttgaaccagactgcacggcatccttgtttatgaacagacatttggccatcaagcgggtggtagttaatcacctagggattttgtccagacaaaagcttattgagatttgacccatgcatttcttaagagcatcatcgaataanagatgactgcatcagattgcttcttt

SEQ ID NO: 1378 - DNA, 215 bp, Zea mays
  misc_feature: Incyte ID No: 700550838H1
  unsure 80, 198-199: a, t, c, g, or other
tctgctataggaattttgcatgaatcttggattaattgaggagtccaaggtttcaaggccattaccttggaggccagcgnctaatgttttccgtgttaaagaggatgttcgacctatattctgggccaacaggccaaagagctatcttaaaaggacattaggttgggatcagtatccccatggacggtggggtgattnncggaacccatcatatg

SEQ ID NO: 1379 - DNA, 295 bp, Zea mays
  misc_feature: Incyte ID No: 700550841H1
  unsure 17, 28, 44, 135, 142-143, 149, 159-160, 189, 236, 262, 289: a, t, c, g, or other
ctagtttttttttaacnaactgtgcaancatacaactgcggagnaaaaactccaggtcgtgtatgtttcacttcactaattgaaaattactgccagaacatggtaattttataaagggtgccttccacacaacanacgaacnnaaacanctggatggtnnttgggcgaagaagatgaagggcagagagnaacggagacggcctttgggcggcggctgcagataatataggaacgcnggcagccgatactgcttgcgagtaanccccgccaaagctgctggccgctcaancgccgg

SEQ ID NO: 1380 - DNA, 293 bp, Zea mays
  misc_feature: Incyte ID No: 700550842H1
cttattttatggaaacgggtctggaagacaaaggatcccaggtgttcctcctatggcaccacaatttacaagagcgcatggcaacataaacgatcagttccagcagacagctagcttatttgctgggtcacagcaatcaggaggtatgcgtccattgggagcagtagggccttccgtgccaccacctccggagaacacctccttctgtctgttcccgccagcttcatccgtccccagtacaatggaggccgaggatgtcaacagagcaaaccagttctatgcatgggagaggg

SEQ ID NO: 1381 - DNA, 231 bp, Zea mays
  misc_feature: Incyte ID No: 700550845H1
  unsure 204: a, t, c, g, or other
ctcaaacacaaagactaacttccgggaggttgccatcaaaggtttctgggacatgtacgacccagagggctactctttgtggttctgtgactacaagtacaatgatgagaacaccgtctcctttgtgaccctgaacaaggttggtggattctgcagcggatggacctgtgccgcaagtacgctttgggaagatgctcgtgatangctctgagccacccttcaagctgaagg

SEQ ID NO: 1382 - DNA, 241 bp, Zea mays
  misc_feature: Incyte ID No: 700550846H1
gccaagcacgccgtctccgagggaaccaaggccgtcaccaagttcaccagcaactgagcgcgctgcgggatccgcggatctgttagaagggttctttgctgtgtcctttccccagtcccccaccctacccgcctagtagctagcttgcctgctctataaatccggcgcgccggattgtaatggtcctcttagatttgatgtccctgttgtggaatatagttgtatctctccgcttgctatt

SEQ ID NO: 1383 - DNA, 296 bp, Zea mays
  misc_feature: Incyte ID No: 700550848H1
aacgagataccaactgaaccaatatccccaacaattgaggcactcattttgctccacgataaagtaagtgcatcctctgagaaacaccattcaagtacaaggcttgttgtaccatcaaacaaagttggctgtattcttggggaaggtgggcaggtgattactgaaatgagaagacgaactggggctgaaattcgagtttactcgaaggcagataaaccaaaatacttgtcttttggtgatgaacttgtgcaggtgacttaatatttgctaacagcatcaacatatttctatatgtt

SEQ ID NO: 1384 - DNA, 290 bp, Zea mays
  misc_feature: Incyte ID No: 700550849H1
  unsure 248, 256-258, 283: a, t, c, g, or other
tgccaagaagaaatgatctatctggctggtgctgtgcttgcttgttggttacctcgtggaagcttaaaatatctcgttcttgttgacatccttgcagttgtcgcgtgaacaagtaatctatgatggcaatgtttgcctggtcatgaagtattattactttcgttgaaaccgtgatgctattaagactaatttttttatggaacatcgaatgtaaggcatacatggttatgagttttgtactaccctanaaaaaaannngccgcaagacagttagccaggccgngtgtggc

SEQ ID NO: 1385 - DNA, 298 bp, Zea mays
  misc_feature: Incyte ID No: 700550850H1
  unsure 237-238: a, t, c, g, or other
agggaactggtgaacaaacagaatgagagcgaaaacatgcaggactccgacaacctctcgatgctgacttccatgaacacaggaaacacaggcagcgtgttcccattctcgaaacaaaacaccaatccttttgaagtgaccagctcaaggctagagttcggcctcgtttcatcggattcactgatgagttcccctcacagttccttggagaacgtcaacctgctcggctcacagagnntgaatgaacaccagaacccagcctccctgcaacacttcgtggactggcccaggacgcctg

SEQ ID NO: 1386 - DNA, 295 bp, Zea mays
  misc_feature: Incyte ID No: 700550852H1
gggaagtggacagcaggatcattctctcttcggcgactcacgtaactgggaggtaccatttttgcagggtttcttgatggccccaaaccatgcaggtgcttcatcttcgattccccttaccactggcagttctaggggaccaaatcgacgctatgcttcacgctctgtacctggggttgggaatttgctcctaggtcctcaaattgacgaagctgaagctcatgctgtttcactaggtgctggttctgaaatcactgcgtccatgcttgctcctggtactgaatgccttgtacag

SEQ ID NO: 1387 - DNA, 295 bp, Zea mays
  misc_feature: Incyte ID No: 700550853H1
agaagaacagtgtggctaggcacaacagacatgtctcaggaagaattccgctcgtttattgaaaaacttgcaggtgattatcatggcgacacatatcatttaattaacaagaactgcaatcacttcacagatgatgtctgccagaacttaactgggaaacccatcccttcctgggtgaataggcttgcaagagtagggtcagttttcgattgccttcttccagaaagcgtacaagtttctcctgtaggtcgtgtcccaacgagtcggcgaatatctgatgatgatttgtattcaa

SEQ ID NO: 1388 - DNA, 293 bp, Zea mays
  misc_feature: Incyte ID No: 700550855H1
  unsure 154: a, t, c, g, or other
actggcttgtggactggaaaaccagctataccaccagaatctccgtttttagctctagctcatcatgctagtcatgtggacacaaactcaaacgctgtttcatctttatccgaatctagtcctatggatctcaagtgccagtatgattctgagnccctggcagacggatgcatcaaaatgcaaactgatgatgagattgttgtggatggatctcattctaacgaagattctgttattgagaaaaaaaggcgacgtgtggtcgaggagatagctgccgacggaatttaccatct

SEQ ID NO: 1389 - DNA, 98 bp, Zea mays
  misc_feature: Incyte ID No: 700550858H1
  unsure 2, 16, 32: a, t, c, g, or other
cngagatgtgtcttantatgactatggatganacttttgtgatgtaattgatgagacttttgtgatgtaattgatgagactatgtatttaaatattgt

SEQ ID NO: 1390 - DNA, 289 bp, Zea mays
  misc_feature: Incyte ID No: 700550861H1
  unsure 216: a, t, c, g, or other
acttgacgaaggacatacacctagaaatcgggagactaatgtactcgaatcactaaatagagtggaaacaccacgcaaagtggttctttcgggtacacttttccagaatcatgttgaagaagtgtttaatatcttgaatctcgttcgcccaaagtttctcaggatggaatcatcccgtcctactgccagacgtataatgagtcaagttgaaatagntggtagaagttcgaaagggctgctgatggcgcattcactaaggcagttgaagaaaccttattgaatgatgaga

SEQ ID NO: 1391 - DNA, 291 bp, Zea mays
  misc_feature: Incyte ID No: 700550862H1
gtctgctataggaattttgatgaatcttggattaattgaggagtccaaggtttcaaggccattaccttggaggccagcgactaatgttttccgtgttaaagaggatgttcgacctatattctgggccaacagaccaaagagctatcttaaaaggacattaggttgggatcagtatccccatggacggtggggtgattctcggaacccatcatatggagcacttactgaccaccagttcacaagaccacgaggccgtggtaagaagctccaagaggaatgggctgttccatg

SEQ ID NO: 1392 - DNA, 293 bp, Zea mays
  misc_feature: Incyte ID No: 700550863H1
  unsure 287: a, t, c, g, or other
ggaagagagagctctccgcctctctcctccgccttagagcgacgtcgctgccggagctcgatacctatgggtggcttcgggacctcgcgccctgcctccgtcgccctctgcgccttcctcaccttcctcaacctcttcgccgtccttctcgccgtcgggccgagcgccgccgcagcaccgggaaggtgatgccggacgagtacgacgagcggtcctactgcctctacgacactgacgcctccacggtgtacggcgtctccgctttcttcgtgctcctgctccagcangccatt

SEQ ID NO: 1393 - DNA, 293 bp, Zea mays
  misc_feature: Incyte ID No: 700550866H1
aggaatttctggttcgtgatccaatgcctgctgtatacttcttccttattgatgtctccatgaatgctatacaaactggtgcaactgctgcagcttgcagtgctatttcccagtctatttcagatctaccagtcctcggacaatggttggaattgcaacatttgattctgctattcacttctacagtcttaaacgtgctcagcagcagcctttgatgctcatcgttcctgatgtccaagatgtatatacacctcttcagactgaccttattcttccagtttctgagtgccggg

SEQ ID NO: 1394 - DNA, 226 bp, Zea mays
  misc_feature: Incyte ID No: 700550867H1
cggatcctcccctccgccgccggctccgcctagaccggcccgcgttcgtggatctctcttctttcttccacgtttttttggagtcgatggctgcgggagcaccgggatcttgccgggtggttctcgtctcgatctgatgccgctcccgcgatgtaatctggcgacaatttgacgagaagagaagtagcggcgtgtttcttggcaactcgcctggtaatgtgacgca

SEQ ID NO: 1395 - DNA, 293 bp, Zea mays
  misc_feature: Incyte ID No: 700550868H1
gatgcatctgccgagtctggatctgaagtggaagatgtaacatctcctactgcatcaaggaacctgattacacatcctattttgacccctgttcacgaagagtcaaaattgtcgccacatggttccacatttgttgctcatgcttctattgaagaaaacattcctgttgtagacaaggttgtggatgatggatggggtactcccagaggtagtctccaagcttcttcaggttcgttgccctcgagaaacacgcacggcacattcgaaggactgagagttcaagctgtcgcatg

SEQ ID NO: 1396 - DNA, 287 bp, Zea mays
  misc_feature: Incyte ID No: 700550874H1
caaaatctggtggatctattgtgttcttgactcagattattggtgctgagagaggattgtatccaggcgctgcagcatatggcacaagcttgggagccatccaccagttggtccgtctgtgtgcgatggagcttgggaaacacaagataagggttaacgccgcctgccgcggcctgcatctgcaagacaagttccccgtgtccgtgggcaaggagaaggcggagaaggcaacggcggaggtgatgcccctgcggagatggctggatccggagaaggacctggcgtcg

SEQ ID NO: 1397 - DNA, 285 bp, Zea mays
  misc_feature: Incyte ID No: 700550875H1
aggaaccagagcaggagactgtttatgctactggagggagaaacactgaaagtgtaattgtcacaggactgatcaaagttgacaaggcagaaataggaatctctgacaatgatgctggggccgtggagtctgtccaaaagttagatcttctgaaagatacaaaagtgtctctttctgcaaaccatctgcagaaactgtgtttatcttttcaactaaccacaccgcttgggcacacatttaaacctcaccaggtgttcttgaaattgaggcatgagagtaaggttg

SEQ ID NO: 1398 - DNA, 284 bp, Zea mays
  misc_feature: Incyte ID No: 700550876H1
  unsure 4, 258: a, t, c, g, or other
gaantgcttgttgggaacgtagaaactactgtctccgcctgcttctccgaagctcgctgttggtagcaagttttattgctagtattattgttattgctgatttgctcccctctgcctttgcgatgtaaatatttgtgtacccagccccagccccagccccagccccagcttgtagtgagcagtaacaagcagtagcggtaccttcggtattaaccggcagctagctatttcgcggcattttaatccctgtaagcgtantctgtggcgtgagatagatgacaaac

SEQ ID NO: 1399 - DNA, 285 bp, Zea mays
  misc_feature: Incyte ID No: 700550877H1
tccacaatggttgtcgataacattctccaaggctatatttcttggcaatggtctagtggccattgttgctggcctatttgcaaattttcttgctgataacatgggttttggtcctgtggctccatttgatgccgctgcttgcttcctagcaataggaatggcaattatcttatcatcatggggtgagaactatggagattcgtctgacagcaaggacttgataacccagttcaagggtgcagctaaagccattgcttcagacgagaagattgcattgcttggagc

SEQ ID NO: 1400 - DNA, 289 bp, Zea mays
  misc_feature: Incyte ID No: 700550878H1
  unsure 2, 8, 23, 32, 40, 51, 60, 95, 99, 104-105, 187, 193, 199, 205, 222, 255: a, t, c, g, or other
cncaagancttgtagccaagganctgcatggngtggaatngcgctttcgcnacatattcngaggtcaaccacgaaggcatcttttgcagagtggntggngtgtnnttgttagtgccaaacgtcttgttgctggcgatgccttcatctttctaagaggtgatagtggggagcttcgtgtacgagtcangcgtgncattangcagcnagcaaatgttccgtctncagtaatatcaagccacagcatgcatcttggtnttcttgctacagcatggcatgctgttaacactgg

SEQ ID NO: 1401 - DNA, 283 bp, Zea mays
  misc_feature: Incyte ID No: 700550879H1
  unsure 3, 8-9, 11-16, 24, 29, 33, 38, 42-43, 46, 55, 68, 72, 77, 107, 109,: a, t, c, g, or other
gancagtnncnnnnnnaagattancggtncatntccgncgtnnagntcggactcnacttgcgatatanttgntcttntcctcagtaagaatgactcggatggagatncnagcagccaggtgggcttcttatgcggctcatctccgatacgcgctgacaaccctgttatccatgatccacagtttggtaaaagactgnnatcctttctcctctaggagggagctcctatnnnaaaatgccagcagtacgagttgaagtaggctcgccatctgcggcgttacagc

SEQ ID NO: 1402 - DNA, 289 bp, Zea mays
  misc_feature: Incyte ID No: 700550882H1
  unsure 174, 223, 225-227, 229, 235-238, 287: a, t, c, g, or other
agtcgtcgtaggcagcgagcgtctctcctctcccacgcatcgcgccaaggaagagagagagatcgccgctccccttcttcggcgtcggtggtgcgggtgccctccctcctcgagcgagatctgtctggtcacagatctatctgacaaaatggtgaagatctgctgaatcggtgntggctatgtcggtggcccaaccatggcgtcattgccctcaagttcccanannntnaaggcnnnngcgttgacatctccaagccccgcattgaggcctggaacatgacaccctncc

SEQ ID NO: 1403 - DNA, 289 bp, Zea mays
  misc_feature: Incyte ID No: 700550883H1
gcaatatgatgcctgctcctcagcactcaagccaaatgaattcaccaaccatgtcatcaaacctacctcctatgcaaacacctgcaagccgacctcaggaacctgagccaattgagtctcaaagctcggtccagaggatattgcaagacttgatgatgcaatcccatattaatggtgttgggccagttggcagcgatatgaggagagcaaacacaattactcctggtctgaatggtgtcaatccttagttggtaaccccatgacaaataaccctggaatcaatgggatg

SEQ ID NO: 1404 - DNA, 287 bp, Zea mays
  misc_feature: Incyte ID No: 700550884H1
  unsure 248, 271, 277, 286: a, t, c, g, or other
tttgtcccttggacttgagaaactattcttgcttaccacaaggacagcggattggtttgttcgtcgcggctttaaggagtgctcgttcgattccctgcctttggtgaggagaaaacgtatcgacctctcgcgcgggtcaaaatattacatgaagtggctccaggcagcagaggttgggcatatggctgccgacggttttgccatgagatgatgagtgctgcaaacaagcatctctacgatccaatcgntggacgtaaggttccttaataanctgtgnagtcgcttnt

SEQ ID NO: 1405 - DNA, 285 bp, Zea mays
  misc_feature: Incyte ID No: 700550885H1
gttaggtttggagatgataatgacaaaactcttgcaatgactgaaatgaatggtgtatactgttctacaaggccaattcgtgtaggactagcgactcctagaagatctcaaggtgattctggctcttctccgccaaggcaatctgatgttgactctactaacaggacggtatatgttggtgggctgaccccaatgttagtgaagatgaactgaggaaagcatttgcaaaatatggtgatcttgcctctgtcaaaattcctttgggaagcaatgtgggtttgttca

SEQ ID NO: 1406 - DNA, 285 bp, Zea mays
  misc_feature: Incyte ID No: 700550886H1
  unsure 255: a, t, c, g, or other
acaaagggccatggaatgatccttatatattgaagctgatccacaatttggaagctggatgcatgagggaaaccaccaaacccgtttctgagggcggagaaagaagcagctcttcctttcggttggaacagatgaaatggcagggcatgttaagcgatacatcaaatgctgaatcaggatccgatgttgatgatttggtccatcatttgttcataaagtttcaggcatggttgcttgactccggttcgtgaggangtaaaggcacagatgtgcaacatacttgag

SEQ ID NO: 1407 - DNA, 284 bp, Zea mays
  misc_feature: Incyte ID No: 700550889H1
ctcttgtcctcgaccttgattctgacaaattggctgcattctctgctgcatacgcagaacttgaatctgtactttctggattgaatgtgcttgttgagacttactttgctgatgttcctgctgagtcctacaagaccctaacatctctgagcagtgtgactgcttatggttttgatcttgtccgtggaacccaaactcttgggcttgtcacgagtgctggtttccctgctggaaagtacctctttgctggtgttgtggatggacgcaacatctgggctgatgat

SEQ ID NO: 1408 - DNA, 285 bp, Zea mays
  misc_feature: Incyte ID No: 700550890H1
  unsure 237: a, t, c, g, or other
gttataataaggagggcaagatgcggcagacttaagccccgtttggtttgaggtgactaaactttagtcacttttagtctctaaaaaagcaaacatgttgactaaattagagtaactaaactttaattgtttagtcactaaggggtaactaaaagggactaaattaatgctcttctcctctttcttcgtgtagctaacaaccactaattaataggggtaatacattcattattcacnctaattaatgttctttagtcaggtttaatcaatgtaaccatacatggg

SEQ ID NO: 1409 - DNA, 283 bp, Zea mays
  misc_feature: Incyte ID No: 700550891H1
gggtcgaggctcgtagataccagaaagacaatgtggcgtatgtgtcagatggacctcaaagtgacaagtgggcttgggttctctttgaggccacattagacgtaccagcgaatcctgagatcgtagttaaggcggtggactcagctgcaaatgttcagcccgagaaggtagaagacatatggaatctgagaggaatcctcaacacgtcttggcatcggatcaaaattcagagatctttgtgcgttgaaagatctaagctgtgaaattaagtacgcagctgatc

SEQ ID NO: 1410 - DNA, 284 bp, Zea mays
  misc_feature: Incyte ID No: 700550894H1
  unsure 82: a, t, c, g, or other
catagcactgcgtcaccatctggaaatatcattgttgacattcagaacaagggagctgagaacattgttccttccactgatncatcacttgcttcagatgttggtgagagctcccgttcagtgctctatccagttgatacgactactgtgaactcagtgtcatccacgtctacagtggctggtaccccagttgaactttctgggtatcaggagggtgctccagtggtatgttcttcatgtttaacagctgatgttcagaacaatgtgacatctgatatgccagg

SEQ ID NO: 1411 - DNA, 286 bp, Zea mays
  misc_feature: Incyte ID No: 700550895H1
gatgactctgagaggccaccacggagaaactatgagcgccacagcgggactggccatggctatgagatgaagcgtgatggcgcagggcgagggaactggggcactgccactgatgaacttattgcccaggatgcagaggactctccgaagatggaggaggctgctcctgttgctgagaaacaaggtgagcagaatgatgccccagcagcagatgagaacaaagataacaaggatgctactgcaaatgaggaggaagaaaaggaagaggacaaggagatgactctgg

SEQ ID NO: 1412 - DNA, 307 bp, Zea mays
  misc_feature: Incyte ID No: 700550901H1
ggaggcagaggacgattgcactgaagctctgaatctggatgatcgctatattaaagcatactcacgccgaattactgcacgaaaagaacttgggaagcttaaggaggcaatggatgatgctgaattttctatcagtcttgatccaaacaattcagagctaaggaagcagtattctgagataaaagctttgcacatggagaaaatggctaaaaaggttccagtgccagctaaacgtgcagtttctggaattgataaaactgcagatgtcaattctcacccaccgactatctcccagaagggcaatatt

SEQ ID NO: 1413 - DNA, 193 bp, Zea mays
  misc_feature: Incyte ID No: 700550905H1
  unsure 125, 176: a, t, c, g, or other
ctttaacaaacaaatggtttagctcaaagtcatcaaagaagatacctctgacagccgtcacttctgttatcgatggcttgaaaaaactttacatcgaaaagttgaagcctttggaagttacatancagttcaatgattttgtttcccctttgctgacaagtagtgattttgatgcnaagccaatggttatgct

SEQ ID NO: 1414 - DNA, 299 bp, Zea mays
  misc_feature: Incyte ID No: 700550906H1
cgacaaatgtggtcaagaagtatgacaaggcaaacaatgcctggaacatactgaagccattgcctgttagagctgactcatccaatggttggggtctagctttcaaagcttgtggcgatcgattgctggtaatcgggggccatagaggacctcgtggcgaggtaatattgctgcattcctggtgccctgaaggtggggaagatggtgctgactgggaggttctctcggtgaaggaacgtgcaggcgtcttcgtttacaactgtgcaataatggggtgctgagttaccttgctcatacat

SEQ ID NO: 1415 - DNA, 301 bp, Zea mays
  misc_feature: Incyte ID No: 700550907H1
  unsure 114, 248, 275: a, t, c, g, or other
gaggcttccaaaaacgtcatattagctggagaatgttctttgttggattaccttgtactctagaaaaccgatgtttttttttttgcaaacttacagtcctcatgtatgtttgtnctcttcctggtgtttgatgcatttctggaaaaccttgattgtaggatgtcttagctatctatgtatgcgggtataactagttagttattcaccattgttcttctgcaaccacttaatgcttcatctggtgctgnattcttccaactgtatgttttgctganatcacaccaggtggacacattttttt

SEQ ID NO: 1416 - DNA, 298 bp, Zea mays
  misc_feature: Incyte ID No: 700550910H1
  unsure 73: a, t, c, g, or other
ggtgggaccatgctgcaggccgaggtggccttcgcgcgtgtcttcgagttgtgcgcgctgctgcaggggtggnccgtgctggaggccgaggtggccttcgcgctgcatcagcgcgatctcctgctcgaagtcctgggaccttctgctcttcgtcgcgtatcatctgccgcactttggctagtgcggacacgcgctggcgcttggcctccagtatctctttctgcctctggggattgcggttcttgaggcgcagggtgtcacacccggttttaaaggacaaagccgggtgcatctcata

SEQ ID NO: 1417 - DNA, 293 bp, Zea mays
  misc_feature: Incyte ID No: 700550911H1
gagcaattgaaaatgcaagaaatggtaaacataagcatcaagtactcctggatgctggttggggttcaggtgtattgagggatgaagatgcccttagccttgatggttcattttatgggaacgttgggcgatttatcaaccacagatgctatgatgcgaatttagttcagatccctgttgaagttgagacgcctgatcatcattattaccatctggcatttttcacgaacaagaaagtagaggcattgaagagctaacatgggattatggcatggttttgatgatacggaggg

SEQ ID NO: 1418 - DNA, 290 bp, Zea mays
  misc_feature: Incyte ID No: 700550912H1
  unsure 45: a, t, c, g, or other
attgggtagcatccatgtatctataactgtgaccgcaactttgangaaacacatgctgtggctcatggcctcgagataaaaaaaggttaaattgcaatcgacaacaatctggttgggcagaggtaaatatcatgccgtgctcctgtcatagacatggttgcctgtattttatttgaatgagggttgaatagcttataacattgtgaggaatcctaccacatattgattttcatgttggtgtttttttgttgggcatctctctccagttggtcataaaaacaatgaactgt

SEQ ID NO: 1419 - DNA, 294 bp, Zea mays
  misc_feature: Incyte ID No: 700550915H1
  unsure 51, 127, 135, 137, 158, 168, 171, 182, 196, 207, 213, 230, 233, 240, 246,: a, t, c, g, or other
cctttactgatacttatcagatatacaagaacacatggcatttgtatcggngaattggaacctgctagttggagagatactgttggctacctgagatctcacatgccaatgtgtccacacttgctantgaggaantngataacatgcttttccaggtnggggattttncanccaggagagantgagcagcttgaantttacatgtancattgntacagtgggatctaggnccngtagaanttttanaaatcagactgtaggtgccctgctgcagaactgcnaggtggtnctgat

SEQ ID NO: 1420 - DNA, 295 bp, Zea mays
  misc_feature: Incyte ID No: 700550916H1
atttttctcttgagcctgtgctgcctccggtgactgcaaggccagaacatgttgaaagagcgttgaaggcacgttatcaagatgcaatgaacatactgaggccacaggggagggaacttgatctgctgattgtaatactgcctgacattaatggttccttatatggggatctcaaaaggatctgtgagactgatctcggattggtctcccagtgttggtctgactaaaacatgtttttaagatgggcaagccgtatcttgcaaatgttgcactcaaaataatgttaagttggtgg

SEQ ID NO: 1421 - DNA, 303 bp, Zea mays
  misc_feature: Incyte ID No: 700550917H1
  unsure 152: a, t, c, g, or other
ggcatattatctatattgaggatgaacctgtcgaggctgagacactgaaccaagtgaagcatctgacaacattgtctttcactgaagtagaggagttaggcaagacatctagtgttgatgcaaggttaccttcaagctctgatactgcagtnatcatgtatacaagcggaagtactggtcttcccaagggtgtaatgatcacacatggcaacatggtggccacaactgcagcagtcatgacaatagtcccaaaacttggcatgaatgatgtttatctggcttaccttccattggctcatgtct

SEQ ID NO: 1422 - DNA, 300 bp, Zea mays
  misc_feature: Incyte ID No: 700550918H1
aggtagtcaagagcattcgccgcgggaacaaagggttgtgtgtgattgctggaaatatttctcctattgatgtgattacacacgttccaatactatgtgaggaatctaatgttccttacatatatgttccatcaaaagaggatcttgcgaccgcgggaaccactaagaggccaacttgttgcgtcctggttctgaccaaaccaaacaagggggagctcagtgacgaggtgaaggataaactgaagtcagactatgaccaagttgtaacggaagttgctgaggctacatctgcaatgttct

SEQ ID NO: 1423 - DNA, 301 bp, Zea mays
  misc_feature: Incyte ID No: 700550920H1
  unsure 53: a, t, c, g, or other
gatacacgggtgcttgcattcgaagctgggcgaaaaggcaaaatcagagttancaccatatgcagcaggccctcttgggagccgagctgctaaggcaattggatttattgagaagatgatagagtactcatatgttaatgcaccattgcagaaggagctgttggctgatgaggtggggaacacagctgcattcctggtttcttcattggcttctgccatcaccggctcgactgtttatgttgacaatgggctcaatacaatggggcttgcaattgacagccctaccataacgtcatagatg

SEQ ID NO: 1424 - DNA, 302 bp, Zea mays
  misc_feature: Incyte ID No: 700550921H1
  unsure 98: a, t, c, g, or other
atgacgagaacctcaagcaaattgaggctgaaaagaagaaagcccagaaagaagctgaaaaggagggcaaaccaggacaaaacttcctgtaaaatcanaaaatgggaatgcagataaatcgccaagatcaccatcaaccttctaatgatgtacggcagaacttcacatggtcatcatttcttcctcaacgaatgcccgcctttggctggcctgggcacaatttcgcaagcatgaacagtatacaaatccataaattccttgtggacaaatgcttacaagacaagatggttttggttcaacat

SEQ ID NO: 1425 - DNA, 298 bp, Zea mays
  misc_feature: Incyte ID No: 700550924H1
agatgctatgttacacattcgtagacaatgccaagaggcattcttagacatgtcattttgtttgtttctgcccccagatcaacccagactctgcaaaaggctataaaactcgtggaatggcatatgccatgcttggcaaatgggaggaagctgctcatgatctgcacacagcatctaacatggattacgacgaggagatcaatgctgtgctcaagaaggtggagcctaatgctcacaagatagtggaacatcgcaggaagtatgagaggttgagaaaagagagggaggaaaagagagc

SEQ ID NO: 1426 - DNA, 284 bp, Zea mays
  misc_feature: Incyte ID No: 700550925H1
gattctcagataatgtggtcctcagaacattgcagatgtagcctcagcgacttccgttacaacttggtgtagtatcctgcccagcttctgtgaaccgaaccaatatgttttgcacggtggctggagcgagatatgactatgagtttacctatatgctatggaccatccttgttggcggcatatgattctaccagtgattagatctagccaattacaatcagttctgtgagcagactgtttccttgtgttgtcagatctcggtagctagtgtgtgcgttccaggt

SEQ ID NO: 1427 - DNA, 291 bp, Zea mays
  misc_feature: Incyte ID No: 700550926H1
aaaaagatggacttgaggcttactgctgttcaccttattgatgcccatttatgctgtgatcctggaaagtatgtcagtgctttgcttctttcactatcaacgatgctacacttggaattgccacatatcaatgtcttgtcaaagattgacctcattgagaactatggaaatttagcattcaaccttgacttctacactgatgtccaagatctttcttatttgcaatatcatcttgagcaggatccccgctcagccaagtacaggaaactgactaaggagcctgtgatgtga

SEQ ID NO: 1428 - DNA, 284 bp, Zea mays
  misc_feature: Incyte ID No: 700550928H1
  unsure 276: a, t, c, g, or other
gtttatttgctggtatcagttttggttcagttctccaaagcacggttttagtttgtgctgcttctcttggttcatgcacatgagctgtttttttttgggttcatgacctttggaaaggtgaagcaaaagtctcggtgcttcctcttgctatccagggcagatttttgtttgatgctgcttgacgtggaggaactatattctagtactgactttatatatcctaataaatctactgttgtgctattcaagttttgtgttggacttctgacgtgaggngatgtttg

SEQ ID NO: 1429 - DNA, 105 bp, Zea mays
  misc_feature: Incyte ID No: 700550929H1
tggcaatgtagggatggttaatgctaatgtcctccactgtatggacgaagaaatagctgaaactagctagacgtcctgtgttgtttttcctccgttagtacacta

SEQ ID NO: 1430 - DNA, 291 bp, Zea mays
  misc_feature: Incyte ID No: 700550931H1
gaagcagttccaaggtgctgtggatgctgctcgcaaggctaacagtgccaaaacatggaaggaggtctgttttgcttgtgttgacgccgaggagttccgtcttgcacaaatttgtggtctcaatattattattcaggttgatgacttggaagaagtcagtgagtactaccagaatagaggatgcttcagtgaacttattgctctcatggagagtggtctggacttgaacgtgcacacatgggcatcttcacagaatgggagttctgtatgctagataccgctctgagaagc

SEQ ID NO: 1431 - DNA, 300 bp, Zea mays
  misc_feature: Incyte ID No: 700550933H1
agaagtttgatactgatttaattacacttcatccaattttaaccgaatgtcgtgtgattaaatctgatctggagcttgctctcatccggtatgctaatgatgtcagttctgaagctcacattgaggttatgagacgagcaaggccaggcatgaaggaatatcaattagaaagtatcttccttcaccatgtttatatgtatggaggttgccgacattgctcttatacatgtatatgtgctactggagataatagtgctgttctacattatggacatgcggcagctccaaatgaccggactt

SEQ ID NO: 1432 - DNA, 297 bp, Zea mays
  misc_feature: Incyte ID No: 700550935H1
agagagacctgattgttatcgaggaactccagaagaacttatctcaagttaaagatgaaaaggtgaaggtcctgatggaattaacaaaactaaaagaacaatatttgctattgaagggctctgctgtcaaggaaggtcatgatactggtgattcatctaaactcattcctgggcatgaccaacaagggatgctgaagactatgctgaagaggacatctttaagacactggatgaggaaagaaagtaatactattggacatgggagctctgatggaaatgatcatacagtttgcaaag

SEQ ID NO: 1433 - DNA, 296 bp, Zea mays
  misc_feature: Incyte ID No: 700550936H1
  unsure 121: a, t, c, g, or other
ggccgtcatggtggagacgcagggggagaagctcgacgacatcgagagccacgtcgccaacgcctcccactacgtgcagggcggcaacaaggagctgggcaaggccaaggagtaccagagnagcagccgcaagtgtctctgcatcggcatcataatcctgctgctcctcgtcctgcttgtcatcgtgccaatcgccaccagcctcaggaggtgatcgagttgtgatgggaggaacaacgccggggttgtgaattgtgaaatgaaatgaggggttccaattcgatccgatgggtggg

SEQ ID NO: 1434 - DNA, 169 bp, Zea mays
  misc_feature: Incyte ID No: 700550937H1
  unsure 124: a, t, c, g, or other
tcctttggagaaatattagcaattttagcaatatgatttgtgtgcttcgtccaaaggaaacaagatatataatgtttatcttcagacagcatgaagcaagataagatatatatcttgtttcctnggagaaatattagcaattttagcaatatgatttgtgtgctcgtcc

SEQ ID NO: 1435 - DNA, 293 bp, Zea mays
  misc_feature: Incyte ID No: 700550941H1
gtgtacgaacctacgacagctctctacttccctcgcgtcctctccatcgagagctgctcctgcttcgtctcctcccacaccgcgcaattcgtcgggattcgggaaccctagcgccggatctccgcggcagcgccggaaatggcgaatcccctagcggggctgcaggaccacctcaagctcgcgcgggactacgcgctcgagggcctctacgacacctccatcatcttcttcgacggcgccatcgcccagatcaacaagcatctaactactttggacgatgctctgattcgtac

SEQ ID NO: 1436 - DNA, 287 bp, Zea mays
  misc_feature: Incyte ID No: 700550945H1
  unsure 109-110: a, t, c, g, or other
gaactctcatgtttcatctggaggatgcaactttctaagtatcctccatcaacgcgcttatctccggtgtaggacacctcctgtttatccaagttactgatgaaaggtnntctcggcttttgggtatgttcataaaatagccacctttgaaaaggctgcaggttttcaggcattgatccagtacactgatgcggctactgcttcagctgctaaagaatcctagatggaaggagcatcccaagttacttgcttccggagcatgtaacatcctgctgcctgcgaatttc

SEQ ID NO: 1437 - DNA, 287 bp, Zea mays
  misc_feature: Incyte ID No: 700550946H1
acaaggttgcacgtgttgacatatctaatcgtctcaggtcatcgccatgtgttcttgttgcagcgaagtttggttggtcagccaatatacgaaaggctgatgagagcacagtctatgggtgatacagcctctttggatttcatgcgttcgaggaaagtttttgaaataaacccagagcatgagataatcaaggccttgaatgtggcatgcaggaataaccctgatgatcctgaagccctaaaggctctggatgttctctttgaaactgctatgattcaagtggcttt

SEQ ID NO: 1438 - DNA, 297 bp, Zea mays
  misc_feature: Incyte ID No: 700550950H1
gaaagaaagaaaagggggcaggaagaaatcgagcctcactcgatccatcgcctcgccgcagcacacacgaggccggcggcgccatggccatgaagctggacatgtccgcgctcgagaccaacttcgccaacctgaccgcctccgccggcgacgacacgtacttctccgccgaggcccccgacgtgccgtccatggtgctccccatctgcgacgacttcgacggcttccaggcggccaccaaggatatggtgaagaataagaaggggacgaccacgcttgcttcatcttcgacaaagg

SEQ ID NO: 1439 - DNA, 171 bp, Zea mays
  misc_feature: Incyte ID No: 700550953H1
  unsure 72, 81, 97, 100-101, 106-107, 110, 112, 114, 125, 129, 136, 138, 142, 148,: a, t, c, g, or other
tatgatttaaggtcatttgcttttaagctgaaggctacgatggagagcatggataagggattgaggtcatcnaggctatcngagcagttgaacaaancannatgcnncantngnaattcccaaanggcnttaatgncnttcnatgcgnttaacngntgaatactcccncaa

SEQ ID NO: 1440 - DNA, 291 bp, Zea mays
  misc_feature: Incyte ID No: 700550955H1
  unsure 100, 133, 264: a, t, c, g, or other
aaactagtctcctcttcgcacgagcggaacaccatccacccaccagttcgaagcggacgcgaccgggcaacctgcggcggagatgtcaggcaggggcaanggcggcaaggggctcgggaagggcggcgcgaanttcacccggaaggtgctgcgcgacaacatccaggggatcacgaagccgggcgatccggaagctggcgaggaggggtggctgaagccatctccgggctgatctacgaggagacccgcggcgtgctcaagatnttctcgagaatgtcatccgcgacgtgt

SEQ ID NO: 1441 - DNA, 289 bp, Zea mays
  misc_feature: Incyte ID No: 700550957H1
gcagcttgatgctgtaaatttcgcttatgaggctgggcttcaggagaagttcccaccagttcctcttttgaagtcctacctggaagactctaagaagacatcaaccgctgcttcagataattcaagcactagcagcggccaatcagggagcaatgtgaacaagaaagaacagtctgcactgcgagctgtcatcaagtgtgttgaggatcgtaaactagaagctgagtttccactggagggtcttcggaagcaacttgaagaactagagaaagccaagaccgagaagaag

SEQ ID NO: 1442 - DNA, 285 bp, Zea mays
  misc_feature: Incyte ID No: 700550959H1
  unsure 146, 150: a, t, c, g, or other
atacaaacaacaatagatgccagacattttgctatctcagccaagttcccggaattcagtaacaagaaccggacgcttgtggtccagtactccattaagtttgagcaggatattgaatgtggcggtggctatattaagcttatgtnccgnttatgtcaaccagaaaaaatttagtggggacactccgtacagcttgatgtttggaccagatatatgtggtactcaaacaaagaagctccatcttatactctcttaccaggggcagaactatcccatcaaaaaaga

SEQ ID NO: 1443 - DNA, 282 bp, Zea mays
  misc_feature: Incyte ID No: 700550960H1
aagaacacataacttatggaagttcaggaagggttgcaggcttcattgcagaaacattccaaggtgtgggaggtgctgttgaactagctcctggatacctaaagttagcttatgacattgtgcgcaaggctggtggcgtttgtattgctgatgaagtccagagtggttttggccgtactggcagtcattactggggattccagacacaaggtgtcattcctgacatagtcaccatggcaaagggaattggcaatggcctaccattgggggcattgtgacaac

SEQ ID NO: 1444 - DNA, 285 bp, Zea mays
  misc_feature: Incyte ID No: 700550962H1
  unsure 99: a, t, c, g, or other
ctcggtagccggagaacgagcagcagcggaggcgatggcgtccccggatcccggccacacgccggcgcaaggcgaggaatctgcctccccctcctcgtngcctccccgaaagctccagagtttcacaccagggctgtggtcacaatacaaagcttatgaggatgcagttgtggagaacattaaaggaactattgcggatgctctggttcttgtgagagagcatcaggcggaggcaattggatgtgccatgttgcaggattcatctgttcagaggtcctcgaagat

SEQ ID NO: 1445 - DNA, 286 bp, Zea mays
  misc_feature: Incyte ID No: 700550963H1
gttactgctgctcatcgtcctattagggagattcttgaaaaggagaagaaggagagagcttcagcagaaacagaaaataggccattgcctctgtcgcacactagcaatgatgtccgtgcattaagaataagtgatttcatacatgcgcatgaacaggtgtgtgcaagtgtttcctcagattccagtaacatgaacgagcttgtgcaatggaatgatctctatggagaaggcgggtcaaggaaaaagacaacgctaagctacttcatgtagctgatgttgcaagtat

SEQ ID NO: 1446 - DNA, 287 bp, Zea mays
  misc_feature: Incyte ID No: 700550964H1
  unsure 269, 276, 279-280: a, t, c, g, or other
gtcttgtagggtgccaagaacggaatatcagcaatcttgtacaggaccaagattattgatgttatcgagaagggagagaaacagcccaacatcactattggcattttggtctccgttgtcatcgtgttcgttaccgttctcttcaagctcctgtttggtggcaagaaaccagtggcacctgtgaaacctgcagctgaggcgaagaagcccaaggccgcggagacggacggtgctggaagcagtggtgacaaggatgagaaagaggatgnaaagganganncagggcc

SEQ ID NO: 1447 - DNA, 293 bp, Zea mays
  misc_feature: Incyte ID No: 700550965H1
gaaattaaaaagagcacagagggctgtcaaagaaattgctggaggtgatgatagcatggatgagcaggaggatgaaacacaagaaaatgtttggggcagaggtaaaaatgcatactatgctcctggtgaacaatctggtgatgatgaggtggattacgaggaggcacaaaggatacaaaaaattaaggaaaaaaggctgtctatgaaggattttggattagaagatggtgaaagtgatgaagagggtaatgcaacaaaggtatccaaccatgaatccaaaatgaaagaagact

SEQ ID NO: 1448 - DNA, 291 bp, Zea mays
  misc_feature: Incyte ID No: 700550967H1
  unsure 196, 244: a, t, c, g, or other
aaaggaactgcacaagacagtttctactttggaatatggtgctaaggcaaagtgtattgtccgtgctgctcatgccacaacacctagggacaaaatgagctccgaggagtcatctgtgatgctcaattcaagaatcgttgcaatgaaccagttcatccacaagcttcaaaaagagaacaaattgagggagaaagancgcaatgaggcccagaatgtgctaaggctgaaggaagaggagctagcncaactgagagcaaagctccagctgatagaagggccaggggaaactat

SEQ ID NO: 1449 - DNA, 183 bp, Zea mays
  misc_feature: Incyte ID No: 700550968H1
  unsure 91: a, t, c, g, or other
tgatgttatctaacagtgttagattaggcgtcattttctgttgtgatttttggaaactttgtaatgcttcctcctggaactggagcaagtnaactgcaagttaccaggttggcctttagagcatgaacatatcacttaccgtgcgtggtcgttatgtggtactacgtcaggttctcttcgtgt

SEQ ID NO: 1450 - DNA, 288 bp, Zea mays
  misc_feature: Incyte ID No: 700550972H1
  unsure 266: a, t, c, g, or other
aattgcacgacgacatcaaagcacacaaagatattgcacattttgaaacggcatatgttgtgaaactacaccgcatagcgacacttgcacctccacaacaggtttttactttcacccatccaaatttctcaccaaatgccagcaaccaaaggtacaccaagttgcaatttgaaatgctgccagacatgggttcatgccttgtgcacggatttgctggctattttgactctgttctttatagggatgttcatcctggatcgagccanacaccgctacaccaaacatgtt

SEQ ID NO: 1451 - DNA, 285 bp, Zea mays
  misc_feature: Incyte ID No: 700550973H1
gaggtttactctacctccaccaggactcgaggtacagaatcatccatagagatctgaaggcggccaatgttctcctagacaaggagatgactcccaagatttcagactttggcatggcaagaatatttggcaacgaagagacggaaattaacaccttaaaagtggttggcacatatggttacatgtctccggagtacgcaatggatgggatcttctctgtcaagtcggacgtgttcagctatggagtactattgctggagatcgttagtggcaggaggaacaggg

SEQ ID NO: 1452 - DNA, 285 bp, Zea mays
  misc_feature: Incyte ID No: 700550974H1
cgacttctggataaacactgtgggggttgatggactgtttacagatttcaccggaacccttcacaggtaccaagaattgacatccccacaccggaaggatgagactgcaaatagcctcctagtaaaaattagccaaatgatctcagcatatgaaggtctctgatcagcacgacgttgctgaaaattgtttgtgcttttgttaatcgatctgcaagagcacacgatccattcatcacggacggtgcaacgtgacactgtgactttgcaaggttaaataaacgagtt

SEQ ID NO: 1453 - DNA, 281 bp, Zea mays
  misc_feature: Incyte ID No: 700550975H1
  unsure 144, 147: a, t, c, g, or other
agcagtcctctcttgctgctgaccttttgaagttatctgaagcgaacacttcacttggaggcaaattatcctctgtggcggcagagcttgtgcaagtttatgctgataaggaagaagaatctcttgataatgagaagcaaattnctntcctcaatcaagatattgccgatctgaggagaaagcttgaattgttatcatctgagaaagccgcagttgatgatgagttggccaaactgctagctgatattacgactcgtgacgaaaagatgaagcgaatggat

SEQ ID NO: 1454 - DNA, 185 bp, Zea mays
  misc_feature: Incyte ID No: 700550977H1
gaagaggatgaggaacaaatggagataagggatagaacagagacaaatcttgtgaatcttagaagaacaatatatttgactattatgtctagtgttgattttgaagaagctggacacaagcttatgaaaattaagcttgagcctggtcaagagatggagctgtgcattatgcttcttgagtgttg

SEQ ID NO: 1455 - DNA, 282 bp, Zea mays
  misc_feature: Incyte ID No: 700550978H1
  unsure 3, 35, 55, 91, 107, 117, 135, 137, 139, 149, 160, 173, 177, 201, 216, 219,: a, t, c, g, or other
tgntggtggtcatcgtcctgcttgtcctcccgcgncgtcgctgctgcgctgcttngcctgctggtggctcacggcagcgatggaaccaggncacaacagcaacaatngcggtggtantggtagttccagcagcancnanagccacaagnaaggcgtaggnggacgagcccatnccgngccgacgacaccgtctccgtatcngtctccgtctccggnggntggcaacaanagcagcagctacgacgagtngtgaanncccgtgcgacatngnanggtgccncg

SEQ ID NO: 1456 - DNA, 99 bp, Zea mays
  misc_feature: Incyte ID No: 700550980H1
gcagcagtatggcttgaatccttatgaagtttgatgtgtcctctgtgttgtacccaaaactccttctggcagcagtatggcttgaatccttatgaagtt

SEQ ID NO: 1457 - DNA, 287 bp, Zea mays
  misc_feature: Incyte ID No: 700550981H1
gattactgtggttcggtgcaagggggattctggaaatgacacccgcacgcctttagtcattgccaggagtatatggcttgctggaaaaaatgctcatcacgtgcagtcaatgcaccgttgtccagttgtcacagaagatatttcgtgcagtgctggtacaagatgggaattttgtatgaggtgagttgaaggagtaattgactctttatgataactgggtagcttcaacaggaacgccggggcttggtggcatttgttcgtctgttttcttctagaagagaaacaag

SEQ ID NO: 1458 - DNA, 290 bp, Zea mays
  misc_feature: Incyte ID No: 700550982H1
  unsure 2, 5, 20, 100, 108, 114, 123, 140, 152, 154, 157-158, 161, 169, 197,: a, t, c, g, or other
antanctagatttagcaagnctatttagagaatcattgggagaagcaattttctactccacttcttaaatttaagatttagagagttgtttagaagaacnaatagagntgcccntaggaatanagggaatatagtccatntcaaccagtttngnagnnacngtggtttnagccttaagcattggcttgggttggganattgcttggnnacngattgctgnaatccccggggtgnnaacggcaagaaggngacnctctgcnaccggtgccganaccccaaanaggaggncg

SEQ ID NO: 1459 - DNA, 289 bp, Zea mays
  misc_feature: Incyte ID No: 700550983H1
ggaagatgtgggggaaaggaaagaagcgtttcggcggtggcggcagcggtgagcccgcggccaagcgccaggccgcgagggacgatggcccctccgaatccgctgaagacggtaccgtcgtagccgagatatcgaagaacaagaaggtgtccgttaggagctggaaaggcagggtcttcgtcgacttacgcgagttctacttcaaggacggcaagactctccccacccgcaaaggtatatcactccaattagatcagtggaagatattgaaggacaacatcaaagccat

SEQ ID NO: 1460 - DNA, 286 bp, Zea mays
  misc_feature: Incyte ID No: 700550984H1
caggagactgtcgcaaaatcagagcagattctggagcagcgggaggcagctgttgtggcaaaggaactgacctctttggagaagttgcaggagaagagggaagctgcattagctatgatctttagcaagtccaggctttccttacctgttcctaccatcaacccaatgaacaaggcgctgaataatcttggtgtcaagtggccaaaaccggcatctgaggagagtgtgcacttgcagttgataatgctgtagtgacgcctcgttctgagcttgttgcactctgtga

SEQ ID NO: 1461 - DNA, 285 bp, Zea mays
  misc_feature: Incyte ID No: 700550986H1
aaagtgtgaaattttgattgcatttgcaccatttgtagttgtcatggcggcattcgtagcattcataatctggaatggtggtatagtactaggtgctaaggaagctcatgttgtttcgccacactttgcacagtttctgtactttggccttgtgtcagctgctgccctccttccatggcatttcactcccaaccgagtattggatctattccacttgtctggaaagaacaaaacctgtggttctctggcagcattaatgggtcttggtttaagctttggtcgctg

SEQ ID NO: 1462 - DNA, 109 bp, Zea mays
  misc_feature: Incyte ID No: 700550987H1
  unsure 55, 57, 59-60, 62, 69, 71, 78, 84, 91-92, 94, 98: a, t, c, g, or other
aggaccacgacatgaaggagcgcctctgcctcgaggctgagcgccttggcctgtncncnntnatcattngnactcgcngttttngggttcnngntaancgcggaaacgg

SEQ ID NO: 1463 - DNA, 280 bp, Zea mays
  misc_feature: Incyte ID No: 700550989H1
tctcgctgtaaaaggatagtcgcagaatccaccggattaagcatgctagaaaaatctgttccagcgctccgatgcaactcctcgtggtcatgtttgcttttcttttctggctaatttgttccagaatggatgggtcgaattttggagcaaaaatctttctggcttctccatgtactaccataacgatttgtcagttaattctgcagattggtgtggtgttattcagggccgactatgatgcctctagccatttgtgtacatacgtataaatgaactaggt

SEQ ID NO: 1464 - DNA, 160 bp, Zea mays
  misc_feature: Incyte ID No: 700550990H1
  unsure 9, 23, 40-41, 51, 59, 66-67, 72, 77, 80, 88, 95, 120, 125, 133, 141, 148: a, t, c, g, or other
aagaatacnactaactgtgttgnaagacctcagtggagannaagatgtcanccatggancatgagnncttcnaagtnacnctctcaanaacttgnttatcctcctgatcgcttggtagangagantccaaacntgggaaantccagtngtgtgagcaagg

SEQ ID NO: 1465 - DNA, 278 bp, Zea mays
  misc_feature: Incyte ID No: 700550992H1
gaggagaggaaagaacctggaagagaggagcttgaggagatggcgagcgccgagggcgagaggtgggtgggactggcgacggacttctcgcaggggagccgagaggcgctgcagtgggcggcgaccaacctgctccgcgccggcgaccacctgctgctgctgcacgtcatcaaggagcccgactacgagcagagcgaggccatcctctgggaatccaccggctccccgttgattcccctctcggagttctctgacctattatcgcgaagaaatatggg

SEQ ID NO: 1466 - DNA, 270 bp, Zea mays
  misc_feature: Incyte ID No: 700550993H1
  unsure 37, 72: a, t, c, g, or other
caaggcccccaagtttgatctcgggaagttgatggangttcatggcgactacaacagaggacgttggtgtgntgcttgagaggcctgtcgagggtgatgaggctatgcaggaggttgctgctgccgagtagtttatttgctacttctttatctagacgaatctggacaggaggtcccttatgacgcgaacttcataaaattgtctggcgacatgttttcttctgtccctgccctaaactctaaacccaaaggttattcgtaacaagtgtt

SEQ ID NO: 1467 - DNA, 282 bp, Zea mays
  misc_feature: Incyte ID No: 700550994H1
aaatattacatgaagtggctccaggcagcagaggttgggcatatggctgccgacggttttgccatgagatgatgagtgctgcaaacaagcatctctacgaatctagtcgatggacgtgaggtttctttatgagctgtgcagtcgcttatacatcgtagaaatgtatatttattgtgcaagaaaataatcagtcaataatcgaagatgtggttgtgtttcttgagttgatttcttcttgagcatagcaatgctcaaaagagttgttgatctgcacactgctgg

SEQ ID NO: 1468 - DNA, 285 bp, Zea mays
  misc_feature: Incyte ID No: 700550995H1
  unsure 57, 264: a, t, c, g, or other
ttcctcgctggggcccaactccatcttgccggcgagaaactttcttcacaaccggcnaacaacgattttgatgcggaccaggcgatgttcaagatccttggcctgatccccaaaggctccaagctttggcgaggaagaggtgtctgcggcggctcccgcagaatccgagaggtctgagcaagctgcttcgatgtagaatatatacatatcattaccgattatccgtatcacggttggggcgaaactagaactaccgttgtagcnagagcattggattgtagaaac

SEQ ID NO: 1469 - DNA, 280 bp, Zea mays
  misc_feature: Incyte ID No: 700550996H1
  unsure 278: a, t, c, g, or other
caaaagagtaggagcctttgccatggctcttcagacaataaacaagtgcttgtctgatgcagtctgtgccatggcacggagtatgttagatggcgagagtcgtgctgctgccctaattcattctggcaatgaaattttggagacagctagatactcttctgaagccagcattcaagagaaggacctcattctgagcaacaaactgtgctgagacagcttgaagctattctccatatttataggctagctcgagctgggcaaactgtagatgctttgangg

SEQ ID NO: 1470 - DNA, 270 bp, Zea mays
  misc_feature: Incyte ID No: 700551001H1
tgactcagagatggacgaaccagatgatgaaggtgttcacatggatgaagagaatgatggagcagtcctggaatctgaggatggagtgtctaatgtggttgaactgcccaaagaatcaaaagggaagtatgtacctccgagtctgcgtaatgcttccaattcagaatcagaagaaattgcccagatgcgtcgcagagtaagaggacttctgaacagactttcagagtcaaatgtggagtccattactcaggaaattgccacactttttcg

SEQ ID NO: 1471 - DNA, 281 bp, Zea mays
  misc_feature: Incyte ID No: 700551004H1
aactcgcaccctcgctacgccgatccgtctcttctcccctaatcctccttccccgatccagtcccgcagcaacgccgagggagagcgaggagagacagatacagatcgcgcgctcagatgtcgtcggactcctcgtcgtgggcgcgcgccctggtgcagatctcgccctacaccttctccgccatcggcatcgccgtctccatcggcgtctcggtcctcggcgcggcatggggtatcttcatcacggggagcagcctcatcggggccgccatcaaggcgcc

SEQ ID NO: 1472 - DNA, 280 bp, Zea mays
  misc_feature: Incyte ID No: 700551005H1
gaaagaattcctttaactactttaaggtgaaatcagcattttccaaggcgtactctgtgttaactgatgcaaacttgtttattagtttgggacataataggagcattctgggtaccattgtgagaccagattcagttctccttgaccggaaaggctggaacaatgaagatatgttagcggaaccctgggagccgatcacccaacagtttgacaccgagaatgatgcagtatacaattggcatgtgatagacgaggatgaaccattgcccagaaatagtca

SEQ ID NO: 1473 - DNA, 282 bp, Zea mays
  misc_feature: Incyte ID No: 700551007H1
  unsure 68, 158-180: a, t, c, g, or other
agagaagcaaccctatgtggatcaagctgggcagaagaagcaggactatgagaagaccaaggcaaatnttgagaaggagagcacaagctcaaagaaggctaagactgatgacgacgatggctcgaagtccgaggtcgatgatgaggatggcggtagtnnnnnnnnnnnnnnnnnnnnnnngtaaatagtatctccgctgtcgtgaggtagcaaatcgattgttaggtccccaattagctcactggtttgctatctttaatgttaagttgtttggaacaggtg

SEQ ID NO: 1474 - DNA, 279 bp, Zea mays
  misc_feature: Incyte ID No: 700551009H1
tgaatattactcccttgacgcgacttaccgcagttggcttaaaattgagatgatgaatgccgctgtttctcctgagatgctttcggcagaggaaaagggtcaagctgttgctgcagctaaagaaacactgaacttggcatgttcgttactacgcagggatggaagaccatggctgtatgctgtcgagagcagtccatttgaatcccccgatgttatttccttgagctgcatgctctgcaatgctctgcctaccttctggagaatgtatgttaccagatg

SEQ ID NO: 1475 - DNA, 166 bp, Zea mays
  misc_feature: Incyte ID No: 700551010H1
  unsure 7, 11: a, t, c, g, or other
gtcgcangcangaatacgtaagctcggcgcagacatggtgtgtttgtctgaagaattgttgtcaatgctggcttgctctggactcaagttgtttgtggggggtgaaaaaatgctagctactgtagaactgcagcaacaccagaaccgcaccaacggcgaggcgagg

SEQ ID NO: 1476 - DNA, 277 bp, Zea mays
  misc_feature: Incyte ID No: 700551011H1
ggtcagtgacgattgagaaacccgtagtcggagcagaggaggggtagaggatggtgttcggtcaggtggtgatcggcccgccgggctccggcaagaccacctactgcaacggcatgtcgcagttcctctccctcctcggcaggaaagttgcggttgtcaatttggaccctgcaaatgacgcattgccatatgagtgtgccataaacatcgaggacctcataaaactcagtgatgtcatgtctgagcattcgcttggccctaatggagggcttgtgta

SEQ ID NO: 1477 - DNA, 277 bp, Zea mays
  misc_feature: Incyte ID No: 700551013H1
acacttcgttgtatgcaagctttggtcagggttcaggcccgtgttagagcaaggcgagttcgcatggctttggaaaaccagactgatcagcaaaatacttcaccagagcacacgaccgtggcacgtgtcagagaaattgaggatggctggtgtgatagtattggttctgtggaagatatccaagcaaaacttctaaagaggcaggaagcagcagctaaacgtgagcgagccatggcctatgctctagctcatcagtggcaagcaagttcaagacaaa

SEQ ID NO: 1478 - DNA, 279 bp, Zea mays
  misc_feature: Incyte ID No: 700551019H1
gaaccagataacaatacagaacattctgaaacaccttctgaaacaaatgaattgacatcaacttctggcacaagcgatgctgctgatggcacaaaggaaatcgtacaagagaactggcttgtgttacttttcagggagcttgagaagcaaggcatcactttacctgagaggtttactgaagatgaattacgcagattttatattgctgcaaatggcgacttttcaagtttactctcttcggttaagaagacaattcgttggagggaaacgtttcacata

SEQ ID NO: 1479 - DNA, 277 bp, Zea mays
  misc_feature: Incyte ID No: 700551021H1
ttgctattcagttgtgcagttgatataagaagtattcaaaatgacgatcttatcaaggacactattcctttgtcataagagttttctgattgtttcacttaactaacatgatttcgttcaagatgttcaggatgtttagagtgtttgggcacaagaaagtctgggtactagacggcggtttgcctcagtggcaagcttctgggttcaacgtggaaaaggccagccctgacgatgacgcagttctgaaatcaatcgctgcaaacagggctgtcaaaag

SEQ ID NO: 1480 - DNA, 279 bp, Zea mays
  misc_feature: Incyte ID No: 700551023H1
ggcaatgatgttccttgatcgacaaaaacaatcaaagaatcctaaatatattctggttcactgtacccatggtcataatcgtacaggtttcatgattattcattaccttatgcgcacacacgtctcttgtgttgctgaggcgattagtatatttgctcaaaggcggccacctggcatatacaagagggactatattgaagcattgtattcattttaccatgaggttcctgacaatatgatgatagcatgccctccaacaccagaatggaagagaccaga

SEQ ID NO: 1481 - DNA, 280 bp, Zea mays
  misc_feature: Incyte ID No: 700551024H1
ccatcctcagacagaacaggcgaacagcctcccaagcgacacaacagcctcaggaggcacccccgcggttagtctcgaagcttccgttcggaaccagggttagggtttcgcgtcctcccgtcgtcatcctcagccatgtccgggcgcgaggtccgcgagtacaccaatctcagcgaccccaaagacaggaagtttggtaaagggaaggataagatcgacgatgaggacatcaccttccagcgcatggttgcaaagatgcaagaggttgctggtgataggg

SEQ ID NO: 1482 - DNA, 279 bp, Zea mays
  misc_feature: Incyte ID No: 700551025H1
  unsure 77: a, t, c, g, or other
acaaccaggactgttgtttgagctatttgcttctctcgaagcaaatgaaagagaccaggcaagagctgctttgctgnccacaatctgtttcaaacaagccatctcaaactgcgggtacatcaaatgacgaagaagactcaaacaaatgcacaacatcaaatagcgacagccaggtggaggatacatttgaactaggagatgaactatttgcaaaattttatgctgcacttgatgaaatcaatttctttaagacatcacctgctggagctgaagatcctg

SEQ ID NO: 1483 - DNA, 188 bp, Zea mays
  misc_feature: Incyte ID No: 700551026H1
  unsure 159: a, t, c, g, or other
agttaatcttcatttgattttatcttgttagcagcgcaggaaccgttgctgattcagtggttggtagtttctttcacttcctgagttgttggtttagggcatgttcgttttgctcttaatccatgtggattgagtgggattggataggtttaatctcanataagttaaaatctttcataatttttttt

SEQ ID NO: 1484 - DNA, 225 bp, Zea mays
  misc_feature: Incyte ID No: 700551028H1
ccacagcagccgcctatagagaagatggatgttcccagcacggagagtagacgtgtaggaagaacattcctagatctaaacgagcttgcacctggaggtggctttgatgagagcccaagcttgacagtgaaagatgacatagacaacatttagggaataaagtttttttctttgatacatttgagtgctgttggtcagttttctgacttcgaagcaagggcggca

SEQ ID NO: 1485 - DNA, 276 bp, Zea mays
  misc_feature: Incyte ID No: 700551030H1
agaacaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcggttagtccttgccttcaaggttc

SEQ ID NO: 1486 - DNA, 277 bp, Zea mays
  misc_feature: Incyte ID No: 700551031H1
ggaattggtgaccatagatgtcatttcgtagcatagtccgtgatgttagggatggcttcggcagcttgtcaaggagaagctttgaggtgaccctcgcaagcatttatggccttactgggcatcacaaagggaagacccagagctcatcacatgtgctcgacgactcaccttccataattcgtgaaagtcgatgggcgaatctacctcctgaactcatccgtgatatcatacggagactggaggctgatgagagcacctggccagcgcggaagcacgt

SEQ ID NO: 1487 - DNA, 283 bp, Zea mays
  misc_feature: Incyte ID No: 700551033H1
acaaccaggactgttgtttgagctatttgcttctctcgaagcaaatgaaagagaccaggcaagagctgctttgctgtcacaatctgtttcaaacaagccatctcaaactgcgggtacatcaaatgtcgaagaagactcaaacaaatgcacaacatcaaatagcgacagccaggtggaggatacatttgaactaggagatgaactatttgcaaaattttatgctgcacttgatgaaatcaatttctttaagacatcacctgctggagctgaagatcctggtcta

SEQ ID NO: 1488 - DNA, 279 bp, Zea mays
  misc_feature: Incyte ID No: 700551035H1
  unsure 3: a, t, c, g, or other
atnatgcatctgtactcacagcccttgctgcccaagatgcactatgtgcacccgctgtctgtgatacaggtggacaacctgaggcgccaagccacaagcattgtctccacaaggctgggccgtgcagagccaccgctgcggaaggaaatcgtggaatacatgcttgacgtggactcacacatgtggagcatgagaaagagcaaggcaaatttcttccgtatcacgggtgtcctgagccccctgtttgctgtggcgaggtggttcgatcagatctgtcac

SEQ ID NO: 1489 - DNA, 277 bp, Zea mays
  misc_feature: Incyte ID No: 700551036H1
  unsure 31: a, t, c, g, or other
aaacgactacctggctgtgactgcggcgaanacgcgacattcctgccgcactaccgcggggcgctactccaagaagcggttccgcaaggcgcagtgcgccatcgtcgagcgcctcaccaactcgctcatgatgcacgggcgcaacaacggcaagaaggtcatggccgtccgcatcatgaagcacaccctggagatcatccacctgctcactgacgccaatcccatccaggtggtcgtggacgccattatcaacagtggaccacgtgaggatgccacc

SEQ ID NO: 1490 - DNA, 278 bp, Zea mays
  misc_feature: Incyte ID No: 700551037H1
  unsure 70, 76, 147-149, 156-157, 182, 237, 252: a, t, c, g, or other
cgcgccatgcattgctgtgtgccgtgatccgaggtggggccggtgctacgagagctacagcgaggaccgncgtctncgtgcagaacatgactgagctcatcccgggactgcagggcgacgtcccgcagaatttcaccagcggcatgnnnacccgcnnccggaaagaacaaggtggcggcgtncgcgaagcacttcgtcggcgacggtggcacgcacgacggcatcaacgagaacaanaccgtcatcgaccgnaggggcctgatgagcatccacatgcc

SEQ ID NO: 1491 - DNA, 276 bp, Zea mays
  misc_feature: Incyte ID No: 700551038H1
aaggtcgttgtcgtctccaggtccatcaaatgcgacaaggtcgagcgcacgcaattcagctccgaagtcatctcctttcaacagaaagatgcaagtaacaccaagtcacttgcctttgatggttgatacatttcactgtatatcattgcacgacagatccatttagtacctttttctgagttaaactacttcaaacattgctgaagactacaaccagttgttgtaattgaagcgggtcaagacatagcatttgcaaagatttagttcattctcatc

SEQ ID NO: 1492 - DNA, 203 bp, Zea mays
  misc_feature: Incyte ID No: 700551040H1
  unsure 31, 62: a, t, c, g, or other
gtctcggaaccaagcaagccgaaaaaaggtngccgatccaggcatggggcaggagccgcggnccgtgacaaactgcaccgaccagaatgcgccgcaccggggcggggtggtggctggctgacgaccggccacttgcgtgcggccgagtactagtacgttttcttggtaccaaagaaagtagtaattgattatcaccaccacat

SEQ ID NO: 1493 - DNA, 274 bp, Zea mays
  misc_feature: Incyte ID No: 700551041H1
atgaacaagcagtgcaggttggtggagcagataaggtatcttttgaaagacgacgaggaagcaaggatccagctgggctcaaatggctttgccgaggcactggttgagttcttgaggaatgctgtgaatgatggaaatgagaaggcacaagaagttggtgcaatggctcttttcaatcttgcagtcaacaacaacagaaacaaggggctcctgttatctgctggagtcaccgatctacttgagcagatgatatcgaatccacggctatctggtc

SEQ ID NO: 1494 - DNA, 274 bp, Zea mays
  misc_feature: Incyte ID No: 700551042H1
aaaccctagctttctctcatcctccacgaaccctagatccaaaatctaacacacgtcatcctcttattatcgccgtgcttgacgcttctctctgcagtcgattccgccgcggaccgaccggttcacttcccttttctcccgagatctcgactctcgagcaagtatgggtgaggcgaaggacaacgaggtgtacgaggaggacctagtcgactatgaggaggaggtggagaatgtcattgatggcgcccccaccaacggctcctcagatgtcgtc

SEQ ID NO: 1495 - DNA, 272 bp, Zea mays
  misc_feature: Incyte ID No: 700551045H1
gaggagggaaacagagaagatgacgacgaagcgcgacaccgagtcggacggcgaaggctccaaccccgtcggtggtggcgcgactccgccgcccctagccgccgcccctgtcgtatgcctcctccgctccgccggggacttcggtggcggcgccttcgttggatccatcttcggatatggacaaggcttgatcaccaagaagggttttaagggctcattcagcaatgcagggtcctctgccaagacttttgcaattctctctggcgttcaga

SEQ ID NO: 1496 - DNA, 241 bp, Zea mays
  misc_feature: Incyte ID No: 700551046H1
  unsure 208: a, t, c, g, or other
gccaagcacgccgtctccgagggaaccaaggccgtcaccaagttcaccagcaactgagcgcgctgcgggatccgcggatctgttagaagggttctttgctgtgtcctttccccagtcccccaccctacccgcctagtagctagcttgcctgctctataaatccggcgcgccggattgtaatggtcctcttagatttgatgtccctgtngtggaatatagttgtatctctccgcttgctatt

SEQ ID NO: 1497 - DNA, 273 bp, Zea mays
  misc_feature: Incyte ID No: 700551047H1
aaaatacccctccttgtggtgtctctaatataccagctctattagggtcttgaactgaaggatgctgccacgagatattgttatttcaaccctgttgatacttaagctattcggttcaatggtgcaaggaatacactctaatacgattttgcatcgtccgatacatatatttatggtagagcgccctagcttccttgttctagtgttttttaagggtcgtgctggttttgccaccagtccattattggctgatgagatagcaaatgtccgaga

SEQ ID NO: 1498 - DNA, 274 bp, Zea mays
  misc_feature: Incyte ID No: 700551048H1
  unsure 141-142: a, t, c, g, or other
gatgcatctgccgagtctggatctgaagtggaagatgtaacatctcctactgcatcaaggaacctgattacacatcctattttgacccctgttcacgaagagtcaaaattgtcgccacatggttccacatttgttgctcannttctattgaagaaaacattcctgttgtagacaaggttgtggatgatggatggggtactcccagaggtagtctccaagcttcttcaggttcgttgccctcgagaaacacgcacggcacattcgaaggactgag

SEQ ID NO: 1499 - DNA, 280 bp, Zea mays
  misc_feature: Incyte ID No: 700551049H1
  unsure 45, 112, 114, 117, 122, 126, 129, 136-137, 139-140, 142, 150, 154, 157,: a, t, c, g, or other
agtatgagaggttgagaaaagagagggaggaaaagagagcgcagntggatcggcttcgtcaacgtgcagaaggcgcaggtgctttacgacaaaggccaagaggaaggagcantngtnaattngttnatnagaagtnnanntnccaaaagntttnctngaagggatgcctggtggtggtttccctagagggatgcccgntggaggtttccccgggggtggnatgcctgggggtttccctgggggtggnatgcctgnaggtttccctggtggtntccccgta

SEQ ID NO: 1500 - DNA, 273 bp, Zea mays
  misc_feature: Incyte ID No: 700551050H1
  unsure 201: a, t, c, g, or other
aactcggagctgcagcagctgctccacatcttcaagttgcttggcaccccaaacgaacaggtgtggccaggcgtcggcaagctgcccaactggcacgagtacccccagtggaagccgacgaagctgtctgctcttgtgcccggcctcgacgctgatggctacgatcttcttgagaaattgctggaatacgagccggcgaanggatccccgcgaagaaggccctggagcacccctacttcaaagatgtgaggaagggagatgcgcatgactgaa

SEQ ID NO: 1501 - DNA, 89 bp, Zea mays
  misc_feature: Incyte ID No: 700551053H1
  unsure 8, 10, 87: a, t, c, g, or other
gcaaaagntngacgggggaaagcaacggagacgagggcaacggaccagggctgagagcctaagaccaccacaccttccacacaacanat

SEQ ID NO: 1502 - DNA, 273 bp, Zea mays
  misc_feature: Incyte ID No: 700551054H1
aaagaagccaacaccgtcaattgaaatttgaagacaatgcaaaaaccactaatgattctagatggcgcattccgatgtataaaatgccctatgcaccaccacctccagcagtgccacccccaggctatgtaccttctccacattttccttatccaggccgcctcttatcttctgggcatccatacggagatctcgctggtaacatggaaaactcagcaccacatagtctgcatagatggattcagtgtgatggctgtggagcgcaaccaattg

SEQ ID NO: 1503 - DNA, 274 bp, Zea mays
  misc_feature: Incyte ID No: 700551055H1
  unsure 55: a, t, c, g, or other
acgaattacacgagggaagaacgctgatgaacaaatggcgtaaatctctatcgangaagctgtggaggaaaacgaaggatctccccgtgcttgtgcatgccagatcgcctgctctacgtccgcatcccgtccctcgcgaaactcggcactcccagggtgtgcaaaattcatggcttcagacacccgcaagaagctcattcagatcgatgtgagctcggatacagtgtgcccttggtgctttgtcggtaaaaagaaccttgagaaagcaatggag

SEQ ID NO: 1504 - DNA, 273 bp, Zea mays
  misc_feature: Incyte ID No: 700551056H1
gtgtacgaacctacgacagctctctacttccctcgcgtcctctccatcgagagctgctcctgctcgtctcctcccacaccgcgcaattcgtcgggattcgggaaccctagcgccggatctccgcggcaggacggaaatggcgaatcccctagcggggctgcaggaccacctcaagctcgcgcgggactacgcgctcgagggactctacgacacctccatcatcttcttcgacggcgccatcgcccagatcaacaagcatctaactactttgga

SEQ ID NO: 1505 - DNA, 271 bp, Zea mays
  misc_feature: Incyte ID No: 700551057H1
agcaattgaagctcacaaagcatggctgaagagacctgaagtgcttgaaaactgttccactgggcttcatttcccctcagaacatgtggagaactctgaggagaaggtgatgccactcaaatcacttcaattctatgccgctgatgggtagagagatcgttgatggcagctactggaggatgctgcagttgttgatgtaaataagctcgcttgacagttgtggaacagtgttgttagatgctcacctacgtgcattatctcagttaacttg

SEQ ID NO: 1506 - DNA, 270 bp, Zea mays
  misc_feature: Incyte ID No: 700551058H1
gctggttcagtctcttttgagccggctactagaatttggaaaagttgggccccccaaggtgtaaattcttcatttggttggcttctctaaatcgttgctggacagcggatagattaagcagacgaggtctcgtgcatcctgtaaggtgccccctttgtgaccagcaggaggaaacagttcagcatatcttggtggcttgtgtgtttgccagagacacttggtggcagactttgcacaaggtagggctgcatcgcctgactccaggattga

SEQ ID NO: 1507 - DNA, 271 bp, Zea mays
  misc_feature: Incyte ID No: 700551059H1
  unsure 2, 5, 7, 12, 14, 19, 57, 66-67, 69, 71, 78, 113, 125: a, t, c, g, or other
anagnanaccananaaganagagagggggagagacacagaggcctcactccacacancatacgacnncnanaagcaanaattaaagcgacgcgcaagtcgttataagatcaanttcttgaatccntgccgcaaaggaaagaagctgcttgtccttgacatggaactatactctgtttgaccataagtcaacagctgagaatcctatggaactcatgcgcccatatcttcaccagttcctcacagctgcatatgcaaaatatgacatcatgg

SEQ ID NO: 1508 - DNA, 268 bp, Zea mays
  misc_feature: Incyte ID No: 700551060H1
aaagaactccttcgtcttgacccagcagaagaaggtggatacgtcttgctttccaacttgcatgcggctggaggtcactggaaccacagtgacaaagtgaggcagatcatggaaagaaaaggattgagaaaattagcaggtgctagtaattttggatcttgatgttgttgcttcacaagttcagatgccaggcaagactaccattttttttgaaatgcaagcttgtttcttctaatgaacggattaaatcttgtacatttcatggaaa

SEQ ID NO: 1509 - DNA, 267 bp, Zea mays
  misc_feature: Incyte ID No: 700551061H1
  unsure 218, 221, 227, 231, 237-239, 241, 255, 260, 266: a, t, c, g, or other
gacgcgaccgacccaggcaggcaccactccgctcaacgcaccgggcggcacccaaatcccaaaccctagcacacgcaccatggcggcgcagagaagatccggtggggggagctggaggaggacgatggcggggacctcgatttcctcctcccgccccgcgtcgtcgtcggacccgacgagaacggcctcaagaaggtcatcgatacgtcttcgacganaanggcacnaagntcgggnnnanaacaacaaccgggntcggnaaattng

SEQ ID NO: 1510 - DNA, 270 bp, Zea mays
  misc_feature: Incyte ID No: 700551062H1
gttgagtcatatgcaggacctcctccgattcctgaccattttgaagctccaccaggcccaatgcactatgggcgaccatcagatcctccaccagggcattgtgcaggctggtctaggccgcctaggatatctaataactattctccctcaagacattctgtggagcctccagtttcccatgcagctggagctggaggtatgtaacatgttgtgttgatatatatgctttttaatgaaagctgtttccatttctattaatatctgtttctg

SEQ ID NO: 1511 - DNA, 273 bp, Zea mays
  misc_feature: Incyte ID No: 700551064H1
  unsure 91, 235: a, t, c, g, or other
aaagctttccaagaaactgaggagggctttctttctctagtcatcaaggaatggtctttcaagcctcagattgcatcagttggctcctgtngccttgttggtgtaatctgtgctgggactctctatgttgcaaacctgggcgactcgcgtgcagttcttggaaggcttgtgaaagcaactggagaggttctggccactcagttgtcagcggagcacaatgcatgctatgaagaanttagacaagagctgcagtcatcacatcctgatgatcca

SEQ ID NO: 1512 - DNA, 275 bp, Zea mays
  misc_feature: Incyte ID No: 700551065H1
  unsure 68: a, t, c, g, or other
aggagggaaacagagaagatgacgacgaagcgcgacaccgagtcggacggcgaaggctccaaccccgnccggtggtggcgcgactccgccgcccctagccgccgcccctgtcgtatgcctcctccgctccgccggggacttcggtggcggcgccttcgttggatccatcttcggatatggacaaggcttgatcaccaagaagggttttaagggctcattcagcaatgcagggtcctctgccaagacttttgcaattctctctggcgttcagagtt

SEQ ID NO: 1513 - DNA, 272 bp, Zea mays
  misc_feature: Incyte ID No: 700551066H1
acagcatcgcagaaaccaatcattcatggcaatctgaaaacaaataacattatgcttgacgctgatttccagcccaggatatcagacttcggcctctaccttctgctgaaccctgctgctgcgcaggagatgcttgagacatctgcaatgcagggttataaggctccagagctgatcaagattagggatggcaccagggagagtgatatctacagtttgggagtgattatgctcgagatgcttgctcagaaggaggccgcaaatgatgaatc

SEQ ID NO: 1514 - DNA, 269 bp, Zea mays
  misc_feature: Incyte ID No: 700551068H1
  unsure 16: a, t, c, g, or other
ccggagttacttgacnattttgactttgagcagaatgaagctacacccattaaggataaagatgtctacaagcaaaaattaaagcgacgcgcaagtcgttataagatcaagctcttgaatccgtgccgcaaaggaaagaagctgcttgtccttgacattgactatactctgtttgaccataagtcaacagctgagaatcctatggaactcatgcgcccatatcttcaccagttcctcacagctgcatatgcaaaatatgacatcatgat

SEQ ID NO: 1515 - DNA, 270 bp, Zea mays
  misc_feature: Incyte ID No: 700551069H1
atccagacaggaaaactatcagatcatacccagctggatactgctgatgagtctaatcgatatgatctaccggaaggtaccaatgcactgggatatgctctgcaaaatccagaaagcggagagaataatgaaaacattgcactgtccaagtctgacaatataagctcaatccaaattgaagctggtcaggttgaagctacagaagataagagcatccaatcaggctctatagaatacactccaggggaagctaaatctgtcactaggaaa

SEQ ID NO: 1516 - DNA, 245 bp, Zea mays
  misc_feature: Incyte ID No: 700551073H1
  unsure 23: a, t, c, g, or other
cagagaacactaaggtggtggtngagagtggtgctgtgaccatctttgtcaagctactcaactccctcagcgaggatgtccgtgaacaggctgtatgggctttaggtaatgttgctggtgactccccaaagtgtcgtgatctggtacttggtcatggtgggctataccctttgctgcagcagcttaatgagcatgctaagctttcgatgcttaggaatgccacatggactctctccaacttctgt

SEQ ID NO: 1517 - DNA, 266 bp, Zea mays
  misc_feature: Incyte ID No: 700551075H1
acaaggttgcacgtgttgacatatctaatcgtctcaggtcatcgccatgtgttcttgttgcagcgaagtttggttggtcagccaatatggaaaggctgatgagagcacagtctatgggtgatacagcctctttggatttcatgcgttcgaggaaagtttttgaaataaacccagagcatgagataatcaaggccttgaatgtggcatgcaggaataaccctgatgatcctgaagccctaaaggctctggatgttctctttgaaact

SEQ ID NO: 1518 - DNA, 267 bp, Zea mays
  misc_feature: Incyte ID No: 700551077H1
  unsure 30, 205-206, 239: a, t, c, g, or other
gactagttcttagatcgcggaggccagcgnatcgatcattcgatccccaccactgcccgaggccccctcctcgctgacttggctcctccgccgtggccggagggaagcaagtggggaccacagaagcattagctgggtgaactctttcaaaaggggcaggtgcgctagtttgaatggctgctacaaagcttcaggccttttggannccaccctgctggccccaaaaccattcatttctnggcgccaacattcaaatggggtatcagc

SEQ ID NO: 1519 - DNA, 268 bp, Zea mays
  misc_feature: Incyte ID No: 700551078H1
  unsure 234: a, t, c, g, or other
ctcatggcagcgtagagtcaggtgaatccagctcacagcacgccggagagaatggttcgtatttcgctgtgagttcccccatggctacaactacaagcgtgcatgacgacatcacggagcttcagaactttcttttggaagatgatgacctcaacttcggcatggattcagaaaacaccgggcttgaaggcaccgaggcaacagatgatattggagaactgattcaggggttcnacacacaagaggaacttgacctcggcagtggagc

SEQ ID NO: 1520 - DNA, 266 bp, Zea mays
  misc_feature: Incyte ID No: 700551081H1
  unsure 20, 22, 26, 30, 60, 86: a, t, c, g, or other
gcactcttgcagggaaggantnatanagcngagcactctatgaaagatgttccaacatanctacctgaaggcacaatattgccctntaacctcccacgagaagatgtaagagatgcattcatatgcttgactgcaaattcgctcgcggagttcctgctggcagtgttgttggaagtgcttccttgcggagacaatctcagattctctacagatatccatcatgaaagtagttaattcagaggaatgttcagacaggttaaggaaat

SEQ ID NO: 1521 - DNA, 266 bp, Zea mays
  misc_feature: Incyte ID No: 700551083H1
cacaaaaagccccagaaaaacaaggagggtcatcatcaaagggagagccttctggtagcacctttgatccttctgagtatgaggaaaatgacatggatgaacttgctctagtcaaaatggtcttttcaatgttcccaaatgtctccacggacttcattgatgagttaatcaaggcaaatgattttgacatgaatctgactgttgatatgctttatgagctgaactcacaagatatggttcatgatgattctgaggttatcaatcat

SEQ ID NO: 1522 - DNA, 266 bp, Zea mays
  misc_feature: Incyte ID No: 700551085H1
attgctggagctggtgagcttcatcttgagatttgcctgaaggatctgcaggaggacttcatgggtggtgctgaaattattgtttccccacccgtcgtctccttccgtgaaacgttcttgagaagtcctgccgtactgtcatgagcaagtctcccaacaagcacaaccgtctgtacatggaagcgcgccccttggaggagggtctcgctgaggccatcgatgacggccgtattggcccacgtgatgatccgaaggtgcgctcccag

SEQ ID NO: 1523 - DNA, 273 bp, Zea mays
  misc_feature: Incyte ID No: 700551087H1
  unsure 58: a, t, c, g, or other
aaaccctgaacaaagccagccccaagatgaacggtgcatttccgccgtacagatcggnctccacttgcgatatacttgatcttatcctcagtaagaatgactcggatggagattcgagcagccaggtgggcttcttatgcggctcacctccgatacgcgctgacaaccctgttatccatgatccacagtttggtaaaagactgccatccttttctcctctaggagggagctcctatggcaaaatgccagcagtacgagttgaagtaggctcgc

SEQ ID NO: 1524 - DNA, 111 bp, Zea mays
  misc_feature: Incyte ID No: 700551088H1
gcagcagtatggcttgaatccttatgaagtttgatgtgtcctctgtgttgtacccaaaactcttctgcagcagtatggcttgaatccttatgaagtttgatgtttgaactt

SEQ ID NO: 1525 - DNA, 265 bp, Zea mays
  misc_feature: Incyte ID No: 700551090H1
ccatgattgaccatgcgcaggaggatggcactgtggtgttccaggatggcagctcaatcaaagctgatgttatcatgcactgcactgggtatagtgatctgcagtatcacttgcatcccgtttcctacaaaagcatgccattttgcgttaatttggaatctgataatgtgcttcttgcatttgtatgttgcctagctacctgtatgactttccattccttggagatgacagcactatcaccgtggatgacaaccgtgtcgatcca

SEQ ID NO: 1526 - DNA, 259 bp, Zea mays
  misc_feature: Incyte ID No: 700551091H1
  unsure 61, 108, 256: a, t, c, g, or other
accactgctccgccgcctccggcgaccgccggagcccgtggtggaggaggacgtggagagngtagatctcgccagatccaaggaggtggggacgagatggtgagctcntcgtcgtcggtggttaacgtgtacccgctcgccaactacacgttcggcaccaaggagcccaagatggagaaggacacctccgtcgccgaccgcctcgcccgcatgaaggtcaatacatgaaagaaggatgcgtacaatgttgaagcancct

SEQ ID NO: 1527 - DNA, 263 bp, Zea mays
  misc_feature: Incyte ID No: 700551092H1
gtcactacgtacatttttttttcctttcaaagcagctaggtgaacaaggacgagtacctgtacttctgctgaagcttgacgaccccgttcctagaagaaaaccagctatcgtgttcctgcacagctcttacaagtgcaaagagtggctgcgcccactgcttgaggcatatgcttccaagggctacgtctgtgtggctattgactcgcgctatcacggcgaaagggccagcaatgaaaccacttacatagaggcatgaaatcgg

SEQ ID NO: 1528 - DNA, 264 bp, Zea mays
  misc_feature: Incyte ID No: 700551093H1
  unsure 182: a, t, c, g, or other
aggcagcaagccgctgggggaaagcgtattcgcggtccacgcggtcgccggtgcggcggcgatcagcgcctccgccgtcgccgtgtaccccctcgatacggtcaagacactcctccagctgggagcgacggggcagaagcagaagatggggctccggcaggtggtggaccggctcatggccncttccggccctgcaggtttttacaatggcattggatggtccatattgggtaaacttcctggattgggagcacgttttgggac

SEQ ID NO: 1529 - DNA, 289 bp, Zea mays
  misc_feature: Incyte ID No: 700551101H1
  unsure 18, 29, 34, 39, 168, 192: a, t, c, g, or other
ggggtgcctatttattgngggatctgcantcccngctgntccaatcatttgcaatgccctaattagggcatcctgcccctcgccttttaggctcaggacggaaggtcagttgccatggttaccgaggaccctggttactctggtgctgtcctgttttactggaccccnctcccagccccaggggtgcctgtnggggtccatttgggtacgtctgggcccccatttcaccagtttctgcggccttccaccgggcctgaaccacagcggaggagctccgtaagacttccca

SEQ ID NO: 1530 - DNA, 288 bp, Zea mays
  misc_feature: Incyte ID No: 700551102H1
  unsure 141, 213: a, t, c, g, or other
gcggatacataaccgtagatgagttggaagaagctttgaagaagtatgatatgggagatgacaaaactataaaagaaatcattgctgaagtagatacagatcatgatggaagaattaattaccaggagtttgttgccatgntgaggaacaacagccctgagattttccaaatcggaggcgcatgttctaactgtcatggacaatcacattgantactttcaagaacaatctgcccttagacataatctttgtcccattttctttttggaacagccgttaagaagactc

SEQ ID NO: 1531 - DNA, 285 bp, Zea mays
  misc_feature: Incyte ID No: 700551103H1
ggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctctgccattgaaagctgtaacaaggccctagaactggacagcaacaacgagaagggcctcttccgccggggagaggcccacctggccgtgaatgactttgaactggcacgggctgatttccag

SEQ ID NO: 1532 - DNA, 285 bp, Zea mays
  misc_feature: Incyte ID No: 700551105H1
ggctttggcaactgactagttcccctaataatcggtgcccccgatatggcgtttccccgcataaacaacataagcttctgactcttacctccctctctcctactcctgctcgcatctgctatagtggaagccggagcaggaacaggttgaacagtctaccctccttagcagggaactactcccaccctggagcctccgtagacctaaccatcttctccttacacctagcaggtgtctcctctatcttaggggccatcaatttcatcacaacaattatcaatataa

SEQ ID NO: 1533 - DNA, 283 bp, Zea mays
  misc_feature: Incyte ID No: 700551106H1
agaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaatatgctggaagtctcaaataatatttttttcctattttatactcatggaagagataagctaaagaggggacaataatgagaaatgttggtgtgcttttctaagcatttaaaacataattgcca

SEQ ID NO: 1534 - DNA, 286 bp, Zea mays
  misc_feature: Incyte ID No: 700551107H1
  unsure 52, 114, 124: a, t, c, g, or other
cttgcaagatggcgggtgaaaaagttgagaagccagatactaaagagaaganacccgaagccaagaaggttgatgctggtggcaaggtgaaaaagggtaacctcaaagctaaanagcccaaganggggaagccccattgcagccgcaaccctgtccttgtcagggaattggcaggtattcccgatctgccatgtattccagaaaggccatgtacaagaggaagtactcagccgctaaatccaaggttgaaaagaaaaagaaggagaaggttctcgcaactgttaca

SEQ ID NO: 1535 - DNA, 286 bp, Zea mays
  misc_feature: Incyte ID No: 700551108H1
ggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtctctacaattcctctgataatatattttcaaggatgtttttctttatttttgttaatattaaaaagtctgtatggcatgacaactactttaaggggaagataagatttctgtctactaagtga

SEQ ID NO: 1536 - DNA, 286 bp, Zea mays
  misc_feature: Incyte ID No: 700551109H1
tgtgcccgggagtaagggagatattttgtccttgataattctgattttcccttggcatcaccaacgcctcagagagatacacctgcaccctccagtcagggtcagtgttggctggaaaacactgaaaagtcttcgctctgtctttcaccttaaattgtgttttccaacaaatgagagagaagcttacgggggagatgcctgagagatgcctatggcgctgtagttttttttcttccctatgatctcacatgaaaggtgctatgtaacaaccagtatgagtcaaata

SEQ ID NO: 1537 - DNA, 284 bp, Zea mays
  misc_feature: Incyte ID No: 700551110H1
cagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggttcatccatccgacattgaagttgacttactgaagaatggagagagaattgaaaaagtggagcattcagacttgtctttcagcaaggactggtctttctatctcttgtactacactgaatt

SEQ ID NO: 1538 - DNA, 284 bp, Zea mays
  misc_feature: Incyte ID No: 700551111H1
gcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtgctgaagaggcaggatggcttggggctgcctgggcccccctccaggatgccgccaggtgtccctctcctccccctggggcacagagatatattatatataaagtcttgaaatttggtgtgtct

SEQ ID NO: 1539 - DNA, 285 bp, Zea mays
  misc_feature: Incyte ID No: 700551112H1
  unsure 69, 78: a, t, c, g, or other
ctggcatcgaagatggtgtgttctttctggaaactgtatatcttattggacttatccagatgatgaganacgcaagantcccataggaaggataaatctggctaattgtaccagtcgtcagatagaaccagccaacagagaattttgtgcaagacgcaacactttgaattaattactgtccgaccacaaagagaagatgaccgagagactcttgtcagccaatgcagggacacactctgtgttaccaagaactggctgtctgcagatactaaagaagagcgggat

SEQ ID NO: 1540 - DNA, 289 bp, Zea mays
  misc_feature: Incyte ID No: 700551115H1
  unsure 20, 40, 48, 53, 73, 101, 120, 122, 134, 176, 208, 223, 234-235, 254, 276: a, t, c, g, or other
ccaaacccactccaccttantaccagacaaccttagccanaccatttncccanataaagtataggcgataganattgaaacctggcgcaatagatatagtnccgcaagggaaagatgaananttatagccaagngtaatatagcaaggactaacccctatacctctgcataatganttaactaggaataactttgcaaggagagccanagctaagacccccgntgaccagacgnnctacctatggaacagctanaagagcacacccgtctatgtancaaaatagtgggc

SEQ ID NO: 1541 - DNA, 289 bp, Zea mays
  misc_feature: Incyte ID No: 700551116H1
  unsure 31, 34-35, 55, 67, 99, 125, 154, 212, 276: a, t, c, g, or other
aagaggatgaagaccccatcccacccagcangannactgacattgccacctcagnacagagcacggnctcatgtgacaccagccccgacaccgtctcgncctccctgagccccggcttcgagganctgtcccatgtccaggctggctccccagncatcaacggcccagccagacagatgacgaggagatcacgggcgaatagccctgctgcncggtgccttgagggggtctcagggcagcagcatacaaggtggcagcgggtaaccctgccttgtnctgtcatccaggg

SEQ ID NO: 1542 - DNA, 285 bp, Zea mays
  misc_feature: Incyte ID No: 700551118H1
  unsure 24, 57, 69, 71, 109, 111, 119, 122, 153, 158, 168, 172, 179, 185, 199, 201,: a, t, c, g, or other
gcagctctgaggtaaacttttatntcttggctgacaggacttccacacccatgctcntcttggcacctntnactctgcccaagcagtggcagcccagtccaaaaggtgncngccatggncanaggggttggggagtcacttcacattccaggntggangagtagaggncttnggggtantcctcncaccccattgccancnagaggccatnantcacctnaaccccaagtcctgcntcctggtnggaagtgacnatgcctcctcnnagctctccatanntantgg

SEQ ID NO: 1543 - DNA, 283 bp, Zea mays
  misc_feature: Incyte ID No: 700551119H1
cgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccagtccacacaggggaggtgatagcattgctttcgtgtaaattatgtaatgcaaaatttttttaatcttcgccttaatacttttttattttgttttattttgaatgatgagccttcgtgcccc

SEQ ID NO: 1544 - DNA, 285 bp, Zea mays
  misc_feature: Incyte ID No: 700551120H1
cccaaacccactccaccttactaccagacaaccttagccaaaccatttacccaaataaagtataggcgatagaaattgaaacctggcgcaatagatatagtaccgcaagggaaagatgaaaaattatagccaagcataatatagcaaggactaacccctatacttctgcataatgaattaactagaaataactttgcaaggagagccaaagctaagacccccgaaaccagacgagctacctaagaacagctaaaagagcacacccgtctatgtagcaaaatagtg

SEQ ID NO: 1545 - DNA, 284 bp, Zea mays
  misc_feature: Incyte ID No: 700551121H1
  unsure 215-216: a, t, c, g, or other
gggagagagatgttatcatgagggaattccggtcagggtcaagtcgtgttctgatcactactgacttgttggctcgcgggattgatgtgcaacaagtgtctttggttataaattatgatctacctaccaatcgtgaaaactatattcacagaattggcagaggggtcgatttgggaggaaaggtgtggctataaactttgttactgaagatgctnnagaggattcttcgtgacattgagactttctacaatactacagtggaggagatgcccatgaatgtggct

SEQ ID NO: 1546 - DNA, 286 bp, Zea mays
  misc_feature: Incyte ID No: 700551123H1
  unsure 63, 171, 247, 255, 259, 262: a, t, c, g, or other
acctcctactcctcattgtacccattctaatcgcaatggcattcctaatgcttaccgaacganaaattctaggctatatacaactacgcaaaggccccaacgttgtaggcccctacgggctactacaacccttcgctgacgccataaaactcttcaccaagggcccctaanacccgccacatctaccatcaccctctacatcaccgccccgaccttagctctcaccatcgctcttctactatgaacncccctccncatngcncaaccccctggtcaacctcaacct

SEQ ID NO: 1547 - DNA, 285 bp, Zea mays
  misc_feature: Incyte ID No: 700551124H1
  unsure 251: a, t, c, g, or other
agcagaactacccgcccgtccaagagcaccagcagaaagagcctcgagccccagacagcacggcctacacgcagctcgtgtacctggatgacgtggaacagagtggtagcgaatgtgggaccacggtctgtacccccgaggacagtgccctgcgatgcttgttgaggggtcgagtcggagaagtggtggccagctgcccagcctgcaggaggagacgaccagacggactgcggatgccccctcggagccancagccagcccccaccagagaagtctgcccacgag

SEQ ID NO: 1548 - DNA, 285 bp, Zea mays
  misc_feature: Incyte ID No: 700551125H1
  unsure 2, 18, 218, 257, 276: a, t, c, g, or other
gngggggccgctttccancctcagccgatgataatctcaagacacctcccttagctacttcaggaggctgaggcagaaaaaccacgcaaacccaagaggcagagggcggctgagatggaaccacctcccgaacccaagaggcggagggtcggtgacgtggaactcacgcaaacccaagaggcggagggccgctgacgtggaaccatcatcacccgaanccaagaggcggagggtcggtgatgtggaaccgtcacgcnaacccaagaggcggagggncgctgacgt

SEQ ID NO: 1549 - DNA, 283 bp, Zea mays
  misc_feature: Incyte ID No: 700551126H1
gccgtagggagtacctgctgccccagctgactgtggccccctccgtgatccatccatctccagggagcaagacagagacgcaggaatggaaagcggagttcctaacaggatgaaacttcccccatcagttcccccagtacctccaagcaagtagctttccaatttgtcacagaaatcagaggagagatggtgttgggagccctttggagaacgccagtctcccaggccccctgcatctatcgagtttgcaatgtcacaacctctctgatcttgtgctcagcat

SEQ ID NO: 1550 - DNA, 284 bp, Zea mays
  misc_feature: Incyte ID No: 700551127H1
  unsure 76, 148, 195, 205, 208, 225, 270-271, 273: a, t, c, g, or other
gtggggacaagatggaggatgtccacagaggctgacctgtgggggaaaagaagtgctcaggtaaggttgtctcctnctcctgtcctaaaaaaatccatgcttgcaggagagggttggtgcctgctcagtttctgtcgagggaatgggngtctcctcggctcctcctgggccctctgcttcttggaggccgaccgntggagactgnggntcctgtgcttggatctntgacatctgtcagtccactggaggctagagaagttgactttaccnncngcttctgtggg

SEQ ID NO: 1551 - DNA, 282 bp, Zea mays
  misc_feature: Incyte ID No: 700551129H1
  unsure 3, 42, 257: a, t, c, g, or other
ggnactcggcaaatcttaccccgcctgtttaccaaaaacatncacctctagcatcaccagtattagaggcaccgcctgcccagtgacacatgtttaacggccgcggtaccctaaccgtgcaaaggtagcataatcacttgttccttaattagggacctgtagaatggctccacgagggttcagctgtctcttacttttaaccagtgaaattgacctgcccgtgaagaggcgggcatgacacagcaagacgagaagcncctctggagctttaatttattaatg

SEQ ID NO: 1552 - DNA, 286 bp, Zea mays
  misc_feature: Incyte ID No: 700551131H1
  unsure 10: a, t, c, g, or other
ccaaacctgncattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatccattctagagtccatatcaacaatagggtttacgacctcgatgttggatcaggacatcccgatggtgcagccgctattaaaggttcgtttgttcaacgattaaagtcctacgtgatctgagttc

SEQ ID NO: 1553 - DNA, 173 bp, Zea mays
  misc_feature: Incyte ID No: 700551132H1
taacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaataactttttc

SEQ ID NO: 1554 - DNA, 282 bp, Zea mays
  misc_feature: Incyte ID No: 700551133H1
  unsure 263: a, t, c, g, or other
aaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggcttcttaccatgaaggttgttttgcttattgtatatttgtgtatgtagtgtaactattttgtacaatagaggactgtaactactatttaggttgtacagattganatttagttgtttcatggct

SEQ ID NO: 1555 - DNA, 283 bp, Zea mays
  misc_feature: Incyte ID No: 700551135H1
  unsure 194, 196-197, 199-201: a, t, c, g, or other
cgcagggcaacagccccatctgcttggctgaccccacacccaggaccactgtccggctctaacacagctattaagtgctacctgcctctcaggcactctcctcgcccagtttctgaggtcagacgagtgtctgcgatgtcttcccgcactctattccccagcctctttctgctttcatgctcagcacatcatcntnntnnnccagtctcttccccaaagtctcaccttttcttccaatagaaaattccgcttgacctttggtgcactgcccacttcccagctc

SEQ ID NO: 1556 - DNA, 215 bp, Zea mays
  misc_feature: Incyte ID No: 700551136H1
ttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttcttttaatacacttaactcaggccattttttaagttggttacttcaaagtaaataaacttt

SEQ ID NO: 1557 - DNA, 218 bp, Zea mays
  misc_feature: Incyte ID No: 700551137H1
  unsure 210, 212-214: a, t, c, g, or other
aagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactcatcgggcgcttctttggcggtgacaggggtgcgcccaagcggggctctgncnnngcct

SEQ ID NO: 1558 - DNA, 281 bp, Zea mays
  misc_feature: Incyte ID No: 700551138H1
  unsure 2, 277: a, t, c, g, or other
gngcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccactgctgctacagcaaccgttctgctgcctatgccaagaaaggagactaccagaaggcttatgaggatggctgcaagactgtcgacctaaagcctgactggggcaagggctattcacganaagc

SEQ ID NO: 1559 - DNA, 111 bp, Zea mays
  misc_feature: Incyte ID No: 700551139H1
cttaatttgttttccttgttagggtcaagggtgtcctccactcctttaacagctgctggacagacacattagagcagctgtttgttattgataataaaatattataaaact

SEQ ID NO: 1560 - DNA, 110 bp, Zea mays
  misc_feature: Incyte ID No: 700551140H1
  unsure 34, 52, 90: a, t, c, g, or other
tggtattattaaaaagacattacatacgcaagtntttctcgacaatcaagantgttattaatgtgtaatactgagcactttacttcttantaaaaacttgatatagtagc

SEQ ID NO: 1561 - DNA, 281 bp, Zea mays
  misc_feature: Incyte ID No: 700551141H1
gccactgccacacgtctgaccctctccaccccatagtgaccggctgcttttccctaagccaagggcctcttgcggtcccttcttactcacacacaaaatgtacccagtattctaggtagtgccctattttacaattgtaaaactgaggcacgagcaaaggaagacactggctcatattcctgcagcctggaggccgggtgctcagggctgacacgtccaccccagtgcacccactctgctttgactgagcagactggtgagcagactggtgggatctgtgc

SEQ ID NO: 1562 - DNA, 278 bp, Zea mays
  misc_feature: Incyte ID No: 700551142H1
  unsure 172: a, t, c, g, or other
gatttccctaactacacacccaaccatttataagcacagctggaagtttccttttatattgcaccaatcacttgctagtaaagatggatgcactaacccacagatctgagaaagccagccacattggttttatctggatctgaattctttgtattagtaatttacttaagangccagtctaaagagctgccacccattcttgtgtgttgagcttttgcaatttttattagtgaagatgccaaaagcttcgaaggacccaccaagcagtgatcttgttt

SEQ ID NO: 1563 - DNA, 280 bp, Zea mays
  misc_feature: Incyte ID No: 700551143H1
  unsure 232-233, 237, 263, 265-269, 279: a, t, c, g, or other
catcttcttgctcatgttatttctcctgggaatgagcagtttgacttctgttcccacgttcctcattctatcagctctagatggattttgcctgcatagctggcttaatatgtctttgtgtatgggtagtctgtagcctgagaatatttacctaaaaagtctaaacagccaccaagaatgtttataggggtataggaatatagttaacagagtgctaatctctcctcaaatnncctnttggaatgcttcccccaaaattgggncnnnnntaggagcttnt

SEQ ID NO: 1564 - DNA, 279 bp, Zea mays
  misc_feature: Incyte ID No: 700551144H1
gatggttctctgggttcctgataaaagtgtctagatagatggtagagggcaattccaagagggcaactccaagatagaaaatttggaaaaagaacaaatttaggggaaacagaagataagcgagttcaggttccagtcatgcggtgttggagatgccttgtcatctgatgaagactagtacgcagctggatagcagagtccgaaactcaggtggaggtgaagttatgagggattatcacaatctagtttggattcatatttcttaaatatgtatgacaa

SEQ ID NO: 1565 - DNA, 277 bp, Zea mays
  misc_feature: Incyte ID No: 700551147H1
  unsure 77, 172, 201, 251, 255, 263-264: a, t, c, g, or other
gccaagtcttagggcatcacaaacagcccatttgatggagggagcagggacatagcacatttttgtctgtctttgtnaggctgtttgctaagtctctgaggagaggaagcctctcgggctttccgtcggctggggctagtgccagagaatcccttctcgtggccagcaggtncctgggaggccggcacaaggcaccgctcnccactcatgacaccttggtgcagagtgacctcctgcccagtcaccactcnggcngcccagcnnaacacacaaagcc

SEQ ID NO: 1566 - DNA, 171 bp, Zea mays
  misc_feature: Incyte ID No: 700551148H1
  unsure 6, 28, 30, 32, 52, 68, 77, 91, 109, 113, 118, 129-130, 167-168: a, t, c, g, or other
gagcgngccggtgacagccacaagggcntntncaccgcgcccatggcagagncagaccgatccagagnccagacacngagggaggagccgnaggcggagaagcagacanggangcccngcggaacgganncacccagacgcacagccagggcagccagaagagcgtnngca

SEQ ID NO: 1567 - DNA, 285 bp, Zea mays
  misc_feature: Incyte ID No: 700551149H1
  unsure 5, 21, 23, 25, 29, 40, 42, 52-53, 64, 67, 75, 111, 118-119, 150, 205, 217,: a, t, c, g, or other
aattnaccccctaataaaatnantnaacnactcactcatngncctgcgccannccatccaacanacnccgcatgntgaaacttcgggctcactccttggcgcctgcctgancctccanntcaccacaggactattcctagccatgcactnctcaccagacgctcaaccgccttttcatcaatcgcccacatcactcgagacgtanattatggctgantcatccgctaccntcacgccaatggcgcctcaatatnctnnatctgcntcttcnacacanngcnannc

SEQ ID NO: 1568 - DNA, 276 bp, Zea mays
  misc_feature: Incyte ID No: 700551150H1
gctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtgaggcagtggaggttactatgggcaaggcggcatgagtggaggtggatggcgtgggatgtactgaaagcaaaaacaccaacatacaagtcttgacaacagcatctggtctactagacttct

SEQ ID NO: 1569 - DNA, 277 bp, Zea mays
  misc_feature: Incyte ID No: 700551151H1
  unsure 2, 42, 93-94, 188, 276: a, t, c, g, or other
gnctcagcccggctgatgcctctgcagtgctgagtcaggatntggggccggctctcttgggtccttccccttttcccaggtactgccttacanngctgtggccaggaagtggccggtataaaggatgcccaaggtctttgtacgtgtataggagttgcgtgtttgatattgttaatataataataatnattttttagagtactgcttttgtatgtatgttgaacaggatccaggtttttatagcttgatataaaacagaattcaaaagtgaaaaana

SEQ ID NO: 1570 - DNA, 280 bp, Zea mays
  misc_feature: Incyte ID No: 700551152H1
  unsure 31, 38, 241: a, t, c, g, or other
gcgcgatgtaacacgagaaagcacataccanggccacnacacaccacccgtccaaaaaggccttcgatacgggataatcctatttattacctcagaaatttttttcttcgcaggatttttctgagccttttaccactccagcctagcccctacccccaattaggagggcactggccccctacaggcatcaccccgctaaatcccctagaagtcccactcctaaacacatccgtattactcncatcaggagtatcaatcacctgagctcaccatagtctaa

SEQ ID NO: 1571 - DNA, 278 bp, Zea mays
  misc_feature: Incyte ID No: 700551154H1
  unsure 188, 228, 233, 237, 239, 249: a, t, c, g, or other
gctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcccgagcacgtcttccgcaccttcgacaccancggcgacggcaccatcgacttccgggagttcatcattgcnctgancgtnanctcgcggggnaagctggagcagaagctcaagtgggcctt

SEQ ID NO: 1572 - DNA, 277 bp, Zea mays
  misc_feature: Incyte ID No: 700551155H1
  unsure 89: a, t, c, g, or other
tgtatatctcttggaaaataagacaatagtatttctcctttgcaatagcagttataacagatgtgaaaatatacttgactctaatatgnttatacaaaagagcatggatgcatttcaaatgttagatattgctactataatcaaatgatttcatattgtcttttatcatgatcctccctatcaagcactaaaaagttgaaccatatactttatatctgtaatgatactgattatgaaatgtcccctcaaactcattgcagcagataacttttttgag

SEQ ID NO: 1573 - DNA, 280 bp, Zea mays
  misc_feature: Incyte ID No: 700551156H1
  unsure 2, 7, 11-12, 25, 53, 56, 73, 118: a, t, c, g, or other
cnaaaanacannacacaaataaacnaaaaaaatccattcatttactcatgcantanattctcctgcaagcttntatgggcactcagtaagtactcaggattggctttatcagccttgncactgagcagctcatggtcctatggaacctgagccaggcctagtctctccatgattggctcagctaactctcagttcagagtggagagtatcaatcttgtgtttttgcccttaggcagcactatatgagacatggggcctgtggtccttccttctggtgtcc

SEQ ID NO: 1574 - DNA, 101 bp, Zea mays
  misc_feature: Incyte ID No: 700551157H1
  unsure 42, 47, 61, 68-69, 74-75, 80, 86, 99: a, t, c, g, or other
ttctattaacattattttgcttgccgctggcatgcctgaggnatgtnttgggctttgattncacactnngtttnngtaanaaattngactcattaaaancc

SEQ ID NO: 1575 - DNA, 278 bp, Zea mays
  misc_feature: Incyte ID No: 700551158H1
  unsure 110, 157: a, t, c, g, or other
ctcgtttctcaagtgtatgcatcatggtaaatataaactaaccacaagataggtagattgattcatttcattttaatctccttgtgtaattcagtacctccataattgtnctaatcttcttcccactgtttacaaattaccagttaattaactcgtnaagaaaaattcacatatcagaataaaaataaatgtatactcactttataaaaatcaccactgctgtctttccttaatactagcagtggaaatgtaagtggcttactctacaaattttggtg

SEQ ID NO: 1576 - DNA, 203 bp, Zea mays
  misc_feature: Incyte ID No: 700551159H1
  unsure 33, 64, 120, 198: a, t, c, g, or other
cgctattaaaggttcgtttgttcaacgattaangtcctacgtgatctgagttcagaccggagtnatccaggtcggtttctatctacttcaaattcctccctgtacgaaaggacaagagtntaaggcctacttcacaaagcgccttcccccgtaaatatatcatctcaacttagtattatacccacacccacccaagancaggg

SEQ ID NO: 1577 - DNA, 133 bp, Zea mays
  misc_feature: Incyte ID No: 700551161H1
  unsure 5-6, 10, 22, 50, 52-53, 62, 65, 87, 93, 111, 119, 130: a, t, c, g, or other
gttcnnaaanatcaaaataagnattaaatgtgagcacatcacctctagcntnnccagtattngangcaccgcctgcccagtgacacntgtttnacggccgcggtaccctanccgtgcanaggtagcatantcc

SEQ ID NO: 1578 - DNA, 278 bp, Zea mays
  misc_feature: Incyte ID No: 700551165H1
  unsure 45, 138, 150-151, 184, 187, 205, 228, 237, 245, 264, 268: a, t, c, g, or other
ttctgtagccggaagatctccgttccgctcccagcggctccagtntaaattccccttccccctggggaaatgcactaccttgttttggggggtttaggggtgtttttgtttttcagttgttttgtttttttgtttttnttttttcccttnnccttttcccctttaatttggagggaatgggagnaantgggaacagggaggtggnaggtggattttgttaattttttnagcccattnccaggggngggaattttttaaaaatgngccngaaaaaaatt

SEQ ID NO: 1579 - DNA, 278 bp, Zea mays
  misc_feature: Incyte ID No: 700551166H1
  unsure 272: a, t, c, g, or other
gacgctacttcccctatcatagaagagcttatcacctttcatgatcacgccctcataatcattttccttatctgcttcctagtcctgtatgcccttttcctaacactcacaacaaaactaactaatactaacatctcagacgctcaggaaatagaaccgtctgaactatcctgcccgccatcatcctagtcctcatcgccctcccatccctacgcatcctttacataacagacgaggtcaacgatccctcccttaccatcaaatcaattggncaccaa

SEQ ID NO: 1580 - DNA, 276 bp, Zea mays
  misc_feature: Incyte ID No: 700551167H1
  unsure 140: a, t, c, g, or other
ctgttgggacagtctgcctctacccgtcccagctgccgttgagcgccctgggttccgctagggcctcccttctccctcaggagaccaggggcagaccagggcttgtgcctggcatgaggtctcttaagtgacccgttccnccttcacccagcacctttgttgagggcctgccatatctgggccccgagtacccagtctgtagggaaagtggacatccatactcaccccccaggcatggccctgggaggctgactgtgcatggctccagggaggcca

SEQ ID NO: 1581 - DNA, 276 bp, Zea mays
  misc_feature: Incyte ID No: 700551168H1
  unsure 9, 24, 75, 88, 150, 155, 213, 247, 255: a, t, c, g, or other
cctgatganagattctgggaaganagttccagacagaggaaatagtatgtacaaatatcttgagtcaagagaggntagtatgaatgangaatgaaggaagaacagtcagactagaggacaagggcaagagtggctgttgacacagttganaattnagaccaggataggttgaagcagaggggtgacaggatgagttttaatcacactggaggnagatgataatggctgtaggggatctgttaggaanctattgcnagaatccaggtgagaggtgat

SEQ ID NO: 1582 - DNA, 276 bp, Zea mays
  misc_feature: Incyte ID No: 700551169H1
  unsure 34-35, 37, 51, 84, 108, 124, 138, 148, 154, 216, 260: a, t, c, g, or other
ggtcaggggagacctccaggcgcagggaaggacnncncagggtgacacgtnaagtatgcgacggctgctgatccctctggcccngtggctgggtgcgttgggcgtggncgtcgccgagctcatngaagcccagcgccncggcctgcangtggcntgaggaatttcacaagcacccgcccgtgcagtgggccttccaggagaccagtgtggagagcnccgtggacacgcccttcccagctggaatatttgtgaggctgganttaagctgcagcagac

SEQ ID NO: 1583 - DNA, 274 bp, Zea mays
  misc_feature: Incyte ID No: 700551170H1
ggcaggtgtcccacagcaacagaaggaatagtagtccccactctttccatcagccctaccctaccctcattccccgacaccctctggcttgaaccatggctgagcagtgccggcatacgctttgctggcatgcttggatgcccagctgtgtccagagtggcctgggaccgccagttgcacgcctgccacctcagccagcccccgcccagctcatcagtctgaatggagttgccttaaattggcaggtggtaccgtatcatgcccttggagtgtg

SEQ ID NO: 1584 - DNA, 275 bp, Zea mays
  misc_feature: Incyte ID No: 700551173H1
cttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttcccttgctgtgcaaggacccagtccaggaggcctgggctgaggacgtggacctccgggtgaactttgccatgaatgttggcaaggcccgaggcttcttcaagaagggagatgtggtcatgtgct

SEQ ID NO: 1585 - DNA, 276 bp, Zea mays
  misc_feature: Incyte ID No: 700551176H1
  unsure 23-24, 264: a, t, c, g, or other
aacacttcgctggtcctgggcgnncctggtgggcagtttcatcattgctggtgtggctgtaggcatcttcctgtgcacaggtggacggcgatgttaattactctccagccccctcagaaggggctggattgatggaggctggcaagggaaagtttcgctcactgtgaagccagactccccaactgaaacaccagaaggtttggagtgacagctcctttcttctcccacatctgcccactgaagattgagggaggggagatgganaggagaggtgga

SEQ ID NO: 1586 - DNA, 153 bp, Zea mays
  misc_feature: Incyte ID No: 700551177H1
ggattttataacatacatgtgcagaaatgtattcaaatgaaaggaagcatacctttatcaagatgctattaaaattgaacatcaagtataatatttcatttggattctcttttttggttaatgcctaaaaatgcctatttgggattttttttt

SEQ ID NO: 1587 - DNA, 275 bp, Zea mays
  misc_feature: Incyte ID No: 700551178H1
  unsure 117, 215, 218, 235: a, t, c, g, or other
cagggcaaccgcaccacccccagctacgtggccttcacggacaccgagcggctcatcggggatgcggccaagaaccaggtggcgctgaacccgcagaacaccgtgtttgacgcgaangctgatcggccgcaagttcggcgacccggtggtgcagcggacatgaagcactggcctttccaggtgatcaacgacggagacaagcccaaggtgcaggntgnctacaagggggagaccnaggcattctaacccgaggagatctcgtccatggtgctgac

SEQ ID NO: 1588 - DNA, 116 bp, Zea mays
  misc_feature: Incyte ID No: 700551179H1
  unsure 36, 51, 79, 88: a, t, c, g, or other
aaagcccatgtcgcagcccccatcgctgggtcaatngtacttgccgcatantactgaaactaggcggtatggctcatangcctcacantcattctcaacccccctgacaaaacact

SEQ ID NO: 1589 - DNA, 118 bp, Zea mays
  misc_feature: Incyte ID No: 700551181H1
gcagaagcaggacaaagagaagccggagtaggagggagcgggtagagggatgggctctgctcagctattcttgggccagatggggcctgaccgatagaataaaagacttttctacaac

SEQ ID NO: 1590 - DNA, 153 bp, Zea mays
  misc_feature: Incyte ID No: 700551182H1
  unsure 15, 19, 21, 24, 30, 35, 41, 61, 64, 68, 76, 81, 104, 110, 130, 137: a, t, c, g, or other
ctgacagccagtatnacgncntgngctacnggcgncaaatntagatccaggaacaacgtgngcnattntgccaganctgtnaatttacctaataatgttgaacnaaaatngattgagtttaccggaattncaaagantggaatggtggaattt

SEQ ID NO: 1591 - DNA, 272 bp, Zea mays
  misc_feature: Incyte ID No: 700551183H1
  unsure 28: a, t, c, g, or other
caaaaattattttctctgtatgattaanagtttattccatttattttagtttgtgtttacttgattttgaggaagaaaatatttgactttgtgtaaagagtagggtatcagggtgtctttctgccgtgggagatgtgtatatatatagtatttggtgtatagtagaaaataagctttgtgcatctgtatttgagatatgttaatgacgtggagtaaagtcagctgtaagactctggaggcaaacaagttgtatatggttcatatggcctatg

SEQ ID NO: 1592 - DNA, 236 bp, Zea mays
  misc_feature: Incyte ID No: 700551184H1
  unsure 140: a, t, c, g, or other
gttttaatgtagaacctcaaacaggatggaacatcagtggatggcaggaggttgggaattcttgctgttaaaaataattacaaattttgcacttttttgtttgaatgttagatgcttagtgtgaagttgatacgcaaggnaaatggtccatgttacccacagttttcaggtactcctagactttaaagatgtcttgaacatttaagttcttcagcagttcacactacaccgttttt

SEQ ID NO: 1593 - DNA, 277 bp, Zea mays
  misc_feature: Incyte ID No: 700551185H1
  unsure 204: a, t, c, g, or other
ttctattagctcttagtaagattacacatgcaagcatccccgttccagtgagttcaccctctaaatcaccacgatcaaaagggacaagcatcaagcacgcagcaatgcagctcaaaacgcttagcctagccacacccccacgggaaacagcagtgttaacctttagcaataaacgaaagtttaactaagctatactaaccccanggttggtcatttcgtgccagccaccgcggtcacacgattaacccaagtcaatagaagccggcgtaaagagtgt

SEQ ID NO: 1594 - DNA, 149 bp, Zea mays
  misc_feature: Incyte ID No: 700551187H1
gaaccacccctatataagacagcaaactgagtcgataaatgttttatgtgttctgaccactgcactgaccagctgcctccctatctctctccttctgctcagacctccctatccttgagacacagcaatactgaaattaggggccaggc

SEQ ID NO: 1595 - DNA, 267 bp, Zea mays
  misc_feature: Incyte ID No: 700551188H1
  unsure 266: a, t, c, g, or other
gggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattagctgaagatgtttattacaatcactctctgtggggggtggccctgctgctctcagaatccggtgcttgaagtctcgtgcactgtcaatcctcctatggcctggcaaagtna

SEQ ID NO: 1596 - DNA, 275 bp, Zea mays
  misc_feature: Incyte ID No: 700551189H1
  unsure 34: a, t, c, g, or other
gatccctgaaaagttccagcatattttgcgagtnctcaacaccaacatcgatgggcggcggaaaatagcctttgccatcactgccattaagggtgtgggccgaagatatgctcatgtggtgttgaggaaagcagacattgacctcaccaagaggcgggagaactcactgaggatgaggtggaacgtgtgatcaccattatgcagaatccacgccagtacaagatcccagactggttcttgaacagacagaaggatgtaaaggatggaaaatacag

SEQ ID NO: 1597 - DNA, 75 bp, Zea mays
  misc_feature: Incyte ID No: 700551191H1
  unsure 12, 14, 24, 37, 40, 44, 47, 60, 74: a, t, c, g, or other
cttgcccctgtnanctaattagancagatggaccctngcntaangcntgcggagttttgngacgtagtagtggnc

SEQ ID NO: 1598 - DNA, 201 bp, Zea mays
  misc_feature: Incyte ID No: 700551193H1
  unsure 5, 29: a, t, c, g, or other
atgcntccctgaggcagacggagtctgantccagatgctgatagaaccactttaaatcatgcagatcattcatcaaaaatagtccagcatcgattgttatctagacaagaagaacttaaggaaagagcaagagttctgcttgagcaagcaagaaggatgcagccttaaaggcggggaataagcacaataccaacacagccc

SEQ ID NO: 1599 - DNA, 275 bp, Zea mays
  misc_feature: Incyte ID No: 700551194H1
  unsure 189: a, t, c, g, or other
gacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacaaccccaattagctgaattcgcgtgtggcagagggangaaaaggaggcaaacgtgggctgggcaatggcctcacataggaaacagggtcttcctggagatttggtgatggagatgtcaagcag

SEQ ID NO: 1600 - DNA, 278 bp, Zea mays
  misc_feature: Incyte ID No: 700551195H1
  unsure 24, 26, 44, 258: a, t, c, g, or other
caccgctgagctgggagaaagatngnggcagccgtgcgacaggntttggcccagctcatgaattcgagcggctctcataaagatctggctggcaagtatcgtcagatcctggaaaaagccattcagttatctggagcagaacaactagaagctttaaagcttttgtggaagcaatggtaaatgagaatgtcagtctcgtgatctcgcggcagttgctgactgatttttgcacacatcttcctaacttgcctgatagcncagccaaagaaatctatcac

SEQ ID NO: 1601 - DNA, 211 bp, Zea mays
  misc_feature: Incyte ID No: 700551202H1
cctttttgaataacagatggggagatctatagggtaaatacagcaaaacgaagcgagcatgtaggccacagcagtcagctctgttgtgcggaaagatgtgtatatatgtattagcaacatgtttgttctgatgacctttttaatgcttttcgatggtaggtctgttccatcaagtatttaactaatcatcatttgttgcagttggtatagg

SEQ ID NO: 1602 - DNA, 262 bp, Zea mays
  misc_feature: Incyte ID No: 700551203H1
  unsure 177: a, t, c, g, or other
aatgcaagtgactcagactctgatgacgatgcaaatgatgacgccaaccaataacactcaattacaaattgagttattagttaggagattcacagggaattttccttggtgctgggacttcagggtcgaattacttggtggtttatgcatttattagcactgtgtttgaattgtgantgtcacattgagcttatggtgattagatatcctggccttgtcgttccgtgtgccactgttgcaggtctatagtgcaaggggttcg

SEQ ID NO: 1603 - DNA, 264 bp, Zea mays
  misc_feature: Incyte ID No: 700551206H1
gagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgtctcgctgcagcattcatacaaagatactttcctgaagctaaagtgctgatatcgtcgcctacctggggtaaccacaagaatatcttcaatgtgctagggtaccttggtcag

SEQ ID NO: 1604 - DNA, 236 bp, Zea mays
  misc_feature: Incyte ID No: 700551208H1
ccacaccgtctcctccacaacacgctcctcacctcgcggcgactcttgccaagcattcctccgcgaaaaacgcatccgctccaaggggagttgatcgagaagcgttggtggacatgggtcagatccagtactccgagaagtacttcgacgacacctacgagtacaggcacgtcgtcctcccgccagaggtcgccaagctcctccccaagaaccgcctcctctccgagaacgagtgg

SEQ ID NO: 1605 - DNA, 265 bp, Zea mays
  misc_feature: Incyte ID No: 700551210H1
  unsure 239: a, t, c, g, or other
catcagattgtgtagtgttgttgctcaaggcagcacctcgagaggctacagtgggcttgttgacaagtcttcctaaattaagcactgtcatggacttgctgaagcatgacagccaccgatgtctgattcgcttattatatggcctagccttctcatgcagacaatacttagcccagggaatgatcctgtcaatatcagtgccagctttgatgcgagttgaagcacttgtttcagttttncaagggtccaatgatagccttcttgc

SEQ ID NO: 1606 - DNA, 267 bp, Zea mays
  misc_feature: Incyte ID No: 700551213H1
agaaaaaagagttgctgacaagattgtgtacggcggcaaggctgatgagaagcaactaaaaatttctcctacactattgttagatgttcctgaagattcagaaattatgacaggcgaaatatttgggcccttgcttcctattgtgacggtcgaaaagattgaggaaagcttcgacttgatcaatgccaagcctaagccactagccgcctaccttttcaccaagaataggaagctgcaagaggagtttgggcaagcgtccctgcagga

SEQ ID NO: 1607 - DNA, 156 bp, Zea mays
  misc_feature: Incyte ID No: 700551214H1
attagattggaaggctttctggaatggttagggtgtaatgttgtacaataatctaattcgcattggtttggccctagttcagttgaatgatgttgacggggttgaaggcaaacataatgtatttgttgtagtcatcaaacgtgttgcgcacaattc

SEQ ID NO: 1608 - DNA, 275 bp, Zea mays
  misc_feature: Incyte ID No: 700551216H1
gctatcgatgcttcagatgggctggacacgcttgcaaaccttgcgattcttggtgaaggtgaagctctcccttcacagccaacaacaaaacatccccgccatcgtccgggctgctcatgcatcgtctgcatccaaccaccaagcgggaagggtccaaagcacaagcaaacttgcacctgtaacgtttgtatgacggttcgccgccgtttcaggacactcatgcttcgacgcgagaagaaggcgacaaaggatctgtctcgcaagaaagagacggg

SEQ ID NO: 1609 - DNA, 266 bp, Zea mays
  misc_feature: Incyte ID No: 700551217H1
  unsure 137: a, t, c, g, or other
agagttcaaatatgtctgtctaccaagcaatcagatgcatgtcatcatccaagctttttgttggagggctttcttatggaaccgatgatcacagtctcagagacgagtttgccaaatatggacaagttattgaagcncagattatccttgatcgtgagtctgggaggtccagaggttttggctttataacttacacgtcttctgaggaggcttcggctgccatcactgccatggatggaaagacctggatggacggaacatacggg

SEQ ID NO: 1610 - DNA, 132 bp, Zea mays
  misc_feature: Incyte ID No: 700551218H1
  unsure 7, 10-11, 29, 35, 52, 61, 76, 84, 94, 99, 110, 114, 129: a, t, c, g, or other
ggcagantgnntgttggaggatatcatgntagaantggatcgcatcattcgnccacagggntttatgcattattanagacgagnatgacactcnctcangaatcatgcantctngcaccgaagttcctntgg

SEQ ID NO: 1611 - DNA, 265 bp, Zea mays
  misc_feature: Incyte ID No: 700551219H1
  unsure 81, 83, 93-119, 122, 138-139, 145, 147, 226-227, 239, 255: a, t, c, g, or other
agactgaaaacggcatcagtagcagacgcaggcgaccacgaggagtgacggcatcagctgcggcagcgacgcccaacaaancncacctcatgnnnnnnnnnnnnnnnnnnnnnnnnnnntgncgctgtggcggcgcanngagagngnggcggagatcgagcaggccatgcgcgcccgcgtctcagacttcaagaagcaggccgactccttgacccttgaaggcganngaagagcatganaaaggacctgggtttngagacatatt

SEQ ID NO: 1612 - DNA, 263 bp, Zea mays
  misc_feature: Incyte ID No: 700551220H1
  unsure 25, 181: a, t, c, g, or other
ggaagatgtgggggaaaggaaagangcgtttcggcggtggcggcagcggtgagcccgcggccaagcgccaggccgcgagggacgatggcccctccgaatccgctgaagacggtaccgtcgtagccgagatatcgaagaacaagaaggtgtccgttaggagctggaaaggcagggtcttcgncgacttacgcgagttctacttcaaggacggcaagactctccccacccgcaaaggtatatcatccaattagatcagtggaaga

SEQ ID NO: 1613 - DNA, 262 bp, Zea mays
  misc_feature: Incyte ID No: 700551222H1
  unsure 158, 242: a, t, c, g, or other
attggaagagcttcatggactctatgaatctcagaaagtactgagtgcagatctaagtgatcaacttcagacattacagaaaagaatgaaggaaacagagtgcaccctagcggatcttgaaacgagatacatgaaggcaaatgatactattaaggagnagcaatatttgatagaaaatcttcttaaatcagaaaaagttcttgttggtgaagcacaaacactccgatcagagctggagaatnagcaggggatctacatgggc

SEQ ID NO: 1614 - DNA, 262 bp, Zea mays
  misc_feature: Incyte ID No: 700551223H1
taggaatgaaaaacacgaaatagctccaaaggaaaaaacatcaaagaagaaccggaagaaggagaaagaagtggcagagagtgttcctgtaaagcctaaaaaggaaaataggcttttggttctgccttttgaattatctgttatgggtattttattgctcttcgtattaggtggtttctatgtggtccattgtgtatgggcggcactgaagcgtactccgcgccttcaattgtgttgacatctcgttcacgagatgggttgc

SEQ ID NO: 1615 - DNA, 242 bp, Zea mays
  misc_feature: Incyte ID No: 700551224H1
  unsure 21, 37-38: a, t, c, g, or other
gcaaggcatcggtgtgggtanctttcagaagatctanngtggccgccagaggaatggctcccgcccaccacacttctgcaagagcagtggtgctgttgcacgcaacatcctgcagcagctgcagattatgggcatcatcgatgtcgatcccaagggtggacgcctcatcaccaaccagggaaggcgtgatctggaccaagtggctggaagggtcgctgttgaagcgtgagcagtgtcatctt

SEQ ID NO: 1616 - DNA, 261 bp, Zea mays
  misc_feature: Incyte ID No: 700551225H1
  unsure 243: a, t, c, g, or other
atttgttgatgatgtgcagtcagctatcgatcacataaatcgttatggaagtgcacacacagactgcatcatcacaactgatagaagtgctgcagaggcctttctgcagcaagttgatagtgccgctgtgtttcataatgcaagcacaaggttttgtgatgggacgcgttttgggctaggtgctgaggttggcataagtacagagcgcatacatgcccgcggacctgttggagttgatggaanctaactactcgctgcatt

SEQ ID NO: 1617 - DNA, 210 bp, Zea mays
  misc_feature: Incyte ID No: 700551227H1
  unsure 29-31, 33-34, 43-44, 57, 74, 114-117: a, t, c, g, or other
gaaaagaactgctagaaagtaacgatcgnnnanngttaccagnnattgggcgatatngatttactaggtctggntctgtaatcctccctgcatagctcttattcgtaactcgannnnggcacgaaagttggtgtgtgttttagcagaatgctttctgtccgtgaaagtaaacttgaaactgcttattacgactgaaatgatattgtcgtt

SEQ ID NO: 1618 - DNA, 264 bp, Zea mays
  misc_feature: Incyte ID No: 700551228H1
tgaccgttcgatttcatgattgtaaattcttcagtagtggttcttttctccccgcctggcgattgcagaaaactgcatatacgagtgtaaatgtattttgctcttcgatatggttttagctttcgtgttgtgcgaggatagctccttaagtgggatgtgtgatatagtctttctgtataacacgttgtcatggagagatgccttttagacaagttttttccagtgttgtggcggtgtatatgtatttgtgcgtcttcgcaagga

SEQ ID NO: 1619 - DNA, 268 bp, Zea mays
  misc_feature: Incyte ID No: 700551229H1
acgaattacacgagggaagaacgctgatgaacaaatggcgtaaatctctatcgacgaagctgtggaggaaaacgaaggatctccccgtgcttgtgcatgccagatcgcctgctctacgtccgcatcccgtccctcgcgaaactcggcactcccagggtgtgcaaaattcatggcttcagacacccgcaagaagctcattcagatcgatgtgagctcggatacagtgtgcccttggtgctttgtcggtaaaaagaaccttgagaaagca

SEQ ID NO: 1620 - DNA, 269 bp, Zea mays
  misc_feature: Incyte ID No: 700551230H1
  unsure 150: a, t, c, g, or other
acaggaaaggactggtcccatgcagggtgcattgaatgcacagcagcagtccagtagcaacatgatatccaacaatgcaatgagtacaatgcagactaataacaatgcaaatgcgaattcattgcagcagttaaagcagcaacgtcaggngcatcaaatgatgcaaagtcagcaaatgaagcagcgccagcagatgatgcaacagatacaacaaaagcaaacgcttcaaccgcagctcccaatacagcactaaagaaacaacagcagct

SEQ ID NO: 1621 - DNA, 267 bp, Zea mays
  misc_feature: Incyte ID No: 700551231H1
  unsure 227: a, t, c, g, or other
gtgaggccgatagatagaggagctgcggcgccgccggcgagcgaagagtggaggatccgatccgaagcgagaggactgaatcctgcggccgggagggacgcgggaccacgacgagcgtcgtcgtcggtgccaagcaacggcagttgtccctgtccagagcacaggtaagatggttaacgcgatcaaggggtgttcatctcctgcgacgtacctatggcgcattcaangtcaacctgaacgcgtcgatccgccgtcggagaggtacat

SEQ ID NO: 1622 - DNA, 273 bp, Zea mays
  misc_feature: Incyte ID No: 700551232H1
  unsure 19, 35, 75-76, 86, 240: a, t, c, g, or other
ttggaagagcttcatggantctatgaatctcaganagtactgagtgcagatctaagtgatcaacttcagacattnncagaaaagantgaaggaaacagagtgcaccctagcggatcttgaaacgagatacatgaaggcaaatgatactattaaggagaagcaatatttgatagaaaatcttcttaaatcagaaaaagttcttgttggtgaagcacaaacactccgatcagagctggagantacagcaggggactacatgggctattttcaaaa

SEQ ID NO: 1623 - DNA, 264 bp, Zea mays
  misc_feature: Incyte ID No: 700551233H1
  unsure 2, 11, 21, 24, 36, 74, 222-224: a, t, c, g, or other
cnattgctcantccatttganccntgctattgaggncgaggcaccctttgagtgggaaggttttgctcatatcncccttcattgctgggcagagaagcagcagcttagaggttcccaatctgtcgagttcgaggggaaagcaggagcttccttatccgctattgtgcttcatgtagccatcaggttgctctccgacagtgagcctgttttcaggaaggcgtnnntggtcgcagcaaaggcagcgagtcgtccagttcctgtact

SEQ ID NO: 1624 - DNA, 262 bp, Zea mays
  misc_feature: Incyte ID No: 700551234H1
ccgtggtgttcctgttgaaaatggacataggcacgccaaccgtcgtggccttccacgtggaccaaaggaaactgaaatatctgcaagtgtgcctgatgcgaagaattcaaagaggggctctgctagctatggtgctcatgagagacaagtatgggttcagaagtcaagttcaggctcgtgagtttgttcattgatgatactcccatcgaaacaggtattgccagtcgtggtgaagtcttggatctgcagtgcattcttcttt

SEQ ID NO: 1625 - DNA, 262 bp, Zea mays
  misc_feature: Incyte ID No: 700551236H1
acacagtttcctgaaatgcttgatggaagagtaaaaacattgcaccccagtatacatggtggtattcttgcgcgaagagaccaggagcaccatctgaaagcactgaaagagcatggcattgggacatttgatgtggttgtagtgaatttgtatccattctatgataaggtcacctcaggtgcaatatcttttgaggatggcattgaaaatattgatattggtgggcctacattgatccgagcgctgccaagaatcataaggt

SEQ ID NO: 1626 - DNA, 191 bp, Zea mays
  misc_feature: Incyte ID No: 700551240H1
gtgagttcacttagcacttttgtacacatcccgatgaagattcccaacgttgaatcttgtttgagcagccagaagttctgctttgtatatgctcgtagtttgtatgcgagaattctttcctgtatcagttttttcagaaacgatttgccttgggcatatatatagcaaaaccggcaatgtggccagcagcc

SEQ ID NO: 1627 - DNA, 248 bp, Zea mays
  misc_feature: Incyte ID No: 700551242H1
  unsure 58, 242, 244-246: a, t, c, g, or other
gaacgtagaaactactgtctccgcctgcttctccgaagctcgctgttggtagcaagtnttattgctagtattattgttattgctgatttgctcccctctgcctttgcgatgtaaatatttgtgtacccagccccagccccagccccagccccagcttgtagtgagcagtaacaagcagtagcggtaccttcggtattaaccggcagctagctatttcgcggcatttaatcctgtaagcgtancnnntc

SEQ ID NO: 1628 - DNA, 160 bp, Zea mays
  misc_feature: Incyte ID No: 700551243H1
  unsure 142-143, 152: a, t, c, g, or other
aaggaaaataagaaccctctgcagctttccctttgactgaagtgcagcccggcacaccggttgcttgttgaagaatgcttttttattattattgtagttaagagtccagacgtcgttattaccacttatcttcgtattggannaaaaatgtntttttctt

SEQ ID NO: 1629 - DNA, 264 bp, Zea mays
  misc_feature: Incyte ID No: 700551245H1
  unsure 2: a, t, c, g, or other
gnaagtttgaaggaagcttgtgaaactgctctgcaggagcatcactttctaactggtacacttgaggaagactccaacaggtcagacaacgagtattcagagcaaattaaactactatcagaggtcttcagccaagcgacagtcgccgatacaccaacagatgtgcccgattacctttgctgtcagataacattcgagatcttccgagatccagtgatcacaccgagtggtgtaacttatgagaggctgtacttgttgaacatc

SEQ ID NO: 1630 - DNA, 267 bp, Zea mays
  misc_feature: Incyte ID No: 700551247H1
ggttaccaactacaattttggtttcctttttttccctgttgccaataccactgttgccacaggatgtttttacttttcagtccgggagctattttatttggtttcatggataagcatccttgccagcattgtttacaaaaagaacattctactaccaaagctgcacaaaattagtggtttgagttctcgtgtactcttctatgctgcagcataatctgtttcgttttgggaattgggtactatgtttgcttttttcattagtgacag

SEQ ID NO: 1631 - DNA, 213 bp, Zea mays
  misc_feature: Incyte ID No: 700551250H1
aaatcatttttatgtaccgttttaagagtttggagtgaactagagatggtgaatgtccctcctctggaggatgccatggaccctttttgtttacatagaactgccctgctgttaaacttttgctacttggcgaaggcagttgattgcttgcctccattaacacctgctatgcgagaagcttttagccttgggctgtcgggcagagggactcct

SEQ ID NO: 1632 - DNA, 210 bp, Zea mays
  misc_feature: Incyte ID No: 700551251H1
  unsure 7, 9, 19, 32, 45, 65, 68, 73, 75-76, 78, 80, 82, 85, 88, 121, 136: a, t, c, g, or other
cattcananaccattcganacaccctcgcacncacactctccctncgtgccccagcctaaatccncanaacanannantnanaanagngagttcgtgtacaccggcgacgcttgacacgtncgaatttcgtgccgnccggtgacaagtggacatacgtgttgcatcgttgtggattgtgttaccgtgcgcaataattctcggccgtgttg

SEQ ID NO: 1633 - DNA, 260 bp, Zea mays
  misc_feature: Incyte ID No: 700551252H1
  unsure 153: a, t, c, g, or other
gctatcgatgcttcagatgggctggacacgcttgcaaaccttgcgattcttggtgaaggtgaagctctcccttcacagccaacaacaaaacatccccgccatcgtccgggctgctcatgcatcgtctgcatccaaccaccaagcgggaagggnccaaagcacaagcaaacttgcacctgtaacgtttgtatgacggttcgccgccgtttcaggacactcatgcttcgacgcgagaagaagcgacaaaggatctgtctcgc

SEQ ID NO: 1634 - DNA, 259 bp, Zea mays
  misc_feature: Incyte ID No: 700551253H1
catcgagtaaaatctgtttccatggccaaatttaccgcacaagaagttgctgcccttcaagaaggggggaatgagcgtgctagagaagtatttttcaaggaatgggatcctcaacgaaatggataccctgacagcagtaacgctgacaaattgagaaatttcattaagcatgtgtatgtggaacggagatacacaggagaaaggagtactgataggccaccaagggcaaaggatgacaagatgagtatagtgaaaatag

SEQ ID NO: 1635 - DNA, 258 bp, Zea mays
  misc_feature: Incyte ID No: 700551254H1
cataggccagcgctttggtgctatcccagaggaccccgacgagctgctccggttactcgaagaagccgaaatctggttgtccagggtggatcaatctccgcccgagagcatgtacaatgctcttcgccccaccatggctgttttgattacaaatgagctactggagcaccctgatcccaacgtgaaggttgctctcacctcttgcttaacagaagttaccaggattactgcgccagaggcccctatgatgatgatgtt

SEQ ID NO: 1636 - DNA, 257 bp, Zea mays
  misc_feature: Incyte ID No: 700551255H1
agatgttgaagaggtcgtgacaactgttgagatagatgatgaaacatatgaagaaattgtgcgcaccacgaaacgcactatcccctttctttttgtccgaggtgatggtgtcatattggtttctccaccccttcgtacggcatgaagtttgaagtcagatcatgctggttgttaattatgataactggtgtatttggccacttgatggcgttgcatggagtgtatgttatgggcctaccgctactttttctgatggg

SEQ ID NO: 1637 - DNA, 256 bp, Zea mays
  misc_feature: Incyte ID No: 700551256H1
aagctccttcagatgctcgtttgacctcctggtaagtttgatttcaggttgacttttgtctcatgtggatcattacattatgatgatgatgttatctagcttatgaatatgacctcttacaagttgtccgaaatttatgacttcaagtttttgttccttctgtttacaagctgtttcaaatttcaaaactgttgttgtaattaatcttaaatctatatcttctcatggattcaataggttgtaaaaatgctttgga

SEQ ID NO: 1638 - DNA, 261 bp, Zea mays
  misc_feature: Incyte ID No: 700551260H1
gtggattctgagttggagctgaactacgggaggcgatacggtttgcttgggttgaatggctgcgggaaatctactcttctcacagcaataggctgcagagaacttcctatccctgaacacatggacatataccatctaagccatgagattgaagcttctgacatgtccgcactgcaagctgttgttacttgtgatgaagaaagagtgaagttggaaaaggaagctgaaattttggctgcacggcgagctcttggaatcaca

SEQ ID NO: 1639 - DNA, 263 bp, Zea mays
  misc_feature: Incyte ID No: 700551261H1
cccaaccgcacaagcgcgcgaggcaggagagagagagaggcggggagcaaaacaatggaggggaaagaggaggacgtgcgcctgggcgccaacaagttctcggagcgccagcccatcgggacggcggcgcagggcgcgctgacgacaaggactacaaggagcccccgccggcgccgctgttcgagcccggggagctcaagtcctggtccttctaccgcgcgggcatcgccgagttcgtcgccacttcctcttcctctacatca

SEQ ID NO: 1640 - DNA, 265 bp, Zea mays
  misc_feature: Incyte ID No: 700551262H1
gtgcgccgtactgcaagagcagctcaaccatgcccaggtccgcggcgcggcatgctagatggagcaaagataatccttcaacagattcaagagggcggacgccgcttcatcacagcatcatgaaagggcgacatgtgtacgccaagctactgctttccaggggcgccgattctcaagccgcggatcgagatggtaggacagcgttacagtatgcaatcgacagcggaaccatagaggacgaagagtccttgttttgctagaggac

SEQ ID NO: 1641 - DNA, 266 bp, Zea mays
  misc_feature: Incyte ID No: 700551263H1
ggccaccggaagattttaatgcttcaggtgcataggctctgcattaatattctcatgacagcatacgcagccgcaattttggtaggagcgatcatctacgaacctgtatcagaagattgtcattgtgtctggtcatggctgcctgcctccacactctggcaaagagcacaacaatttgacattgagaataaggattgtatcacacaattttatatgttcatttggaagttattctacgccgagtatttcttataccattgtgtagt

SEQ ID NO: 1642 - DNA, 257 bp, Zea mays
  misc_feature: Incyte ID No: 700551266H1
  unsure 12, 142, 159, 168, 256: a, t, c, g, or other
gggatggtccangctttttcggaaatgatgtcctggagttcttgactcgcacgaatggtggggctgtgcaaactatatggctgcctgttgtctgctgcctgctcgtgaaatctattctgatgggtcatactgttcaggacgnagctatgatggctctgnttgggatanttatttggacgctgatcgaatacactttgcaccgcttcctggtccacatcgagaccaagacctactggtggaacacgcacataccttnt

SEQ ID NO: 1643 - DNA, 258 bp, Zea mays
  misc_feature: Incyte ID No: 700551267H1
  unsure 76: a, t, c, g, or other
agaacaagaactaataacaccaacaagagctgctgccaactcctgcacagcctgggctctcatcactgattgcccncctattaccttcctcttttgcaatttagaatcacccatatatctacctgctctcggtcctctgtgaactctctcgtcttctaggtttcccaggcctcaagataagcctctggaccaaagcttgaaagcagctgccgttcttgcctcttttttaattcttcattcgtggttcctggattttgg

SEQ ID NO: 1644 - DNA, 258 bp, Zea mays
  misc_feature: Incyte ID No: 700551269H1
  unsure 121: a, t, c, g, or other
gggtgacgaaaccgcgccgcaccagacaagacagaggagccgccgccgcgacccacaggccaccgggtcgccgaggaggggatccagcgagccatgtcgaccgacgtgcccatgagccccnagctcgagcaggtggacggcgagatccaggacatcttccgagcgctccagaatgggttccagaagatggacaagatcaaggactccagcaggcagtccaagcagctggaggatctcaggccaagatgagagagtgcc

SEQ ID NO: 1645 - DNA, 88 bp, Zea mays
  misc_feature: Incyte ID No: 700551271H1
  unsure 2, 4, 9, 12, 21-22, 68, 79: a, t, c, g, or other
gntncttgngcnattttcttnnttccatcgtccacaacagtggggtttggaggtgttataactgatgncttctcatgtnccagctaac

SEQ ID NO: 1646 - DNA, 259 bp, Zea mays
  misc_feature: Incyte ID No: 700551273H1
ccagaaactggatttcaagttccctctcaccgtgtcctgcgtccacttcatctgctcttccattggagcttacattgcaatccatgtcctcaaggcgaaacccctgattcaagttgaaccggaggaccgctggaaaaggatatttccaatgtccttcgtcttctgcataaacattgtgctgggaaatgtcagcttgcgctacatcccagtctccttcatgcagacaatcaaatctttcactcctgcaaccacagttatt

SEQ ID NO: 1647 - DNA, 261 bp, Zea mays
  misc_feature: Incyte ID No: 700551275H1
gaggaagcaatgcagtcagcttcaaagggcaaggttcagaccattcgccaaggctatctatctaagagatcttcaaacttgagaggtgattggaaaaggaggttctttgtcctcgacagtcgaggaatgttgtactattatcgcaagcagaacagtagaccatctagtggatattctaaccaaagaactagcattccctcagaacatggttctgggttgctcagcagatggttctcttctcattatcatggaggcgtgcat

SEQ ID NO: 1648 - DNA, 258 bp, Zea mays
  misc_feature: Incyte ID No: 700551276H1
gcgaagaagtccgccgtggcgcctgctgggaaggctgcccagcctgcggcgaccaccaagttcccgaccaagcccgctcctccctcgcagacggttcgggatgcacgcggcggtggctcatcagctcgtggaggctttggccgtggtgaacgtggccgtggcagaggtggacggggatatggccagaaccgtggcttcagtggtgacaatggcagtgacttccagggaggttatggtggcggaggctatggggatggt

SEQ ID NO: 1649 - DNA, 92 bp, Zea mays
  misc_feature: Incyte ID No: 700551278H1
gtgaaaagataatctagtaaactgtacttggcctgtttgactgtagccgcagtagcgtatgcgcatactattggctgttgtcgtgtctggag

SEQ ID NO: 1650 - DNA, 257 bp, Zea mays
  misc_feature: Incyte ID No: 700551281H1
  unsure 33, 130: a, t, c, g, or other
gggaaagtctttccaacaatcattggtaataangtcacaataggtcacagtgctgtgttacaaggatgcacggttgaggatgaggcttttgttggcatgggggcaaccctattagatggtgtcgttgttnaaaagcatgggatggtagctgcaggatcccttgtaagacagaatactaggatcccttgtggagaggtatggggagggaaccctgccaaatttctgaggaagctcacagatgacgagatcgcatttat

SEQ ID NO: 1651 - DNA, 257 bp, Zea mays
  misc_feature: Incyte ID No: 700551282H1
agagatttcacaaatccatcattacctacagaacaacgtcctagggcctctcagcaagcttatcctgatccagctaatctctatgccttccaacaagctggagcttcatatgcacagatggggagggctgcaatgattgctgccgcatttggtggaactttacctcatggagtgactggtaccaatgaacggtgcacactcatagtcagtaatctgaataatgataaaattgatgagataagctcttcaatctgttt

SEQ ID NO: 1652 - DNA, 201 bp, Zea mays
  misc_feature: Incyte ID No: 700551283H1
  unsure 71-73: a, t, c, g, or other
tgaagttggacgtcgtggggttccacgcgtcggagctgttcgtgccggagatcgccgaggtgctgttcgcnnngatgcgcgagttcgtgtacaccggagacgcttgacacgttgaatttcgtgccggccggtgacaagtggacatacgtgttgcatcgttgtggattgtgttaccgtgcgcaataattctcggccgtgttg

SEQ ID NO: 1653 - DNA, 255 bp, Zea mays
  misc_feature: Incyte ID No: 700551285H1
gtggatagcaactacaagctcgcctatgatgggtttctctccaaggtgccgattcctcctggacaagtttatgctataaacgatgcgttgtcagctgaaggagcggcagacgactacgaagcgtgcttgaagcagcttgttaagaacggtgtgatttctatgtcagcggcgactggatttcctaggtttgatctccagcttctgggaatgggacctgatggccacattgcgtctccttccctggccaccctcttg

SEQ ID NO: 1654 - DNA, 253 bp, Zea mays
  misc_feature: Incyte ID No: 700551286H1
aacgactgagcgagtgccactatccctttgcttgccctggagaggagagggtgcgctatgggcgatacagggagcagctccattctggtgcacattctggtggtcgccctatgcctgaccgcctttggcttcgccgtcgccgccgagcgccgccgcagcacgggttcaatagtcacagacagctccaatgccacattttgtgtttatgactccgatattgctactggctacggtttggtgctttcctgtttct

SEQ ID NO: 1655 - DNA, 167 bp, Zea mays
  misc_feature: Incyte ID No: 700551287H1
  unsure 2, 64, 78, 106, 134: a, t, c, g, or other
cnggtgaaggtgacgcgcagatccatgatcaagcgtcccgcggggtacagtcttcgccgaggancgcggcaagcacgncgccggcctctccactagggactacccngcccatctcgccgtttgccggcgctggnggtcgcttcagaaggagatcatcatccgacgca

SEQ ID NO: 1656 - DNA, 252 bp, Zea mays
  misc_feature: Incyte ID No: 700551288H1
  unsure 15, 43-44: a, t, c, g, or other
gtttatttgctggtntcagttttggttcagttctccaaagcanngttttagtttgtgctgcttctcttggttcatgcacatgagctgtttttttttgggttcatgacctttggaaaggtgaagcaaaagtctcggtgcttcctcttgctatccagggcagatttttgtttgatgctgcttgacgtggaggaactatattctagtactgactttatatatcctaataaatctactgttgtgctatcaagtttt

SEQ ID NO: 1657 - DNA, 255 bp, Zea mays
  misc_feature: Incyte ID No: 700551289H1
gggcgacggtgcgggcgctgcggctggtgcctggtggtggtggggtaaaacggaatggtaaactgaagccaactgccaacccgacgaaggccagaactgcgcgcgcggaacctgttcgacgaattggcgcactggctatggcgctgctacgcgccgcgctagcccagccgttatcgccgcgccccgcgctcccggtccgccaccctccgacctcgctgacaggctccaggtttatctcgacttctcgttccacac

SEQ ID NO: 1658 - DNA, 257 bp, Zea mays
  misc_feature: Incyte ID No: 700551290H1
  unsure 137, 146-147, 194-195: a, t, c, g, or other
gactagttctagatccgcgctaatatcaaggtttcatcaacagagactggagttatatttggcaacatagtttacgagacttcaaatgtgatggaacgatcagtggttgtcctaaatgatattcatatcgacatcanggattacannctcacctgctacctgtgctgatgttactttccggaacatgtgggcannatttgaatgggaaaataaggtggcagtgaatactgtgattcagatgagaaggaattcttgaa

SEQ ID NO: 1659 - DNA, 142 bp, Zea mays
  misc_feature: Incyte ID No: 700551291H1
  unsure 35, 124: a, t, c, g, or other
gggttggcttctcctccccctccggttcgggttcnggttcgtgaggttctccggggttcggtttcgtgggtggggcggatcgagatggcggcgtcggatgttgagtaccgctgcttcgtcggcngcctcgcctgggccacgg

SEQ ID NO: 1660 - DNA, 258 bp, Zea mays
  misc_feature: Incyte ID No: 700551293H1
  unsure 209: a, t, c, g, or other
tcaacgatgtcaagcgaagaatataaaaatatcgttgtccaagctaaagaacacatcttggccggtgacattttccaagttgttttaagccagcgttttgagagacggacattcgccgacccctttgaaatctatcgtgcattgcgcatcgtaaatcctagtccatatatggcctatctacaggcacgaggttgtattctcgtggcatngagtcctgaaattcttacccgggtacaaagaggacaataatcaatcgtc

SEQ ID NO: 1661 - DNA, 263 bp, Zea mays
  misc_feature: Incyte ID No: 700551294H1
  unsure 251: a, t, c, g, or other
atggctttgattctgctactagttgttctaaccaagagattgtagtgtcaaccatgggactaaaagcttctggtgttgccaatagaggcgcctcaactgtaaaaaagtatgaagctacatcaacgaggagtacaaatctagcaagcaagtctccattgttgcagaaaaaactgcaaacaccaaccaggaacaggaaccagctaacttcgagcaccataggtggaagaagaacaccaaatggaaaattggcntgcaaagtatca

SEQ ID NO: 1662 - DNA, 262 bp, Zea mays
  misc_feature: Incyte ID No: 700551295H1
gaagtatggcttattaataagatctggcttttggtttaatgctacatcattgcgagactggccactgctaatgtgttgccttagtctacccatatttccccttggtgcatttgcagtcgaaaagttggcattcaacaatctcattagtgatcctgctactacctgttttcacatcctttttacaacatttgaaattgtatatccagtgctcgtgattcttaagtgtgattctgcagttttacaggctttgtgttgatgttta

SEQ ID NO: 1663 - DNA, 91 bp, Zea mays
  misc_feature: Incyte ID No: 700551296H1
  unsure 49, 53, 84: a, t, c, g, or other
gttattattgatgcaaacacaggcccgttccaggggctatggatttgtncgtngtccgtcctcccaaaccctgaccaaatcccntagcccc

SEQ ID NO: 1664 - DNA, 282 bp, Zea mays
  misc_feature: Incyte ID No: 700551302H1
  unsure 107-108: a, t, c, g, or other
gactagttcttagatcgcggaggctcagcggattcgatcattcgatccccaccactgcccgaggccccctcctgcgctgacttggctcctccgccgtggccggaggnnaagcaagtggggaccacagaagcattagctgggtgaactctttcaaaaggggcaggtgcgctagtttgaatggctgctacaaagcttcaggccttttggaaccaccctgctggccccaaaaccattcatttctgggcgccaacattcaaatggggtatcagcattgccaacata

SEQ ID NO: 1665 - DNA, 163 bp, Zea mays
  misc_feature: Incyte ID No: 700551303H1
  unsure 87: a, t, c, g, or other
atcatcactgcatctaatatgcggtgatgatgtttacatttaccgtgcaagcaagatgacttatattatgccttaggacaataaganttgttttcactctaatgaaatacttggtaaaaagttgtctctgtagttgtatatttgactgtgaatatttgaaccc

SEQ ID NO: 1666 - DNA, 274 bp, Zea mays
  misc_feature: Incyte ID No: 700551304H1
  unsure 124: a, t, c, g, or other
atcatatatccactgttaactatcatggagaggttccagctgaagagagagttgagaacctgaacaagttccgcaatgaagagggggattgtccaacattagtatgcactgatctggcagctanaggcctggacctggatgttgaccatgtcatcatgtttgacttcccatcgaattctgtatgtgtttgtgtttgcatttactcccatcatagcgatttttatgcagtctttgtggtaattcttgtgtttttagattgattaccttcacagaa

SEQ ID NO: 1667 - DNA, 220 bp, Zea mays
  misc_feature: Incyte ID No: 700551306H1
ccccggtggcactaatgcccatcgcgaacccctcgcaggaaagaagctctgcaagcggaccctcaagctcgtgcgacgagcctctgaggccaagtgcctcaagcgcggagtcaaagaggtagtcaagagcattcgccgcgggaacaaagggttgtgtgtgattgctggaaatatttctcctattgatgtgattacacacgttccaatactatgtgaggaa

SEQ ID NO: 1668 - DNA, 274 bp, Zea mays
  misc_feature: Incyte ID No: 700551307H1
gtacttgttggctgttggattctacaggattggcgactactcaaaaagcaggcaacttgcagatcgttgtttggagattcaagcggattggcggcaggccatatcgctgaagaaggcaatagaagataaaattgccaaagatggtctgattggaataggaattgcgacaactgcggtcggacttctggttggtggaattgcagctgctgttgccaggaagaagtgaggtcaatatattggatcggcagctcattgaactaggggagctcccgtc

SEQ ID NO: 1669 - DNA, 101 bp, Zea mays
  misc_feature: Incyte ID No: 700551309H1
  unsure 9: a, t, c, g, or other
tgcaggatncccagtggtttggtgcattgttacggagtatgccaagggcggatcagttaggcagtttctggcaaagaggcagaataggtcagttccacaca

SEQ ID NO: 1670 - DNA, 272 bp, Zea mays
  misc_feature: Incyte ID No: 700551310H1
  unsure 201-202: a, t, c, g, or other
ggaacaacttccaataggaattgcaacagcagcttttgacggcattcactcctccaaatgggaagagcctgatggagccaaaggatgttggctgatttatacaatgcaagatggcaaaagttgcgagttggagtcatatgatttgatgtcagctaatgatgctccagagagggatccaatggactgggttcttgaaggganngcagacggaggctccacctggaatatacttgatgctcggaattcagaaatgttcgagagccgtttcttga

SEQ ID NO: 1671 - DNA, 272 bp, Zea mays
  misc_feature: Incyte ID No: 700551311H1
agcaaaacttctggtggaagaggatgaaggttgatgtttctaagtatgtggccgcctgtgaggtatgtcagcgcgtgaagggcgaacataataggcctgcaggtttattgaagccattggaaattccggagtggaagtgggagcatatcaccatggattttgtggttggcttacctcgttctcctcagggcagggatgctatatgggtggtagtggatcacttaactaagtctgcgcactttattctcatgaagaccacaaatttagcttca

SEQ ID NO: 1672 - DNA, 272 bp, Zea mays
  misc_feature: Incyte ID No: 700551312H1
gccgtgcactgggaagaggaggtctaggagcagatgagcgggctggagctggagctgggcctgagcctaggcgtcctcatcgacgtcgtcgacgagcagtggatgcgcgacaccctccccgccgatgacatccccgtgccgccggccatggcagtcaaaactgaggacgccgaggatccagcgcccgccaatcaggaaagccaaccagcacaaggggatgtatggcgtgattttgccttggaaaatctctgattctttatgctctacattgt

SEQ ID NO: 1673 - DNA, 274 bp, Zea mays
  misc_feature: Incyte ID No: 700551313H1
  unsure 42: a, t, c, g, or other
ggaaggagtcggagggaaccgaaaactcagggtctcgaattncctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactctgccgccatcctggag

SEQ ID NO: 1674 - DNA, 272 bp, Zea mays
  misc_feature: Incyte ID No: 700551314H1
  unsure 94, 156: a, t, c, g, or other
gatattagagagctgatttcattggatgatgttatggaggagattgggttggggccaaatggcggtctcatctactgcatggagcaccttgaanacagcttggatgattggtttgatgaacagctagagaactacttagatgatgattatcttgtntttgattgccctggccagattgaactcttcacacatgttccagttctgcggaactttgtcgagcacctgaaacgaaaaaatttcaacgtttgcgctgtttaccttcttgattcaca

SEQ ID NO: 1675 - DNA, 276 bp, Zea mays
  misc_feature: Incyte ID No: 700551315H1
acaatgtcaaggattgcttcctttatatcctgttacatcatcagctaccttgtcatcatcctgctcgccaacatccaatatcattttataaggatgaagattcatcgcatgaggaatcctcctatagcttgactgactatgtatgcttgaagatacctgatggatcattaaataaagtaaattgcatcggtgtgataaagggctctggtaactgttgtactaccctcagcatgatgtcactttcaggttttctgttgcatatacctgacggatatg

SEQ ID NO: 1676 - DNA, 279 bp, Zea mays
  misc_feature: Incyte ID No: 700551316H1
  unsure 45, 177, 200, 266: a, t, c, g, or other
ggttgaagaactgaagcaagatcttaatcatgagaagaatctaantgcagatcttcgtctacaactgcaaaagatgcaggaatctaactctgagctgcttctggctgtgaaagatcttgatgagatgttggagcaaaagaacagagacatttccattttggcagaggatacacaagnggatccacaggaggcagaatagncagcatgcactgtcaaatgtgcataattctggacgcaaaattgccttatctgaaacgagttcatancaagagaaggagg

SEQ ID NO: 1677 - DNA, 272 bp, Zea mays
  misc_feature: Incyte ID No: 700551320H1
ggctgttgccttcctctcggacttcaaacttggccactatatgaagatccctcccaagtccatgttccttgtccagtttgtcggtaccattgtggccggcacggtgaacatcgggacggcatggtggctgctgggctccatcgacggcatctgctccgactcactcccaccagacagcccctggacatgtcctaacgaccgcgtcttcttcgacgcgtcagtcatctggggcctcgtgggtccacggcgcatcttcgggccagacgggaata

SEQ ID NO: 1678 - DNA, 274 bp, Zea mays
  misc_feature: Incyte ID No: 700551321H1
acagcttcgacagctcctgaaaacagtgggggcgcccaaacatccgctgaaacttgagcttcagcagctaattgggaacaaacattttccaagaccctgccgtgtggtttcctccgcgctgttgcttaatataattacgcatctaatttagggtctacaactacaagttatttttttttctgcctgttgtttttgacaccatgacttgctgtttccttgctatattgagtagtaccttgcaataaaataactgcaaggtactactcaatatatg

SEQ ID NO: 1679 - DNA, 273 bp, Zea mays
  misc_feature: Incyte ID No: 700551322H1
  unsure 155: a, t, c, g, or other
atcgcctcggaaaaaggcgagaaatctgcaacagaagaagcagcagcgacaggattccttcctcgtacctttcgttgcgctcgcgcactcggatcgacccctctagggttttgcatcggcctcccgccagctcctatccctcccctctccctccnccgcgcgcccgcgcgggggagccaccaaaccctaggacggcaaatccggtgcgatcacccacggtggaggcctcgtcggcggccgagaggagccgctcagggtcgggtcagggttccg

SEQ ID NO: 1680 - DNA, 271 bp, Zea mays
  misc_feature: Incyte ID No: 700551327H1
aaaatacaggaggtgttgttcaagagagagtaccaaattctcaaggagctcagtctgagaatgatcctaacaataccactatatttgttggtgggcttgaccccaatgtcactgaagataccctaaaacaagttttttctccttacggtgaagtcgtccatgttaagatccctgttgggaagagatgtggttttgttcagttcgttaccagaccttctgctgaacaagcgctgctaatgctgcaaggggccttgattggtgcacagaatgt

SEQ ID NO: 1681 - DNA, 273 bp, Zea mays
  misc_feature: Incyte ID No: 700551330H1
  unsure 156: a, t, c, g, or other
atcaaacgcacatgtcgccacttccaaggtgtggaaaccgttaaggcagatctatcgtcgaacaaagtgactgttaccggcaaattggatgccgagaagctgcgagataagatcgccgagagaaccaagaagaaggttgacatcatctcagctccngccaaaaaagaagccgccgccacggaaaatccaccggagaagaaggttgaagagaagaaacctgaagagaaaaaaccagaagaaaaacctaaagagagtatggtggttttgaagatc

SEQ ID NO: 1682 - DNA, 274 bp, Zea mays
  misc_feature: Incyte ID No: 700551331H1
agaaaatgaggaagtcaatctcgatgatgtcaatgcagcttttgatgatcctgaggacgataatgaggatgctttcgaagatgaaacaggtcctctaacacttaatgcattcgacctaatcattctttcgcaaggattgaatcttgcagcgctctttgaccgcagacaggactgtgacaagcttcaaaatagattcttatcacgcaatccagcaaaggttatcttgtcaagcatggaggttgttgcgcaatcaatgggatttaagacacacatt

SEQ ID NO: 1683 - DNA, 277 bp, Zea mays
  misc_feature: Incyte ID No: 700551334H1
  unsure 11, 34, 104, 169, 266, 268: a, t, c, g, or other
aacatcccccnaatcatgaattggtggccaaggncctgcatggggccgagtggcggttccgtcacatcctttcgaggtcagccacggagacatctcctgcaaantggttggagtgtttttgtgagcgccaagcgtcttgtcgcgggggatgccttcatatttctcagangtgacaatggggagctccgtgttggagttcggcgtgcactgaggcaccaaaccactatcccatcttcagtcatatcaagccacaatatgcatcttgntnttcttgcaa

SEQ ID NO: 1684 - DNA, 273 bp, Zea mays
  misc_feature: Incyte ID No: 700551335H1
gaacaagaacaaattgaccgattggctgaggacggtgatatctacagtaagctggcaaggtccttggcacctgaaatatttggccatgaagatgtcaaaaaggcactgctgttactacttgttggtgcaccccatcggaagctcgcagatggcatgaagatcagaggagacctgcatatatgcatgatgggagatcctggtgttgcaaagagtcaacttctgaagcatattatcaatgttgcaccaagaggagtgtacaccactggacgtggg

SEQ ID NO: 1685 - DNA, 273 bp, Zea mays
  misc_feature: Incyte ID No: 700551336H1
gcatgttagaccctgaggtgtacagcaagtacgtcgaggacaaggccgccgcccatctgtccggcttcgctttcgctgtcattggcattattcatcttgctggtggcaaaatgcccgaagaggacctctggcatcagttgaagcgggtgggtttgaacgagactgatgaagctcaccttgttcttggcaacaataagcaggcgctcgaacacctagtgcagcaaaggtacttgctgaaggagaaaattgctggaccggaaggtcatttcgtga

SEQ ID NO: 1686 - DNA, 244 bp, Zea mays
  misc_feature: Incyte ID No: 700551337H1
  unsure 116-117, 119: a, t, c, g, or other
ccaaggggcggtgaggtaaagctggccccattcgttaccttgcaggcgtaatttattcattcagaatatattttttcttaaatgttctctcaagttaaggcttaagaaccagaagnngnaggattgtttcgtattagatattctgcctgccttgtactacttccttctccgagtattgtaatgactatacaatctgttggcttgtattgtaccgctgctattgacccagccagtattttactgc

SEQ ID NO: 1687 - DNA, 272 bp, Zea mays
  misc_feature: Incyte ID No: 700551338H1
  unsure 155: a, t, c, g, or other
gctcttcgcgccggacgacgccaaggccacgcagaccgtcgacccgaacaggaagcctcctaccatcgtcacccacaagaagaagatcaagctccggcgagttcatctattgctcaacctcagtattggccaacgtgaaaacatggaggtgaagngaagcaagtggtagttgagcatatgctggtggttggttgtcttcatgaacatctctttgatggctgataccattcctgggactgcaagccaacactgtcctttaacccatgacccat

SEQ ID NO: 1688 - DNA, 233 bp, Zea mays
  misc_feature: Incyte ID No: 700551339H1
  unsure 115: a, t, c, g, or other
tttcgtaccgcggcccctaaacccctttcctcgttcccctccgtctctcagttaggcacaatgatgctagctaataagcttggtggtttgctcaagaatgctacgagttcaaagngttcaaatatgtctgtctaccaagcaatcagatgcatgtcatcatccaagctttttgttggagggctttcttatggaaccgatgatcacagtctcagagacgagtttgccaaatatgg

SEQ ID NO: 1689 - DNA, 271 bp, Zea mays
  misc_feature: Incyte ID No: 700551342H1
aggagctggtggggaaggaggtgacagtggagctcaagaatgacttggcgatccgcgggacgctccactcggttgaccagtacctcaacatcaagctcgagaacacccgcgtagtcgaccaggacaagtatccccacatgctttcagtgcggaactgcttcatcaggggctcggtggtgcggtacgtgctgctcccgcaggacggcgtggacatcgacatcctccacgacgccaccaggagggaggcgcgcggaggctgatcctgatgcgc

SEQ ID NO: 1690 - DNA, 271 bp, Zea mays
  misc_feature: Incyte ID No: 700551343H1
ccgccatccattctcctcctccgttgcagctgcggcatccatccagtagtccgaccaatccatggcttcagcgttcgggaccgcctccacttgcggcattaaacatgcacctgccggcgttgcgcttgctgcgcccatgaagcacctttccctcgtctcgccctcgctggtttcgcttccgcgcaagatgaggccgcgaaggaagtacaacttcagggtaaacgctgcaaaggagctgcatttcaacaaggatggctcggctatcaggaaa

SEQ ID NO: 1691 - DNA, 272 bp, Zea mays
  misc_feature: Incyte ID No: 700551344H1
gggaagaagttgaggcaaaagcagaagaaagcagaagcgcgtgctaaaagggaggctgaagagaaacaagaggatgaaacagcttcatctaacagttcaaaatctggcaagaaacaacatgcaagaccagttgatctggatccacatggtgaaaaattaatccagattgaagacccgcttgcagaagccacaaaatacttgaagcttctgcagaataactcgtcagactcattagagacccatatactttcatttgagctaagcatgagaaa

SEQ ID NO: 1692 - DNA, 269 bp, Zea mays
  misc_feature: Incyte ID No: 700551346H1
  unsure 52, 65, 70, 92, 154-155, 169, 184, 200, 214, 227, 256, 259, 261, 266: a, t, c, g, or other
cactgactagcaatgtaactgatgataatgcggagaaagtaagatcaatatngaaaccatttgtncatanacataatggcaatattcttcgnactcttccaggactcagggagagtgtaattattttgaagcctcttccccttcaaaagagtannataaaaaggtgganaacattggttctggnaacaacttcgaacatnaatatgtcatttcntagcttctacacncccttcccttgtaaccgccattaacatgnctnangaggnagc

SEQ ID NO: 1693 - DNA, 159 bp, Zea mays
  misc_feature: Incyte ID No: 700551348H1
  unsure 21, 143, 153-155, 157: a, t, c, g, or other
gctcctatcaacctttcgganccgtttgaatcaagtgcttcggtgggctcttggttccattgaaattcttttcagcaggcattgtcccatatggtatggctatggaggtcggcttaaattcctggagagatttgcttatatcnacacaacaannnanct

SEQ ID NO: 1694 - DNA, 272 bp, Zea mays
  misc_feature: Incyte ID No: 700551351H1
  unsure 188: a, t, c, g, or other
aaataaagatcagccctgggataatgctattgatttatgcaagaacaagcagctcggttcctctgaagattctttccattgatgatggtacagtcttgaagtccttcagccacctcctccatcgtaacaagaaggtagattttattgagcagttcaatgaaaagcttctggtcaagcaggaaggaganaacctccaaattcttgatgtaaggaacttccaattgacagaagtgagcagaactgagtttatgactccatccgcctttattttc

SEQ ID NO: 1695 - DNA, 269 bp, Zea mays
  misc_feature: Incyte ID No: 700551353H1
  unsure 21, 98: a, t, c, g, or other
ctcgtttagaacctctaaaanttcccccactcgccagtcgcagcagcacctgtagcagccatggacgccagcggagccggtagcaaggggaagaaggnggcggccgggcgcaaggcaggcggccccaggaagaagtcggtgacgcggtccgtcaaggccgggctgcagttccccgtcggccggatcgggcgctacctcaagaagggccggtacgcgcaccgtgggcactggcgcccccgtctacctcgccgccgttctggagtactcgc

SEQ ID NO: 1696 - DNA, 205 bp, Zea mays
  misc_feature: Incyte ID No: 700551354H1
tctaagaatatcattgtaaaggattacgcatgagtctggatatcatctccaaccaagaccgatatgaaaataccatcgtgatgttgtcaataccagccataagcgtgggtctgtctgattggggttactcgcattaatattgtactgtattgtattagaggttatgcggcatactcataatctgaataagataacaaaatttggc

SEQ ID NO: 1697 - DNA, 270 bp, Zea mays
  misc_feature: Incyte ID No: 700551355H1
aaagtattggcaggtgactaatttagtcggtcagatgcttgggaaccagcctcagatgtgaaccgagaagcactagtttcattttgtagcagaatcctattgctctgtttattctttttggttggtattagaatcccgccacctgctattaagtacaccaatacagcaccagacttgttaatgcgtggatcgctctaaagaaaaatcacggtgtcttgccctttccagtgatgtgcattatctttgaatcatgaacagggaacatgcctg

SEQ ID NO: 1698 - DNA, 133 bp, Zea mays
  misc_feature: Incyte ID No: 700551356H1
  unsure 2, 50, 55, 57, 87, 119: a, t, c, g, or other
tnatacatatattctcaccgtatgcatatgtatgtatttgtacgaaatantaaancnaaggccagggggtcaagccaaacaataatntgatgtacttggaattcagatgtgttatcatncaccacttgtctgg

SEQ ID NO: 1699 - DNA, 269 bp, Zea mays
  misc_feature: Incyte ID No: 700551357H1
  unsure 2, 7, 67, 85, 133, 199: a, t, c, g, or other
cngctcnatggcattaatcatgtagccgttctgttgcataatgactgtctttatctctcccaggagntatttgggtttgcatttnagtatcgaacagactttccaagttccatgaaggaacatgctgtgtttnttgatttggctccaaggtttcagctgttggcagaagaaatattgcagagacaagttcaccttgtgnattataatttgaaggaggctatagatggtgctgatggatttcagaatactcatcagatgaaacaatttga

SEQ ID NO: 1700 - DNA, 268 bp, Zea mays
  misc_feature: Incyte ID No: 700551358H1
  unsure 37, 59, 69, 72, 126, 139, 143, 179, 210, 215, 222, 233, 239, 248, 253, 263: a, t, c, g, or other
gggtgatccatttgagcaaatggaaggcaacgatgtnccccttggaaacatgttgcaangggttccctntgnaagtttagacttacgtggcagctctatgcaaaattatgctccaaactcaggaanacatatcttcagnagcncccagatgccaggtacttcacaatgtctatgaccanggctacagagcctgatgactttcctgggttncagtncaaagancagggaaagantgatgnccaccaccnccaanaccatagtcntcact

SEQ ID NO: 1701 - DNA, 268 bp, Zea mays
  misc_feature: Incyte ID No: 700551359H1
gaggtggttgaggatctcgttcagacgatctacagctcagaccggtcggattccatgcagacaactatcagctagatcagataggcaaatgaccattatttgtcgcgacaccaagcgcttacgatggacctcggcaaacaccatgtgtctcagaaatttagtatcagtaactggagcatgctgatgaacattggcagttggcgagggggcgaaggcatgggcatcccaatcccttcaccagaaggaaataaaggagaggcgaagagga

SEQ ID NO: 1702 - DNA, 270 bp, Zea mays
  misc_feature: Incyte ID No: 700551363H1
ggcgatgtgaaattaacaatggaggatgctggaaagataccaagaatggtcggacatactctgcctgtaatgatgatggctgcaaatgcccagatggattcaagggtgacggtaggcacaaatgtgaagatattgatgagtgtaaggaaaggactgcgtgtcaatgcaaagaatgcaaatgcaaaaacacatggggaagctatgagtgtggctgcagtggaggcttgctttacatgaaggagcatgatacatgcataagcaaaagtggac

SEQ ID NO: 1703 - DNA, 275 bp, Zea mays
  misc_feature: Incyte ID No: 700551365H1
  unsure 5, 49, 63, 65-66, 69, 101-103, 108: a, t, c, g, or other
gttgntgtcaatggcaatgggatggaggttggtcatactattgtgacgnactgttggtggaangnnatncacagcagaggcagactattagttatgtggcnnncgtantcgtggggcaaggttcatttggagttgtcttccaggccaggtgtctggaaactggtgagagagtagctataaagaaagttcttcaagatgtgagatacaagaaccgtgagctgcaaacaatgcaagttcttgatcacccaaatgttgtatgcttgaagcattacttc

SEQ ID NO: 1704 - DNA, 271 bp, Zea mays
  misc_feature: Incyte ID No: 700551367H1
  unsure 63, 97, 186: a, t, c, g, or other
ctcttcgcgccggacgacgccaaggccacgcagaccgtcgacccgaacaggaagcctcctacnatcgtcacccacaagaagaagatcaagctccggngagttcatctattgctcaacctcagtattggccaacgtgaaaacatggaggtgaagtgaagcaagtggtagttgagcatatgctggtgnctggtcgtcttcatgaacatctctttgatggctgataccattcctgggactgcaagccaacactgtcctttaacccatgacccat

SEQ ID NO: 1705 - DNA, 231 bp, Zea mays
  misc_feature: Incyte ID No: 700551368H1
tttcgtaccgcggcccctaaacccctttcctcgttcccctccgtctctcagttaggcacaatgatgctagctaataagcttggtggtttgctcaagaatgctacgagttcaaagagttcaaatatgtctgtctaccaagcaatcagatgcatgtcatcatccaagctttttgttggagggctttcttatggaaccgatgatcacagtctcagagacgagtttgccaaatat

SEQ ID NO: 1706 - DNA, 134 bp, Zea mays
  misc_feature: Incyte ID No: 700551371H1
  unsure 18, 22, 46, 65, 78: a, t, c, g, or other
tgatacatatattctcancgtntgcatatgtatgtatttgtacganataataaacccaaggccanggggtcaagccanacaataatttgatgtacttggaattcagatgtgttatcaaacacaacttgtctgcc

SEQ ID NO: 1707 - DNA, 269 bp, Zea mays
  misc_feature: Incyte ID No: 700551373H1
ccagaaactggatttcaagttccctctcaccgtgtcctgcgtccacttcatctgctcttccattggagcttacattgcaatccatgtcctcaaggcgaaacccctgattcaagttgaaccggaggaccgctggaaaaggatatttccaatgtccttcgtcttctgcataaacattgtgctgggaaatgtcagcttgcgctacatcccagtctccttcatgcagacaatcaaatctttcactcctgcaaccacagttattctgcagtggc

SEQ ID NO: 1708 - DNA, 101 bp, Zea mays
  misc_feature: Incyte ID No: 700551374H1
aacgtgtcgttttttgtcaaagcggttcctgtgctgtataacatgttgcatgagtattggcgcaacttataagacaatgtcaaatgggtttttgggagtcc

SEQ ID NO: 1709 - DNA, 268 bp, Zea mays
  misc_feature: Incyte ID No: 700551375H1
  unsure 69: a, t, c, g, or other
catgcccatgcccgagcaacaacctaatagcatgcttgtaacgcaacaaggtttgggatacctccagcnaaacaccccaccttcatacggctccgttgggggtagtaatccattcgggtaaaagaagtgtgggaatacctgctctttcatctctagactaagggtctgcagcactcagcgggacagacatgcatcgaagccctcgagagaatgtgtttcatacaaccaggtcggtgtattctgtcgggtgtgatatgttgtacaactt

SEQ ID NO: 1710 - DNA, 267 bp, Zea mays
  misc_feature: Incyte ID No: 700551376H1
  unsure 65-66, 68, 241: a, t, c, g, or other
cttctcgtcatgcctggccaagtacaaggacgaaaaagaaaaacgcgtgtcgctagaagcgaagnnangacttacgtgggagaagctcgagtcagctgcagctttccagccagtgactggccatacagccgtcctagtaggccaccggcgtcagcaaatctgatcgccaccatgatctagctcatgcatgtatgccgaacaagcgaaggtggtgctctcccccccttttggtgaggcgcanaagtgtagtgttctctattttgctcc

SEQ ID NO: 1711 - DNA, 250 bp, Zea mays
  misc_feature: Incyte ID No: 700551380H1
  unsure 3: a, t, c, g, or other
ganaaagagtagcatcttaacattttctggacctgaacctctgtttggactccataacctgataaacgcatgtactgagtgcaatggatgtgccggcatgatccaaggttgttgctgaatcctaaagaaccggacgaaggatgctaacggtaggacgacctggtctcttagcctaccgtgggctgttgtcagatgtcaaaaatgccctcttagaagtttagaacatttctttggtgctcactcgcgtttc

SEQ ID NO: 1712 - DNA, 268 bp, Zea mays
  misc_feature: Incyte ID No: 700551381H1
ctgaaggtaaaggacaacagaatgattcttggtcaagtaagatgacttctcgtggtgctgaggataccagcggtggctgggacagcaaggagaagggctcttcctgcaatggtgggggtgaaggactacaaaatgatccatgggcaaacaagattggttctaacgaaggtaaagaacaagaagctgatccttgggccagcaagatgtcttctgctgtgggtgctgatgacaagaatggtacctgggacacgacaacaaagggcatcta

SEQ ID NO: 1713 - DNA, 270 bp, Zea mays
  misc_feature: Incyte ID No: 700551382H1
  unsure 22: a, t, c, g, or other
ctatgtgtcgcacattcaagtnaatcaggctcagaagcagcgacgcaggacataccgtgctcatggacgcatcaacccttacatgtcctccccatgccacatagagctcatcttgtcggagaaggaagaaccagtgaagaaagaggccgagtctcagatcgcaaccaggaaggcttagagaaggggctctatcttctgtgattggcttagtacaagttttggctgattatttgttgtctcatactgtttacctgagtattgtttgcaagt

SEQ ID NO: 1714 - DNA, 269 bp, Zea mays
  misc_feature: Incyte ID No: 700551383H1
gcagatccccagaacagcagccccagcacgagtccccatatgccaatgacgcctgagaatatttagctgctcaaagatgctggaaaatgctaaggggcccagcatgttttgcccatgcgcgtcggtacaacttataggatccagtctgagattttgctcgtgttttgggtttcccttggacacaccgctgctgataccattgtagagggaggagcataacgtttccgtttcgagtattgactttgggcacttatagctgtcaagacatg

SEQ ID NO: 1715 - DNA, 95 bp, Zea mays
  misc_feature: Incyte ID No: 700551384H1
  unsure 23: a, t, c, g, or other
agagttgtttgtgtccagcctcngtaacagataaaaacggacggtcctgatccccttgttcgtttgtgttaattaatgttgtaattgagcaggac

SEQ ID NO: 1716 - DNA, 266 bp, Zea mays
  misc_feature: Incyte ID No: 700551385H1
aatgcaataccttcttcatgctgtctgatggccagtcgtgggctatgctgcaaaatctcagggacaatgggcagtctgttgcatttgattgccctgagatggataaagttgttgatgaggttaaaaacgttgaagagtggctcaatcagtgccactgtactctacttctagatggaaataatagttctttgctctccatacttgtaaagataagaggattattggatgatgtttgcacgttatatgctgaggatgtatgaagttaa

SEQ ID NO: 1717 - DNA, 250 bp, Zea mays
  misc_feature: Incyte ID No: 700551386H1
  unsure 23, 25-26, 41, 60-62: a, t, c, g, or other
ggccgagaagaagcccgcggcgnannaagccggcggaggantgagcccgctgccgagaannngccggccgggaagaagcccaaggcggagaagcgtgtcccagcaggcaagtccgccggcaaggagggcggcgagggaaagaggggccggaagaagggcaagaagagcgtggagacctacaagatctacatcttcaaggtgctgaagcaggtgcacccggacatcggcatctcctctaaggccatgtcca

SEQ ID NO: 1718 - DNA, 267 bp, Zea mays
  misc_feature: Incyte ID No: 700551387H1
  unsure 2, 205-211: a, t, c, g, or other
gncataacataacatcatcacatcattttgcataacataagcatcatacagcataatgcatctggaacaagaaggggatacagtgttgaccttcggaacatattttggaaaagagaaaatcatgctaaggcacaagacaaatcgagatcaagtgtagcctcatcggaaacgcaaaacttttttacagcttcgaacaatatttcannnnnnntggacatttttcatcagagaagtaagcaaattcttatggtatagaaaggatttctt

SEQ ID NO: 1719 - DNA, 270 bp, Zea mays
  misc_feature: Incyte ID No: 700551388H1
gggacaaactgttctgtcatatgttaatatggtgtgttcgaccttgaggaactccatcccaaaatctattgtttattgccaagtgcgagaggccaagcgctcgctgctcgatcacttcttcactgaactgggagcaagagagatgaagcaactttccaagcttctcgacgaagatccagcagtcatggaacgcagaactaaccttgcaaagaggctggagctgtaccggagtgcccaatcggaaatcgatgcagtcgcatggtccaaata

SEQ ID NO: 1720 - DNA, 262 bp, Zea mays
  misc_feature: Incyte ID No: 700551391H1
  unsure 193: a, t, c, g, or other
gtttttctgtggagcgtctagttaaccgatgagctgcagggttggaaaaaagagacagtgatagcgaggtccgagggcggtgatcgggttgttcttgcaactgacgagaactcttgtatgtcgaaaagtaaggtcaaagaggtgatcacagtggtggagaaggagctgggatttggtgaagggaaactcctgnataagctttgcaaggtgtatctatacatatctgcacaaaggatcgtggggtgccttgtcactgaaccga

SEQ ID NO: 1721 - DNA, 266 bp, Zea mays
  misc_feature: Incyte ID No: 700551392H1
  unsure 28, 34-35, 38, 79, 81-82, 88, 112, 210, 237, 259: a, t, c, g, or other
tcccgtccgacgtcctccacaaaacatncgatannatncgaggccgcggctctcatagcagcagcagccgccgattacncnncatcanatccttccccgtcaatgcacaagnctcttgacgagggaatcgccaaagctgcggacctgctccggtgtgcggagcggcctctggttgtgattgggaagggtgcggcgtatgcgcgcgcggangaagcgattcggaagctggtggacacnacgggcatccccttctcccgangccgatg

SEQ ID NO: 1722 - DNA, 133 bp, Zea mays
  misc_feature: Incyte ID No: 700551395H1
  unsure 26: a, t, c, g, or other
cgtttccctagctggaaatatttggnccactcaatgtgtgtgctctgagtggctgttgtggtaattttatgccctaatgacatgacataaattactcctaatatttagctatcgatgaatctcccaatgtaaa

SEQ ID NO: 1723 - DNA, 270 bp, Zea mays
  misc_feature: Incyte ID No: 700551396H1
caacaaatgggttccgagtcatgcttcgccacgtcgattcgggaaaaaattaaccaaactagagcgtgtccaacacgggatcaagcgtggaaagagcaggcttcagaagcttaatgcaatggtgttggcagcatcatcaacacctgattctgaagatcagttagaagcccctattcacgcaggaaatggagagtacttaatagagttagccattggaacaccaccagtgtcttaccctgcggttttggacactggcatgaccttatatgg

SEQ ID NO: 1724 - DNA, 276 bp, Zea mays
  misc_feature: Incyte ID No: 700551402H1
  unsure 125, 129: a, t, c, g, or other
agagttcaaatatgtctgtctaccaagcaatcagatgcatgtcatcatccaagctttttgttggagggcttcttatggaaccgatgatcacagtctcagagacgagtttgccaaatatggacaanttancgaagctaagattatccttgatcgtgagtctgggaggtccagaggttttggctttataacttacacgtcttctgaggaggcttcggctgccatcactgccatggatggaaagactctggatggacggaacatacgggttaatcatgc

SEQ ID NO: 1725 - DNA, 274 bp, Zea mays
  misc_feature: Incyte ID No: 700551403H1
gagtttatggttattgatactggtggggtaattactttgtcaaagtctcaagcaggtgtaatggaagaacttgccgtcaccactactgttggtatggatgggattcctctcgccactagagaagctgctattgcaaggatgccatcaatgattgaaaaacaagcagttgcagctgttgatgaagcatccgtcatactattcgttgtggatggtcaggctggtcttgtggcagctgatatagagatttctgattggttacgacgcaactactctg

SEQ ID NO: 1726 - DNA, 272 bp, Zea mays
  misc_feature: Incyte ID No: 700551405H1
  unsure 2, 4, 24, 50, 119-120, 135, 216, 218, 229, 240: a, t, c, g, or other
angnagacggagacttgtcggagnaggagggcgagcacggtgacgtcctnaccagtggtgcattgccccataaggttcctcccatctccaagctgtcgtcgtccatgaaggggcttggnncatcgggaaatcggnaaccctaccgtacaggtggcgtccccaagggtaaggtgacaggtagaactaactacagtggcaaagccagcgagcacagtntnaggagccggancgccaacgagntgctcccgcccagcgcgagtttcgtgaagctg

SEQ ID NO: 1727 - DNA, 273 bp, Zea mays
  misc_feature: Incyte ID No: 700551406H1
cgccgtcacagtcgagatcatgcacgcgatgtggaagcccgccaagttcaagtacatctacctgctggcgacgctgtacgtgttcacgctgacgctgccgtcgtcggcggccatgtactgggcgttcggcgacgagctgctgacccactcgaacgccttctcgctgctgcccaagacccggtggcgcgacgcggcggtgatcctgatgctgatccaccagttcatcaccttcggcttcgcgtgcacgccgctctacttcgtgtgggagaaggt

SEQ ID NO: 1728 - DNA, 87 bp, Zea mays
  misc_feature: Incyte ID No: 700551410H1
taatgttggctgcctgttttttttatggcgagataatgttatgaaactggatagttccctgtaaacatggcttaaaacatgacagaa

SEQ ID NO: 1729 - DNA, 273 bp, Zea mays
  misc_feature: Incyte ID No: 700551413H1
  unsure 271-272: a, t, c, g, or other
ggcaacaaggtaggatggttagaattctatggctgtagtcagcaatcggggaggtaaacctctgctgactcgtgatctagaatttgaacactgtaaacaaaatatgtttattgtagcctaacgaaggtcaggacctccagtggtttattgcacaagttgtgcagtcggtcccagaatcatttggggaaggcgctataaacagtttttcttggcaggagtggagtgtagctccttttcgctaatatcatttttacttttagatgcaatcaanng

SEQ ID NO: 1730 - DNA, 274 bp, Zea mays
  misc_feature: Incyte ID No: 700551414H1
  unsure 28-29: a, t, c, g, or other
agaagcttcaatcaaccaatttctgttnngaatgaggtgcagaatgcgatatgaaagtgacgatgcttctgaaagaaggtgcactggtataataattggaagcagagaagctgatcctatatggtatggttcgaaatggaaatgcttggtggttagatgggatgatggtatagagtgccgttggcccaatagggtatctccttgggagatgagctcacaggatctgtttcaggatctcaaatgtgcgctcccagttcaaaacgtctgaaaccat

SEQ ID NO: 1731 - DNA, 183 bp, Zea mays
  misc_feature: Incyte ID No: 700551415H1
aatggacatgttgtacgatagctgttgtagctacgtgtagccatagcctaagctctaaatggcaggcaagaattggtctatgaaagtatggatgcaggcactcactgtagaggtgacctagccctgtagttctctatatcttctcatatctaaaagctgacggttccatgtggcgcctaaact

SEQ ID NO: 1732 - DNA, 282 bp, Zea mays
  misc_feature: Incyte ID No: 700551416H1
  unsure 9, 110, 250: a, t, c, g, or other
aatcatacngccagaaatattagatagacagaaaggaagaggagaatagcggcgaggacgaagtgggcccgcccaggaaatggcgtcgatgcagagctggcgcaaggccngacggcgccatcaaggacaccacaaccgttagcctcgccaacctcaactcggacttcaaggatctggatgtggcgatcgtgaaggcgactactcacgtggagtgcccacccaaggagcgacactgcgaaaggttgttgcngcgacatccatcgccaggcctagggcggatgt

SEQ ID NO: 1733 - DNA, 92 bp, Zea mays
  misc_feature: Incyte ID No: 700551417H1
  unsure 30-31, 53, 85: a, t, c, g, or other
tgcaggaaggccagtggtttggtgcattgnnacggagtatgccaagggcggancccagttaggcagttttctggcaaagaggcanaataggt

SEQ ID NO: 1734 - DNA, 274 bp, Zea mays
  misc_feature: Incyte ID No: 700551419H1
gcgcagtgtgcttggacggcagcccaccggtgtaccatttctctcccggctccggttctggcgccaataactgggtcgtccacatggagggaggagggtggtgcaggaatcctgatgagtgtgcggtccgcaagggcaacttcaggggctcctccaaattcatgaagccactctcgttttcagggatattaggcggcaaccaaaaatccaatcctgatttctacaactggaatagagtaaagatcagatactgtgatggttcatcatttactgg

SEQ ID NO: 1735 - DNA, 274 bp, Zea mays
  misc_feature: Incyte ID No: 700551420H1
atggatttagttttaagtgtgatgagagagctgaaaaacgaagagagttctactcaaagctcgaggagaagattcatgcacaggaactagagaaaagcaacttgcaggcaaaatcaaaggaaactgaagaagctgaactcaaaatgctgagaaagagtttaaatttcaaggcaacaccaatgcccagcttttataaggaaccacctccccccaaggttgagttgaagaagatacctacaacaagagctaggtcaccaaagcttggtcgctccaa

SEQ ID NO: 1736 - DNA, 274 bp, Zea mays
  misc_feature: Incyte ID No: 700551421H1
  unsure 30, 32, 35, 42-43, 226-228: a, t, c, g, or other
cattatggcttagagactatagtagcacancngangtaaganngtcggaaagttctggatatacaaaactttatgcagaaccctcagctgcaggagtttgaattccagaactttccgacttcttacctccgctgtgctgctcatcgtgttgcacaacattatggcttagagactatagtagcagatagtttagtagaaggctcagttagcaggattgttgcaagannnacagcagaaagcaggtatcctgcaatttttttatcagaagttccta

SEQ ID NO: 1737 - DNA, 273 bp, Zea mays
  misc_feature: Incyte ID No: 700551423H1
  unsure 185-186: a, t, c, g, or other
gtcaactcagcttcagaatccataccaaatgacgcagctcccccaacccagagcaaaatgaatgggtcgaccaagaaatcattagtcaacggtgttttggatcaaccaaatgccaactcagggctagaatcttcgggaaatgattatcctagctacactaactcgagcagtgctatgccacccgnnagtaccgagttaattgggtctgcagctgctgttatagatgttgattctgctgagaatggcccaggtacgaaaccagaacaaccggct

SEQ ID NO: 1738 - DNA, 103 bp, Zea mays
  misc_feature: Incyte ID No: 700551424H1
  unsure 97-98: a, t, c, g, or other
agcaacgttatcaccagctgtatacgctttttaatcgacaacatttgaataatatgtacataacattatgttgtgctctgttctctgtctgtttganntgctt

SEQ ID NO: 1739 - DNA, 270 bp, Zea mays
  misc_feature: Incyte ID No: 700551429H1
  unsure 119: a, t, c, g, or other
aggaaaatgtcgaacctatgaatgaggaatatggtgagcatatttcaggctatccaagagacaattccgactccagacccgtacagatgatgggtgatgggagcgacgataatgatgangatgctgaaggagatgagggtgaggaagatggagaggactatgaagctgaagatcctggtgatgaggatgatgacgttgagatggatggggatgatgatgtcgaggtggatgaggatgatgacattgagatggatgaggatgatgacattg

SEQ ID NO: 1740 - DNA, 276 bp, Zea mays
  misc_feature: Incyte ID No: 700551430H1
  unsure 157-158: a, t, c, g, or other
gggcactggcctcagttgaggacaagatactcagaaaaataagggacaaagaggcggaagtggagaccataaacaaaaggaactctgaactagaggaccagattaagcatttgggagtggaagttggtgcttggcagcatagggccaagtacaatgnnaagcatgatcaatgcactcaagtacaacttggaacaggtttgtgctcaccagagcaaggatttcaaggaaggctgcggcgatacgaggtagatgacacggcgtcctgtcgcgatggtg

SEQ ID NO: 1741 - DNA, 275 bp, Zea mays
  misc_feature: Incyte ID No: 700551431H1
atgccctcagattctgttacctctggtgaacaatcagaccaaaatggtccgaaagcttgtttggtgcaatgtggtttatgccatggaacatctggtgcttttagaaagactgtgaagggtcaatgggttcatgctttctgtgctgagtggctgttggagacaacattcagaagagggcaacataatccagtcgacggaatggagaggctcatcacaaggataaagatacatgctctatatgccaccgctgtgttggtgcatgcttgaagtgctgt

SEQ ID NO: 1742 - DNA, 282 bp, Zea mays
  misc_feature: Incyte ID No: 700551432H1
  unsure 56, 63, 212: a, t, c, g, or other
cgaattcccaggcaggcaggtcggcgaggagggcaggaagaccgaagaccgagccnctgcggnggctcgggacgggaacgggacaggaccccaaaatctcagatccttcctgcccgcccgcccgtgcccgtcgacgcgtcgttcttgccggccgcgcctcacctccgccctctcattcctccagggggatcggatacgccacaggctgcgcnatggtgctgtgggtcttcggctaggctccctcatctggaaccccggcttcgattcgacgacaaaatcctc

SEQ ID NO: 1743 - DNA, 271 bp, Zea mays
  misc_feature: Incyte ID No: 700551436H1
  unsure 25: a, t, c, g, or other
aacgaatctgtactagtatgcgaanggcaagtaggatggatgctatctggacagagcaaagaaaaatggaagctcttaagctatattatagggtcctcgaatctatgtgtagggcagagtcacagatcttgagtgggaacaatcttacatcacttttgtctaatgaacgtttccatcggtgtatgattgcatgttctgcggagttagttcttgcaactcacaagactgtcactatgatgttcccagctgtgttggagaagactggcataca

SEQ ID NO: 1744 - DNA, 272 bp, Zea mays
  misc_feature: Incyte ID No: 700551437H1
  unsure 120: a, t, c, g, or other
gactacggaggtgacaagtacgtgaacggcgagataatcccctgcacgtacccgacgtaccagccgaaggagcggaggacgtccaagtacgagagcaggcggtacgagaggcggagagangggccaccggcggccagcaggaaaccgaggcagcaggcaccagctcagactcagaccgagtcggcgtcttcgtgacgagctctgcaggcattttgtccacgtacctacctacctagaagtagaacaagagaggaggaacgcctaaattctgt

SEQ ID NO: 1745 - DNA, 273 bp, Zea mays
  misc_feature: Incyte ID No: 700551439H1
aaaagatcaagcaagagtctgaacagtttaggtcttggaaggctgcccgtgaaaaggaagtacttcagctcaagaaggaagggagacgaaatgaatatgagatgcacaagctcttggccttaaatcagaggcagaagatggtcttacagaggaaaactgaggaagcagctgctgctacaaaaagattgaaggagttgctggaagcaaagaagtcatcacgggaaacatatggcagtgcaaatggttcggggatgcaggccttaatacgagcta

SEQ ID NO: 1746 - DNA, 268 bp, Zea mays
  misc_feature: Incyte ID No: 700551442H1
tcggtgatgaccttgtcactaatcccacttcagtttgtcagacaatgactggtcggttcaagctcttcgccatcggctgcttccgagctgtggcttcttcctgctgggaaaaatgcctctccgccatcgaccgcctctgaggtgcggcttcttcctggcgagaaaaatgcctcccaatccctcatggcttcatttcgttacttatatcttgctaatgtgtttcattgtgctggtaatgagcaattctcaaggggatttcgaatggact

SEQ ID NO: 1747 - DNA, 270 bp, Zea mays
  misc_feature: Incyte ID No: 700551443H1
aacgacagaaggttgatgatgatgtccaagagggtgctcttcctccgtatctgctggatcgtgatcagacacagcgcgctaaggttctcagcaacacaataaagcaaaagaggaaggaaaaggctggcaaatgggatgttcctctgccaaaggtcaggcctgtagctgaagaagaaatgttcaaggttctacgaactggcaagcgaaaaaccaagcagtggaagagaatggttactaaagccacctttgttggagctggatttacaagga

SEQ ID NO: 1748 - DNA, 273 bp, Zea mays
  misc_feature: Incyte ID No: 700551447H1
  unsure 154: a, t, c, g, or other
aaggggacacctagtaaggacctggagagcaaaaaagatgctgtgaggcaaccctttggtgttaaggatatgaacaatacaagagcatgtgatgcagaagggagctccagcagcatgttttggttcttgaagccctgcactttccttgtggagnagcgtcataacactacaattttttaacgaacaacacttgatatagttagaatccattacttcattcattccaaatattctctgttcctatttgatcgattcatttcatgggtactctat

SEQ ID NO: 1749 - DNA, 278 bp, Zea mays
  misc_feature: Incyte ID No: 700551448H1
tagtctagaagaaaagctagttctctcctcctcagggcagtagaccagccttgttctctttcggaattcgggaaaaaaaagaagagcccgtcttcatagcgagccagctgcatcccaagtgtaaaaaaaaaagagaggaaacagctgcgaggcttaccctttttttctccccagttttgttaccctgatggttccttcctaattctcccttttctgcacatgtttttaggggaattaatgacatttccttttgttgaataataataagaatgggtggg

SEQ ID NO: 1750 - DNA, 272 bp, Zea mays
  misc_feature: Incyte ID No: 700551450H1
gtaggcaggaagaaagaataaggcgagccgagagccattcgcatggaggcggcgatggatctgatgcggcggatgccccacggagcgcggagacggcgctcaacgcgctgctctccctcctccccgaccactccctcgacctcctctcccaggtcgacctcccgctccaggtttgcatggataaggagagcctgaaggaatacattctatgcgaatataaccgtgatgctgactcctaccgatctccttggtcaaacaaatatgacccccct

SEQ ID NO: 1751 - DNA, 175 bp, Zea mays
  misc_feature: Incyte ID No: 700551451H1
  unsure 28, 48, 57, 71: a, t, c, g, or other
aaataaagatcagccctgggataatgcnattgatttatgcaagaacangcagctcgnttcctctgaagatncctttccattgatgatggtacagtcttgaagtccttcagccacctcctccatcgtaacaagaaggtagattttattgagcagttcaatgaaaagcttctggtca

SEQ ID NO: 1752 - DNA, 270 bp, Zea mays
  misc_feature: Incyte ID No: 700551452H1
ctgagtggcaggttgtggtatgcgggatcctgctgatcgcgatggcaatcggtaactttgcaaacacagtggacaccctggtgaccaagtcccggttcaaggcgaagatgaagaaatccaagggcagacgggacctcgacacatgcccctcgccaacaggttcatcatcgccgatagattcagcgaccaccaaagcatgaacaaggccaagaggaaaaggtgcccgtgtttaacccgggtgtgttaccactgtaaagcgttttagtgttt

SEQ ID NO: 1753 - DNA, 168 bp, Zea mays
  misc_feature: Incyte ID No: 700551453H1
  unsure 14, 25, 39-40, 50, 63, 66, 78, 80, 96, 114, 121, 136-137, 139, 154-155,: a, t, c, g, or other
ggcgggcaggggcncgcgcgagcangggagagggagggnncgcgcggggngaagaagaggagnganagggagagaganantgagaaggggactggngctcacctcggggtccanaatccgntgatcgccgtctccnnancctagggcaccacgnngatagagngntnt

SEQ ID NO: 1754 - DNA, 176 bp, Zea mays
  misc_feature: Incyte ID No: 700551454H1
  unsure 66, 80, 83, 128, 131, 145, 163: a, t, c, g, or other
cgcacacctcaccaggctgctgaatctgaagctcaccaaggtagagttcgacaggctctgcttcgncaccatcggcaagnggnaacatcgcgctgcacaacgcgctcattagggggatcataggcaangcnctgtcgggagtgcntccgcccagccggcaggnggtgacggggcag

SEQ ID NO: 1755 - DNA, 270 bp, Zea mays
  misc_feature: Incyte ID No: 700551458H1
ggtaggcaggaagaaagaataaggcgagccgagagccattcgcatggaggcggcgatggatctgatgcggcggatgccgccaacggagcgcggagacggcgctcaacgcgctgctctccctcctccccgaccactccctcgacctcctctcccaggtcgacctcccgctccaggtttgcatggataaggagagcctgaaggaatacattctatgcgaatataaccgtgatgctgactcctaccgatctccttggtcaaacaaatatgacc

SEQ ID NO: 1756 - DNA, 266 bp, Zea mays
  misc_feature: Incyte ID No: 700551460H1
  unsure 113, 233-234, 237, 239-240, 243-244, 249-250, 253, 257: a, t, c, g, or other
ttgatggctgtaatgcttgagtcaatctttttacttgaaggtacagcggtgttatggaagttatgattatcaattgaatatgttttagcataaagatgagtttcaggatagtngccaatatcaaatgtcgaagttgatggctgtaatgcttgagtcaatcttttacttgaaggtacagcggtgttatggaagttatgattatgtagggtggattaaccttttaccgaaaaaannacngnnatnnccttnntcncgangccgatggg

SEQ ID NO: 1757 - DNA, 273 bp, Zea mays
  misc_feature: Incyte ID No: 700551463H1
  unsure 5, 80: a, t, c, g, or other
ggganaattggggattggaagagcgctctgagggaggctgatgccgccattgctgctggcgccgactcctctcagttgcntcttgccttgaggtcagaagcacttctccgccttcacaagctggaggaggccgagtcgactcttgcaagcttgctgaaactggacagtgcattgccctcatcattgacagcagcaaaactctcggggatgcttgctgagtcatacatacatattgttcaagcgcagttgacatggcattgggagtttgatact

SEQ ID NO: 1758 - DNA, 268 bp, Zea mays
  misc_feature: Incyte ID No: 700551466H1
  unsure 11, 21, 33, 39, 150-176, 260-261, 263-266: a, t, c, g, or other
tggactggacntggacgggangaacatcactgntgatanagctcagccacaaggacctggtagagaccgtaatggtgaccgtgattatgaccgcgagcgtggatctcgttatgaacgtggtcgtgactatggtggtgggcgtgcaccgcnnnnnnnnnnnnnnnnnnnnnnnnnnnactgcttcaagtgtgggaaacctggtcattttgctagagagtgcccatctggggatggtgggagaggggacagatatggtgggnnannnnac

SEQ ID NO: 1759 - DNA, 87 bp, Zea mays
  misc_feature: Incyte ID No: 700551467H1
  unsure 49-50, 84, 86: a, t, c, g, or other
agaaggatgatactggatcatctcctactggcaaaaggacgtccattannccccaagttcatgccccacttggatatggaactngng

SEQ ID NO: 1760 - DNA, 270 bp, Zea mays
  misc_feature: Incyte ID No: 700551468H1
  unsure 268: a, t, c, g, or other
acgctccgtcgtgcccaagatcagcaagatggaccggacgtcgatcctgggcgacacgatcgactacatgaaggagctgctggagaggatcaagctgctgcaggaagagatcgggcagcagcaggaggaggcgccaggcatgctcagcgtcttccgggagctcaaccccaacgagatggtggccaggaacacccccaagttcgacgtggagcggaaggagggcggcgacacccgggtggagatctactgcgccgccaagccggggctnct

SEQ ID NO: 1761 - DNA, 260 bp, Zea mays
  misc_feature: Incyte ID No: 700551469H1
  unsure 30: a, t, c, g, or other
aagtttgccggttgtggagaagcttcttcnaagtagatcattgtccatggcgtatcctaggcatttggcacagagaaggataaaactgctgccgagaaaatataatccaatatctgatggcaaggttccattctttgctgatgatgaagaatctccagcaacaccaaaggcagacgctttttttgtccctagagagaacccaaggaatctggtaatcgtccaattgagcagtggccttcgcggagagaaactgaccgaca

SEQ ID NO: 1762 - DNA, 104 bp, Zea mays
  misc_feature: Incyte ID No: 700551470H1
atttgcatcgttttggtatttcgtggctccatgtgtgagcatgctgtgtcctataacctggtttatgagatgagttgttaaacttgcttggcttgattggtttt

SEQ ID NO: 1763 - DNA, 266 bp, Zea mays
  misc_feature: Incyte ID No: 700551474H1
  unsure 152: a, t, c, g, or other
agacaccccaatgcagtgatgatatggaacagtgccatatctgcctaaccgaatatgaggacggagaccagataagaacccttccgtgcaagcacgagttccacctgcaatgcgttgacaagtggctgaaagaaatacacagggtgtgcccncctgtgccgtggagacgtctgcgaagtcgcctcgtgaagaccttggcgctgccatccttccgttgcggcaccggtggatagggcaccaccgccaggcgccactgttccgtggtt

SEQ ID NO: 1764 - DNA, 251 bp, Zea mays
  misc_feature: Incyte ID No: 700551475H1
  unsure 65: a, t, c, g, or other
ggaggcatttggctttgcgccttcctggttattatggcttaggtacagcacctttatgttgttgnatcctactggcatctctagtgaagttggtctgatctacattgccttgccttacatgaaggcatcggagaaatactgtattaggatgcccaacaaatggaacttctcatacgattacttctattcatctgtcctgccctcctgatctatgttccaggaagcccacacatgtaccgttacatgctctc

SEQ ID NO: 1765 - DNA, 171 bp, Zea mays
  misc_feature: Incyte ID No: 700551476H1
ggtctcttagcctacagtgggctgttgtcagatgtcaaaaatgccctcttagaagtttagaacatttctttggtgctcactcgcgtttcatgttcaacggtgctacatgactggtgctggatgcatgtaaactctgcaaccctatcatgttatggcagctagatgctacta

SEQ ID NO: 1766 - DNA, 271 bp, Zea mays
  misc_feature: Incyte ID No: 700551482H1
gaaaagtgtacaaaggaaggcttgctgatggctcattggtagcagtgaaaagactaaaagaggagcgtacacctggtggtgagcttcagttccaaacagaggttgagatgattagcatggcggtgcacaagaaccttctccgacttcgtggtttctgcatgacacctactgaaaggttgttagtctacccatacatggctaacgggagtgtggcatcacgtttacgagagcggcagccatctgagccacctcttagctgggaaccaagaag

SEQ ID NO: 1767 - DNA, 266 bp, Zea mays
  misc_feature: Incyte ID No: 700551484H1
  unsure 3, 117, 213: a, t, c, g, or other
aancaggatggggaaggggacagtgggggcggcatgggagactacttaaagcttgcagaaggtttcttgaagaagcgctgattaatcttccatatcatgattcaggaaggacttgtncggttagtcacttgtcctgtttattgtctccaagtagtgacattttcgaggtttccatcataggatgtaatacaagtgcattgctatgttgtctgngtgttgtgacatgaatgcttaatgtgctgctgggataataaaagctggatgct

SEQ ID NO: 1768 - DNA, 268 bp, Zea mays
  misc_feature: Incyte ID No: 700551485H1
attggcaaattccttacgcttggcaatcgaagaagaacctatgaagtggagtggtttaatgttactggatggtttgtagtggacttcacactggaggaacttaaaacacttagagtgaagcagagatactcgtttagagatcaacaatacaatggtatgttttcaatcatcacgtttgaagaattcatttcaattgccctagatgcagacagaactgtcggcatatatcccgagattaaagatccagtttttatcaacaagcatgtca

SEQ ID NO: 1769 - DNA, 268 bp, Zea mays
  misc_feature: Incyte ID No: 700551486H1
aatgttccagtgaaacgcctaggcctcattttaaggaacctgttgtggacagctctgggttaacatcagcagcacctgaaagtttaacagctaagcaacatgtccactcaccagatgcctttataccaccaaagcctggtgctccaactggggaattaggtgatgtaaaatcagattttaaaggtgaagaaattattcaaaaagaacaatattgtgaaagcgaacctattgttgctacaagagagaatttgctaattgatctttcctg

SEQ ID NO: 1770 - DNA, 268 bp, Zea mays
  misc_feature: Incyte ID No: 700551488H1
  unsure 249: a, t, c, g, or other
ctacaccggcgatcggcggcgaacgatggggtgggcgacgcggttcctggcggcggtgtgcttctttgctgcgggcgtcctcttcgtcccagaggctatcggttccccatccggcgcaggagccgtcaccgccgccaagctggcccacgtcctctcctttgccacctcctggggcgccgccctctgggccaccttcatcggcggcatcataatgttcaagaacctgccgaggcacatgttcggcaattncagagcaagatgttcccgg

SEQ ID NO: 1771 - DNA, 265 bp, Zea mays
  misc_feature: Incyte ID No: 700551489H1
cagaatatgacatgatccagaactacaaggttcttcaggatgtgttcaacaagctgcggataggcaagaatattgaggtcaacaagcttgttaaaggacggccattggacaacttggagttccttcagtggttgaaaagatattgtgattctgtgaatggtggaattatgaacgaaaattacaaccctgtagaaaggaggtcaaagggatgcaaagaacgtgtctcaaagggttccaataagccatctaaatcattgcaagccaa

SEQ ID NO: 1772 - DNA, 267 bp, Zea mays
  misc_feature: Incyte ID No: 700551490H1
  unsure 118: a, t, c, g, or other
ggccttgagccctctgagttcgaggactctgtcgcccaggctttcttcgacctggagaacggtaaccaggagctcaagagcgacctcaaggacctttacatcaacggtgctatccagntggatgttgccgggagcaggaaggctgttgtgatccacgtcccataccgcttgcgcaaggccttcaggaagatccatgtcaggatcgtcagggagctggagaagaaattcagcggcaaggatgtggtaattgttgccacaaggaggatc

SEQ ID NO: 1773 - DNA, 268 bp, Zea mays
  misc_feature: Incyte ID No: 700551492H1
tcccgtccgacgtcctccaccaaaccctccctgaatccgaggccgcggctctcatagcagcagcagccgccgattcggccgcatccgatccttccccgtcaatgcacaagtctcttgacgagggaatcgccaaagctgcggacctgctccggtgtgcggacggcctctggttgtgattgggaagggtgcggcgtatgcgcgcgcggaggaagcgattcggaagctggtggacaccacgggcatccccttcctcccgacgccgatgggg

SEQ ID NO: 1774 - DNA, 285 bp, Zea mays
  misc_feature: Incyte ID No: 700551502H1
gactagttctaggatcgaacgcggccgcggcggcgactccccgatctccagatccctgctgcgagcgaagggttccattcgagcagagatggcggcggcatgggaggtgctggctgtgttgctcgtcgcggcgcaggtggcgtcagggcgcaggtcacggcgccagcgttcctgtgggcgcccaaaaactacggatcagctctgatgatgctaaggaggtagtccattaccaaacaatctcaccaaagagcttagctaaatctgttctcgaggaaggtggctggt

SEQ ID NO: 1775 - DNA, 283 bp, Zea mays
  misc_feature: Incyte ID No: 700551503H1
  unsure 226-229, 261: a, t, c, g, or other
gtatggacattcccacagggcaccggaacttcagggggaagctgtgtatggtttgaccgaacttaaacgagatgacataagaaatgcacgcctggtagcaaatccagggtgttatcccacatctattcaacttccgctcgttcctttggtaaaggcaaaactgatcaagctaaccaacattattattgatgcaaaactggagtcagtggtgcaggacgtggggctnnnntagcaaatctttacactgaaatcgctgagggnatccatgcttatgggataacaa

SEQ ID NO: 1776 - DNA, 282 bp, Zea mays
  misc_feature: Incyte ID No: 700551506H1
  unsure 49, 56, 83, 255, 263-264: a, t, c, g, or other
caagaatgtgttccatgcgctctactgcataatggagaaggaaggggtnggcggcntttcacaaggggctcggaccgagctgncatcaagttgatgcctgcagcaggcatctacgttcatgtgctacgaggcctgtaagaagatcctggtcgaagacaatgaggatagtgagtgaagctgaagcatgtatgcccctaggaggggtatgactgatgtgccaggctagaagaggtttgggttgggttggggagtatnacctagtnntatcaactgatgaaaatg

SEQ ID NO: 1777 - DNA, 278 bp, Zea mays
  misc_feature: Incyte ID No: 700551508H1
  unsure 7, 9, 13, 23, 28, 30, 39, 42, 52-53, 55, 57, 102, 115, 136, 139, 162, 180,: a, t, c, g, or other
tttctgnanatgnccgcaaccancttgngnagatggaantcnccagcacgtnnanantgttttgtccaattgctggttgtggtgctcatctagattgcctgnaggagtttgaggnccactatgtcactcgacatantgnttcatgctctgtatgctcgcgantttatccaacttcaaggntgctgagcatccagtttctgnnacgcacgactncgtntntccaagcaanagttgcccgtggttttccatgtacgagtgtttggtggacngctgtggna

SEQ ID NO: 1778 - DNA, 148 bp, Zea mays
  misc_feature: Incyte ID No: 700551509H1
  unsure 100, 104, 131: a, t, c, g, or other
taggcgtgaagccaatggaggtggtatttgacagtggtagcacgcctagtgaacgtctatcgaagtacagtgttcctgagccaggtgagtagtagttcgntaancgttcactaggcgtgaagccaatggangtggtatttgacagtgg

SEQ ID NO: 1779 - DNA, 276 bp, Zea mays
  misc_feature: Incyte ID No: 700551510H1
agctgtattcgatggagtaaacccttccttgagctctgttaaaagtttgtttctgaatgagttaagttgctgggatagggctggggctaagcagttacctagcattgatcttcctgctgttttagtagggtctaggctgggttccaatctggtctagtgttttggcttgccctctgggcattgtactttggtctcttgaacctttttcctctcttaaaataatggcgtgcatttctcctgcccgttcaagagaaaaaagtcaatgtccatctgaat

SEQ ID NO: 1780 - DNA, 277 bp, Zea mays
  misc_feature: Incyte ID No: 700551511H1
  unsure 230, 256: a, t, c, g, or other
ctaagaattttaaagcagtgtgcagtatttcctatcagtttcgtatgcgaacaatgaaaatgccatttttccttgtgacctctgtatatggaacaatactgtctatgcactgcatagcatttttacagatgcgcaaacatggcaatgtctgtaaacagcatttcaatgtttgcgcatctgtaaaaatgctatgcgtgcatagacagtattgctccatatacagatggcgncaaacattgaaatgctgtttacagantttgccattccaaattctacc

SEQ ID NO: 1781 - DNA, 281 bp, Zea mays
  misc_feature: Incyte ID No: 700551513H1
  unsure 63, 74, 76, 79, 81, 187, 189: a, t, c, g, or other
cttatcatccccatccgcacctctctccatctccctgctcctcccgcctccttcttgatccanccaagccaggnanccncnatgttggattcggaggagcaccacttcgaatcgaaggccgacgccggagcgtccaagacctacccgcagcaggctggcaccgtccgtaagaacggattcatcggcntnaagaacccccctgcaagttgtggaggtttctacctcaaagactggtaagcatggccatgccaaatgccactttgttgccatagacatattca

SEQ ID NO: 1782 - DNA, 101 bp, Zea mays
  misc_feature: Incyte ID No: 700551515H1
  unsure 76, 90: a, t, c, g, or other
gggagatcaatggggcttcgcaagcatcacagtacggacgcaaagaaaactggcatggcaagacgaacgcagcggnaccatgattgacgntactgaaataa

SEQ ID NO: 1783 - DNA, 273 bp, Zea mays
  misc_feature: Incyte ID No: 700551516H1
  unsure 78, 224, 264: a, t, c, g, or other
aatctgctcccgagcccgtacggcaaggcatttgtttacaagaaggctcttgagctacgccacggctggaaaggctgntgagtacatcatcccatctttcaagaacattgacagttttgtcagtgagtggggaattgacaatttggagaagagggagctataccttgctatcaccaccatcctcaagaccacaagggcatggctaaggagtactttaactttcngcaataagttaccttgccacattcaaaggtcagatgatgnatcagctac

SEQ ID NO: 1784 - DNA, 283 bp, Zea mays
  misc_feature: Incyte ID No: 700551517H1
  unsure 195: a, t, c, g, or other
aataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagncatccgccctcaggatgctggatgggatgccaaggagtttgataatgagactccatacactattatgtttggtccagataaatgtggg

SEQ ID NO: 1785 - DNA, 277 bp, Zea mays
  misc_feature: Incyte ID No: 700551520H1
  unsure 80, 255: a, t, c, g, or other
gatgaattgatcgagaaggctgatggcttatctggagtctttccagaacacaggtatgagatcgtgaaacgcttgcaagnaagaaaacatatatgtggcatgacttggatggtgtaaatgatgccccaactttgaagaaggctgatattgagttgtgttgacgagtcgagcaattttccaaaagatgaagaatacacacttggttttatgctctgctctgatatggaagtttgactcccaccatttatggtccanatcatgccatcctcaatgacgc

SEQ ID NO: 1786 - DNA, 280 bp, Zea mays
  misc_feature: Incyte ID No: 700551521H1
  unsure 227: a, t, c, g, or other
ccagccaccgccgctagaagaagagctcggcgattcccaggtcccgcgagaatatgccgaagcagataccatgagattaaggacttcctcctcaccgcgaggaggaaggatgcccgctcagtgaagatcaagaggagtaaggatgttgtcaagttcaaggtgcgctgctccaagtacttgtacacgctctggtcttcgatgctgagaaggcaaacaagttgaagcantctacttcccccaggtttgaccgtcgaggaggtctgattggatactggcaagc

SEQ ID NO: 1787 - DNA, 272 bp, Zea mays
  misc_feature: Incyte ID No: 700551522H1
gtaagaaattggcagcaagttcagcaggggccagactaataaatcagcttgatagcatccttgcagcggtgccttggactttggcggttagaagaggtttataattttatatgatgaaattatgtgcatcttcagttgtttttgcctcactgctctgtaaggacatataaaattggtatttgtactttctaggttctcctggaatggtagagttttacagggaacctccatcatcagttgctgacatagctcgaactcgacgtttctcttcg

SEQ ID NO: 1788 - DNA, 252 bp, Zea mays
  misc_feature: Incyte ID No: 700551523H1
  unsure 168-193: a, t, c, g, or other
aaaataataattttatacatatgtttactgctatagtgtaaaccttttagaccgcctaggcgaccgtctaaatagagggcgactgatcctttaacgtttaggataacagtgtgaatcttctcctgctattgaacactaatcttggtagctattgaactctgctttctnnnnnnnnnnnnnnnnnnnnnnnnnnttttagtacaatattgcatcttcttcttctgtcgactgttgggtactctgttcactcgg

SEQ ID NO: 1789 - DNA, 204 bp, Zea mays
  misc_feature: Incyte ID No: 700551524H1
  unsure 36, 44, 68, 88, 105, 169: a, t, c, g, or other
catttgtaacgtgagcatggaactgtcgctccgccngtgtcttntatatagaattattattagatgancacaaagacggagcgatggntccatttgtaacgtgancatggaactgtcgctgatgacgagctgttcacttcccatgtgtagatgtagaaggtggattgangcatccattacagcactgctgcctggtattgtcat

SEQ ID NO: 1790 - DNA, 204 bp, Zea mays
  misc_feature: Incyte ID No: 700551526H1
gtcttcgtctcccgctcccccgggtccattcgcacccaacgcagctacagacggtctccatggcgaagaaaggggcgaagagaaagcagcagttgccgccggctcccacggcgaagaacgggagcaaggctgtgctcccactgaaggccgcgaagagagcgcccaagaagcagaaggttctggagtcctccgcgattctgatac

SEQ ID NO: 1791 - DNA, 277 bp, Zea mays
  misc_feature: Incyte ID No: 700551527H1
  unsure 191: a, t, c, g, or other
aaagcatggtgctccccaagtctagcagggtgtgttgtatggcttccacgctccagctgttgttttccattgccatcacagctttggcctttttcctccacccatgcgcatcgactgatgagttccaccgtgaactctacggttggtccaatggcatcgctacatggtatggcgcagtgatggcgctggantgacggtggtgcgtgtggataccagaatgctgtggaccagccacctttctcatccatgattgccgctggctgctcttccatctacg

SEQ ID NO: 1792 - DNA, 282 bp, Zea mays
  misc_feature: Incyte ID No: 700551528H1
  unsure 239: a, t, c, g, or other
aacggatagagctgactgcttgcatatgcgctagtacaaatagagcgccgcagtgaatccggcccaattcactttcccatcgcgtgaagaggttgccgttaccgaccatgtcgcagcagccggcgccggcgccgccatatcggccgtataggcaggtgagggaggcgacgccccatagccgggcgatctcctacgtgcggttctccccctgcgggcgcctcctcgcgacagcctccctncgacggaacggttagcgctgctctccccgtcctcactggccgt

SEQ ID NO: 1793 - DNA, 273 bp, Zea mays
  misc_feature: Incyte ID No: 700551529H1
gaaatggtcagtgccatgcgtgatgataggagcttgggttgttctgaacttagcagatggctaacaatggcacaaataatggcctccagctttggcgagaagagtctttctttggagcactggcagatggtgaaggagcttgagaggcttagaaagcagaggatgcaatgagaatgactcatcattagctgtgtttttgcactctaattgtttatgttggtatgctgttatgtgtatagtactagacgtttgaatcaagacaggatctaaggc

SEQ ID NO: 1794 - DNA, 282 bp, Zea mays
  misc_feature: Incyte ID No: 700551534H1
  unsure 69, 164, 265: a, t, c, g, or other
aacaaagtcctattttatccagcaagacagcagtattcagtttctatgaatggatgccaagatactgtncctctaatcactgcaagaactggtctatatcttgaaggatcagtgttacctgcaacttctgatgttgacatcaagattctagcagctggaaagancaactatgcccatctgaacaaaggggatgagcaacagaggcaaagacagattctgaaggatcattttttgcaggtcctttgtatgatgacatagtatatanagttgaagcttcagagg

SEQ ID NO: 1795 - DNA, 279 bp, Zea mays
  misc_feature: Incyte ID No: 700551535H1
  unsure 224-225: a, t, c, g, or other
gtctcaactggagcagcagcccctgggtcagaacaaggctctggtggctccacactgcacacctgttcttgttgattctggggaagggaggagcaaaagattcattagccggttcacgtccatcaaccctcggaagattctcctcttgttcgcaacgctgtcgagcgtggggacaacgatactgatctacttacgctggcgatcaacagcaaagcggaggcctnntcgcctggagacacccaccagccaccaccaccatttgcgtcggcgggcgggcgg

SEQ ID NO: 1796 - DNA, 278 bp, Zea mays
  misc_feature: Incyte ID No: 700551536H1
  unsure 80: a, t, c, g, or other
gttggagcaggtctgggtctggccgtgtgagttatttcccagccaggcatctgagagctttggtcttgacctcgacaganatcgccatggacgcatcggcggaggtggaccacctcgccgccgagaggtcggccgcgcgcttcgatgtcgaggcgatgaaggttgcatgggctggctcgcgacacgccgtcaagtcggcgaccgcatggcccgactccgtcgcgtccgaccctgtcttccgcaagataacaggaccatgctctccaggaaggattgtt

SEQ ID NO: 1797 - DNA, 274 bp, Zea mays
  misc_feature: Incyte ID No: 700551538H1
atttcctcctaaaatccccaagcctccaatccactgaactaaaccctaggcgacatggcgggtagagactactgccggttgccggtgcgcccgcgcgacttctgaggccccgcccccgtcccggcgtcgcggaactggctccactgtcgcccccatcactgggactgggagagtgggagttcagagcccagacgctggggcgccgggtcaccggaaggccgggaaggaaggtgtggccgcaagacgcaggcaggaggcatcgactcgactcacc

SEQ ID NO: 1798 - DNA, 277 bp, Zea mays
  misc_feature: Incyte ID No: 700551539H1
gggatttttggaaacatgcaaaatctctatgaaactgttaagaaggcccaaatggttgtccaagttgaggctgtccgggtgcagaaggagcttgcagcgttacactttctggaaaccagcaacctattagagttgaaatcacagaagctgcaatggagttgggtgctgaaaaactttcggagctggtcaatatgcttacaaggatgcgcatcaacggagcgtccaggccatgaaagagaggatgtctgacttggcacagagcttaggaatgcctgcg

SEQ ID NO: 1799 - DNA, 276 bp, Zea mays
  misc_feature: Incyte ID No: 700551541H1
gaagagctgcggtgtgaggagatacaacgatggcgcaacatcaacaagcgatggaggatccatgaaccatcccacctccttcatctcgaccaccaggtctaccatggtgtggatttgactctagctatagtgggtctaatggtagtggctccagcgatgactggtctcgacctctacttggcgccattcctccacgaccatgacaatagtggagctcaagcagaggcattgtgcttggctcctcggcggcggcgacgcttccaaatctgagcgggt

SEQ ID NO: 1800 - DNA, 276 bp, Zea mays
  misc_feature: Incyte ID No: 700551542H1
gaaaaatgatgttagatgggtcaagtaaatgactattcccaaaacaccaatcattcctagtgcgccaaatagcccagaataaagcaccacaaccaaataacaccaactaagccatcgtgtcttttggtttacaaaaccaattgtcatacaaatctttgatattttttggaatagatctcaaattcagggcacttgaataactctccacatgtattgagcaatggggcaatagaaaaacaagtgatcaattgttggggtcgtgcttcggtacgccga

SEQ ID NO: 1801 - DNA, 275 bp, Zea mays
  misc_feature: Incyte ID No: 700551543H1
  unsure 262: a, t, c, g, or other
aagaaatcaaaatagcatcatcaagactcgggaagacaagtatcgttcaaaaattaaagcactcgagacattagtaaatggcacaaatgaagaaaatgagatgacagtagatcgacttgagctagttgaggtagaaaaatcaaaacttgatgagaaaagaaaactaggtgaacaagacatggttcggctgtgcaagaaaaggagaatgcagaaaatactattgcttcccttcagcaagaattacaggtctgagtaggatgcngaacagtaccacg

SEQ ID NO: 1802 - DNA, 275 bp, Zea mays
  misc_feature: Incyte ID No: 700551547H1
  unsure 126: a, t, c, g, or other
agcacatcaaaccctagctccgcccagcccccaaccatgtcggcgatgatgcaaccgcagatcatcctgctcaaggagggcacggacacgtcgcaggggcgcgctcaggtggtgagcaatatcaangcgtgcacggcggtgggcgacaccgtgcggaccacgctggggcctcgggggatggacaagctcaccacgacgacaagggcggagtcaccatctccaacgacggcgccaccatcatgcgcctcctcgactcgtgcaccccgccgccaaaa

SEQ ID NO: 1803 - DNA, 278 bp, Zea mays
  misc_feature: Incyte ID No: 700551550H1
ggagtcggagggaaccgaaaactcagggtctcgaatttcctaggagcggaggcgatggctgggaagggaggaaaaggattgctacgccgcgaagacgacggcggccaagtcggcggagaaggacaaggggaagaaggcccccatctcacggtcctcccgcgcgggcctccagtttcctgttggacgaatccacgtcagctgaagcaaaggactcaggcaaatggccgcgttggtgccatgcagccgtctactctgccgccatcctggagtattgactg

SEQ ID NO: 1804 - DNA, 251 bp, Zea mays
  misc_feature: Incyte ID No: 700551551H1
  unsure 13, 37: a, t, c, g, or other
gagttctctttgnaggaaaacagggttggaccagtangctgttgcgaaatttgctggaagctttgaaatggttccaagaaccctggcagaaaatgccggacttagcgcaatggatgtaatatcctctctttatgctgagcatgctagtggcaatgtgaaagttggcatgacctggaggaaggtgcctgcaagacatcacgaccttgaaaatatgggaccttatgtcacaaagttcttgccctaaaatatct

SEQ ID NO: 1805 - DNA, 274 bp, Zea mays
  misc_feature: Incyte ID No: 700551553H1
gaacaaagtggaaccaagctacccccacagagcacggcgaggaagctggggtgaagcagcatgatgctacagttcctgatgacaagaaatggcctgggtggcctggagagagtgtgttccgtatactggttcctaccacaaaggtgggtgccgtcattgggcgcaaaggggatttcatcaagaaaatgttgaggaatcaagagcccgcatcaaggttcttgagggaccaccagctgtgccagaaagagctgtaatgtttcagcaaaggatgaac

SEQ ID NO: 1806 - DNA, 107 bp, Zea mays
  misc_feature: Incyte ID No: 700551554H1
  unsure 5, 13, 27, 43, 45-46, 79: a, t, c, g, or other
gctgncagagggnggcatccggctgtncctttacatttgtgtntnnccaatcacctatataaccaacccccatgaatantgaaacagaaatgaaagaacagaccgat

SEQ ID NO: 1807 - DNA, 156 bp, Zea mays
  misc_feature: Incyte ID No: 700551555H1
  unsure 11, 22, 24, 27, 38, 44, 47, 62, 87, 98, 104-105, 130: a, t, c, g, or other
ttagctgcttncaaaggagacnancantgtgtcaagcntcttcncanactacggagctgatncaaatgctagaggtacgcataaaantagaactgtgntacatnnttttacagattgtaccagaactggngacgttcttgaccaccaagaatacta

SEQ ID NO: 1808 - DNA, 274 bp, Zea mays
  misc_feature: Incyte ID No: 700551556H1
ggtgatgcttatcacaaaatttgtttgttgttctggattatcaaatgtggaacttccaaagttactgataggaagtttgcattttcttatgtcactcaccatttaccattttatgattttatatgcttcataacatgctgatagaagcttgttgaagtgcagagaagcaaaggatacactcaagctcccaagaaacgtcttggaagcaagaattcaaaagtgcaaattctaacactatatgtgctagagactctaagcaaaaattgtggggata

SEQ ID NO: 1809 - DNA, 272 bp, Zea mays
  misc_feature: Incyte ID No: 700551558H1
caaagggtcagcagttactaactgaatgggcacgcccattcttggaggagtatgcaattgacgagctcatagacccacgactcggagagcgctactctgaaaatgaggtgtactgcatgctgcacgcggcaaacttgtgcataagacgcgacccacattcaaggcctcgcatgtcccatgttcttcgattcttgagggtgacatggtcgtggaatctggtggttctgttactggcagtagtgatctgggagcagaagctggaggatgctgaa

SEQ ID NO: 1810 - DNA, 276 bp, Zea mays
  misc_feature: Incyte ID No: 700551559H1
aagattataaggccccaacaggtatacaccggcttctggcttaggcactatacccccgtacagagaacgagtgctatcaagccagagtgaggaacttggtcaggttgccacctcaaacgcaactaggcgccgccgtgctggttctgccctgtagaagctgcagcgtataaacgcaccggcatactcaataacatcgaccacttttgtgcttgaaaaggccacaaatgctttttagcttggttggagttgtaggccttttgttgtcgagtatatagg

SEQ ID NO: 1811 - DNA, 127 bp, Zea mays
  misc_feature: Incyte ID No: 700551560H1
ctatgacaaatcgtttgtcgcttgattgtgctttgtttgtaaacttgcttgtacgtgactagcacttgttatcgcatttttgattggttctgtaaacaatatccgataaacaagattagtatcctgc

SEQ ID NO: 1812 - DNA, 272 bp, Zea mays
  misc_feature: Incyte ID No: 700551562H1
agcgcctcgagatcacgttctctgacgcgcctgtctttgaggacccttgtggtcgtggcctgcgcgccctactcccgtgagcagatcgactcgtttctggatctcgcacggtgcaccatagtgtcacagctctccaacgagagcttcgactcatatgttctgtccgagtccagcctctttgtgtatcccacaaggttgttctgaagacctgtgggacgacgaagctgctgctcgccattcctcgcatccttgagcttgctgcaggctgtcat

SEQ ID NO: 1813 - DNA, 269 bp, Zea mays
  misc_feature: Incyte ID No: 700551563H1
gtgtcctcacaactgtggttgatgacttcttcgatgttggtggatcaaaagaagaattagaaaacctgatagcactagttgagaagtatgtctactcttttatgaagtaacactgatcacttatgcatggctaattaatctcctgtttctggctgatggttttcatagatggcatgcgcaccatgcattgagttctattcggaacaggtgaaaatagtatttctgctattatacaacagtgaaccatcttggagcaatggctctgcagc

SEQ ID NO: 1814 - DNA, 278 bp, Zea mays
  misc_feature: Incyte ID No: 700551565H1
  unsure 57, 80, 88, 95, 100, 108, 112, 202, 245, 251: a, t, c, g, or other
cacgtgacgtggctgtcagcaagtagcagcttctgtcgcgtctccccctccctgacngagcgatccagcgagagggagcnagtagcanccgcagncggangagctcgncgangccgccgaagacgaccatggggttctgggcgacgacgctcatcttcgtcctcgccggcgtcgccgcatccctcttcacctcctctgctgnaaccgcgggccctaccacaaacctgttccatttgaccttggtnactacngctgtaattgttgctggatgatgtatg

SEQ ID NO: 1815 - DNA, 275 bp, Zea mays
  misc_feature: Incyte ID No: 700551566H1
  unsure 218, 220, 263, 269-270: a, t, c, g, or other
tcaattctgattccgcatcttcaaaaccttgtgaagcaaactgcattccagcaagatctgattacgaacctactaagtagcttgcaacaaaatgagagagtcgatgcagctcagtcaagagtccagagcacgacgagtgatacagtggttgaagctgctactgctgagagagaacactcgttacttgttaaatttttgagttacaatctaggatgatncntgactgacgaataatgcggcaaagctgaaacatgttcagctgnccagannagctt

SEQ ID NO: 1816 - DNA, 119 bp, Zea mays
  misc_feature: Incyte ID No: 700551569H1
ataattactgtgttgattatgtgccgtcagatgttttcaagtaatgaaacagaactgatgttgtaagtttatgtttctgaagatttgtatgttcatatatataataatatgctttgaac

SEQ ID NO: 1817 - DNA, 265 bp, Zea mays
  misc_feature: Incyte ID No: 700551570H1
tcttggtgtcaagtggcctaaaccggcttctgaggagagtgtgcacttgcaagttgataatgctgcagtgaggcctcgttctgagcttgttgcactctgtgaggaaatgaatgtgaacgggcttcataagttcatatccgacaacaggaagaacttggcagccatccgcgaggaaattcctagtgactgaagaaaacatctcatccttatggcctggtgttggatccctggaagactttatctggagataatctgtattagatgg

SEQ ID NO: 1818 - DNA, 273 bp, Zea mays
  misc_feature: Incyte ID No: 700551571H1
gactagttctagatcgcgagcgcgcaaagctcaaggcagagttgctgcgtgctctgggtggcgtgaaagcttacagcgtcgctacttaggggtccctcttggtcacaactcatcctttttacaaggccctgcatttgctcctccacgcatacgggaggccatttggtgtggaagcacaaactctagcaagaggaaggcaaagaattgaatgatcctcgggtgctaactgatgttggagatgtcccccatcacgagatccgtgactgtggtgtc

SEQ ID NO: 1819 - DNA, 273 bp, Zea mays
  misc_feature: Incyte ID No: 700551574H1
aattccaggaatcagatgagaactcaggatacagggcacctgaggtgatcttggctggtcagtactccctgaagagcgacgtgtacagcttcggagtcgtcatgctagagcttctgactggccggaaaccgtttgacaggacccgaccgcggcctgagcagtcactggtccgatgggctactccgagctgcacgacatcgaccccgcgctgcaagggctgtaacccgtccaaatccctctcccgcttcgccgatgccatcgccctttgtgtta

SEQ ID NO: 1820 - DNA, 272 bp, Zea mays
  misc_feature: Incyte ID No: 700551575H1
  unsure 115: a, t, c, g, or other
gctctgggcgaagtatgcctcgcgagatgccttcccggggcgggcagcgggtgcgaagtcccgccttcgcgttggatttgcatggtcaggatcctgccgcattcgtgcgcgaagnaaagacggtgcagcgaggatcgtggggcgctatgtgccgaagacagagggtctgaggagctgggatatccgggggccaacgatagattgaatcgggtcttcgaattgaactgcttgccatacagtggttatcccggggaagacgccgccgacagcca

SEQ ID NO: 1821 - DNA, 273 bp, Zea mays
  misc_feature: Incyte ID No: 700551576H1
  unsure 187: a, t, c, g, or other
tgctgatctggccccaacccaccccatcaggctcgggcttgctctcaacttctcagtgttctactacgagatcctcaactcccctgaccgtgcttgcaaccttgcaaagcaggcctttgatgaggcaatctccgaactagacagcctgggagaggagtcctacaaggacagcactctgatcatgcantcctgcgtgacaacttgaccctatggacttccgacaccaacgaggacgccggagatgagatcaaggaagcagctgctgcccccaaa

SEQ ID NO: 1822 - DNA, 269 bp, Zea mays
  misc_feature: Incyte ID No: 700551578H1
  unsure 60, 239, 267: a, t, c, g, or other
cacacacggcgtcacactcacacagtcagacgctccattcttccagagttccagttccangctccatcgccgcgccgccgccgccagcagcagccccacgtccagccaggcaaccagcagccaggtggtagccatcaagattcaagactcaagggctccaacgtcaagccgagccagcagccaggcgcagccgtacagggctccaacgtcaaaaggtggtccaggagggaagctgatancttcggtggtggtgaattgatggtgagngc

SEQ ID NO: 1823 - DNA, 273 bp, Zea mays
  misc_feature: Incyte ID No: 700551582H1
ttcgttacaaggatcttcttgatgatgtttactctgatatatcaaatttgctgaaatcaagcgggaatgtttgctcaattatatattgccttgaacgggcagcttgtgatgatctaagcatgcatttgtcacagcagggtgtctcttgtgctgcttatcatgctggcctaaatagtaaagtgcgaattctgttctcgatgactggctttcatcgagaactcaagttgttgttgcaactgtagcattgggatgggtattgatagacaagatgtc

SEQ ID NO: 1824 - DNA, 270 bp, Zea mays
  misc_feature: Incyte ID No: 700551583H1
  unsure 266: a, t, c, g, or other
cgaggaaaagcaagtaggcaatgaaagattcaacatatttagtggctgcccttctggccagacagcgactattgttctccgtggtggtgcagaccagttcattgaggaagctgaacgaagtctccatgatgccatcatgattgtgaggagagcacttaagaactcgacagttgtgccgggtggtgggctattgatatggaaataagcaagtatctcagggcagcatgcacgaacaattgctgggaatctcagttcttgtaaattcnttgc

SEQ ID NO: 1825 - DNA, 273 bp, Zea mays
  misc_feature: Incyte ID No: 700551584H1
ataaagggaagtgggccagctaacacctcgcctagcataattaaaagtatgctcccaagggttcgtacaatcgttcgtttcagacctcagttagtaaaccctaacaacagtgaaggtgggataactggtattccctatgcaaatagacaagcacatagaaggaagtccaaaggataccaagtaaaaagttcgatgttacaaaacggagaactgtgccgatacatgattctaactctgtctgtggagtgctgctggaagatggtttttgtctgg

SEQ ID NO: 1826 - DNA, 271 bp, Zea mays
  misc_feature: Incyte ID No: 700551585H1
ccctgacaccggaggccaggttgtctacatcttggatcaagtgcgcgctctggagaacgaaatgctgctgaggatcaagcagtgtggtcttgacatcacgccgaagatccttattgtcaccaggttgctccctgatgcaactggcaccacctgtggccagcgccttgagaaggtccttggcaccggcactgccatatccttcgcgtgccattcagaacagaaaacggaatcgttcgcaagtggatctcgcgatttgaagtctggccgtacc

SEQ ID NO: 1827 - DNA, 72 bp, Zea mays
  misc_feature: Incyte ID No: 700551589H1
  unsure 28-29, 37, 63: a, t, c, g, or other
ctgcaaacccagaaatgggaccagacanngggccgantgagaacagagctggaggctgggaanagcggggtg

SEQ ID NO: 1828 - DNA, 266 bp, Zea mays
  misc_feature: Incyte ID No: 700551593H1
  unsure 183: a, t, c, g, or other
cagagacttatgcttggtgagaacctgtatcctcttgttgaacagctggaacgtgagcaggctgccaaggtcactggcatgcttttggagatggatcagacggaggttcttcacctgctggagtcgccagatgctctgaaagccaaggttgctgaagccatggaggtcctccgctctgcccanatctccagcagagcaatgtttctactgagcagcagctggctaatctatcatgaatgatggcgtcgtctccagctgaacgttaa

SEQ ID NO: 1829 - DNA, 269 bp, Zea mays
  misc_feature: Incyte ID No: 700551596H1
cgattcgttttgcttccttgtttgaccaggttctggagctcgccggtaatgctgccagggacaacaagaagactcgcattattccgcgccacgtgcttctggcgatccggaacgacgaggagcttgggaagctgttgggcggcgtgatatcgctcacggcggtgtgctccccaatatcaacccttctgctgcccaagaagacggcggagaaggcgtccagtggcgggagcaaggaggcaaattcgcccaagaaggcgccaagtcccctt

SEQ ID NO: 1830 - DNA, 281 bp, Zea mays
  misc_feature: Incyte ID No: 700551601H1
  unsure 239, 263-264: a, t, c, g, or other
aagcaaaggaagacatgcttaaccagctatacagctcgataagcgggcaaagcaatgctaagattgaagagctgcttccaagaggaccataatgctaagcgcagaagggagaagtaccaaaacaatcatctctcctgtcaaaacttactcgtcaactcagtatccatgataacagggcatctgtttcctcttattctaatgacaccactgaagccgagagccctcgaacaccaacccgntcaggtgaggactggaggtcagcnnttgattccgcttcaaat

SEQ ID NO: 1831 - DNA, 274 bp, Zea mays
  misc_feature: Incyte ID No: 700551602H1
gaaaaaatagaggatgagtatcgggtgaacatgattcttgacaatctcccactagttgttcctcttgcaaggcaggataggggtgctactgtttaccaggctggatatcatgttgtgtcaagggccaatacgctggtaacaatgataagaagtcctttatccacaatcacttggcctttttagtaaaataccacaaggatgaaactacagatctctctagaattgttggatttgaggtcaaaccatcagtatcaatcaccagtttgaagggccg

SEQ ID NO: 1832 - DNA, 189 bp, Zea mays
  misc_feature: Incyte ID No: 700551603H1
  unsure 135, 154, 174: a, t, c, g, or other
gtctgttattgctcatgtggaccatggcaagtctacacttacagattcccttgtggcagctgctgggattattgcccaggaagttgctggtgatgttcgcatgactgatactcggcagatgaagccgagcgtggnatcacaatcaaatctactngtatctctctttattatganatgactgatgagtca

SEQ ID NO: 1833 - DNA, 272 bp, Zea mays
  misc_feature: Incyte ID No: 700551604H1
  unsure 245: a, t, c, g, or other
gtgtctgccgaggacaagacgacggggcagaagaacaagatcacaatcaccaacgacaagggccgtctgtccaaggaggagatcgagaagatggtgcaggacgcggagaagtacgtcggaggacgaggagcacaagaagaaggtggagtccaagaactcgctggagaactacgcctacaacatgcgcaacacgattcaaggacgagaagatcgcgtcgaagctggctgccgacgacaagaagaanatcgaggacgccatcgacgcggcctca

SEQ ID NO: 1834 - DNA, 272 bp, Zea mays
  misc_feature: Incyte ID No: 700551605H1
  unsure 245, 247: a, t, c, g, or other
aagaaaggctggaaacccagtagcaggacttatcgacaaactaaattttgaaagaaattgtatcactctactcttgagcaataatcttgatgacatggatgaggatgaaaaaatgcacctgtggagaaggtagaggttgatatagcactttctgcacatgcaaatgcaagacggtggtatgaaatgaagaagaaacaggaaagtaaacaagagaagactatcacagctcatgataaggcgtttanangcagctgagaagaagacagccttca

SEQ ID NO: 1835 - DNA, 271 bp, Zea mays
  misc_feature: Incyte ID No: 700551606H1
  unsure 39, 61, 69, 105, 201, 247: a, t, c, g, or other
caaccctgacaagatccactttgttcccatctctggttncgaaggtgacaacatgattganaggtccancaaccttgactggtacaagggcccaaccctacttgnggctttggcttgatcaatgagccgaagaggccttcagacaagcccctgcgtctccccctacaggatgtgtacaagattggtggtattggaactgtncctgttgggcgtgttgagactggtcatcatcaagcctggtatggtngttacctttggtcctagtggcctt

SEQ ID NO: 1836 - DNA, 263 bp, Zea mays
  misc_feature: Incyte ID No: 700551607H1
gactagttctagatcgcgtgccctcgccgcagccatcttccatggcggaccagctcacggacgagcagatcgcggagttcaaggaggccttcagcctcttcgataggatggcgacggctgcatcactaccaaggagcttggaactgtgatgcgctcccttggccagaaccccactgaagcagagctgcaggacatgatccaacgaggttgatgctgatggcaatgggaccatgacttcccagagttcctgaacctgatggcaa

SEQ ID NO: 1837 - DNA, 145 bp, Zea mays
  misc_feature: Incyte ID No: 700551608H1
  unsure 10, 38, 58, 65, 83, 135-136, 138: a, t, c, g, or other
caagaatgtnttccatgcgctctactgccattatgganaaggaaggggttggcggccngtacaangggctcggaccgagctgnatcaagttgatgcctgcagcaggcatctcgtcatgtgctacgaggcctgtannangatcctg

SEQ ID NO: 1838 - DNA, 260 bp, Zea mays
  misc_feature: Incyte ID No: 700551610H1
cgcaaccatgtcgaggaggaagaccagggagcccaaggaggagaacgtcacccttggacccactgtccgtgaaggagagtatgtctttggtgtcgctcacatcttgcatccttcaatgacaccttcattcatatcactgatttgtctgggagggaaactctggttcggatcaccggtggcatgaaggtgaaggtgaccgtgacgagtcgtcacttacgctgctatgcttgctgctcaagacgtcgcacacgctgcaagga

SEQ ID NO: 1839 - DNA, 274 bp, Zea mays
  misc_feature: Incyte ID No: 700551611H1
ttcaaaaaagaagaaaaagacaaagggcaaaaaggggaagaagtataagaaaggaagccacagaagttctgtgcttggtacttgcatggaacaaggaagttaggaatgttctagcagtgcaagtgcagacacaactgttaaaatctgggatatagctgttggtaaatgtgcagtcactctagaacaccatgatgacaaggttcaagcagttgcttggagcccacagttcacctgaagttctgcttagcggatcctttgataaaacagttgcctg

SEQ ID NO: 1840 - DNA, 270 bp, Zea mays
  misc_feature: Incyte ID No: 700551612H1
aaaaggtcctacttaggcaacaaccagaaccgccattcttttgagaagcctgtgaggatttacaactaaagctaggaatactttttacatgcgatgaatgatgaacaggatataagcagtcttgttccaaaagcagtcttttggtgatgtacatggagcttttgcatagagtagtttatgtggcaattatctcaagaattttcatctggtggatgtacagggtccgtatagcaacatttcctgtagaaagttgaagctgtatatcgaggg

SEQ ID NO: 1841 - DNA, 273 bp, Zea mays
  misc_feature: Incyte ID No: 700551613H1
  unsure 14, 201: a, t, c, g, or other
actttgtcagaaangccttctgcatccaagtccaagtcaaaagatagatcagctgcaaaagttgcaaaagagcaacccaaggtttctgcaaagccactgggaaatggtacgctacaagttcttataacaacctctctggaaagttccatgttctggaaccatcagcttctttgttgggtagccaaggcatcaataaattcncgaataccgatgagatagatgaacattctcgcagctcccatggtacaggggatttcgattgtgcctccaaca

SEQ ID NO: 1842 - DNA, 271 bp, Zea mays
  misc_feature: Incyte ID No: 700551614H1
  unsure 113, 133: a, t, c, g, or other
agttatgatcactacctctactatattatgttttgcagcacttgaagcatcttcgaaaggaaataagtacatcaattcgtgcttgaggtgatcagcttgaccacaatgttctnatctctcatcttggcatgtnattagtgtgctagtacagtatgtagacagcttatattctaacactgaattgtaataattctggaattaacagcaaactgcagatttcaatattggttaaaaatcttgctgattacatgattattgtgatcttaaagta

SEQ ID NO: 1843 - DNA, 268 bp, Zea mays
  misc_feature: Incyte ID No: 700551615H1
agttatgatcactacctctactatattatgttttgcagcacttgaagcatcttcgaaaggaaataagtacatcaattcgtgcttgaggtgatcagcttgaccacaatgttcttctctctcatcttggcatgctttagtgtgctagtacagtatgtagacagcttatattctaacactgaattgtaataattctggaattaacagcaaactgcagatttcaatattggttaaaaatctgctgatacagattatgtgattcttaaagtaa

SEQ ID NO: 1844 - DNA, 268 bp, Zea mays
  misc_feature: Incyte ID No: 700551619H1
atccggcaatgatggatgtgagcccatttaataaaggcagagaaagcactatttggggtgtttcactcatgtttggttatcttggttttgatgggttcacaagcacgttccagataaactcttcaaagggtatgacatggaaatacacaaccaaatattctacacgacagtgtgctcttgtcttcttagtttaagtgggctgattctccagaatcatctgatccagctgtggattttatgtttcatcacccagatgcttctctgatgt

SEQ ID NO: 1845 - DNA, 134 bp, Zea mays
  misc_feature: Incyte ID No: 700551620H1
  unsure 9, 11, 66, 80, 118: a, t, c, g, or other
ggcaaaacncnggttgccgcaccagatgggctactccatctacgggctatgggcgcccaactacgntgcctacgctgtantacgctgtcgtcccttcgctgtgcctgctccaaggcanccctctgttccctgag

SEQ ID NO: 1846 - DNA, 267 bp, Zea mays
  misc_feature: Incyte ID No: 700551621H1
  unsure 104, 242, 251, 255, 260: a, t, c, g, or other
cgtttagaacctctaaaatttcccccactcgccagtcgcagcagcacctgtagcagccatggacgccagcggagccggtagcaaggggaagaagggggcggccnccgcgcaagcaggcggccccaggaagaagtcggtgacgcggtccgtcaaggccgggctgcagttccccgtcggccggatcgggcgctacctcaagaagggccggtacgcgcagccgtgggcatggcgcccccgtctanatcgacacngccngaaanactcgcc

SEQ ID NO: 1847 - DNA, 189 bp, Zea mays
  misc_feature: Incyte ID No: 700551622H1
atcggtccagcccaagactaaacaaagcaaacttgagttgtttggaggcggagggagcagagaaatcccccaaccaaaccaaaccctcgccgtgccgccgcctccgactcctctccgttccgagcctaccaccacagggcaagggcttcatccagccgcgtgcgagcctgaccgcccagttagacgatg

SEQ ID NO: 1848 - DNA, 273 bp, Zea mays
  misc_feature: Incyte ID No: 700551623H1
gactagttctagatctatgctgatcgcctgcaagtacgaggagatttgggccccagaggtgaacgacttccatcctccatatccagacagtgcatacagtagagaacagattcttcgatggagaagggaattctgaataggctggagtggaacctgactgtccctacagtgtatatgttccttgtccgttttctgaaggccgcaacattgggcggcaaagttgagaaagagatggagaatatggtgttcttcttcgctgattggcgctgatgc

SEQ ID NO: 1849 - DNA, 220 bp, Zea mays
  misc_feature: Incyte ID No: 700551625H1
  unsure 64: a, t, c, g, or other
tggagagatttccctgaagatcttttcgaaactgtcatagcaaggcttcctgttgctgcaattnccacgattccgcactgtctgccgaaggtggtcttcccttttgggctcaacagtttctctcgtcagtactctgaagctccacatggactgccatggttctatacaatcactcatgagaattcaaacaacaatgttgcgatgtatgatccttgctgaa

SEQ ID NO: 1850 - DNA, 268 bp, Zea mays
  misc_feature: Incyte ID No: 700551626H1
  unsure 103: a, t, c, g, or other
gttgaagtgtgcagaaattctccttgaggcgggggccgcagttgatgccctagataagaacaagaacactccgttgcactatgctgctgggtatggtcggaangaatgtgtgatcttctgttgaagtatggtgctgctgtcacgctccagaatctggacgggaaaacccccatcgaggttgccaaactcaacagtcaagatgaggttctcaagttgctagagaaggacgctttcctatagagaagagaaccgccgaataaatgtatca

SEQ ID NO: 1851 - DNA, 268 bp, Zea mays
  misc_feature: Incyte ID No: 700551628H1
  unsure 112, 255: a, t, c, g, or other
caaagacttagaacagttgatgaacagcaggaacacttatctagccaagcaagaagagtgcacgaagaagatccgagatttgggcttgttgcctgctgatgcttttgaagcnacaagaggaaaaacaagaaacagctacataagatactctatgactgtaatgagcagttgaagcagtttagtcatgtgaaccaaaaggctcttgaccaatatgtgaacttcacagaacaacgcgaacaatgcagagaaggcganctgatttgatgcg

SEQ ID NO: 1852 - DNA, 265 bp, Zea mays
  misc_feature: Incyte ID No: 700551631H1
  unsure 102: a, t, c, g, or other
gtggtactaccggtggcgtctgaggcagccgccacacatggacacccgcctctcccacgcggagactgcccaccccgacgagctggacgaggagtttgacancttccccactcccgcccgccagacgtcgtgcggatgcggtacgacaggctgcgcacgttcgcggggaggatccagaccgtggtcggcgacttgcgacgcaggcgagcggttgcagtcgctgctgagtggagggacccgagggccaccgcctgttcgttgtttc

SEQ ID NO: 1853 - DNA, 261 bp, Zea mays
  misc_feature: Incyte ID No: 700551633H1
ccggaggaagtgagggacttcttcggggacgacgagttccgtgtgtccaacaagtgggacgacatgcttgtttaccataagacgctggaggagtgccagacaccgggacgatgaaagtgcattgggtccggaagttccccttcttctgcagtgacagagagtacataattgctcgccggatatggaaactggggggcgcctattattgtgtcacaaagggtataccatgctcgtccatccacggcgcaacaaacctcgaag

SEQ ID NO: 1854 - DNA, 266 bp, Zea mays
  misc_feature: Incyte ID No: 700551635H1
gagaaaaaggaaaggaaaggacaaaggagcggcggcgaggtctatggcgtcgacggcggggtacctggcgcggcgggcggcgcagaaggagcgggtgcgcctgctctaccgagggcgctcaaggacacgctcaactgggccgtccaccgccacctcttctaccaggacgcgtcggatctccgggacaagttcgaggccaaccgacacgtggataacctggacgtggtcgataggctctcgacgatgcggagctcatacaggaattc

SEQ ID NO: 1855 - DNA, 266 bp, Zea mays
  misc_feature: Incyte ID No: 700551636H1
gaaaccgacaatcaaggttctagcctggaatcattttgggtagatctattggagtcatctatgaaaaatgatactcctgttgatgcttctgcttgcggtggatctttggttcaaatcagcagactaataatgggatgggagattctggaaataatatcttgtatattaatgccacaagtaatgctatcttttctccaccaactaatgtggtttcagaagcttatgctaatcctggccttagtcaagtatcagagagttactttgga

SEQ ID NO: 1856 - DNA, 267 bp, Zea mays
  misc_feature: Incyte ID No: 700551637H1
  unsure 241-243, 246: a, t, c, g, or other
ggaaagtgcaaattcacaaagaaagcaaagtttgctgaagctgctggtgcttctgctatagtaatcataaaccatgtccacgaattgtacaagatggtctgcgaaaagaagaaaccgaccttgacataaatatacctgcagttctcctaccaaaagatgcaggttctgctttacatacacttcttacaaatggtaacacagtttctgtgcagctttactctccagatcgacctgtagttgnnnccncagaggtgtttctatggctat

SEQ ID NO: 1857 - DNA, 267 bp, Zea mays
  misc_feature: Incyte ID No: 700551638H1
  unsure 196-198, 218-220, 222: a, t, c, g, or other
ggacttttgggaaattttgcccatggtgtaactgatgtaccttgccctagaccttgtgcacaggtggttaagttagcttcaataactagtttacaaattatgttggttaattttttccctgatcccactttgcctttacaaattatgctgtaccactaaactttaaagggcagtggtgttttctttgcaaataaannngagagaagggaatcatgtcnnngnagatatttcaaaagaagtggccatcctggcatagacttgaaggtc

SEQ ID NO: 1858 - DNA, 270 bp, Zea mays
  misc_feature: Incyte ID No: 700551639H1
ccgatgcaatcaatttcttctgagcttgaggtacttggcaggcatgatcacccacgtctaactgttccatttctgaagatgaggcacaatcattttatgagaaggtcagtctgagggtcaagaagtaaaaattatgattgagaagagaatggaatccagtgcaatatctgaaagaaagaatgttgatgctcgatcttactttatgaccttggaatactgggaagatttattttgtaagctaaatgagatgagaagatataggagaatagt

SEQ ID NO: 1859 - DNA, 267 bp, Zea mays
  misc_feature: Incyte ID No: 700551642H1
  unsure 68, 255: a, t, c, g, or other
ttcagccgccgccgcgcgtagcaagcaggagcagcaaggatgccggctggccacgggctgcgctcgcngacgcgcgacctgttcgcgcgccccttccgcaagaagggctatcccgctcaccacctacctccgcacctacaagatcggcgactacgtcgacgtcaaggtgaacggcgccgtccacaaggggatgccgcacaagttttaccacggccgcaccggtcgcgtctggaagtcaccaagcgcgccatcggntcgagataaaca

SEQ ID NO: 1860 - DNA, 268 bp, Zea mays
  misc_feature: Incyte ID No: 700551643H1
  unsure 75, 94, 110, 182, 240, 251: a, t, c, g, or other
attctaggtgttttggatttgtcaattttgaaaatgcagatgctgctgctcaggctgttcaagagttgaatggcnagatattcaatgataaggnactgtatgttggaagncacaaaagaagtctgaaagagagatggagttgaaggagaaatttgaacagaatattcaagaggtagctgcanaagttccaaaacactaacttgtatctgaagaacttagatgataacattgatgatgaanagttgcgtganatctttgctgatatggc

SEQ ID NO: 1861 - DNA, 198 bp, Zea mays
  misc_feature: Incyte ID No: 700551644H1
  unsure 22, 39, 188: a, t, c, g, or other
gtccatctcctccgtcaccaangatcggactatggggangacagggagggtcggcacaggacatcacggcagagcagccaccacggcgttgcacagcatcaccgtccgcgctggcgttgccgtcgactccatcgagttcacctacaccgacgacgctgggcagaggcgcactgctgggcggtggggtngattggcggc

SEQ ID NO: 1862 - DNA, 265 bp, Zea mays
  misc_feature: Incyte ID No: 700551647H1
gttcctcaaccgacacttgtcctcaatcatgttccgcaacagggattgcttggagcccctgctggatttcctccgtggccaccggcacaaggggcatgttatgatgcttatgatagaatacaaagcttggggaggcttcagtctgtgctgaccaaagctgaggagcacttgtcaaagctccctgctgacacaccatactcacaatttgcttataaatttcaagagtggggctggagaaaggtggggtgatacagcagggcatgtt

SEQ ID NO: 1863 - DNA, 221 bp, Zea mays
  misc_feature: Incyte ID No: 700551648H1
  unsure 112: a, t, c, g, or other
cattgatatttcatgaaggcaaggcccctaagggcgacagaactgattgggtgatgtatgagtacagaatggaagatgaggatttggtttctgctggtttctcaaaggatgntatgtactctgcaaaattttcaagaaaagtggccttggtccaagaatcggagagcaatatggggctccatttaatgaagacgaatgggataatgcagagtcgaacttct

SEQ ID NO: 1864 - DNA, 269 bp, Zea mays
  misc_feature: Incyte ID No: 700551649H1
aggatttcttggaagaggtggagtaagttgtctgttgatgatttactgtttcaaacaagaatagcagcatcacttatgagcagccagcctgaagcttgtcttggttttatcctctgtaaactgatttgctccagcgacatgtcttggttttatcactctgtaaactgatttgctccagcgacatgtggttcttacatttgaaaccctcctgaacgcatactgtagacaaatgagatacgtaagatggagttgtatttgacagtctccac

SEQ ID NO: 1865 - DNA, 263 bp, Zea mays
  misc_feature: Incyte ID No: 700551650H1
  unsure 197-198, 200-201: a, t, c, g, or other
ctcgcccgcatctgcgacggcatcctcgcgctcctcgactcccacctcgtaccatccgccggcggcgccgagtccaaggtcttctacctcaagatgaagggtactaccacaggtaccttgctgagttcaagtcaggtgcagagaggaaggatgctgcggagagcaccatgaatgcctacaaagctgctcaggatatnngnncttgctgatctggctccaacccaccccatcaggctcgggcttgctctcaacttctcagtgtt

SEQ ID NO: 1866 - DNA, 266 bp, Zea mays
  misc_feature: Incyte ID No: 700551651H1
gaggaatgtgattggagatagaggattaggagttgttgcggatacgtgcaagaagctccaaaggctcagaatagagcgaggagatgatgaaggaggtgtgcaagaagacagggaggggtctctcaagtgggcttgacggctatagccgtaggttgccgtgagctggaatatatagctgcctatgtgtctgatataaccaatggggccttggaatctatcgggacattctgcaaaaaactatacgacttccggcttgttctacttga

SEQ ID NO: 1867 - DNA, 266 bp, Zea mays
  misc_feature: Incyte ID No: 700551652H1
  unsure 109: a, t, c, g, or other
agtccctaacagccgttttttcccagtttgggaaaattcttgatgtgcttgctttcaagactttgaagcataaaggtcaagcttgggttgtcttcgaagatgtcgcatngctactgaggctctgaagaggatgcagggctttcccttctatgacaaaactatgagaattcaatatgccaagaccaaatcagatattatagcaaaggctgatggcacctttgtacctcgagaaagaagaaagaggactgatgaaaaatctgaaaaga

SEQ ID NO: 1868 - DNA, 266 bp, Zea mays
  misc_feature: Incyte ID No: 700551654H1
  unsure 223: a, t, c, g, or other
gaagatagtgtttcccttaagaactctttcaggtggtttacatcgatgattggcagaaaggcaaacttaaagttattgatctcaaaggttcgtgaggctggggcatcatcgtgaaaactactgaatttgtacaaggtcatacagctagatggggccttgcttggtcattcattgctccgaaaccaagaaaaatagtcctcggctccagtgctccagcaaaaanaacaccattcctttatgcttcaggggcttcgtcgtgaacaggt

SEQ ID NO: 1869 - DNA, 161 bp, Zea mays
  misc_feature: Incyte ID No: 700551655H1
  unsure 11, 48, 61, 126, 141: a, t, c, g, or other
gaaatggtcantgccatgcgtgatgataggagcttgggttgttctgancttagcagatggntaacaatggcacaaataatggcctccagctttggcgagaagagtcttctttggagcactggcagntggtgaaggagcttnagaggcttagaaagcagagg

SEQ ID NO: 1870 - DNA, 266 bp, Zea mays
  misc_feature: Incyte ID No: 700551656H1
  unsure 52, 109: a, t, c, g, or other
ggcaatgcagactggaagcctttgcagttcctatgttttgctttcttctgcngaatactacagaagctaagagctactgaaccactaataactccaatatacaatgaantggcgaggttgaaggacgaggaataagaatggcaaaaagagtagtccgtgctctgggtttgatttttggatgtgtgttcactgcatccctggcttatacagcagctagtaacatggttgagctttcatgcagtatatccccgtatgttttactacta

SEQ ID NO: 1871 - DNA, 57 bp, Zea mays
  misc_feature: Incyte ID No: 700551659H1
  unsure 42, 50: a, t, c, g, or other
aatttaaaattaagattattctcaacaagtgtttaagattanaaaaaaanacgaaag

SEQ ID NO: 1872 - DNA, 186 bp, Zea mays
  misc_feature: Incyte ID No: 700551660H1
  unsure 6, 8: a, t, c, g, or other
ctcatntnacaaccggagaatcaaatctcgagcatgtgtaaaagcctcatcctttgccttcatgaagaacgcccaagaatagcgagaaaagtcgtcaatgaccacaagacataccacatcccccaaacgagcaaactcgggctagaccaacattgtccatatgaagcaattcaccgagttctgaag

SEQ ID NO: 1873 - DNA, 265 bp, Zea mays
  misc_feature: Incyte ID No: 700551661H1
  unsure 127: a, t, c, g, or other
agaagttctaaggaactggccacataggaacattcaagttatctgtgttactgatggtgagcgaatcttgggacttggagatttgggttctcagggaatgggaattccgtaggcaaacttgctctancacactgctcttggaggagttcgtccatcagcttgtttgcctatcacaatcgatgttggcacaaataatgagaaactgcttaatgatgagttttacatggactccggcaaaaacgtgcaatggcgaggagtatcatga

SEQ ID NO: 1874 - DNA, 266 bp, Zea mays
  misc_feature: Incyte ID No: 700551662H1
tttagaagcaaaagcaaaacaatacaaggatcctgcattgatgcacatatttttgatgaacaacattcactatattgtcaaatctgtccgcagatcagaagccaaagattgttgggtgatgactggattcaaaggcaccgaaggattgtacaacaaaatgccaatcagtatagaaggattgcttgggcgaaggtgttgcaatgcctctctggtcaaggtttgacttcatcagtggtagtggtcatgtaggaagtgatggtggcata

SEQ ID NO: 1875 - DNA, 183 bp, Zea mays
  misc_feature: Incyte ID No: 700551663H1
  unsure 104: a, t, c, g, or other
atctgtcgctgatcaaatacgcacggcttctctggagagcgcatgttgaatcagctgggatggtacttgtacaggcactaaaagaactcaggaggacccctganatgttgttcagcttaggacgatgttggttcagtggcatcagtacctgctagagttttccttacatgagctaccattcag

SEQ ID NO: 1876 - DNA, 121 bp, Zea mays
  misc_feature: Incyte ID No: 700551664H1
gaccatttaaattcccatctttaaatggtacatatctgaagaattcgcacagatcttgtgagtgccatttaaagttttgttgctttcatttattaaaaaatgatctgcttattccttacat

SEQ ID NO: 1877 - DNA, 271 bp, Zea mays
  misc_feature: Incyte ID No: 700551665H1
  unsure 7, 95, 112, 150, 252, 260: a, t, c, g, or other
agttgcncaaaaccactcgttgctcatgtaccatactgtgaactatatgaaggtcaagtccctacgagaccaacaataatttgtacgtccacaanaatattctgcagagatntgagaacaaagattcaagatgtccatgccattctctgncaacgggtggcaatggcgaaagacaacgtccacatgttgtaagctatatgtaattgtaacttaggtacaaagagtcgtccctgtgctgtgcggtcagggaanatagtctngtggttgcgct

SEQ ID NO: 1878 - DNA, 159 bp, Zea mays
  misc_feature: Incyte ID No: 700551667H1
  unsure 17, 23, 38, 44, 46, 60, 74, 91, 95, 132, 143, 152: a, t, c, g, or other
gaggcaaacggtggctntcggantcatcaagcagtgtngagaananggatccaactgganccaaggtgaccaangctgccgcaaagaaganatgntgtgtctggctggtctgtgttctgctgagggataccnagtggatacgnaaaatattngtcttgt

SEQ ID NO: 1879 - DNA, 86 bp, Zea mays
  misc_feature: Incyte ID No: 700551668H1
  unsure 42, 52, 77: a, t, c, g, or other
gtacagagcgcgctttcaaggccttttttttttttgagatantcaaggaggngaggaggaaatggccggtacacganccacctggg

SEQ ID NO: 1880 - DNA, 197 bp, Zea mays
  misc_feature: Incyte ID No: 700551675H1
  unsure 34, 95: a, t, c, g, or other
acatgggcacccacttccccaatcattcagtggnaaaacaaatattagggaatcagaacactgtgtcaacttcaagcaatacattcaaacactanacttgatgtcatagtggaaaatttttgggactcctgttggagcagaaattgagagagttgacatctggtgtgaaatcaccctacactaaaccagccgaaggt

SEQ ID NO: 1881 - DNA, 267 bp, Zea mays
  misc_feature: Incyte ID No: 700551677H1
  unsure 251, 263: a, t, c, g, or other
catatgtacttccaactggcgatgcaaagaaacacttgaagagtatctgactaagaggaacattcatgggaatatatgacgtggatacacgtgctataacacgaagataagagaagacggcagtcttattggtgtcttgagtactgatcagtctcagacagacaatgagttgttggaaatggccaaaaagtggaaaattgttggagttgatttgattagtggtgtcacatgtgatgctccatatgaatggntggacaagactncctc

SEQ ID NO: 1882 - DNA, 263 bp, Zea mays
  misc_feature: Incyte ID No: 700551678H1
  unsure 11, 24, 28, 70, 105, 165, 169, 214, 249: a, t, c, g, or other
ggccttctagncaagggcctaacntgtnggaaatcatacaaggagatctacgacgacgtgctgcaagcanggctctgcgttgcacaaagctgggagtgcagccangttccggtggggatctacggagcgaactgtcctcagtggatagtggcaatgcaggttgcnatgnctatagtctagtctgtgtcccatgtacgatatttaggtgcggganctgtcgactacatcatcgatcatgccgaaatcgangttgcttcaaaaag

SEQ ID NO: 1883 - DNA, 140 bp, Zea mays
  misc_feature: Incyte ID No: 700551680H1
  unsure 73, 80, 127: a, t, c, g, or other
acagcacgcagggcacaaggagaagaagaggggaagaaatattcttcccgtcgaaagacggagagaggaaaanggacaanggcaaggcaagagagaggcgtcgtcgtttatctgctgccggattgcnaagaggaagagga

SEQ ID NO: 1884 - DNA, 267 bp, Zea mays
  misc_feature: Incyte ID No: 700551681H1
  unsure 130, 263: a, t, c, g, or other
cccgactgggtgaaggatcttgatgctgttggcgagaatggagaggagattgagaatccacttactctgttgaatgatccatcctctgttgagccactggggaactggggaagaaggtcctactgtggtngcttcgtgttgaagcacgggcggatagcaagtttcctcaagggtgggtaattgagccacctttggaagtcgtcgttccccgcaaagcgcactccatggcctgaaaccaccaccgagcttccatccgagttgtnggat

SEQ ID NO: 1885 - DNA, 262 bp, Zea mays
  misc_feature: Incyte ID No: 700551683H1
  unsure 237: a, t, c, g, or other
gggccgtctctccaaggaggagatcgagaagatggttcaggacgctgagaagtacaagtctgaggatgaggagcacaagaagaaggtggaggccaagaactcgctgagaactactcctacaacatgcgcaacacgatacaaggacgagaagattgcgtccaagctgccggccgatgacaagaagaagatcgaggacgccatcgacgcggccattcagtggctggacgccaaccagtncgccgaggcgacgattcgaggacaa

SEQ ID NO: 1886 - DNA, 262 bp, Zea mays
  misc_feature: Incyte ID No: 700551684H1
  unsure 105: a, t, c, g, or other
caggtccttctagtgctttttcccccacgttggaccacatgagaggggtctggcattttcgtccatacagtgcttcgaatggcgacatcttgatgctggcctgangctattgttgtatgagaactctgcgtagggtagactggactcccaacttctatcaaaagctaacacacatgctcttaacagatcttcaaagactttgttgactctctctgtctgcccatctgtctgagggtggtaagcggtactgaaatctagcttg

SEQ ID NO: 1887 - DNA, 263 bp, Zea mays
  misc_feature: Incyte ID No: 700551685H1
gaaaaatttctttcatgtgttgaatctgggaattctacggtttcagagaaaggaattctgcaaatactgctagacttgcgtttcgttggtgatgtcctatcaggggtaaaagttcttccaccaacagtcctgaaatgcagacaaaacaggattttttgccaagcgccgtcaccaagacttccttcaggagaaaacagtcacaattacaggcagactcagctgtcatagagcctataaacaagttagtcaacaggctctcacag

SEQ ID NO: 1888 - DNA, 263 bp, Zea mays
  misc_feature: Incyte ID No: 700551686H1
aaggtctccaatcaagtctcctgttcggtctcctacacaaagaggggcctcaatcacattatctccaaacaaaaacagcagcaattcatcacctcttctgacgcagaagatcaagatatgctaagggatgtcaagtacaggaaattcatccctggtataagcaaaagccaggagtttgacactaaggaaaggcataataagcaaagcaggttaagcaaaagtaatagccattcaccaagcagtggcaaccggaaagagacgct

SEQ ID NO: 1889 - DNA, 262 bp, Zea mays
  misc_feature: Incyte ID No: 700551687H1
ggtgacgacagtgccgagcctgctaatcctgttgccagtgaaattattgtaacccagcttgcaagcatgggcttcaactaccttcattgtcagaaagctgctattacacatcaaacacaggagttgaggaagcgatgaattggctcctctcgcacatggatgatccagatataaatgacccaatatcaaaagattcacgtgcttatgagccatctgttgacgaagcaagtgttcaaatctcatctccttggatccaggaaga

SEQ ID NO: 1890 - DNA, 264 bp, Zea mays
  misc_feature: Incyte ID No: 700551689H1
  unsure 58: a, t, c, g, or other
ccttagggaacgacttttgagcagaaaacttacgctgtgctcccttgggaacgacttntgtgcagctttggatcatactttttggctctgcattcctttaggaacacttttgagcagaaaacttacgctgcgctcccttaggaacaacttttttgcagcttcggatcatgatttttggctctgcattcctttaggaatgacttttgagcttcagaattttactccgctttcttagacatgtctttcaagcttcgtaaatccatg

SEQ ID NO: 1891 - DNA, 128 bp, Zea mays
  misc_feature: Incyte ID No: 700551695H1
  unsure 13-14, 29, 72, 102: a, t, c, g, or other
ccgacggcggcanngagaacgaacagaancgacggcgtcattcgtcctctcccatcgagaagctccaggaantacggacgagctcgagaaggtaaatgaggnagcaagtgacaaggttatggaggtgg

SEQ ID NO: 1892 - DNA, 111 bp, Zea mays
  misc_feature: Incyte ID No: 700551696H1
  unsure 57: a, t, c, g, or other
aggtggtccaggatagcacgccgcttgccagggcgcactgacaatgagatcaagaantactggaggacacacatgagaaagaaggcacaagagaggaagaggaacatgctc

SEQ ID NO: 1893 - DNA, 288 bp, Zea mays
  misc_feature: Incyte ID No: 700551702H1
aattccagggaatcagatgagaactcaggatacagggcacctgaggtgatcttggctggtcagtactccctgaagagcgacgtgtacagcttcggagtcgtcatgctagagcttctgactggccggaaaccgtttgacaggacccgaccgcggcctgagcagtcactggtccgatgggctactccgcagctgcacgacatcgaccccgcgctgcaagggctgtacccgtccaaatccctctcccgttcgccgatgccatcgccctttgtgttcagcctgagccggatt

SEQ ID NO: 1894 - DNA, 288 bp, Zea mays
  misc_feature: Incyte ID No: 700551703H1
  unsure 69, 74, 88: a, t, c, g, or other
cttgggattggtctcccaatgctgtctgactaaacatgttttcaaggtgaacaagcagcagtatcttgnaaatnttgccctgaaaatnaatgtgaaggttgggggaaggaatactgtgcttgttgatgctttggcaaggagaatcccccttgtcagtgacatagcgactattatctttggtgctgatgtgacccatccccatcctggggaagattctagtccttccattgcagctgtggttgcttctcaagactggcctgaggttacaaagtatgcaggatggtgagt

SEQ ID NO: 1895 - DNA, 286 bp, Zea mays
  misc_feature: Incyte ID No: 700551704H1
tagagattggtcttccaatgggagggcttgcaaaattgtttgctcaggactgggagagggtgatgtcaccatggttatgccagcaacagtagctcagtatttgaagatcattcagaatccaacatacgctgaactccaaatggctgccaaccaaggccgcaggtgcacatgggagaagctctctgcaatcagagcaaactgtgccattgaacttgtattggatgaatccatagcagttttaaaccacaaacggagctaaaaagaagcatggaatgacagcggctgc

SEQ ID NO: 1896 - DNA, 288 bp, Zea mays
  misc_feature: Incyte ID No: 700551705H1
  unsure 145, 153, 171, 184, 224, 242, 272, 275, 280, 283: a, t, c, g, or other
ggtgcctgatggttcaattccaataagccagtctgcacatcctccaactctgggccccttcacctataagccccttttagcagacactgtccaagcagaggatataaaggagctatgcaagcttttagtggtggtatcaggagangctgcaanaacatatgctggtcaganaacgaaggaaganagggtcggcgagaaggaagatgaaatcgggagggcagaangaagatgacagggtaggntccctagcattgacaaaccatgatagaganggntatantcnggtca

SEQ ID NO: 1897 - DNA, 283 bp, Zea mays
  misc_feature: Incyte ID No: 700551708H1
catgatggccttgttaagggtcttcgtgaggctgccaaagcaattgagaagcatgctgctcagctttgcgtgcttgcggaggactgtgaccagcctgattatgtcaagctggtgaaggctctttgctctgagcacaacgttcacctggttactgtgcctagcgctaaaactcttggcgaatggtctgggctttgcaagattgattctgagggcaaggcgaggaaggttgtgggttgctcctgtgttgtcgtcaaggactatggcgaagaatctgagggcctaa

SEQ ID NO: 1898 - DNA, 280 bp, Zea mays
  misc_feature: Incyte ID No: 700551712H1
gcattgtaagtacaaagatacctttcaaaggaaccggaaaggagtacattggggatgacataactgaaatatcatctgctgttaagtcagccctgaagcagtgctgtcttcaactgaagtctaagattgtgaagaaacttcaggctcgtgagcggcaggacaggaaaaggaacctgaacagatatattcctgatgttgcaagagcggttatggaaactctagtagaaattgcagatcatctcccccaaaacggccacgttatgataaggaagatgaggaa

SEQ ID NO: 1899 - DNA, 282 bp, Zea mays
  misc_feature: Incyte ID No: 700551713H1
ctctacgagtgaaagatgaggaattgcaacatttggccaaggatatacgttctcgagatgctacaataaatgaaatagcagacaaactaacagaaaccgcagaggctgcagaagctgctgcttcggcagctctcacaatggatgaacagaggcgacttttgtgtttggagattgagcgactaaaacaagccttggaaagacaagtagaacaattcaatgctgaagcttagacagtccgaagagaaggtcatcagcctgagcaaagagaaggagcagttgatg

SEQ ID NO: 1900 - DNA, 278 bp, Zea mays
  misc_feature: Incyte ID No: 700551714H1
ggaacatgtggatatcacacgcacgcgcctacgcttattagccctcattcgaagtcgacggcacccgtcttctctccgcactcgaaaccccatccttgactagctccgatctggtacgagatggccggcaagatgaaggagttagacggcgccagcctgccaagatcttcattggcgggctctccaaggatacaagcatgagtacattcaaagaacattttgggaagtatggggatataattgatgctgtcataatgaaggaccgctacacacaaagc

SEQ ID NO: 1901 - DNA, 276 bp, Zea mays
  misc_feature: Incyte ID No: 700551715H1
aatttcgaacaagtacttaaaggatccagttataattgaccttgttggtgactcagatcagaaattacctgaaggaatctctctctattccattgcatctgataacttcgggaagccttcaattattggtccttgattaaagagcatgccaatggtggaaaatgcattgtgtttactcaaactaaacgggaagcagatagattggcatatgtcagggaaggagttatcagtgtcaggcactgcatggggatatttcacagaatcaaagagagagga

SEQ ID NO: 1902 - DNA, 287 bp, Zea mays
  misc_feature: Incyte ID No: 700551717H1
catgatggccttgttaagggtcttcgtgaggctgccaaagcaattgagaagcatgctgctcagctttgcgtggcttgcggaggactgtgaccagcctgattatgtcaagctggtgaaggctctttgctctgagcacaacgttcacctggttactgtgcctagcgctaaaactcttggcgaatggtctgggctttgcaagattgattctgagggcaaggcgaggaaggttgtgggttgctcctgtgttgtcgtcaaggactatggcgaagaatctgagggccttaaca

SEQ ID NO: 1903 - DNA, 285 bp, Zea mays
  misc_feature: Incyte ID No: 700551719H1
  unsure 274: a, t, c, g, or other
gaatggtgtacagatggaaaactggatgggagccttggagttgctgacgtggtgcccattgtgctgtgccccaaagataactgttttcctgggctatactgctttggcttgcttagggatccatggcttactgatggacaaactatgattatatcttctgtctggggaagtagggaagtaatactttctgtaaatgttgtgagctgtgaactttcaagagtgagtccccaggactcagattattcatggaatgttcttgcagttgataagaacnacatcttgcag

SEQ ID NO: 1904 - DNA, 284 bp, Zea mays
  misc_feature: Incyte ID No: 700551722H1
aatgaattgacaccacatttgttgaacaagttggctcctactgattctcgtttgagaccagaccaaaggcatctggaaaatggtgaatatgagatggcaaattcagagaaacttaggcttgaacaactgcaacggcaggcacgacaactgcaagaaaaaggatggagaccaaggtggtttaagaaggatgatggcgacagttaccgctatatgggtggatactgggaagcgagggagacggggaactgggaggtattccggacatctttcgccagaatagtttg

SEQ ID NO: 1905 - DNA, 256 bp, Zea mays
  misc_feature: Incyte ID No: 700551723H1
tttttgttctccccgcgagcgctctctttctctatcgactggcgacgactccgccaccgccgccgctctacgcgagacgcccaggtcttcgccaacgacgagcatccgggttagagaggaagaaattgcaaccgaaacaatggcggcagattccggcgctcgcagacaaccaagcttcaccaaggtcgaccagctgcgccctggaacccacggccacaacctcatcctcaaggttgttgactccaagatggtctcc

SEQ ID NO: 1906 - DNA, 281 bp, Zea mays
  misc_feature: Incyte ID No: 700551725H1
  unsure 194: a, t, c, g, or other
gcttgaagcatgccgtttggccagtccagatgaggcaaaggctgtaattgcccgtggtgtgatgtcaattccaaattctgtgaagctatggttgcaggcagcaaaattggagagcagtgatctgaataagagcagggttttgaggaaagggctggagcacattcctgattcagtccggctatggaaagctgtanttgagcttgcaaatgaagaggatgcaaggttgttgcttcacagggctgtggagtgttgcccgttgcatgtggaactttggcttgccc

SEQ ID NO: 1907 - DNA, 279 bp, Zea mays
  misc_feature: Incyte ID No: 700551726H1
  unsure 190: a, t, c, g, or other
cgtatctcttgtttaggccgggctcgagagagttgggctccgaatcctgggtgggtttggagttggagaatcgccttcgtcgctcgacccagaaagattcgatggagagccacaacccatcgcactctcagatcgccgaagtgacgatggacatcgcagcgtcagtttctggagcggcagggagcaagtncaacaagggcgcactgcgacttctccgacgccagcaactcctcgaaggacgccagggagaggtcggcgtcgatgaggaagctgatagtc

SEQ ID NO: 1908 - DNA, 281 bp, Zea mays
  misc_feature: Incyte ID No: 700551727H1
ggataatggaagcctgtggttttgggactggaagagtggtcataactttcaacaagatcagactatagtccagcctggatcactggagagtgaggcatgcatatatgccctctcatatgacgtgagcggatcaaggcttgtgagctgtgaggcggataagactataaagatgtggaaagaggacttgacagcgacgccagagactcatcccatcaatttcaagcccccaaaggacatccgaagatattgatgctcaaatcccacaagtagcaagctagtgg

SEQ ID NO: 1909 - DNA, 274 bp, Zea mays
  misc_feature: Incyte ID No: 700551728H1
atgttattgaggtcctgggatggaggtcgctggaccctctactcacttgccatggtaaatcctctcaactctggatgtcttccatttttttcttattaaagagttttcacctaatagttgattatgggttggtacatcaaggctgattcagttcaattttagcaacctttactgtttattaggtgcattccaatattttgtgttttggttagtaatttcttttgccagtttcatcaaacatgatcttctaaacaattgtttgttttttgtgtgc

SEQ ID NO: 1910 - DNA, 275 bp, Zea mays
  misc_feature: Incyte ID No: 700551729H1
agcaatctgtggctcttggcaatatgacaaatccaagggttaggtactgtaggaagtgcaaccagttgaagccacctcggtgccaccattgctctgtttgtggaagatgtgttcttaagatggatcatcattgtgtgtgggttgttaattgtgttggggcgctgaactacaaatactttcttctcttcctgttttacaccttcctcgagacaactcttgtcactctctctctattgcctcacttcatgccttcttcagtgatgccgagatcccag

SEQ ID NO: 1911 - DNA, 279 bp, Zea mays
  misc_feature: Incyte ID No: 700551730H1
  unsure 199-200: a, t, c, g, or other
tatgattctctaggcatatgttatgtactaattgaattttaatttcagtatacactgtgtaatggtaaaaggagaaaacttgatgaatggagaatgtacaaagatcaaagtatggctaaatgaccttgctggaagtgaatgggcagcaaagacagatgcacagggagaaaggttgaaacaagcacagaacgtaaacaanntcactttctacacttggtgatgtcatatgcactcttgtaacgaagacttcacatataccctttagtacaggtggagatt

SEQ ID NO: 1912 - DNA, 284 bp, Zea mays
  misc_feature: Incyte ID No: 700551734H1
  unsure 173, 175, 177, 236, 240, 247, 268-269, 275, 280: a, t, c, g, or other
ggatgacaaaagaaaggagttcatagcttctcttcacaagaggaaaacagaattattcatggccctaattgagaaaaagttgcttcctctccgtccaggtgttcaaaggttaatcgatgaagctttacgaaaggcagttaaagttgcagtgtgcagtacatcaaatgagaaancngnttcagcaatagtgtcgtacttattggggcctgatagagctggtaagttaccatattgcngganatgtggntcctcacaaaaaacctgaccnncaatcntcttntagg

SEQ ID NO: 1913 - DNA, 171 bp, Zea mays
  misc_feature: Incyte ID No: 700551735H1
  unsure 55, 62, 65, 71, 103-104, 133, 138, 151, 156, 162, 166: a, t, c, g, or other
cggtgacagcggtagggccatctccctcttgggtgaaaaagatggtgcccttganaccggangtntctctngcctcaagcctggcctacatggaacccatggnngccaggttgaggtagagacattccgggancagcngtagggccatctnccctncaagcntggnctccc

SEQ ID NO: 1914 - DNA, 287 bp, Zea mays
  misc_feature: Incyte ID No: 700551736H1
  unsure 237: a, t, c, g, or other
gggaaaatgtctcgctcccttcataacagattaagcaagacagaaacaaggcacgtgcgtgaagcaaatcctggaaagcgttctaagcctagtaatattgttgctaatgtggcatcttttatacctcttgtgaagccaaaggtgcaaccaacaacatgtgtgaaaaaagatgttagagtgaaagcacttgagacagctgaagctgcaaaacgtcttgaagaaaagaaacgaagtganacgtgaaatgcgcaaagcagcagcaaaactagagcgtgagaaactgaagc

SEQ ID NO: 1915 - DNA, 285 bp, Zea mays
  misc_feature: Incyte ID No: 700551737H1
cagggatgtgaagcagaaccagatccttgagaagtcccttgttgtcacgcttcttgagcactttgggcgagaggtggctgacctgaggtcggaaaggagtgttctgaagcaagagtggcaagcaaagagtgaggagctgcagcagctgcagagtgaaaagcatgacctcctaaagataagctgtgagctacggaaggaaatggaggctcgtaaccgcaaagtggatgaactgaaatctgaggcaaagttctggttcgacaactgtcggaatgcaagagtcacggc

SEQ ID NO: 1916 - DNA, 281 bp, Zea mays
  misc_feature: Incyte ID No: 700551738H1
ggagatggccacttgttgatgctgaaattgaaagagtggccccgacccagtgtcttggaggcgtttctgttgtgccaaaggccagaatttattgtcaactttcctcttgttgattttattcatcctagatggggtctcctaaaccttgctgccaagttacccccagatgccttacaacctgaattagggatgaaactgctaattgcacatggaagtcaccgagaacttggtaaaggtgatcaatgacaatctaatgattaacatgagcgagtggttcacat

SEQ ID NO: 1917 - DNA, 282 bp, Zea mays
  misc_feature: Incyte ID No: 700551741H1
  unsure 70: a, t, c, g, or other
aaaggaatcaggcggagtggcgcgatgggagagcaggtcgtgacggagcagatccagcggaagctggagngaggtcaacgctaccgtccaacagcacctcgcgggtgtccaggaccacatcaacttcaccatgcagcaagcatacttcaagtgtgcatatggttgctttgatcggcgccatactcaggaagcgatcagcaactgtgtggagaattgtagtgtgcctgtccttgctgccaacaatgtttttgagagtgagatggccaagtttcagccatctaa

SEQ ID NO: 1918 - DNA, 277 bp, Zea mays
  misc_feature: Incyte ID No: 700551742H1
  unsure 180: a, t, c, g, or other
gtcatcatatttaaagcagcttcgccaacaaaaagagggtcaggatggtgttgatttggaaatgaatatgaacgggacaaagtctacatttgaagacgatgagtttgacgatgtggtccgttttattttggtctttacatgctgcatgccgattttggtgattctttttatctctgagtntttgatattagcatgaggagtgcctatggactatgagtctgtctcatggatatgagatgttagctgcatattagatattgacaagagagtgtgtggg

SEQ ID NO: 1919 - DNA, 68 bp, Zea mays
  misc_feature: Incyte ID No: 700551743H1
  unsure 11, 43, 54, 60, 62, 65-67: a, t, c, g, or other
aatctcatgangacactgttgtcattgcagcagcaccagctanaatacttggtncatatntnagnnna

SEQ ID NO: 1920 - DNA, 278 bp, Zea mays
  misc_feature: Incyte ID No: 700551745H1
ggagcatcccgtcccgaggaggaagacaaccggcgacgcggggggaacatggggaagacgccggtgcggatgaaggcggtcgtgtacgcgctgtcgcccttccagcagaaggtaatgccggggctgtggaaggacatcaccaccaagatccaccacaaggtcaccgagaactggatctccgccacgctcctcctcacccccgtcgtcggcacctaccaatacgccatgtggtacaaggagcaggagaagctttcccacagatattaaatgcgctgccc

SEQ ID NO: 1921 - DNA, 274 bp, Zea mays
  misc_feature: Incyte ID No: 700551746H1
  unsure 22, 41, 47, 49, 53: a, t, c, g, or other
gccagtactgaatgtggagganctgcagatagatgcatacnattttncnatangaccacaaatgcacacttgagctgtgtggacactggcagccaggtctgcaatcttgcgtggtcaaagaatgtaaatgagcttgttagcacccacggctactctcagaaccaaataattgtttggagatatccaacaatgtcgagcctgccactttgacaggcatacatacagagtattgtacttagctatttcccctgatggtcagaccatagttactggt

SEQ ID NO: 1922 - DNA, 277 bp, Zea mays
  misc_feature: Incyte ID No: 700551747H1
  unsure 9, 28, 31, 93, 115, 132, 218: a, t, c, g, or other
cttgattangaggaaagaagtctacatntgntattattttatgggttgaggaacaaataattccaaaaaatggtactgaatttgcacttgatnttgttagccgacgcttcttganatgggttcaaaaagttncacccatcttgtcactattttggagagatataaataagataatccccaaggctatgtccaaatgaggaaatgcagctactgttaangaatggagtcagtgctattggaaggaccgtacccagatggactgctatagctatggcag

SEQ ID NO: 1923 - DNA, 258 bp, Zea mays
  misc_feature: Incyte ID No: 700551750H1
  unsure 30, 36, 49, 55, 74, 94, 181-184, 191, 195, 199-200, 209-214, 218-219, 222,: a, t, c, g, or other
aaactagctaaaatctctgttttcaaacancctttnggtatataatacnacagtntttgagaatactgcattantcttccaaaactgtagtatnatataccaaaagttgtttgacaaactagctaaaatctctgttttcaaaactaaaatattacaaatactgcagctcttttgaagtaannnnaaaaaanaagnaaanngaaaaaaannnnnnaacnnaanagaaaaaanaaaaagaacagggggnnnnccccnttt

SEQ ID NO: 1924 - DNA, 282 bp, Zea mays
  misc_feature: Incyte ID No: 700551751H1
  unsure 280: a, t, c, g, or other
cacataaaaaaaataaacaaagtgaaacatccagtcaaaatggagaggatgcgtcaactggccagcaagatgaaatggatgttgtttgtgaaaaggagctgaataaagctgaagatcaaattgatgatctgtcgaaagaagcaacagaaccttcttggaaagtaaccagagagcttaagccaccacttgttctgaggcttggctgctactgggttgcggtctctccggtatgcccgtgaagttgagggcttaggaaaggtagttgctctggacaatgatnag

SEQ ID NO: 1925 - DNA, 198 bp, Zea mays
  misc_feature: Incyte ID No: 700551752H1
  unsure 14, 18-19, 23, 41, 74, 78, 84, 92, 99, 110, 121, 142, 146, 153, 182, 190,: a, t, c, g, or other
caaatttccccganacanntcantcccaccgtctccacagnaaccagcacacatttccctttggcggatcgaangaangaaggnaggagganatgggtngcggcatggangtgcacaaaanccggtggatcgaagagtggancgcnggccgcnagaacctcgagttcaatttccgctggatncgccgcancctcgncg

SEQ ID NO: 1926 - DNA, 283 bp, Zea mays
  misc_feature: Incyte ID No: 700551753H1
  unsure 130: a, t, c, g, or other
ctcctttccccctccctatccaggaaaaggagaaggtaccacctcggtcgatcttccctccatttactcctccgggcgaggtcccgattcgatcgaaggcggcggagagagatgaggaagcgtgagcagnagaacccgtgcgggatctgcgggcactaccacaagtacgaggagggggaggtgtgcggcgtctgcggtcaccgcccacctgcagcgtcaccagtaggggccaggcagcaagactcggcgttcccgtccgagatcctcaaggagttctcttcct

SEQ ID NO: 1927 - DNA, 279 bp, Zea mays
  misc_feature: Incyte ID No: 700551754H1
aaaaaaaatcggtttgttagcgtgacgtgcgtgaggagtctggagtcggacggaatcgaaaaggcgaaaactcagtgtctcgagtttcctcggagcggaggcgatggctgggaagggagggaaaggcttgctcgccgcgaagactacggcggccaagtccgccgagaaggacaaggggaagaaggccccaatctcacgctcctcccgcgccggcctccattccctgttggacgtatccaccgtcagctgaagcagaggactcaggcaaatggtctgttg

SEQ ID NO: 1928 - DNA, 281 bp, Zea mays
  misc_feature: Incyte ID No: 700551755H1
attcaaccaaccaggactgtgtaaagatgcttgttggaaataaagtagacaaggaaagtgagagggctgtcacgaaaaaggagggaattgaatttgccagggaatacggttgtttgtttctagaatgcagtgcgaaaacaaaagtaaacgtagaacagtgttttgaggaactggttctaaagatcttagacacgccaagcctcctggcggatgcttcctcagcaggggtcagcaagaagaacatcttcaagcagaaggctccagaagctgacgccgccaca

SEQ ID NO: 1929 - DNA, 280 bp, Zea mays
  misc_feature: Incyte ID No: 700551756H1
  unsure 152: a, t, c, g, or other
ccctttggttcaaattgccattttctccataacttcccgggtggctacctggcggtttcaaagatgaccaacttgggtgggccacctgttccggctcccccaggaaggatgcctatgggacctggtggtcctgatgggccaccttcacctgntctgaagactcgcttgtgtaacaagtacaacactgcagaaggatgtaaatgggggagcaaatgccactttgctcatggagagagggagcttggaaagcccctgcagatggacaactcgatgggagctc

SEQ ID NO: 1930 - DNA, 265 bp, Zea mays
  misc_feature: Incyte ID No: 700551759H1
  unsure 47, 181, 190: a, t, c, g, or other
agcaaatcggactgatgcttgtttcatccgtgtaattggaagtgagntagttcagaagtatgtcggcgaaggtgctcggatggtcagggaacttttccagatggcccgctcaaagaaagcgtgcattgtattcttcgatgaagttgatgctattggtggtgctcgttttgatgatggggtnggtggcganaatgaggtgcagcgtacaatgttggaaatagtaaaccagctgagggtttgatgcaagagggaacatcaaagttct

SEQ ID NO: 1931 - DNA, 214 bp, Zea mays
  misc_feature: Incyte ID No: 700551761H1
ttccaaagttttcctcaaaaagtactggggtcatgaagagggcacctcaggttgcagagctctaccattcacttatgagaagggactccaaaaaggatacttccggtggcggaatctgtgaagcagctaattctgcgaatgtgcggagtagcatgattggtgaaatcgagaaccggtctcccattgcaagctatcaaggcagatgttgagactc

SEQ ID NO: 1932 - DNA, 276 bp, Zea mays
  misc_feature: Incyte ID No: 700551762H1
  unsure 169, 197: a, t, c, g, or other
atgatggtgaaccggtcgggatggagagcgaaggttttgcaatctatgatgcaatgatgcgtatgaaaactgagatccacacactttgtataggagctgcagcaggccatgcatgtcttgtgcttgcagctggaaaaaaaggcaaacgttatatgttccctcatgccanagctatgattcagcaaccacgtattccntcttatgggatgatgcaagcatcagatgttgttattcgtgcaaaggaggttgtgcacaacaggaacacattggtcaaac

SEQ ID NO: 1933 - DNA, 273 bp, Zea mays
  misc_feature: Incyte ID No: 700551763H1
  unsure 210, 218: a, t, c, g, or other
acaacatgcagttccacttcatccggcccacgcacagcatgttccccttctttacggagctcacagatgcgtactccagggtgctgaggccggcagagggggtgcctgcactgctaaaagagctgagggaggggtcaaaggactgactacagtgttggagagatgcttgaaccggttggagtgggatcggtcgcaggagcaaggcaaggnagcaggcnagaggatgagttgagcaggaacggatgcaatgtcatgattgattggcatgatttt

SEQ ID NO: 1934 - DNA, 173 bp, Zea mays
  misc_feature: Incyte ID No: 700551766H1
ggttgataaatgaattttataaccatataaagtattagaaaacattttggtagccggcagtgcctctgtgaagataccatatccctacccatgctattcaatatccagtatcaatcactgttgactgttcgagatgaaaggggaaatgaaagtctgctgagctatgtttcatc

SEQ ID NO: 1935 - DNA, 281 bp, Zea mays
  misc_feature: Incyte ID No: 700551768H1
taggaggataaaagaagacactaccttggcacatgcctgttgtcacaatggacaaaagaagattagtgttgtgtgagatttttttcattcctttgatctattgcatgctatttgtaccctaatcgacaaaatagatgagactcaattcaggagcaaatcaccagtcctgttcacagtccaattcactatggctaaaatatcaaacttatgctccttgaggtttgttttttccttatcttccttaatatctgatgactgatggactggtgagttcatgactg

SEQ ID NO: 1936 - DNA, 284 bp, Zea mays
  misc_feature: Incyte ID No: 700551770H1
  unsure 252, 266, 271: a, t, c, g, or other
agtacgagaccacgccttccgtgggatcaatcggctagggtttcggagatgttcggccgcgcgccgaagaagagcgacaacacccggtactacgagatcctgggggtttccaaggacgcgtcacaggatgacctcaagaaggcctaccgcaaggccgccatcaagaaccaccccgacaagggcggcgaccccgagaagttcaaggagctagctcaggcttatgaggtcctcagcgaccctgaaaagagagantcttgaccagtatngcgangatgcccttcagg

SEQ ID NO: 1937 - DNA, 282 bp, Zea mays
  misc_feature: Incyte ID No: 700551771H1
  unsure 9, 15, 41, 48, 51, 60-61, 70, 77-79, 81, 84-85, 88, 91, 96, 102, 120, 141,: a, t, c, g, or other
actagttcnagatcncgagcggctcccctgttctccccgcnagcgctntcnttctctatnnactggcgangactccnnnancgnngangcnctacncgagangccaaggtcttcgccaangacgagcatccgggttagagnangancaaattgcaaccgaaaacaatggcgggagattccggagntcgcagacaaccaggttcaccaaggtcgnacngctgcgccctggaacncacggccacaacctcatcctcaangttgttgactncannnngtngtccc

SEQ ID NO: 1938 - DNA, 275 bp, Zea mays
  misc_feature: Incyte ID No: 700551772H1
tggagggtttagggaacaaacaagcgacctcattgtctggccgcctactgttatcattcacaatacttcgactgggaggaagaaagatggtcgcttggagggtttagggaacaaagaaatggataaaaaaatgacagaactagggttttctggtgggaagtcgaagtcctgtatggaaaggaaggacatatgggtttgacacttatcaagtttgcaaacaactcatctggctgaaggaggctgagcgtctgctgagtatctgagaggcaagatcg

SEQ ID NO: 1939 - DNA, 278 bp, Zea mays
  misc_feature: Incyte ID No: 700551773H1
  unsure 100, 223, 231, 243, 262-263: a, t, c, g, or other
ggagtaatatattaattgtgcagagctgtctagaacctgccgaaacaatctggagtaatatattaattgtgcagcgtgccaatctaatatgagttatgtnctttttggtgttcctttcaagggaaacgctcggcggcgaactaaagcagagcttgcgctacacgcgctgcgagcagtttctgtctaaagggcaaggtctgatctcatatttgagctccccgtngcactgcncgcccggccagncaccatcccggtcttgcgnncggcggcgtgcatgg

SEQ ID NO: 1940 - DNA, 276 bp, Zea mays
  misc_feature: Incyte ID No: 700551775H1
cggagtcttcgaagcagaatctcttaggctgcgctgccggattgctccttccgcttacattccaccttcaatactagcctgtgctggacgggtctacccgttggtagtcgctgcacaccccatggagcctaaccagatcgcgatcggcatgagcgacggcaaggtccatgtggtggagccattagacggggacccgaagtggggatcggcacctccacaggacaatggagcgcacccgcacccgcatccagcgatatcagcggcaccgtcgaccgc

SEQ ID NO: 1941 - DNA, 273 bp, Zea mays
  misc_feature: Incyte ID No: 700551776H1
tgagcatgttggtttgtggtctccaacactcattagaggtgttgatcgagaagcgatatacattcctaaccataagtttacagtttctatattaaggaataacactcagaggacccattggcgtattaagacctatcttgctattagccacatggatgctggaaaaattgggactatagttgctgacatgaggaaagttttggcaaaaaatccgcatatagaacaacaaaagctgcacaggagagtattctttgagaaattgatccaaaaatc

SEQ ID NO: 1942 - DNA, 274 bp, Zea mays
  misc_feature: Incyte ID No: 700551777H1
gcctgatggcgagcgtggggagagagcccgtgggaaagaggccccgccgccaccttcattgccgccaggggaacctccgccagcgagctcggacggcgggcgaggggagggagatgaggagcgagagggttggtggcggcgttgcgggaaccgcccgtgccgtccctcacgacgacgcggggggtgtagaatgaattattgattggctaccaactcatattatgcgtcgagaagatctactactaacctggacagattaagcatgcctgcgccg

SEQ ID NO: 1943 - DNA, 275 bp, Zea mays
  misc_feature: Incyte ID No: 700551779H1
  unsure 171-199: a, t, c, g, or other
catggaagctctgtacaagaaggtccatgcggccatccgtgctgatcctagcatggccaagttcaacaaaggcgcaaccaaaggagcacaagaggtacaaccccaagaagttgacctatgagcagagaaaggccagactcgtggaaaggctcaacgccctcaattcctcgnnnnnnnnnnnnnnnnnnnnnnnnnnnnngtgaagtgctatcctatttggcgatcagaacttgcgcaatggcatttgttgttcccttactcctgtaacaggcatt

SEQ ID NO: 1944 - DNA, 276 bp, Zea mays
  misc_feature: Incyte ID No: 700551780H1
  unsure 41, 181: a, t, c, g, or other
aaattttcaagaaaagtggccttggtccaaggattggggancaatatggggctccgtttgacgaagccgaatggggacaatgcagaagtgaaacctctatatttcctttgatgacctcttcagaagtagtgaacccaacagagggaccacacactcagcctgttgcccctgctggtgctcntcaggaacctctacataattcatctgctacttgtgttgtagagggatcgcatttgatcatgccactgcaaatacttgtgctgagggtgtaacatt

SEQ ID NO: 1945 - DNA, 247 bp, Zea mays
  misc_feature: Incyte ID No: 700551783H1
gcccagcgcagagccgccgcagcacatcgctatctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacacgcggggcgttactccaagaagcggttccgcaaggcgcagtgccgatcgtccagcggctcac

SEQ ID NO: 1946 - DNA, 279 bp, Zea mays
  misc_feature: Incyte ID No: 700551784H1
taggaagaccgattcagagttcttggatgctgaaaggaattcccatagagatgatgggtcaacagcatcaacagcagtgctagttggtgaccatctttacgtggcaaatgttggagactcaagggctgttatatcaaaggctggcaaagctattgcgctctctgaagatcacaagccgaacagaagtgatgagaggaaacgaatcgagagtgctggtggaataattatgtgggctggaacttggagggtaggtggtgtacttgcaatgtctcggcattg

SEQ ID NO: 1947 - DNA, 272 bp, Zea mays
  misc_feature: Incyte ID No: 700551787H1
  unsure 157, 165: a, t, c, g, or other
atcttttcttgtgaatttgtaagcttcaatctcaaatccgctggccccttcttttagaatgaaccgaacctccaatattctcttgatgatgcttaacatacagagaaacggtgtaacacaaaacagcacaatccatttctttgtactgtttcttttncaaatatnttactgttttcaatattgaatctatgtctgaatgaattgctagcttatctaattcatatttacattctgacattcaatatgtcttccaagtttgatatagttatgcc

SEQ ID NO: 1948 - DNA, 275 bp, Zea mays
  misc_feature: Incyte ID No: 700551789H1
  unsure 2, 63, 66, 171, 186, 248-251, 256: a, t, c, g, or other
cngatggacctgtgccgcaagtacgcctttgggaagatgctcgtgataggctctgagccaccnatnaagctgaagggcctttggctcttccgtggccaggatgttcccaagtttgtaatggacgaggtctatgacatggagctctacgagtggaccaaggtggacatctcnttcgaggcccagaanacagcgtgtgaatgcgatgattgaggaccaggagccctttgagggcgaggccttgcttgacnnnnaatgnttcaatgagtgtgcttgcc

SEQ ID NO: 1949 - DNA, 274 bp, Zea mays
  misc_feature: Incyte ID No: 700551790H1
  unsure 186, 239, 272: a, t, c, g, or other
gcggatggacctgtgccgcaagtacgcctttgggaagatgctcgtgataggctctgagccacccttcaagctgaagggcctttggctcttccgtggccaggatgttcccaagtttgtaatggacgaggtctatgacatggagctctacgagtggaccaaggtggacatctctgatgaggcccagangggagcgtgtcaatgcgatgattgaggaccaggagccctttgagggcgaggcnttgcttgacgcgaaatgcttcaagtgagtgtgntg

SEQ ID NO: 1950 - DNA, 272 bp, Zea mays
  misc_feature: Incyte ID No: 700551794H1
atgatctaaactttaagaatcagcctaatgatggagcccatattctctcagcccagcatctgggtgatctgtacagagattttgtcaaggatttccctattgtatcaattgaggacccttttgatcaggatgactggagttcatgggcatcattgcagtcctcagttgatatccaaattgtgggtgatgatttactcgtcacaaacccaaaacgtatagcagatgctattgataagaaggcttgcaatgctctgttgctaaaggtcaaccag

SEQ ID NO: 1951 - DNA, 281 bp, Zea mays
  misc_feature: Incyte ID No: 700551796H1
aaggaaggcccagaccggtgcgcggcctgcaggaagcgtgttgggctgacgggatttagctgccgatgcgggaacatgtactgttcggtgcaccgctactccgacaaacatgactgtcagttcgactatcggactgcagcaagggacgcgattgccaaggccaatcctgtggtgagggcggagaagctcgacaagatctgaggcgggcattgggggagcgaaatggttgcaatctgcaagaattccaacatgctgtctttgctgcgttatcattgaaattg

SEQ ID NO: 1952 - DNA, 296 bp, Zea mays
  misc_feature: Incyte ID No: 700551802H1
cttctgaaagatacaaaagtgtctctttctgcaaaccatctgcagaaactgtgtttatcttttcaactaaccacaccgcttgggcacacatttaaacctcaccaggtgttcttgaaattgaggcatgagagtaaggttgaacacttattcgtggtacctggctctgcaaggcagttcaaaattgttcttgtgagtatctctacactggaattggcttcgttagttctttggatgctcataattcatgtggcaatgtagccaatactctagaccaggcatgaactatcttgagaagt

SEQ ID NO: 1953 - DNA, 297 bp, Zea mays
  misc_feature: Incyte ID No: 700551803H1
agcaaacatcaaactcattctgggcacacaattgaatcaagtgaagctactagtaggagacggagtaaccgggaatggaaagggattggtcggaagggtaatgaaaaatttccgcttcgaaatgtactaactgatattcttcatggggaggacaaaagatcgcaaaagtccaatgaagtacgaccccctccatacaaaacaacagaacgacaggaagcgtgaaagggatgatgagacacatcaaacaaagaaggactcctcatcacgctccatgcttggtgatggtgcttcccgtcg

SEQ ID NO: 1954 - DNA, 293 bp, Zea mays
  misc_feature: Incyte ID No: 700551804H1
ctcgtcgatctacacacatacatagtttcttctactacacgacgacaaacatggggaagcctgcgaagatcggagagtggggtggatacgccggcgatcgtcgggatctgagggctactccggaccggctgaccgaggtgaaggtcacggcggacaacagcagctgcatccgctccatctccttcatctacatcggagccgatggcaagccgtacgaggaggggccatggggtttcggccatgatggcacggagtacaagattgatctgtgcaggttcgacgagagcttgacg

SEQ ID NO: 1955 - DNA, 201 bp, Zea mays
  misc_feature: Incyte ID No: 700551808H1
  unsure 2, 7, 28, 30, 36, 41-42, 46, 54, 106, 112, 115, 151, 180, 197-198: a, t, c, g, or other
tntctgnagatgaccgcaaccagcttgngnagatgnaagtnnccancacgtgcncagtgttttgtccaattgctggttgtggtgctcatctagattgcctggaggngtttgnggnccactatgtcactcgacatactgcttcatgctctgnatgctcgcgagtttatccaacttcaaggntgctgagcatccatgtnncga

SEQ ID NO: 1956 - DNA, 296 bp, Zea mays
  misc_feature: Incyte ID No: 700551809H1
acaatttctcgcgctcctaccgccgccgcttcgttctctaaccttggctcccgctccctccgcaggagcatactcaacaccgccttgaggaccccccaactcgccggctgcagccatggtgaaatattcgacggagccaaccaaccccaccaagtcaaccaaggccatgggccgtgacctacgtgttcacttcaagaacacccgtgagacagcttttgcccttaggaagttgtcactcaccaaggccaaaaggtaccttgaggatgtgattgcccacaagcaggccatcccgttcc

SEQ ID NO: 1957 - DNA, 291 bp, Zea mays
  misc_feature: Incyte ID No: 700551811H1
  unsure 46, 52, 86, 110, 216, 259: a, t, c, g, or other
aggtaattgaatctgttgaagggcatgagggtgcatttactctcanatctgncacaggtcctcttcctgttgcttttggtccatcnaatcctatcagtataaagaaccanagccaaattaatgtttctggacttcccattcctctgttcaagaaaacagagactcatcctcacagagtcagttactagacaatgatattcaccgaagcactcttgntccccagaaaagctttctagctaatatcagcagacagattgangcagagaaagctttccaactcgagaattcatc

SEQ ID NO: 1958 - DNA, 291 bp, Zea mays
  misc_feature: Incyte ID No: 700551812H1
  unsure 7, 43, 53, 55, 87, 115, 203, 208, 217, 229, 258, 263, 273: a, t, c, g, or other
ctccttncttatggaggggctccataatcagctaatggagtantctgttatcnanttgtgtgaaaggtgtgtgattgcatgtgctanttattcagcattctggatccgctatgtncaatgtatggaggatacaagggagtctagacctagcacacaatgccctggctcgtgctactacatgtgtttgtcaagaagcagccggngatcnatctgtatngtgctcgctttnaggagcttaatggggacatttctggagcncgtgnagagtatcancatcttactcagattatg

SEQ ID NO: 1959 - DNA, 294 bp, Zea mays
  misc_feature: Incyte ID No: 700551814H1
  unsure 74, 79, 119, 178, 252, 267, 273, 286: a, t, c, g, or other
gggagatagtgatggggaagaacgtgcacacctcctgcttcgccgtgaaggagcccgacgcggacgacgagganaccgncgagagggaggcgaagatggccatcatcctcgcgctctancgccgctcgctcgttgaacgcaccaagcaccaccttggagggaggtgttccccaaaggnatattgtcatgcttctacgtgagtcccatattcagtattcaaagcagcaagaatgtacaggttggattgcgtcnaagtcgacatcttangtctgnggaaatagattgngctgattt

SEQ ID NO: 1960 - DNA, 282 bp, Zea mays
  misc_feature: Incyte ID No: 700551816H1
  unsure 36, 51, 167, 192: a, t, c, g, or other
taagaaggcacggaaggcctccgcatgagatgggtntcttagaagcagggnacttcaccggtcttcggcttggccttggccttggcgaagaccgtgaagttccctgcttctaagaaggcacggaaggcctccgcatgagatgggtttctttaggtctaagctctgantgtggttggtgtcagttaggtactnttcaaaactaagtgtgtgcccaaagtgtctcaggcggtgtgttatgtgctagcaagttctatctatcagagtgttttagtttaaaacacc

SEQ ID NO: 1961 - DNA, 291 bp, Zea mays
  misc_feature: Incyte ID No: 700551817H1
  unsure 268: a, t, c, g, or other
caatccgtagacttaggaaaactgacaacaacaggattgctaaagcttgtggagcagttatagtgaacaggcctgaggagctccaagaatctgatgttggaacaagagctggcctgttcgaggttaagaagataggtgatgagttctttccttattgttgactgtaaagatcccaaggcatgtactgttctgttgaggggagcaagcaaggatgtattgaatgacgttgagagaaacctgcaggatgccatgtccgttgcaaggaacntttgaaaatccaaaactcctccg

SEQ ID NO: 1962 - DNA, 295 bp, Zea mays
  misc_feature: Incyte ID No: 700551818H1
  unsure 294: a, t, c, g, or other
attctgaaaaaataaagagagatccatcaattcctgaaaacccagaaccatggcagaaaacctgctgctgtttccatgattaaatctggaaaaaaggatgatatttctgaaatgaataggggcatgtttaactgggcttcaaggtggtggccatttgggaaatcagatgcagatagtagtacaaccaacataaatgccactgatgaaccgaggactgactctattgaagatttgaatcttcaaacgctccaactaatggaagtgcacaacaggtggttcatgaaatatttacana

SEQ ID NO: 1963 - DNA, 293 bp, Zea mays
  misc_feature: Incyte ID No: 700551819H1
  unsure 230-231: a, t, c, g, or other
atttgattgccctgcctgttgatggtgaaactagcgtctgtttgatagaacgcatttttgccggccagctccactacgagaatttgaaggaaatttaccaacgtggggagctgaatttttttgctcctctcattttccactctccacccgcgcctgactgcagctggctgcgatccccctatctaccgcctgattcatctttgtctccgtcggtgccgccctctacgccnncctgaccccagggatggctggaaaaggaagctatgtacctccacaatatatcccttatacag

SEQ ID NO: 1964 - DNA, 288 bp, Zea mays
  misc_feature: Incyte ID No: 700551820H1
  unsure 154, 256, 271: a, t, c, g, or other
ggcaaaaccaggttgccgcaccagatgggctactccatctacgggctatgggcgcccaactccgctgcctacgctgtactacgctgtcgtcccttcgctgtgcctgctcaagggcacccctctgttccctgagctcacgagtccgtggatcgcncctttcgtctacgtcgcggtcgccaagaacgtctacagcgcgtgggaggcgctgtggtgcggagacacgctgagagggtggtggaagggcagaggatgtggntggtccggagaaganctcgtactctacggctt

SEQ ID NO: 1965 - DNA, 188 bp, Zea mays
  misc_feature: Incyte ID No: 700551821H1
gaaaacacttatcatagaatctgttgatttctttcctgttggtgttaaagttcattggggtcgcattgcataataggccctagtgatcaagtgcgcaatttactgatcgttgtactgcttatttgtacacttgctgcttgaattgttggatcatgtgttcagatatcaaattttgctgctggattact

SEQ ID NO: 1966 - DNA, 291 bp, Zea mays
  misc_feature: Incyte ID No: 700551823H1
  unsure 256: a, t, c, g, or other
acccgttgctggtggcttccctgccgaattggtgggagagggtcgcgtttgtgcttttcagcttcaccatctgcgggattcagcacgtccaattctgcctgaaccacttctcgtccgacgtgtatgtcgggccacccaagggcaatgactggtttgagaagcagacggcaggcacgctcgacatcctgtgctctccttggatggattggttccacggtggcctgcagttccagattgagcaccatctgtttccccncctacctaggtgccacctccgtaagttgcgcctgc

SEQ ID NO: 1967 - DNA, 199 bp, Zea mays
  misc_feature: Incyte ID No: 700551824H1
  unsure 8, 13, 33, 49-50, 77, 92-93, 147, 190-191: a, t, c, g, or other
catttcanaaggnttctagtgaacaggatattngcaatcctagtgaganntgtgtaacagaggaaacccaagtattncatatcaaagtttannagtcttatcgagggttcgcggtatggatgtatcctgtttcaaatgatttctccnaatgtatgaatgaaaacggttaatggatgccccagtaaaaaannaagtaaaa

SEQ ID NO: 1968 - DNA, 291 bp, Zea mays
  misc_feature: Incyte ID No: 700551825H1
  unsure 4, 178, 197, 230-231, 271: a, t, c, g, or other
tgtnagttgcactttgaggagagacgagatcatgaggaagcaatactcccctgtgctctccttgtgcctgatggcccttgtcgtagctgctatggtctgtgtcatgtacaccacctcggcacaagcaggaaggagtggctacaactcgtacgaacctgatggaaggggtggatacaanctactgttcccatcaacgncggtggcagcccctagctaggcggtggatcggnntcctgtatcagaaatcgaaataatataagactgtcttctncggatcacactgccgctccc

SEQ ID NO: 1969 - DNA, 289 bp, Zea mays
  misc_feature: Incyte ID No: 700551826H1
acaaagcaaccattaacatgcttcgcagggttgaaccttatgttgcatatgggtacccgaacttgaagagtgtcagggagttgatctacaagaggggctacggaaaactgaacaagcagaggatccctctgtctaacaaccaagtcatcgaggagggcttgggcaagcacaacatcatctgtattgaggatcttgttcacgagatcatgactgttggcccacacttcaaggaggcgaacaattcctttggccttttaagctgaaggccccgctgggaggtctgaagaag

SEQ ID NO: 1970 - DNA, 292 bp, Zea mays
  misc_feature: Incyte ID No: 700551827H1
  unsure 286: a, t, c, g, or other
atccggcaatgatggatgtgagcccatttaataaaggcagagaaagcactatttggggtgtttcactacatgtttggttatcttggttttgatgggttcacaagcacgttccaagataaactcttcaaagggtatgacatggaaatacacaaccaaatattctacacgacagtgtggctcttgtgcttcttagtttaagtgggctgattctccagaatcatctgattccagctgtggattttatgtttcatcacccagattgcttctctgatgttctaatcctgtncagcgt

SEQ ID NO: 1971 - DNA, 287 bp, Zea mays
  misc_feature: Incyte ID No: 700551828H1
gccagagatgagctccacaggatgctgaacgaggatgagctacgtgatgctgtgctgcttgtttttgccaacaagcaagatcttcccaatgccatgaatgctgctgagattactgacaagcttggattacactccctgcgccaggacactggtacatccagagcacttgtgccacaactggcgagggtctgtatgaaggcctggactggctgtccagcaacattgcgagcaaggcttgaggcctaccttgaatgtcaaccgcgaatgactaggagctccggatgtat

SEQ ID NO: 1972 - DNA, 291 bp, Zea mays
  misc_feature: Incyte ID No: 700551829H1
ggctgcaatggctcgcacgcttggagggactgccgcgatggccgtgcatgagaaatgtggtgttctgcccccgttcacgcttccacctattcttgatgcatctgatgctttagcttcatgctgcttagcgttagtaaagcctaagcactagactacacaatagagggcgtgagcaatggcgaagaagggtaaacttcaatcttcggctctttattgtgttgaccccaggttatataaattatgtttttgggacgagatgtgtaacgtgcctaagttccaggtttttttggc

SEQ ID NO: 1973 - DNA, 293 bp, Zea mays
  misc_feature: Incyte ID No: 700551830H1
  unsure 32: a, t, c, g, or other
gaatcagggaacttccacagaacagtaagatnctagccactcacactgacagtccagatgtaacttatttgggatgttgaagcacaaccaaatagacatgctgtcctaggagcaagcgagtctcgccctgatctgatattaacaggacataaggaaaatgcggaatttgcgcttgccatgtgtccagcagaaccatatgtcctatcaggaggaaaggacaaatctgttgtcttgtggagcatccaagaccatatatctgccctggggattcctcgtcttctcctggagcatct

SEQ ID NO: 1974 - DNA, 151 bp, Zea mays
  misc_feature: Incyte ID No: 700551832H1
  unsure 35, 46, 63, 90, 92, 104, 113, 117, 119, 121: a, t, c, g, or other
ggattctggttaaccagtgtgtggtgtggagtggngtgtactcctnattcctagcaacagttnagccagtgtacatgccatgtggacgtngntaaaccacaagnatgagccantggngnangggatgccccataagcagagtctgggcact

SEQ ID NO: 1975 - DNA, 96 bp, Zea mays
  misc_feature: Incyte ID No: 700551834H1
aatgggtcgaatatatcagttggactttgtagcacggacagtttggaaccaatagcagctgcttggtggtggttgttccacaaaattttgaagtcc

SEQ ID NO: 1976 - DNA, 240 bp, Zea mays
  misc_feature: Incyte ID No: 700551836H1
gggagccgactgcgccgagatccttggccggagcgccgcgtacctccaatggaatctcgctctaccgcgggtggagcttcgactccgaatctgctataacccccaagatctgtatcacgggaagcacatctgctagcctacaccagattcttccatggttgtattatcacaaggtcattggcgtttcccattctttctttttgttgaaggagaggctgcaaagccagctgtcacctctgt

SEQ ID NO: 1977 - DNA, 291 bp, Zea mays
  misc_feature: Incyte ID No: 700551839H1
  unsure 86, 111, 113, 116, 124, 128, 133, 167, 206, 234, 258, 281, 290: a, t, c, g, or other
caacaagtcttgaagcttttcagcagggctcctagcaagaggaagacgtctgaacaacttatggatgcttttttacattttattanacacatacatcaaatattatatgancncanccactatnccanaaggnatagtaaatacgagacagagggagtatctttgtnataaaatgtaaaaaagcatccataagttgttacagacgncttcctctgtctcgatttactattcctnttgggatagtggttgattcatatncgtttgatgtatgtgtttatagntgtgtctana

SEQ ID NO: 1978 - DNA, 283 bp, Zea mays
  misc_feature: Incyte ID No: 700551841H1
  unsure 268, 276, 280-281: a, t, c, g, or other
cacatttctattatcctattttagcctgctatatccatgtatgagccttatgggaactctgcaactactatggatcctcttatacattatgttcgacatgcagacaaggtattatattgagttggaccaataatccttcatatttattgatgtgaattatgttgtactggtgtcctgtccttttgtctgtgcttataatttgtaattcctagctgctgatatggtatgatggatgggaggtggctgaaatcgttcggataagtgtcanttgttgtnttcnntg

SEQ ID NO: 1979 - DNA, 292 bp, Zea mays
  misc_feature: Incyte ID No: 700551842H1
  unsure 13, 59, 90-91, 99, 114, 135, 138-139, 199, 231, 258-259, 285, 291: a, t, c, g, or other
ctcggagggcggngctggactacctgggcaaccccaacctggtgcacgcgcagagcatncctggccgtgctacggcttccaggtcatccnncatgggcntcgtacgagggcttncgcatcaacggcctcgacggngtnngcgagggcaacaacctctaccccggcggccagtacttcgacccgctgggcctcgccgacnaccccgtcaccttcgccgagctcaaggtcaangaatcaagaacggccgcctacgccatnntctccatgttcggcttcttcgtccangccatng

SEQ ID NO: 1980 - DNA, 108 bp, Zea mays
  misc_feature: Incyte ID No: 700551843H1
  unsure 12, 18, 23, 41, 50, 55, 59, 84, 105: a, t, c, g, or other
gagagcttgaancaccanccatngcggagcacgacctcacngcgctgatngcggngcantgggaccggcacctggtcttcccgntgctggagttcctccaggagnggc

SEQ ID NO: 1981 - DNA, 283 bp, Zea mays
  misc_feature: Incyte ID No: 700551845H1
  unsure 55, 189: a, t, c, g, or other
ccaagttctccggtgggctcttggttctgtcgagatcttcttcagtcggcactgnccgctgtggtacggttacggtggcggccgtctgaaatggctccagaggctctcctacatcaacaccatcgtgtacccgttcacttctattcctctcgttgcctactgttgactgcctgccattgcctgctcacnggaaagttcatatacctacgtgtccaacgctgcaacgatatggtttcttggcctcttcagtccatcatcgtgagagcgtgttggagctgcggtg

SEQ ID NO: 1982 - DNA, 292 bp, Zea mays
  misc_feature: Incyte ID No: 700551846H1
gggcctcccccgccaagggcagccaagaaggcggctgctcctgccaagaaggggaaggcagcggcggctcctaagaaggtggcaaccccgaagaaggctgctgctgccgctccggccaggaagggcgtggccaggaaggccaagaagtaggctgcctgccttgtcgctggcgagatcccccctcaattccgcctatagattcccctcttgcctggattttgatccaatcgtaatattgtcagtagctctagattcgtcggtagctccagcatgagtgtcggtggtagttctg

SEQ ID NO: 1983 - DNA, 289 bp, Zea mays
  misc_feature: Incyte ID No: 700551847H1
  unsure 278-279: a, t, c, g, or other
gctgagaaaggattgaggctgagtgagaagacatttgctgcgttgatgccagggctttgcgatgaccagggcagggtggcagaggcccggaaggcagtggatgacatggcagagcggaggctcacgccaaaggacaagtcagtgtttctgaggcttgtcacaacgctgtgcaaggctggtgacttggatggggcgctcgaggtgcaccggaagagcgggcagttcaagcatgtgctggtggatttaagacagtatggagtgctgatggaaggcctttnntggcggcaag

SEQ ID NO: 1984 - DNA, 291 bp, Zea mays
  misc_feature: Incyte ID No: 700551849H1
acattgctgtcaccgcctctccaacctgctttcactagtgagctgcaactgcaatgtcttggacgagaaccaatattgattgataaaaggagagcagaccaagcaccttacgctttgctgtcctacacacagtggtatactgggtactcaacgagttcaaaaatgatcttacggagttcaagtaagccatgcgttttaagagcatgtttgttttagtttatagattatataacctagattatatatgagattaaataatctgaattatataataagattaataatttggac

SEQ ID NO: 1985 - DNA, 290 bp, Zea mays
  misc_feature: Incyte ID No: 700551850H1
agaccatatatgtgatattcagcaacttcaaaaaggttcggttttctgaggccgcaaccttgtgcataccacacctggtttgtgctttgaaggatggaaatgaggctgcccaagagagcgtgcttgacaccctttgcttgcttaaagaatcttggccgcaaatgaatgaagacatcgctaaagcccagtccctgatttcagctgaagccatacctgtactacaaatgcttatgaagacatgtcctcccagttttcacgagagagccgatagtttgcttcatgcttgcctg

SEQ ID NO: 1986 - DNA, 284 bp, Zea mays
  misc_feature: Incyte ID No: 700551852H1
catcaagttgatgaatcgataagtggctagagacaaccaaagataggacagtctgcacagtagtaggcttcacgatggggctaaaagtcccatcaaaatcaatgccagggcgttgcgtaaatctacagtgaacctagcgagccttgtacctttcaagggagccatcaacattaaatttgtgcttgaaaatccacttgtcggccacaatgtttgcaccaggggggcgaggcaccaaatcctaggtgtgattctgcaacagtgctgcatatcatcttccatggcag

SEQ ID NO: 1987 - DNA, 287 bp, Zea mays
  misc_feature: Incyte ID No: 700551853H1
  unsure 13, 20, 27, 31, 34, 61-62, 82, 137, 159, 188, 190, 195, 234, 273: a, t, c, g, or other
tacaaggaccaanaggaganaggctgngatnccngatggtagacaccactatattgggccnngatcctgaacagggccaaanaactgccttatattgctagtatgggaatctatgtttttagcagagatgtgatgcntcggcttctcagagaaaatttncctgcagcaaatgactttggaagtgaggntnttccnggcgcaacagaaattggattaagggtgccagcttacttntatgatggttactgggaagatattggtactattgaagcntttatagtgcaaac

SEQ ID NO: 1988 - DNA, 290 bp, Zea mays
  misc_feature: Incyte ID No: 700551854H1
  unsure 68, 255, 257, 259: a, t, c, g, or other
aagagctgaggcttcgccgcgaaaccccagacctcgcgccgccccttcccctccgcggcgtcgtcctncgcacgctctccgatccaagatgtataagctggggagaggaaaccgcgacaaggtgcagcagttcatgaccattaccggcgccagtgagaaggttgcccttcaggcactgaaagctagtgattggcacttggaaggagcttttgacttcttctatagccaacctcaggtttctgtggtcaatactcngncntccttgaagatattttcaacagatataaaga

SEQ ID NO: 1989 - DNA, 288 bp, Zea mays
  misc_feature: Incyte ID No: 700551855H1
  unsure 129, 248: a, t, c, g, or other
aagaccttgaagcaaataagatcaagaaagactcaggtgttacttgatgaactttgcgacttaaagagaaaggaacaaatgctgcaagacgctaacagggttctgaaaaggaagctgcacgagtttgangcagaggctgcttctcccccacaattggcgtggcaaggcggaggcggcatgttgtcccatgaccctccacagccagaacacttcttcgtggctctggagagcaacgcgcctctggcaanctacataccatactatggactgaaccagcagccagagcca

SEQ ID NO: 1990 - DNA, 286 bp, Zea mays
  misc_feature: Incyte ID No: 700551858H1
  unsure 93, 220, 242, 258: a, t, c, g, or other
cctcaagcaggtcggcgcctacgccgacgccgagaaggccaaggactccgtcggcatccgccccggcaagggtaagatgcgcaaccgccggtncatcaaccgcaagggcccgctcgtcgtctacggcacagagggctccaaggtcgtcaaggccttccgcaacctccccggcgtggacgtcgccaacgtcgagcgcctcaacctgctacgaccttgcccncggtggccacctcgggcgtttntgatctggaccgagancgcgttcaagaagctcgaggaggtgtat

SEQ ID NO: 1991 - DNA, 285 bp, Zea mays
  misc_feature: Incyte ID No: 700551859H1
atagttctgaagggtgtggtccgggtgacaaatttggcggatgctgctgagcacattggtgaagttcttaggcgtgttaaaaaggagcatctccaaagagcgtacaaaattcaagattggtctgatgataacgattttcttgtccagctgtgcaggaccactggaaaacttctcaagggcggggagcctgatctgacaacagcagccaagatggtacttcatgactggcagaggggtaaaatccccttctttgtaccccctccgcagcaaagcgacggcggtgca

SEQ ID NO: 1992 - DNA, 285 bp, Zea mays
  misc_feature: Incyte ID No: 700551861H1
  unsure 125, 193, 277: a, t, c, g, or other
cggaaacaaaaaatcgtcagtgtgatcctgtgagggttcatcttcttctccaagcagatttctgttggttagctactcacgtcaactcaaaatctcgcgttcacctcctaacatagtctctccgnctcccgcttacctctttggctctagtctatccccctctcgattcttcctgtgagcgacagtggtgganctgcgccgctctcaccttcgccggcgacgggcattcacaagtagtgatctcttgactaaggcgtagtggtgattaaagagcttnacaatgag

SEQ ID NO: 1993 - DNA, 285 bp, Zea mays
  misc_feature: Incyte ID No: 700551862H1
aatcaagtacttggtgtctgagggctgcatcaagccattgtgtgaccttcttgtctgccctgatccgagaattgtaacagtttgtctggagggtcttgagaatattcttaaagtagggcagcatgacaagaccatgggtgcaacaggtgacactaacgtcttagctcagatgatcgatgaagcggaaggcctggaaaagatcgagaacctacagagccacgataacatgaaatctatgaaaaggctgtgaagcttcttgagacatactggatggaggaggagatg

SEQ ID NO: 1994 - DNA, 290 bp, Zea mays
  misc_feature: Incyte ID No: 700551863H1
  unsure 17, 134, 234, 282: a, t, c, g, or other
gcttgttgagttaggangcgcggataacaacttaaacaccagcaatgtggaaactacagattacctcatgttgccacctgacagagaactgtcggctaatgattacatggaactaaacgatctccttgctcctngtcccaagcttccccagtgaattttctgctcaggacaatcaatatatgcagcattctcttgctcagtacaatggacattatgatctgtcaggtccttcgngccccaacaatgcctagcatttcgatgtttttcctcccaataatggancctcttaa

SEQ ID NO: 1995 - DNA, 289 bp, Zea mays
  misc_feature: Incyte ID No: 700551864H1
cgtctccttggtcctggtctcaacaaggcaggcaagttcccgaccctggttactcaccagggaatccctcgagtccaaggtgaacgagactaaggcaaccgtcaagttccagctcaagaaggtcctttgcatgggtgtcgccgtcggcaacttggcgatggaggagaagcagatccagcagaacatccagatgagcgtcaacttccttgtttcccttctgaagaagaatggcagatgtgagatgcctgtacgtcaagagcacctggggaagccatacaggtgttctaag

SEQ ID NO: 1996 - DNA, 291 bp, Zea mays
  misc_feature: Incyte ID No: 700551865H1
  unsure 28, 83, 276: a, t, c, g, or other
gccggccagctgttatcgtaatcgatcnggttgccactttgaccgtcctgactcggatctaacgaatctaaagtcgtacacgncagaactgcagaacatccacgtatatatagtcgactgtaaggctgtatccagcagctctcaggccttctttgaaataagcgaaaatttcctgtttcatgtgaaaataagctgattcctataaaatttctttatgatttctataaaattcctatgttacaaaggaggtcttatccaatctcctactggttctgntgtatagcttccctc

SEQ ID NO: 1997 - DNA, 284 bp, Zea mays
  misc_feature: Incyte ID No: 700551868H1
  unsure 268, 271, 277: a, t, c, g, or other
atacatctgtggcttccaatcaaggtggagcaagatatggggaaagctcttcaccacaagataacagttctgaggccatgaaaacggactctacatgcaagatgaagtcaaattcagatgctgctccaataaagcagggctccaatggcagtagcaataacgatgtgggatccagtacaaagaatgttgctgcaaggccttcgggtgacagggagagagtagcgtcaccattagccatcaaatctacccagcatgcctcagcatttcntantatacngattcaa

SEQ ID NO: 1998 - DNA, 279 bp, Zea mays
  misc_feature: Incyte ID No: 700551869H1
  unsure 39, 217, 219, 258: a, t, c, g, or other
gagaggaatatatcttttggtgcaagactcgaggaagcnaacacagagcgatggagattatgtgccaactcctgtctatgagatagcccacgattctttcaatgcagaggatgagctcccttctgacggtgaaaccagggagaatgaagagtctgaaaggcatgacatagctgataatgcccagatggagtctctgttggtgtagcagataacagtntnccatattctcggtactaagtcattgatggtgctaagacnggcattgaagcaatatgtctc

SEQ ID NO: 1999 - DNA, 285 bp, Zea mays
  misc_feature: Incyte ID No: 700551870H1
  unsure 255: a, t, c, g, or other
acctgagtttggcgccttcagtgacgccagatttccttcttaaactttagcaaaagtacttagtttaccgttatatattcaaaaattattcttctcaagaaaggtaggggactgattgtgtcttcgattgagacagacccacaaacatgacaatggatctgttttgaacaatctgtgtccataaccataccatttagagatacacagtaattctcatgtagatgaactcatgacccaagatgcaaatatttgccnttgaagtgcacataagaccatcaaataaaa

SEQ ID NO: 2000 - DNA, 88 bp, Zea mays
  misc_feature: Incyte ID No: 700551871H1
  unsure 71, 74, 82: a, t, c, g, or other
taggtgtccagttaggctacactgttcatttttgcggtggtatgcaacattacttgttaatccgaacaggnaancccatcangattac

SEQ ID NO: 2001 - DNA, 278 bp, Zea mays
  misc_feature: Incyte ID No: 700551874H1
  unsure 22, 32, 59, 78, 115, 130, 186, 222, 265, 271-272: a, t, c, g, or other
catgcacttctgagggtcacgnagatgatatncagaaagccacggagaatttcagtaangtgcacattattggggatngtgggtttggcactgtctacagggcagcacttcctgnaggtcggagagtagncatcaaaaggctcatggtggccatcagttccaaggtgatctgaattcctggccganatggagacaattggaaaggtgaaacatcctaaaccngttccactacttggctactgtgtatgtggtgatgaaaggttcngatatnngagtac

SEQ ID NO: 2002 - DNA, 284 bp, Zea mays
  misc_feature: Incyte ID No: 700551876H1
  unsure 40, 136-137, 143: a, t, c, g, or other
aggcgaggctgggatcatcatcattcatctggttctttgnaatctctacaagcagatgcagataagcaccacatattaatggactcctcgtcatctcctaggttcagcgacaaaacgagcagtaacttggagaggnntgagancgacttggttattcggccacagaggcttagtgtttctgccggaaggacatctacagacagatcaccgaagcacatagaactagtttcaaatggtcataataacagtcaaatgaccaggtccgacctctactgagtttattg

SEQ ID NO: 2003 - DNA, 190 bp, Zea mays
  misc_feature: Incyte ID No: 700551877H1
  unsure 58, 65, 80, 129, 145, 177, 185: a, t, c, g, or other
gctgcaaaaaacggatccgtctagaccatggcatggaatgaagcttcctattcagcancaagcanttgactgggggagancactagcctagccttcaaactctcgagtcatggaatctagagatctgcnaccggcagcttcatcngagcagggttgcaccgagggcaaacttgtgtncatataanaagca

SEQ ID NO: 2004 - DNA, 297 bp, Zea mays
  misc_feature: Incyte ID No: 700551880H1
  unsure 17, 21, 27, 33, 35, 38, 48, 53, 63, 89, 194, 204, 234, 261: a, t, c, g, or other
ctcaacgtgctgatgtnttanaagcangaaaantnctncatttagggntgcangtaaaccgtnatccgaaaagagtatgaggaacttcnatcaaagaataattcactaaaggaaaaacttgaaggcaaacaacacaaaactgatgagggcaggacttaacaacaagctgcaacattctggcaatgacatccagngtaaaagganactaatcgagctatctgcaatgcttgcatngcctggccctaactagattattgggangcgcaattgtagtatgcgtgttaactccttacttta

SEQ ID NO: 2005 - DNA, 283 bp, Zea mays
  misc_feature: Incyte ID No: 700551883H1
  unsure 68: a, t, c, g, or other
gacaaagtgaaaaaatggcgagtgatgttttcgtagcctcgtgtatccatggaggcacacacattgtngagagaagtgcgcccgggtatgtctacaattgctttcatatggttatattgctccagattgttatcttgtggatttacatgaacgtatacccctaaggtcaatgagaagagcatgtctacaccttggtgtcgtgcttctgagctggtcaccgaaagaagccagtaggtgagttttgggacgacatcaacattgtccatcgggatcaagttgatga

SEQ ID NO: 2006 - DNA, 284 bp, Zea mays
  misc_feature: Incyte ID No: 700551884H1
ctgcttctggaggaaaaatctctctgttcaacatgatgactttcaagacaatgacaacgtttatgcctgcaccgccggcagcaacttttcttgcatttcatccccaagataacaacataattgcaattggaatggatgactcaaccatccaaatctataatgtccgaattgatgaggtcaaaagcaagctcagaggtcactctaagagaatcacaggtcttgccttttcaaatgtgctaaatgttttagtctcgtcaggagctgatgcccagttatgtgtttgg

SEQ ID NO: 2007 - DNA, 284 bp, Zea mays
  misc_feature: Incyte ID No: 700551888H1
  unsure 263: a, t, c, g, or other
catcacaaagcaatggagaaagagaaaaagaagggtttaaaaatgattgtgacagaacgcactgtatttaatgatgaggaacagcgacgactagaattgttgaaggagcgtgagcgccgaaaggaggaagaagtggaagctttaaaacgctctatgcaagctggactggctcaagacatgaaggagcaggcccgtctacgcgaagaaatgaactaccaatacaggttgggcattttcaggctgcagctgcaatccagaaaagntggatcctgatgctcccttgc

SEQ ID NO: 2008 - DNA, 281 bp, Zea mays
  misc_feature: Incyte ID No: 700551892H1
  unsure 185-186: a, t, c, g, or other
ggtgaacctcaagaatgctatgaatgctaaatttgatacgcgatgagaaataacacttgacatctagttgttgctgatgagaccaagaatgttattaactgcaagtagagatgacaatggggccctgatttacgactccccgttgggaattcttccattaggggatgaggatggggatggggaannttctccccccacggggatgtaaacgggaaaatttttccactcgacgggtaatgccagatggggacgggaagtatccccatccccgttccccgcgg

SEQ ID NO: 2009 - DNA, 278 bp, Zea mays
  misc_feature: Incyte ID No: 700551893H1
agcaaagacgattgcatttaagtggaagtccaagttagataatcttgacattgatgctagcaatgggaactgtcttgaagctcatgcgtttcttcaactcctggcaacctttggtatttctgctgaattcaatgaagatgactgtgcaaattgcttccatatgtcagtcgtcgtcgtcagacacctgaactttgtcgatgcttgggttgtcgcagaaaatgccagtgtcatgaagttctggtggaagtggaagacctattgatgcaattaatttggct

SEQ ID NO: 2010 - DNA, 282 bp, Zea mays
  misc_feature: Incyte ID No: 700551894H1
  unsure 262: a, t, c, g, or other
cgaggaaaagcaagtaggcaatgaaagattcaacatatttagtgggctgcccttctggccagacagcgactattgttctccgtggtggtgcagaccagttcattgaggaagctgaacgaagtctccatgatgccatcatgattgtgaggagagcacttaagaactcgacagttgtgccgggtggtggtgctattgatatggaaataagcaagtatctcaggcagcatgcacgaacaattgctgggaatctcattcttgtaantcattgctaaagccctgagg

SEQ ID NO: 2011 - DNA, 287 bp, Zea mays
  misc_feature: Incyte ID No: 700551895H1
  unsure 74, 93, 233, 242: a, t, c, g, or other
tcgacgaaaacgaacagcccctcgctttagattgccgcaagttcccccattcctgtagatcgccggcccctcgntcggctcggccatgtcggncggctccacggcgtccctcctcgcggccgtcatctgccttgccctcgccgtgcttgctcccgtcgttcctggagatggtgccacattggaatcagttccagaccttgtgaaggcaatgtacctaaacgttgaaagcttcnctgtgtgangctgttgaatctttctggtgaaattggctgttctaatcctggaag

SEQ ID NO: 2012 - DNA, 287 bp, Zea mays
  misc_feature: Incyte ID No: 700551896H1
ggctgatgaggactcatccgacttcaccttctgcagggttagttctgcagaaaatgacggtcaaccagaatctcctaaagccattcctatggcaagtatgacgctcgaggatgttcgtgttaaaagtgcagatacttcaaagaataatggcatgaaaactgttgactcagaaaaagataggtctggtaacaatgtcagtgtttcaacaaaagacgataacatgaaagcaccagttacacatacaggtagtggagcagatcaaatgtcccttacaggcaaaacgttca

SEQ ID NO: 2013 - DNA, 272 bp, Zea mays
  misc_feature: Incyte ID No: 700551901H1
  unsure 62, 112, 266: a, t, c, g, or other
gtcagttaccaggctcttcgcttcccaacattggtggcatgtttccaaacatgctccctttnggtgttgctgggcagttcaatccccttgtcatccagccacaagcaatgantcaacaggctactcgtcatgctcggcgtgtttatgtcggtggccttcctccatctgctaacgaacagacagtggcaatttactttaatcaagtcatggctgctattgggggaaacactgctggtccaggtgatgtggtctcaatgtatacatanatcatg

SEQ ID NO: 2014 - DNA, 262 bp, Zea mays
  misc_feature: Incyte ID No: 700551904H1
acgaagaacataggtccatgctgtagcttcagctcgtcttctgatggcaatggatacatggctggaaactttagcgacagtgatgaagattatgttaattctactgtgctagaagcagttgaggtgagaagtggatcggaaggatatgtgataaagatgcgagatgggaaaaacttgcgttgtgtccataacaattctcaagggagaaatattccagagagtgcaccccaacctgctattgttttgaggattgaagatggaa

SEQ ID NO: 2015 - DNA, 259 bp, Zea mays
  misc_feature: Incyte ID No: 700551909H1
gaatcagcaacgtttccttggaattttaattgaatcggtaactgttctctagttcgctatttctttaattgattgagtcgatgaatggaataaattaatgtgctagtgtgctgctcactaggtgctcgattaattgcgtgagtccctgaactctcgtcgacttcgcggttctcgcgattatcgagccagattcagttatggcgagttatttcgctatttcagtcagttagctgaattggtggagtgagtagaatattag

SEQ ID NO: 2016 - DNA, 257 bp, Zea mays
  misc_feature: Incyte ID No: 700551910H1
cacatacatagtttcttctactacacgacgacaaacatggggaagcctgcgaagatgggagagtggggtggatacgccggcgatcgtcgggatctgagggctactccggaccggctgaccgaggtgaaggtcacggcggacaacagcagctgcatccgctccatctccttcatctacatcggagccgatggcaagccgtacgaggaggggccatggggtttcggccatgctggcacggagtacaagattgatctgtg

SEQ ID NO: 2017 - DNA, 256 bp, Zea mays
  misc_feature: Incyte ID No: 700551912H1
cgttatgatgctgagctccatggatgctagtctagtgatacccccgatcatcttcctgtggatggatgtccatgtttcactgtactttgatgaatatatattaagacattatgtctgttcgaagtgtaatatgttaatataatctttatttacgcttttatgcattgttcttttgatatattacacttgtgacgtcaacatatgtgtggaaatagatcctggcacacatatgctatgcacccgtctctgccccttt

SEQ ID NO: 2018 - DNA, 259 bp, Zea mays
  misc_feature: Incyte ID No: 700551914H1
  unsure 156: a, t, c, g, or other
aagaaagtgcggtttgataatttggaaccagagagcgtgaaatttatggcaagggaaattctcattttgcgtcgccttgatcatccaaatgttatcaagctagagggtctagtaacatcaaggatgtcctgcagcttatatctggtttttgagtanatggaacatgatctagctggactagcatctttccctggagtaaagtttaccgagtctcaggtaaagtgttacatgcaacagctcctccgtggtcttgagcatt

SEQ ID NO: 2019 - DNA, 206 bp, Zea mays
  misc_feature: Incyte ID No: 700551916H1
catcgatgatgttaatggtagctgtttaaattgaccgtgcaagcatgataacttatattatgccataggacaagtaatgctgattctctcatgaaatactaagtgacaagctgtctctgtagttgtatttgattctgaatgtttgaaccctactgttacaacggctgctattttaggtcagatttcagaggccggataattatgtt

SEQ ID NO: 2020 - DNA, 268 bp, Zea mays
  misc_feature: Incyte ID No: 700551917H1
gcgcgagaagatgctgcatcacatccaccaagaaatcccctatgtaattgagcatcgtctgatgggctggaaggagctaaaagatggttctcttagggtggagcagcacttcattgcacctaagcaaagccagcgtcagattcttgttggtaaaaatggttctaagatagggagaatcggtattgaagctaatgaagagctaaggtccatattcaagagagatgtccatctaattctccaagttagagttgcgaaaaagagaagtgcc

SEQ ID NO: 2021 - DNA, 266 bp, Zea mays
  misc_feature: Incyte ID No: 700551918H1
caagaggaatgccacaggatgacctcaaaaattaaaaagttccttaaagcccatgctcgctttttgaaagcacaggaagaattgaaaaggtcacaagctcgttttgagagactcggtgatttacttgcttcagatattctgaaacgtggtgctaatgaagaagtttctagtatcaatgttgatgaagatccaaatgttccttatgaaaggagcccaaatgctgctatagctaagaagagatcaataccatactcaacaagtgaaga

SEQ ID NO: 2022 - DNA, 261 bp, Zea mays
  misc_feature: Incyte ID No: 700551919H1
gatatattgtgctggaaagatcccgaacacccaaagtattcctttggtgcctcagtcactgaagatggaaagtacatcatattgggcatctatgaaggttgtgaccctgtcaacaaattatactattgtgaaatttcttctcttcctcaaggaatagagggctttagagggacacaggatttgcttccgtttgtcaagcttattgacaattttgatgctcaatatcaagttgtggccaatgatggtgatgaatttacattt

SEQ ID NO: 2023 - DNA, 262 bp, Zea mays
  misc_feature: Incyte ID No: 700551920H1
caaagcgaaaagaaaaaaaaagggaaaaggggctggtgcgcaaaaccctagcgcagtcgcatccatcatggcgatgtccatcttcgtcggcggcgactccggtgcgctcatcgcgccgtccgcgtcctcgctccgcccgccgttccgtcttgccgctggtcccaagggccatttttgtacttttcctcatggagcatctagcaatcacagccggctatgtgttgaacatcaaaggtgttctcgcagctccacccagaactat

SEQ ID NO: 2024 - DNA, 160 bp, Zea mays
  misc_feature: Incyte ID No: 700551924H1
  unsure 2, 8, 16, 22, 31, 37, 40-41, 43, 50-51, 54, 86, 110, 120, 147-148, 151: a, t, c, g, or other
gntatcantatgggcnatacgnacagggaanaaaccntgnntntctgtcnnagntcatgaagccgatgtgaatgttatctcatggnacaagcttgctagctgcatgatancttctgggtncgatgatggcagtttctcagttcgtgnnctnagatcaatt

SEQ ID NO: 2025 - DNA, 167 bp, Zea mays
  misc_feature: Incyte ID No: 700551925H1
  unsure 30, 67-68, 70, 80-83: a, t, c, g, or other
gcaccgtcaaaggcaccaggctgaggaacncctccctctctccctcttatccccaaggcgaggagcnnangaagaggagnnnncttctgcttgtttctccgctttgcaagatgtcgtccccgagcaagcgccgcgagatggaccttatgaagctgatgatgagcgac

SEQ ID NO: 2026 - DNA, 257 bp, Zea mays
  misc_feature: Incyte ID No: 700551927H1
  unsure 95: a, t, c, g, or other
ggttggtctggatcagttcatcacgaagaatgctacactcactaatgagaaggagactgacgcttgcccaatgcagagcaatgaagttctccgtnctctcctgttgtgcgtgttgctgttcagtgcaaggttgcctctgaccttcccaagctagtcgaaggtttgaagcgtctagcaaagtccgatcctatggttctctgtacaatggaagaatctggtgagcatatcattgctggagctggtgagcttcatcttga

SEQ ID NO: 2027 - DNA, 260 bp, Zea mays
  misc_feature: Incyte ID No: 700551928H1
  unsure 52: a, t, c, g, or other
gtctgccattcccacgctccttcctgtgaaccacaaacctaacgcggagggncgccggggccggccgccgggcgaggtgcgcgtacctgccgtcgatcgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtg

SEQ ID NO: 2028 - DNA, 258 bp, Zea mays
  misc_feature: Incyte ID No: 700551929H1
caaaccaagtccaaaaaatcagccatctaatggttttgttacattctccttgactatgggccctgaatatcacatctcacagatcacagatgctgtggttgttgcgaggtatctaggtgcaacatttgtactcccagacatcagaggaaatgaattaggaaataagcgaaaattccaagacatgtacaatgtggataaattcgtgaggagcctagatggtgttgtcgaagtaatagatgaaatacctgatgaagtgag

SEQ ID NO: 2029 - DNA, 263 bp, Zea mays
  misc_feature: Incyte ID No: 700551931H1
cacaaacttcatgcttttgttgagtatgatactattgaagatgctgctagagcgattgtggaacttaatgatgagaggaactggagaagtgggcttagagttcgattgttgagcacttgcatgacaaagggaggtaaagggaaaaagggtgggcatgaatctgatgggtatggtgacgaggagaatgtctctacttctgatcaaccatatgataaatatttagaagaaacacctcagatgtcagatgtgcctggagaacacat

SEQ ID NO: 2030 - DNA, 73 bp, Zea mays
  misc_feature: Incyte ID No: 700551932H1
cgggttaaacaaggccttgttggttagaaggtttttgattttagtagtttcctttctagagatgattattgtg

SEQ ID NO: 2031 - DNA, 269 bp, Zea mays
  misc_feature: Incyte ID No: 700551933H1
cacacatacatagtttcttctactacacgacgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgac

SEQ ID NO: 2032 - DNA, 259 bp, Zea mays
  misc_feature: Incyte ID No: 700551936H1
  unsure 123, 244: a, t, c, g, or other
ggtgctactgtttaccaggctggatatcatgttggtgtcaagggccaatacactggtaacaatgatgagaagtcctttatccacaaccacttggcatttttagtaaaataccataaggatganactacagatctctctagaattgttggatttgaggtcaaaccattcagtatcaatcaccagtttgaagggccgtggaatgataaaaacactcgtttaatcacatgtgatcctcatgccagcnagcttgtggtaaact

SEQ ID NO: 2033 - DNA, 261 bp, Zea mays
  misc_feature: Incyte ID No: 700551937H1
aacctagtgatgggtggctatattatgttgaagtgagatgtaactagatacttggtaactatagcaagcctgaagctgaagctttacaacgggcttttggggctcaaaagaggcggcggttgaatcgtgtctttgatgttatcgtcttcttttatcttgactatcccatcatggtttaggattcgaagaagagaaagaagaaagtaactacaaggcagagcaaagttctgaaggtgcaatctaaatcaactccccaagcct

SEQ ID NO: 2034 - DNA, 259 bp, Zea mays
  misc_feature: Incyte ID No: 700551938H1
aacctagtgatgggtggctatattatgttgaagtgagatgtaactagatacttggtaactatagcaagcctgaagctgaagctttacaacgggcttttggggctcaaaagaggcggcggttgaatcgtgtctttgatgttatcgtcttcttttatcttgactatcccatcatggtttaggattcgaagaagagaaagaagaaagtaactacaaggcagagcaaagttctgaaggtgcaatctaaatcaactccccaagc

SEQ ID NO: 2035 - DNA, 258 bp, Zea mays
  misc_feature: Incyte ID No: 700551939H1
ctaaggtgaccggtcaagtccatgcccacaccaaaacatgcggtgcctgcaagtgtccgacccatatccacgggttgcttgtttcagctggaggaaggaggacattcctgccggtgtctgcagttggatcaggtcagggctcatcggtcactgaggccgacaggaagagcgatttgtcgctggagaacgtcaagacgtccgttgtatcccgcgacggtgaaaagattaatgtacgagtgcagttgcctggaaaggcga

SEQ ID NO: 2036 - DNA, 256 bp, Zea mays
  misc_feature: Incyte ID No: 700551941H1
aaccaagtccaaaaaatcagccatctaatggttttgttacattctccttgactatgggccctgaatatcacatctcacagatcacagatgctgtggttgttgcgaggtatctaggtgcaacatttgtactcccagacatcagaggaaatgaattaggaaataagcgaaaattccaagacatgtacaatgtggataaattcgtgaggagcctagatggtgttgtcgaagtaatagatgaaatacctgatgaagtgag

SEQ ID NO: 2037 - DNA, 256 bp, Zea mays
  misc_feature: Incyte ID No: 700551942H1
  unsure 30, 37-38, 77-79, 81, 179: a, t, c, g, or other
cgactattaaggcacttaatattctatagncctcacnngtggtacaattattaccaactttaggtggataaatggannncnaattgtaccacttgtgaggcctatagactattaaggcacttaatatttgtcagagaacttttgcctcttgggtaacacaaattttccactgccagttngcatttcatttctgctactagtattgaaccagcaaggtttcctccattgctggataaaaatcaatggaatattccca

SEQ ID NO: 2038 - DNA, 255 bp, Zea mays
  misc_feature: Incyte ID No: 700551943H1
gggaaacatggatgacgagtatggtggtgtaatagtgaattctgagattgattctttgcctgatccaaaggaccaggttgcctggctgaagttggagctgtgccgactcatagaggagagaagatcagctgttctcagagctgatgaactagaaacagcacttatggaaatggttaagcaagataacaggcgccaattaagtgcaaaggttgagcagttggaacaagaaatatctgaactaagacaggccctgtc

SEQ ID NO: 2039 - DNA, 257 bp, Zea mays
  misc_feature: Incyte ID No: 700551944H1
  unsure 4, 58, 142, 166, 168, 178, 184, 205: a, t, c, g, or other
gganaaacttgaatcattctatttaccaatgtattcaccatcggttggtgaagtggangccatactaaagcaagttgggttgttcaacatgaatcatgtaaaagtattccagacaaattgggatccctacgatgacttgganagtgatgttgtgcataacagtatnangagcggtganaatgtngctaagtgcctacgagcagtnatgcagccgctagtcgcaagccaatttggagaacccattctcgatacagtta

SEQ ID NO: 2040 - DNA, 257 bp, Zea mays
  misc_feature: Incyte ID No: 700551945H1
tatgatgctagtgctgttattcaggcagtaccaaaccaagcaatggagattctccctcatgccattgacactagagtgcctcgtggccctcggtccaccttgtactatcgtactgggcattccttccaaaggaagcaaggttacacgcacagccagagcactattgtaaggggtagttacggcccccacaaccatgaacccccatgctgctgaatttgtgcctggaaaaacttcgcaacaatctgatgtggctgaca

SEQ ID NO: 2041 - DNA, 258 bp, Zea mays
  misc_feature: Incyte ID No: 700551946H1
gctgctatcaacgcattgcagcttgttgatccctcatttgcatggctcgattctatttgtgaagccgatgataaaatttctccaagtaaaagaccccggaatcttttgatggagaactcggcttttggcacaaactcagaactttctagattgcaattttgtgttgacattgaaatccttgaaaaagaatacatattaacagaagcacagtatatgctcagcactttgaaatcaagttttgatttttcagaaagccaa

SEQ ID NO: 2042 - DNA, 262 bp, Zea mays
  misc_feature: Incyte ID No: 700551948H1
aaacacctcctggtttcaggcggaactccttcgaagataaaagcaaggatatcatagaaatggaaacggaggaagcctatgagatggtacttaatgctgtgctgaaatgggtggagagcaacatgaaccccaggacatcaagaacattctttgtcactatgtcacccacccacacaaggagcagagactggggcgatgatactgacgggaactgctacaaccagacagcccccatcgaggacctgtcctactgggggccaga

SEQ ID NO: 2043 - DNA, 268 bp, Zea mays
  misc_feature: Incyte ID No: 700551949H1
caaaatgaagagctccgttctcacttggagaaactaagacttgaacaagctagcctgttggaagtaagcaatatcactaccaaatcagatggacaaattgaaaacagtatctcaaacctaccagaaatggtcaccgagaatatttctctgaagggtcagcttataaaagaacagagcagatctgagagtttgttggcagagataatgaaactttcagctgagcttaggaaagcagtccaagcacagaataaccttgtacgcttgtaca

SEQ ID NO: 2044 - DNA, 261 bp, Zea mays
  misc_feature: Incyte ID No: 700551950H1
gaactttcttacaaactgaaagaaattcccaaggtccgctgggttcttcctgattcatacttggatgtcaaaaacaaggactatggaggcgaacccttcataaatgggcaagctgttccttatgatcctaaatatcatgaggagtgggtgagaaacaatgcccgtgccaatgacagaaaccggcgcaatgataggccccgcaactttgacaggtcaaggaactttgacaggagaagggagaacatgcaaaactaccagaac

SEQ ID NO: 2045 - DNA, 260 bp, Zea mays
  misc_feature: Incyte ID No: 700551951H1
  unsure 226-229: a, t, c, g, or other
gagtggccccggcgacgcgaggccgaggcgagctaatctgacggtggcagtgacgactccaacgaccaggcgcggaggctgcactgctccagcgaaggcaccatgtcattcatgtctccattcccggggatggatctaagtaaaatggatcccgggactctgaccctccttggggcagctggttgtgtaatgctgactatgcatttcactgtgcaattggtgtcannnnatctcttctattggaaaaaccccaaggagca

SEQ ID NO: 2046 - DNA, 209 bp, Zea mays
  misc_feature: Incyte ID No: 700551952H1
gagtgggagacccgcgagaggctgccgtgtagggaccgtagactcagcgactgcgaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaag

SEQ ID NO: 2047 - DNA, 259 bp, Zea mays
  misc_feature: Incyte ID No: 700551956H1
  unsure 51, 77: a, t, c, g, or other
tggcactccaagcggaaggaacggtggcgtttctccgttctacgaagtggncgcgccatctgcaccggtcggctgcngcggctttcctcgtcagttactcttcccgaacgccgccagcaccgctcgtggcatctgcgtctctgccttctccaaccgccagcaccgctcccgatccaggaccaagaagcgtgtgaggagctttcagctgccacccggtgccaccatgctccggcatctccagcgatccctccgtgccatt

SEQ ID NO: 2048 - DNA, 254 bp, Zea mays
  misc_feature: Incyte ID No: 700551958H1
acggaggtcaagcccgccctgaccaacatggtctccgctgctaagctcattcgcacccagctcgccagcgccaagtgagcacctttttttgcctttttcgtttccgaggagggcgtcgtcgatgccaatttgtttccaataaacagggctccccccctgtgcccgccgttctgttgtgctccgtctgtggttaggttactagttttcttgatctcgcccccacgcggtacctgttttactatctgtttggtggt

SEQ ID NO: 2049 - DNA, 254 bp, Zea mays
  misc_feature: Incyte ID No: 700551960H1
  unsure 179: a, t, c, g, or other
agacaactccaattgaaacatcaaagggaacttgagaaaatgaagattgatgaagattgggatcacagccatcaatccaaagagcaaattgaggccaacctaatgatgaaacaggaagctgcactcaggcgagaaagagcacttgcatatgcattttctcaccagtggaggaattctgntcgaactataacccctacttttacggaacctgggaaccccaactggggctggagctggatggagcgctggatgac

SEQ ID NO: 2050 - DNA, 256 bp, Zea mays
  misc_feature: Incyte ID No: 700551961H1
  unsure 39, 74: a, t, c, g, or other
ttcccgtaccatcccgacgcgatggccgccggcgcgaanccgattaccgccgcgcccccgcaagcgccttcggngcgaagggggtcttcatgcgccgcatcttccccttcctcctcgcgacgaacgtcttcatcggagtttatgtatttgccaagacctacaaaagagaccaggaaaagaaaaatgctcagactactgccgctgcagcattgtcatccccagcaagtacatctgccgaggctccagatcctgctcc

SEQ ID NO: 2051 - DNA, 258 bp, Zea mays
  misc_feature: Incyte ID No: 700551962H1
atctatcagtggataccccaggacacattgtcagcttccatatcgcatgcatcatactcatgtaacagccagctagtttttgctgccttcactgatggtaacttaggtgtttttgatgcggagaacttgagattaagatgtcgaattgcaccatcggtgataaacagcaatccacctgttcaccctcttgtcgtcgccgcacatccccacgagccaaaccaatttgcggtcgggctgtcagatgggtccgtcaaagtg

SEQ ID NO: 2052 - DNA, 134 bp, Zea mays
  misc_feature: Incyte ID No: 700551963H1
  unsure 41, 49: a, t, c, g, or other
cctcccctgccccctcgggcgcttctggcggcgagcagtangttgtgtnctgttgtgtgggtgcaggggaggactacaggacacgacgccgccatcaggcatcatcatcatctcagactcagagcatgccagcc

SEQ ID NO: 2053 - DNA, 264 bp, Zea mays
  misc_feature: Incyte ID No: 700551966H1
  unsure 184, 226-228: a, t, c, g, or other
agagaaactactctgagtctgactactttaagcaagcacttcgccaaggtgcaccagcaaagcctagggaaccaaggattccaagaatgccgcacttacatgatttccagtttttcaataaccaaaggctaaatgaattgtatgaaaaggaagtgcggtaccttatgcaagcgaaccagaaggnaagataccattgatggtgaagacgaagatcagttggagcctnnnacagcagaggagcaggaagagaaggaacaattatta

SEQ ID NO: 2054 - DNA, 257 bp, Zea mays
  misc_feature: Incyte ID No: 700551969H1
attgttgcacagttacgagtccgagttctggaggaaacccaattcacatgctctgctgggattgctcacaataagatgttagctaaacttgtcagtggaatgcacaagcctgctcagcaaacagttgtcccttcttcatcagttcaagacttactagcatcactacctgtgaagaagatgaaacgcttggtggtaagcttggaagttccttgcaggatgatcttggggttgagaccattggtgatctcctaagtttt

SEQ ID NO: 2055 - DNA, 256 bp, Zea mays
  misc_feature: Incyte ID No: 700551970H1
ggaaccgcttttggtggcttcaagagccggacccaggtcccatggcttgttgacaagtacatgaagaaggaaattaaggtggacgagtacattacgcacaacatgaacctggctgacatcaacgacgccttccacctgctgcacgaaggtggctgtctgcgttgtgtgctggcgatgcagatctgaaattcctaagctaagcagtttttggatgtgtcggcatagactgtcttttgttttggaactagaattcctt

SEQ ID NO: 2056 - DNA, 235 bp, Zea mays
  misc_feature: Incyte ID No: 700551971H1
  unsure 20, 36: a, t, c, g, or other
attttaaggtccagtggacnggatacggccctacangaggatacatgggaaccgattgataacttgagtgactgcccgcagaaaattagagattttgtacaagaagggcacaaaagaaagattctcccactgcctggtgatgttgatgtcatttgtggaggcccaccatgccaaggtatcagtgggtttaatcggtacagaaaccgtgatgagccactcaaagatgagaaaaaca

SEQ ID NO: 2057 - DNA, 253 bp, Zea mays
  misc_feature: Incyte ID No: 700551976H1
gagcagtgtgtttggatggtagtgcgccggcgtaccatctcgcccgcggctccggctccggtgagaacagctggctggtccatttcgaggggggaggatggtgcaacaatgtcaccacctgcctgcaacggaagcgcactcggttgggttcgtccaaggagatggcgacgcagattgccttctccggaatcctgagtgacacgccggatgacaacccagatttttacaattggaacaaggtcaaggttcggta

SEQ ID NO: 2058 - DNA, 264 bp, Zea mays
  misc_feature: Incyte ID No: 700551981H1
  unsure 18, 100-102, 104, 108, 113-115, 117, 119, 153, 253: a, t, c, g, or other
atggaaagctgaggatanagtttcggtggagggatagactttggattggggaccctgctgatattgttcttgatgatgtccacttattgacggaggcttnnnantgcntggcnnntngnatcataggcttgtggtattctttcgataccatanctgatatattgcacccatccattttgcagcatttcaaatttagcaaaatcttaacctgcagtggacttgcaagttgcacataactatcatcgcatcggcntgccagggtgt

SEQ ID NO: 2059 - DNA, 260 bp, Zea mays
  misc_feature: Incyte ID No: 700551982H1
agccctgaacattgtcatcatcaaggattataatatgaggactacaaacatgtctaatggtgtaatcaagctacgcactaaaagacttcttgcagagaaagaatctattagaattacaaggtcaaaaaaaactgctgcccagcctaatggtactgaagtgtttgacaacaacgatggccatacccaggctacagttcaagctagtgaccctgctctatttgacgagtacacccacatggctaatggaggtcattccattg

SEQ ID NO: 2060 - DNA, 258 bp, Zea mays
  misc_feature: Incyte ID No: 700551984H1
  unsure 20: a, t, c, g, or other
ctaagggcggcggagcatgngaccagcatagcttgatggacctccaagacggtactctgggctcattgctttcagcgctgatgcaacactgcagcccgcagcagcgaagtatccattggataagggtgtcccgcccccttggtggccaacagggaacgagtcgtggtggcctgcgttgggcctcccaaagggagaagcgcctccgtacaggaaaccgcatgacctgaagaaggtttggaaagttggtgtcctgacggg

SEQ ID NO: 2061 - DNA, 256 bp, Zea mays
  misc_feature: Incyte ID No: 700551985H1
ggttgcaggagaagagggaagctgcattagctatgatctttagcaagtccaggctttccttacctgttccttccatcaacccaatgaacaaggcactggataatcttggtgtcaagtggcctaaaccggcttctgaggagagtgtgcacttgcaagttgataatgctgcagtgaggcctcgttctgagcttgttgcactctgtgaggaaatgaatgtgaacgggcttcataagttcatatccgacaacaggaagaa

SEQ ID NO: 2062 - DNA, 256 bp, Zea mays
  misc_feature: Incyte ID No: 700551987H1
  unsure 186: a, t, c, g, or other
cacacacaagacacaaccccactcacccggcagggaggccctcttcgtcggcggaggccatggtttccctcaagccgcagaagaggctcgccgcgggagtcctaaaatgtggcaaggggaaggtgtggcttgaccccaacgaggtctacgagatctcgatggctaactcgcgtcagaacattcgcnaagctggtgaaggatggattcataattaagaagccacagaaaatccactcaaggtcccgggcaaggaggg

SEQ ID NO: 2063 - DNA, 257 bp, Zea mays
  misc_feature: Incyte ID No: 700551988H1
  unsure 78-137: a, t, c, g, or other
cagaccgcggaggagctcgccacccagatcgagcagcagaagctcgaggagcagaagaccgaggcagaggaagttgtnnnnnnnnnnnnnnnnnnnnnnnnnnnnnnnnnnnnnnnnnnnnnnnnnnnnnnnnnnnnactcgatgaaggggatgccagtggcaagtcaaagcaaagcaggagtgagaagaagagccgcaaggccatgctgaagcttggcatgaagcccatcactggtgtcagccgcgtcactgtaaa

SEQ ID NO: 2064 - DNA, 255 bp, Zea mays
  misc_feature: Incyte ID No: 700551993H1
  unsure 80: a, t, c, g, or other
ctagttctaggaccgcaagctacttcctccgcctcgacaggcgtcggcgagatggtgaagagaagcaagaagagcaagancaagcgcgtcacgctgcggcagaagcacaaggtgctgcgcaaggtgaaggagcaccaccgcaagaagcgcaaggaggccaagaaggagggcaaggccggccagcggaagaaggtcgagaaggaccccgggatccccaacgagtggcccttcaaggagcaggagctcaaggcgctc

SEQ ID NO: 2065 - DNA, 294 bp, Zea mays
  misc_feature: Incyte ID No: 700552001H1
agaagatacttgttgtgtgtatcaactgtttgacaaagcttgttgggcgcctttcccaagaggaattgattgataaattgcctacatttctgccagcattatttgatgcttttaacaaccaaagtccagatgtccgaaagactgttgtgttctgcttggtggatatgtacatcatgcttgggaaagcattcgctccatacttggaagggcttagcagcacgcagctccgcctagtaaccatatacgctaaccggatttcgcaggcgaggtctggcaagccaatcgattctaacc

SEQ ID NO: 2066 - DNA, 201 bp, Zea mays
  misc_feature: Incyte ID No: 700552002H1
  unsure 11, 20, 49, 65, 68, 72, 74, 77, 84, 102, 104, 113-114, 117, 138-139, 146,: a, t, c, g, or other
gctcgggcaanttcaaggcnatgctcgtggcccggcaagatccaacacntcatcttgcgctcggnaanctcngnatnaaggaanttgcatggagctacctgnanaagcctttnnccngatctccacattagtggaagnnaatatgntgagtatnntcgatacccatagncttagacacttanaatnggtcagtttaagctt

SEQ ID NO: 2067 - DNA, 287 bp, Zea mays
  misc_feature: Incyte ID No: 700552004H1
atttgcaaaggctatccattacattaacaagagcctgcctgatgacaagcgtctaaaatttttacacatggatctgagtaagctttctcgaaggaaaggcaccaatgtgcttgcactgttgaccaaggtggcatcagatgtgttggatctaactgaattcctccactgtgaaataagtacatcaacaaaacctgatgacacctcaagtggagaaagaactgctgccaaaccacatgatgacagaagtagcagtgatcaaactgaatgtgcagctaagttggcacctc

SEQ ID NO: 2068 - DNA, 110 bp, Zea mays
  misc_feature: Incyte ID No: 700552005H1
  unsure 8, 16, 20, 35, 48, 53, 73-76, 91, 100, 107: a, t, c, g, or other
cagatganttgaccanggcncatggtgatctgganatggtaccatgancggtncagagggaatcgccttcaannnncaagagtgggttgcntagtagagnggtattncaa

SEQ ID NO: 2069 - DNA, 282 bp, Zea mays
  misc_feature: Incyte ID No: 700552006H1
  unsure 3, 66, 219, 257: a, t, c, g, or other
gtnaaggctgcgttctggtcgttgtttttcgatttatggttggtttgttattttacaggtgttatntctgaaacctttctttccttccatagtagtttccttagggatgttgcaacttaatgaggagctctactgaaataattaggagaattctttccctgttaagggctagtttgttagccagggaattggaggatagcaaggggtttcctcccccanaggttacctctatttcccttgtcaccaaaccagccctnaggaatagttaggtctgaagttgac

SEQ ID NO: 2070 - DNA, 281 bp, Zea mays
  misc_feature: Incyte ID No: 700552009H1
  unsure 244, 265: a, t, c, g, or other
gctgtggagctcttgcagcgtgaatgccatgtgaaaaaaccactgagagtcgttcctttgttcgaaaaactggcagatcttgagtcagcaccagcagcgttagtcggctgttctccgttgaatggtacagaaacaggatcagcggcaagcaggaagtgatgatcgggtattcagattctggcaaggatgccggtcgtttctctgctgcttggcaactgtacaaggctcaagaggagctcattantgtcgctaagctgtatgggtnaagctaaccatgttcc

SEQ ID NO: 2071 - DNA, 184 bp, Zea mays
  misc_feature: Incyte ID No: 700552011H1
taacaaggaaatgaaattggaaactgtgacagctgctatgtctgatggcaagttgctttcccaaaagcaacaacatggtattgaatctaaggtggaggaatgtggcattcctatgtctgaggaagaagctgctgcattcgctgctgctgaggctgctcgagctgctgctatagcagctgcacag

SEQ ID NO: 2072 - DNA, 276 bp, Zea mays
  misc_feature: Incyte ID No: 700552012H1
  unsure 206: a, t, c, g, or other
ctctgatccggtggtctcggcggcgtcctctagcgacgacctactccaatcctctgtttatgcatgtggctattggttgagtccatactaggatatttttcattaattgtgatgtacgatgtaggtatttatgctattttctataatgatttatgctttacgcgataccagccatacaatttatgcaactacgctatgagaatganaataccattcaaaacttgtgtgcatgcattggaaactcacacgacctactataattttcagactggataa

SEQ ID NO: 2073 - DNA, 278 bp, Zea mays
  misc_feature: Incyte ID No: 700552014H1
  unsure 267-270, 273: a, t, c, g, or other
tctcagcagaggaacttggtgcaaagattaaggaatacggcattgttgcccctgatacaaagaatccactttctgatccctacccattcaatcttatgttccagacatctattggccccactggtcttagcgtggggtatatgcgaccagagaccgcacagggtatttttgtaaacttcaaggatctgtactattacaatggccaaaagctcccttttgcagctgctcaaattggtgcaagcttttagaaatgagatctcgccacgnnnnggncttct

SEQ ID NO: 2074 - DNA, 176 bp, Zea mays
  misc_feature: Incyte ID No: 700552016H1
  unsure 46, 100, 115-116, 173-174: a, t, c, g, or other
atttggattgatgatgccaggcccatcaggtccagaggtgaggggnaatcatccagaggcgttcgaaaggttgatccagatggagatgtcagccagatcnaagcaacagcaggtnnaccaccctgcaatggccgctggccgtgtgcctagtgggatgtacgggcacgagcttnntg

SEQ ID NO: 2075 - DNA, 189 bp, Zea mays
  misc_feature: Incyte ID No: 700552018H1
  unsure 27, 31, 36, 39, 48-49, 55, 98-99, 136, 180: a, t, c, g, or other
ctggataaagaaggcagtagtactatngatnctttncancaccaccanncatccntagtactactgccttctttatccatagatggccatagtactanngatgcttggtggtgttgaaaagaatctaaaagatggnactcacttgagaggagatataaacatgatgatggtgggagagcnttcagtggc

SEQ ID NO: 2076 - DNA, 190 bp, Zea mays
  misc_feature: Incyte ID No: 700552021H1
  unsure 16, 21, 35, 48, 54, 57, 78, 81, 94, 127, 133-134, 144, 151, 158, 160, 165,: a, t, c, g, or other
gttcgatctcctctanaccanagccaacgtgctcnagagaaggattgntgtccnatncctgtgtccttcccaggcctnganggtcgttgccctngttctctgcatgatacgacgtgaggaaggctcncacaannacaagggtantgtcgcnattaccnanacagnattcagtggngccatttttgtggag

SEQ ID NO: 2077 - DNA, 278 bp, Zea mays
  misc_feature: Incyte ID No: 700552025H1
gaggcgaagaagtccgccgtggcgcctgctgggaaggctgcccagcctgcggcgaccaccaagttcccgaccaagcccgctcctccctcgcagacggttcgggatgcacgcggcggtggctcatcagctcgtggaggctttggccgtggtgaacgtggccgtggcagaggtggacggggatatggccagaaccgtggcttcagtggtgacaatggcaatgagttccagggaggttatggtggcggaggctatggggatggtgctgtaactggtggatc

SEQ ID NO: 2078 - DNA, 75 bp, Zea mays
  misc_feature: Incyte ID No: 700552031H1
  unsure 5, 12, 14, 29, 46, 67, 72: a, t, c, g, or other
acaanatcaaangngcaaccagacatggngtcatgatcgaaagtcncttccaactgaattggttccnaaccnaac

SEQ ID NO: 2079 - DNA, 290 bp, Zea mays
  misc_feature: Incyte ID No: 700552033H1
  unsure 48: a, t, c, g, or other
tgggactctaaaagtagcagatatatctgtgaaggaagaatgcaaaanccgtccatctggccttaatacagttaatatgcttaaggttgcatcaagtgcacttggtattgggcctcagacagccatgcacttggctgagcggctttacactcaaggattcatcagttatcctcgtacagagagcactgcatatccgtcatcatttgattttcgaggtgcacttgctgcactattaaataatcctctatggtccaatgatgtccggaaattactggatgctggttttgtta

SEQ ID NO: 2080 - DNA, 189 bp, Zea mays
  misc_feature: Incyte ID No: 700552035H1
  unsure 19, 21, 70, 80-81, 89, 114, 151-152, 183-184: a, t, c, g, or other
atcacttagcattatatancntaatattgaggttatggccccaattgatagcttcaggggttgccgtgtngctgcatctnncggaaganctacgtacccatcagcctaaagcanctggggaagctgttgcatctcaagttcctagagatannatacacgcctatttaggagtcccgaaggatnngtggc

SEQ ID NO: 2081 - DNA, 283 bp, Zea mays
  misc_feature: Incyte ID No: 700552036H1
ggaacttgagaagattcgtcagagagaatctgacataacaaaggagcgaattgagaaaattctcaaggctggagctaatgttgtgttgaccaccaagggaattgacgatatgtccttgaagtactttgttgaggctggtgcgattgcagtaaggcgtgtgcgcaaggaagatttgcgacatgttgccaaagccactggtgcaactatggtgtctacttttgcggacatggaaggtgaagaaacattcgattcatcattccttggccatgctgatgaagttgtg

SEQ ID NO: 2082 - DNA, 282 bp, Zea mays
  misc_feature: Incyte ID No: 700552038H1
  unsure 45, 49, 85, 88, 167, 190, 192, 253-254, 273, 278-280: a, t, c, g, or other
ggcgggcgaggagggtgaggcttaaggtcctcggcctgcaggtgncgcncgttcgtgctccgcgtgtgcttggcgctgaacatgncangagtgagttacgagtacgtcgaggaggacgtatccaacaagagtgagctcctgctcaagtccaacccggtgcacaaganggtgcccgtgctcatccacaacncnaagcccatctgcgagtcacccgtcatcatgcagtacgtcgacgagctgttcgccggccggnngatcctcccaacgaccctnagagnnngc

SEQ ID NO: 2083 - DNA, 283 bp, Zea mays
  misc_feature: Incyte ID No: 700552039H1
  unsure 272, 279: a, t, c, g, or other
cccaaccccgcgcgcgggggagcgataaaccctagtcttcgccgtcgtcgcaggaggacccgcgatgtcgcacttcgggaggtcaggcccgccggacatccgcgacaccttctcgctcctcgtcctcaacatcagcttccgcaccacggccgacgacctcttcccgctcttcgagcgctacggcaaggtcgtcgacgtcttcatcccgagggacaggaggaccggggactcgaggggtttcgcgttcgtgcggtacaagtacgccgacgagngcagaangcta

SEQ ID NO: 2084 - DNA, 280 bp, Zea mays
  misc_feature: Incyte ID No: 700552041H1
agtcgcattgtctgaggcattggggacatgcactcgtctgaagaaacttgatcttagggacaacttgtttggtgttgatgcagggttagctctcagcgaaacccttccaaaactacctgatcttgttgagctttatctcagtgatctcaatcttgagaacaagggtactatagcaattgcaaaagccctcaaacagtcagcactgcagttggaggtccttgaaattgctggaaatgaaataaatgccaaagcagccccagatttggctgaatgtctagca

SEQ ID NO: 2085 - DNA, 278 bp, Zea mays
  misc_feature: Incyte ID No: 700552042H1
gtaggaattgaggattgcttacatattgagtttgaatacagcaaaagcaagtaccatctcaatgatgtgattattgggaagatatatttccttcttgtcagaataaagataaaaaatatggaactggaaattaggcgtagggaatcaacaggatcaggctctaacacatatgttgaaactgagactcttgcaaagtttgagttgatggatggtgctcctgtgagaggtgaatctattccagtgaggctgttcctgacaccctatgagttgaccccgac

SEQ ID NO: 2086 - DNA, 170 bp, Zea mays
  misc_feature: Incyte ID No: 700552044H1
gcaattagtttggttctgcttgatgctcaaggtcattgagttggtttgtggaaccttcgagggggcgcttgttggttttatggaattggttggggaatttttctgggacatggcgttatatcattatatgtgggtagtttcttcactttctgtattgggtttcagatatt

SEQ ID NO: 2087 - DNA, 274 bp, Zea mays
  misc_feature: Incyte ID No: 700552045H1
actagttctagaacgaaggacaagtgcaagaacaggagctgaagaagatacagcgttaaagacgctgcccgttgtgtcaaaagaatggtgcccttgcagtgtgctgcggtttttctagaaatataatgcgttttaattactagttggagggagacctgtcttgttcaatttgttcatggaccagaagcaataatctatctgtgtgtagctggattggtgttatgcgatgtcccctaccgtgtgtcccagaatctacttggtgattttatcccag

SEQ ID NO: 2088 - DNA, 277 bp, Zea mays
  misc_feature: Incyte ID No: 700552047H1
  unsure 108: a, t, c, g, or other
agcaagctctgatgcttcatcctatggtgcttcgcaagatagttgacaaggctcctctgaaagactcatcatggacccaaatactcggaaatgtattctttggatcancaaaaccgggaagcccttcacttgagcatatgatcaatatatatgtggaacgccattatatcatgtggagattcccagaactgcagaacttgctgaaagaggctgctcttttggtgattgaatcactaaagcaggataacagagaagccctggactgggcttgtgttag

SEQ ID NO: 2089 - DNA, 277 bp, Zea mays
  misc_feature: Incyte ID No: 700552048H1
cgaaccaaaccaccgcctcctcccccgaccggagaggagcctcaccgccggcgcccatggcgacacgctacttgatcgtgtcgctgcccgtgcagtcgcccggcgcaaccgccagctccctgtggtcgcgcctccaggactccatctcccgccactccttcgacaccccgctctaccgcttcaacgtcccggatctccgcgtcggcaccctcgactcgctcctcgcgctcagtgacgacctcgtcaagtccaatgtcttcgtggagggcgtgtcaca

SEQ ID NO: 2090 - DNA, 93 bp, Zea mays
  misc_feature: Incyte ID No: 700552051H1
  unsure 12, 69, 91: a, t, c, g, or other
agttgatagcancagcagctagctataggttgtcagcaggatcgaccagatagatagcgcgctcggatnatgagttaacagcgctgcaggngg

SEQ ID NO: 2091 - DNA, 279 bp, Zea mays
  misc_feature: Incyte ID No: 700552053H1
  unsure 56, 65, 69, 160, 188, 230, 256: a, t, c, g, or other
gatgtattaaaaaataaagatgacacaaaattgtgttgcagattaaatacaggatnatgatccanagcngcttcaggggtcatgttcctgtatttaatctgcaacatgacccctgaagcagctttggatcatgtacgatccattaggcctcgagtgcttntggcaccctcgcagtggtcactcaagtngatctaaagttattctttgagtccatatgtggtgaggtgggnctctttactccaaaccacatctcccntctgtatagctaaaagttgcagg

SEQ ID NO: 2092 - DNA, 283 bp, Zea mays
  misc_feature: Incyte ID No: 700552055H1
ctcgtctgctcgcatttcctcccaatccatcccgcctccaaacccgaactccaagtcgccccgcatcgatggcgcccaaggccgagaagaagcccgcggcgaagaagccggcggaggaggagcccgctgccgagaaggcgccggccgggaagaagcccaaggcggagaagcgtgtcccagcaggcaagtccgccggcaaggagggcggcgagggaaagaggggccggaagaagggcaagaagagcgtggagacctacaagatctacatcttcaaggtgctgaa

SEQ ID NO: 2093 - DNA, 85 bp, Zea mays
  misc_feature: Incyte ID No: 700552059H1
attttatttgacttcgtcaataaaccgggacaaagcctgtttcatttcatggatacggcaatatgaatggaatttaatatctacg

SEQ ID NO: 2094 - DNA, 275 bp, Zea mays
  misc_feature: Incyte ID No: 700552060H1
tcaagactttgaagatcatgatcactgagtcagggtggccaaacaaaggggcggtcaaggagactggagccactccagacaatgctcagacttacaataccaatttgatacgccatgttgttaatgacagcggcacaccggcgaaaccaggggaagagattgatgtctacatattttcattgttcaatgagaacaggaaacctggcatcgagtcggagaggaactggggactgttttttcctgataagagctctatctacagccttgattggacg

SEQ ID NO: 2095 - DNA, 230 bp, Zea mays
  misc_feature: Incyte ID No: 700552061H1
  unsure 197: a, t, c, g, or other
gcgagtttgtgctggtgaggtcaagtgtgtacccacatatgctttggctctcaagttcgattccaccagacaagtatcacggtacaaatgtaagtccgagctggtctttgttgcacgccggaggtaggtgtacttgcaatgcaagactagcatgatataaagtgatagcatggttccttctgtactagctgaattcnctagaatctagcataaaatgcatttcaattacc

SEQ ID NO: 2096 - DNA, 180 bp, Zea mays
  misc_feature: Incyte ID No: 700552062H1
  unsure 70: a, t, c, g, or other
tcatataccactccctaggagaacccagcaacacacacagccgagctttgcttaggcaagatgaacaggnagccaggagactgggactgcagggcgtgccagcacctcaacttcagccgccgagacatatgccagcgctgcagcgagccacgtggagttgctgatcgtggcggcggagga

SEQ ID NO: 2097 - DNA, 267 bp, Zea mays
  misc_feature: Incyte ID No: 700552063H1
  unsure 172, 176, 189, 207, 263: a, t, c, g, or other
ctctatggcaagacaccattcaggggaccggacaatgacgaaacactctcaaatgtgatctcacagggcttgaagttccctgacagtccagcattaagcttccacgctcgagatctgatcagcgggctgcttgtgaaagaaccggagtaccggcttggctcgtcgagagganttgngagaataagcggnatccctcttgaaggtttnactgggccttgatccggtggacttcaccaccagagacccgaaaatattgtactgcngcac

SEQ ID NO: 2098 - DNA, 275 bp, Zea mays
  misc_feature: Incyte ID No: 700552064H1
aaattactggactccatccatgcttctcatttgcttgttctgataatcatatgctcttcatctagtgcatattgaagtgatgtttcctgtcataaaatggaattgtactatctttgtcgtgcagtttaaactgaccgccggcatctcagttttttttctttggtttttctgcgttttcacgtttttctagagaaagtatatagattcatgacataagatttatgtttttagatttactatgaaaaatactttcataatatataattcatatgctg

SEQ ID NO: 2099 - DNA, 286 bp, Zea mays
  misc_feature: Incyte ID No: 700552066H1
actagttctagaccgcgaaccacaggtcgaaggcggcggcggcgatggggagcgacacggagacggagaagaaggcctcggtggcgctgatgtccatcgcgaaacccctcgctggaaagaagctctgcaagcggaccctcaagctcgtgcgacgagcctccgaggcgaagtgcctcaagcgcggagtcaaagaggtagtcaagagcattcgccgcgggaacaaaggattgtgtgtgatcgctggaaatatttctcctattgatgtgattacacatgttccgatact

SEQ ID NO: 2100 - DNA, 282 bp, Zea mays
  misc_feature: Incyte ID No: 700552069H1
  unsure 208, 236-238, 240, 254, 260, 269: a, t, c, g, or other
gtttatgttgagagattcaatcgacctgaggagaaataaatggcagcaaaggcgtaaagtcgaaggtcccaagaagattgaggaggttcacagagatgcagcacaagaaagacatgcccagtcgagtaggttgggacgtggtccagctgttagttctgttccaagaagagcacatcctatggattatggccctcgtggaccatctgcntcagcatcctcaagttcccaacaagggnnntncgaggaatgcctcnacattngcgtggttnacaagacatccga

SEQ ID NO: 2101 - DNA, 281 bp, Zea mays
  misc_feature: Incyte ID No: 700552070H1
  unsure 36, 41, 81-82, 123, 131, 148, 174, 178, 187, 241: a, t, c, g, or other
gccatgggctacctcgcgcccgagtacgccgccacngggcngttcacggacaagagcgacgtcttcgcgttcggggtcgtnntcctccaggtcctcacgggaaggatggacgtctcccagctnaaggtcgncgccgccgccgtcagcnacctcggcggcctggtcgacgcgaanctcnacggcgcgntctcgagaacggaggcggcgaggctggcggctgttgctgcgtattgcacgagcnagacgccaggtcagcggccgaccatggaggccgtggttca

SEQ ID NO: 2102 - DNA, 282 bp, Zea mays
  misc_feature: Incyte ID No: 700552071H1
  unsure 274-276: a, t, c, g, or other
aatcctcatcgttctcctttccccaaaggccaaaaccgaccccgctccacgcctccactcccagccccagcggatcttctcgagcggcggccggcgatggcagcgagcaacatcgggatgatggacggagcctacttcgtcgggcgcaacgagatcctcgcgtggatcaacactacgctgcacctcggcctctccaaggtggaggaggcggcgtcaggcgcggttgcgtgccaactgatggacgcggcgcatcccggcgccgtgccgatgcacnnnctcaat

SEQ ID NO: 2103 - DNA, 279 bp, Zea mays
  misc_feature: Incyte ID No: 700552072H1
ctctatggcaagacaccattcaggggaccggacaatgacgaaacactctcaaatgtgatctcacagggcttgaagttccctgacagtccagcattaagcttccacgctcgagatctgatcagagggctgcttgtgaaagaaccggagtaccggcttggctcgtcgagaggagctgctgagattaagcggcatcccttcttcgaagtctgaactgggccttgatccggtggacttcaccaccagagaccccgaaaaatattgatactgcagcaacactcg

SEQ ID NO: 2104 - DNA, 275 bp, Zea mays
  misc_feature: Incyte ID No: 700552073H1
  unsure 62, 125, 130, 145, 199, 266: a, t, c, g, or other
atggaaagctgaggataaagtttcggtggagggatagactttggattggggaccctgctganattgttcttgatgatgtccacttattgacggaggcttctaatggcttggctttttgttcatangcttntggtattctttcganaccatatctgatatattgcacccatccattttgcagcatttcaaatttagcaanatcttaacctgcagtggacttgcaagttgcacataactatcatcgcatcggcatgccagggtgtatntcatgttga

SEQ ID NO: 2105 - DNA, 275 bp, Zea mays
  misc_feature: Incyte ID No: 700552074H1
gtcatatatactaactgtaatgccgcattggaaacgtgcaggcagcggcggcggagttggctggcgcggaggtcacttggtcgagttaagcgcgtgttgtaatggaggggctcaacgccactgatgctgtgatcaagaagccaaggagtgttgcattcaggaagccaaggtccatgaagcagctcacggttgagtgcaatggcatttgcctgccatctcggagtgctcgtcatgacgatgacactggcgtcgaagctggtgggcagcggaggaaa

SEQ ID NO: 2106 - DNA, 272 bp, Zea mays
  misc_feature: Incyte ID No: 700552075H1
  unsure 82, 193, 248, 253, 260: a, t, c, g, or other
cgactacaaatgttcctagggtaattggcatgatacataatatagattggatctaggatgttcctatgaatgatttactatntatttggccctagatttggttgatagtgtgtttaatcctggtgtcttcttagcctattgttgcgctcgtggttgtgcatgtttacttttgctttcaatgaatgtttacttncacttatttagttgataccgacctattaaagctgacaataacctcaaggtagcgngttantgtaatnagtacatgctga

SEQ ID NO: 2107 - DNA, 275 bp, Zea mays
  misc_feature: Incyte ID No: 700552076H1
  unsure 245, 269: a, t, c, g, or other
gttaaaactttcagcttgcaagtacctcagtgactcatcattagatgccctctacagagagggtgctcttccattgcttgttgagctagatctgtcctactcgtccattggacagaatgcgatagaagatcttcttgcttgttgtactaatttggttaatgtgaacttgaatggatgtacaaactttcaagaattggtgtgtgggtcagatgatagcagttgtgtcgatatgccagttgactttngtgcacctagtccagcaatcaagngtgagg

SEQ ID NO: 2108 - DNA, 273 bp, Zea mays
  misc_feature: Incyte ID No: 700552077H1
gcatgggaaaagtggcgaggtcaagtaactaaactggagtgcagtgcattttggatccagtgcggccaccaaaaaaacccgtgatggtttgaagaatttgcttcatattatgatggggaacataaaggaaattactgctgctacttcccattggctggagctgtttgcttctcattttctttacataaaaccattgactgtgggttttgaagggatgcaccatttagcacagaaatgcatacagcttatgccatcctctggcactaatggatt

SEQ ID NO: 2109 - DNA, 272 bp, Zea mays
  misc_feature: Incyte ID No: 700552078H1
  unsure 231, 264-266: a, t, c, g, or other
gattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcncgctggtacgagaccgtctctgcggtgtagctnnngattcc

SEQ ID NO: 2110 - DNA, 274 bp, Zea mays
  misc_feature: Incyte ID No: 700552080H1
  unsure 266: a, t, c, g, or other
atttcccagtgttccaatgatagctttaactgcaactgcaacaagtaaggtccaaatggatttaatggagatgctccacatcccgagatgcatcaagtttgtcagcacagttaacaggcccaaccttttttataaggtgtctgagaaatcgccagttggaaaggttgtcattgatgagatcacaaagtttataagtgaatcatacccaaataatgagtctggaattatatactgcttttcaaggaaggaatgtgaacaggttgccnaagactgc

SEQ ID NO: 2111 - DNA, 282 bp, Zea mays
  misc_feature: Incyte ID No: 700552084H1
catcagccatcaggtggcgctggcgggaaagtcacagagatgggactacagataagagagatgatgtacgaaaagattaagatcaataaaataatgtcgagaattactggaaaatctgaggagcagattgatgaagacacgaagtttgattatttcatgagtccttcggaagccaaggattatgggatagttgacaatatcatagatgaggggaaaccagggttggtagctcccttggcaggatctgttccgcctcccaaatcgcgtgtgtggtacttgtgg

SEQ ID NO: 2112 - DNA, 278 bp, Zea mays
  misc_feature: Incyte ID No: 700552086H1
  unsure 9, 170: a, t, c, g, or other
gatctcagncatggcggagatcgagagagcgatgtgctgtttcgatctcagccatggcggaggtggagcagccccaggacgcggtgaagctcttcaaccgctggaccttcgacgatgtccaggtgaacgatatctcgctgaacgactacctggctgtgactgcggcgaanacgcgacattcctgccgcactccgcggggcgctactccaagaagcggttccgcaaggcgcagtgcgccatcgtcgagcgcctcaccaactcgtcatgatgcacgggcg

SEQ ID NO: 2113 - DNA, 186 bp, Zea mays
  misc_feature: Incyte ID No: 700552088H1
caaaattacttgaggagataaaagagcataagaggcagattatgttgcaacaaaatgtaatatatgaatcaaacaaaaagagacagagagtggcagagcagtcatcagatggaatactaggggctgagctaattgcctcacatacaaaggacattgaccacagcaatctgtcaagttttgctctcc

SEQ ID NO: 2114 - DNA, 182 bp, Zea mays
  misc_feature: Incyte ID No: 700552089H1
tcagcagtactggggcagctgatgataagtaacatggtaccaagcagaggccttggcctccatggcatcttggccatcctctcctgtgctcatcagcagtactggggcagctacaatgaagggtatgatcggccgcatcttattagcttcccatggtgcgtatatgacaagcttgtggccat

SEQ ID NO: 2115 - DNA, 180 bp, Zea mays
  misc_feature: Incyte ID No: 700552091H1
  unsure 13, 43, 57, 105, 141, 149, 151, 161: a, t, c, g, or other
tgcctcatcaatnatgagtaggttgattctcatctagcggcancattgctcactacnactggtttgcttgagcaacttaatgtcactctcaagaggaccctcctntcgaccgacaccctgaagcaccacacaagctttagnaagtcggnantgtacttcgnatacataaattacatgata

SEQ ID NO: 2116 - DNA, 272 bp, Zea mays
  misc_feature: Incyte ID No: 700552093H1
caacgtgggggtggtgaccacctgattgatttacatggcctgcatgtgaacgaagcaatccacatcctgaagggtgagctcaccgccttgaagagcgcggcgagggcagcaggggagaggatgcaagtcatggtttgcgttggaacaggccaccacaccaagggctctcgcactgcgaggttgcccatcgctgtggagcagttcctgctggatgaaggcctccagtacacgcagcctcaggcgggtctgctccgagtgatggtgtataacat

SEQ ID NO: 2117 - DNA, 281 bp, Zea mays
  misc_feature: Incyte ID No: 700552103H1
  unsure 176: a, t, c, g, or other
agaagatatggcctgggattcaattttatatagatgtgaatcatgctccagctgtgatgactgattaacagtggcagctgcaggttgttcttggcgatgccccagtagttaataccttttgcatattgaagttttagttgtgggaattagagagaataaaactgtcagttttgttngcacaggctgagcctgtcattgccttgtacggaccttgcgcctgcaatttttgcagtctgtaagcgatgcaatgtatgctataactgtaacgacttccgtttcag

SEQ ID NO: 2118 - DNA, 283 bp, Zea mays
  misc_feature: Incyte ID No: 700552109H1
ggagtgaaggaagaaagagaacgaaaggcggcctctcactcgcagtcgcagtagcaggttctagaccaccaaacccagcggctcccgctcatctcagttcggcttcggccttcgcattcctctacagatttcgcagttttgctgggggtaactacggaatggggggcggatccggatctttcctcaaggtcttggtcaacaacatggatgtcctcgcggggcctttggtttcacttgcgtatcctctgtatgcctctgttagagcaattgaaacaaaatctgc

SEQ ID NO: 2119 - DNA, 283 bp, Zea mays
  misc_feature: Incyte ID No: 700552112H1
cacaacccagtcgctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagtggcggaggatggctactctggcgtggaggtgcgcgtcacgccgatgcgcacggagatcatcatccgcgccacgcgcacgcagaacgtgctcggcgagaagggccgcaggatcag

SEQ ID NO: 2120 - DNA, 144 bp, Zea mays
  misc_feature: Incyte ID No: 700552115H1
tgggcagaaattaaagcagtgaagaagagaaaagaaagagcaaaggaacttgagggcatagacatgagtaatattattactagttcgcgtcggagaagtacatcaagtttcatacccctgccaccaccgccgcaaatagaagtg

SEQ ID NO: 2121 - DNA, 116 bp, Zea mays
  misc_feature: Incyte ID No: 700552117H1
ctagttctagactggctatttattttgccatcctctgttgccttggttttgcccattataaatggaacatagagcaatgtagctttcgtcgctgttaatttatatgatgttattct

SEQ ID NO: 2122 - DNA, 280 bp, Zea mays
  misc_feature: Incyte ID No: 700552118H1
aagaaacaatgaaagcaacagataatttcagcacagtcattggaaaggggggatttggaactgtctttaaagctcaatttaatgatggctctatagctgcggtgaaaaggatggacaaggtttcaaagcaagctgaagaagagttctgtagggaaatggaactcttggctaggttgcaccatcgccatctcgtgaccctcaagggcttctgcatcgaaaagaaagaaaggtttcttgtgtatgaatacatggcgaacggaagtctaaaagatcacctgca

SEQ ID NO: 2123 - DNA, 280 bp, Zea mays
  misc_feature: Incyte ID No: 700552119H1
  unsure 120: a, t, c, g, or other
tgctgcctcgtcgccaccaccatcgctcctcctccccgccgccaggggctaggacgaggcaggagacagaccgacagccggcgatgtcaccgccgacctgtcagacatggagacggggcncgagcaggaggcgccggcggaggtggatcccttggtggaatggtggctgctgttccggctccggtcaagaagaagcggaacctccccaagactccagggtcaagttttcttatctccaagaacaattgggttttattcaagcatgtttgggaggaaaaca

SEQ ID NO: 2124 - DNA, 278 bp, Zea mays
  misc_feature: Incyte ID No: 700552120H1
gctgcctcgtcgccaccaccatcgctcctcctccccgccgccaggggctaggacgaggcaggagacagaccgacagccggcgatgtcaccgccgacctgtcagacatggagacggggcccgagcaggaggcgccggcggaggtggatcccttggtggaatggtggctgctgttccggctccggtcaagaagaagcggaacctccccaagactccagggtcaagttttcttatctccaagaacaattgggttttattcaagcatgtttgggaggaaaac

SEQ ID NO: 2125 - DNA, 279 bp, Zea mays
  misc_feature: Incyte ID No: 700552121H1
  unsure 42: a, t, c, g, or other
ctttgttgtctgatggaaactacaatacagacaagatcaatngttcaaaccctgatgactatgagaaatttgagaaagggataatgcactatgggtgtccacattatagaaggagatgccgcataagagctccttgctgcaatgaaatttttgattgccgacactgccacaatgaaactaagaattccattaaaattgataaaatgaagaggcatgaacttccacgccatgaagtgcagcaggttgtatgctcattgtgtggcactgaacaggaggtgc

SEQ ID NO: 2126 - DNA, 74 bp, Zea mays
  misc_feature: Incyte ID No: 700552124H1
  unsure 51, 60: a, t, c, g, or other
ggttaaacaaggccttgttggttagaaggtttttgattttagtagtttccnttctagagntgattattgtgaaa

SEQ ID NO: 2127 - DNA, 213 bp, Zea mays
  misc_feature: Incyte ID No: 700552125H1
cgagaggaagatggatataatatttcgtctactcttttttctttttcatgtagttttgatttcgcatgtatgtgcatgcagtacagtggtgatgaattgtgcccatgggaatttggtcttgtgaggcgattttagttactgtccctttgtacagtagaggtatggcgttctctgtaactatgcatccatcagggcatcgggcttcgggccaaa

SEQ ID NO: 2128 - DNA, 281 bp, Zea mays
  misc_feature: Incyte ID No: 700552128H1
cccactcgaaagggctgttcttgatggtcgtcaacttgcactgaaaataagtgcaaactcagtttatggtttcactggagcaactgttggtcagttaccttgcttagagatttcttcaagtgtgaccagctatggacgacagatgattgaacatacaaaaaagcttgttgaagataaattcacaacagtaggaggttatgagcatactgcagaggtaatttatggggacactgattctgtgatggtacagtttggtgtttctacagttgaagatgcaatga

SEQ ID NO: 2129 - DNA, 285 bp, Zea mays
  misc_feature: Incyte ID No: 700552132H1
cattgatatttcatgaaggcaaggcccctaagggcgacagaactgattgggtgatgtatgagtacagaatggaagatgaggatttggtttctgctggtttctcaaaggatgcttatgtactctgcaaaattttcaagaaaagtggccttggtccaagaatcggagagcaatatggggctccatttaatgaagacgaatgggataatgcagaagtcgaaacttctctgtttcctttgacttgttcagaagtgaatccaacagagggacaacgtgctcagcctactg

SEQ ID NO: 2130 - DNA, 283 bp, Zea mays
  misc_feature: Incyte ID No: 700552133H1
gcgacacggttggagacccattcaaagaagtacattgagactggtgcccttggtggcaaaggcagtgagtcccataaggctgcggttacaggcgacacggttggagacccattcaaagacactgcaggaccatcgctgcacgttcttatcaagatgctcgccacgatcacactggtcatggctcccatattcttgtgattaaccaaccagatttatcaagcttgccattaaccctgcggagatgtatctatgcgacttgtagatgaggtgtttacctgcatgt

SEQ ID NO: 2131 - DNA, 277 bp, Zea mays
  misc_feature: Incyte ID No: 700552134H1
atctaagcagatctggatagttaagtttacaactattaactaaaatcacaatgaatacgagatcggtcaatactctaccctatcgaaagctactgtcactcacagtttgctactaggtcactgttgcatcgggtactagttgattgtgcttgaggattttaattttttgaggtcatctagagtaatttattgattggggcacatctagagtaatttattgattggggctgtgctggcacaaaatgaagacaaatgcacacatggaactgatctggtc

SEQ ID NO: 2132 - DNA, 276 bp, Zea mays
  misc_feature: Incyte ID No: 700552135H1
tgggaaagtcagttccaaaactaagaggaatatacctccgcgggggcaatgcatgctgccaaacaagtgagtggactgtgcaacttgacccaaaatttcatgagggcgcgagtaacttggagcaactggttccttttgaggagtgcctgcaactgcattctactgatacctctgtggttcaaattcctgagtatatactggtgacaaacaatggacgcagtttcaacattgttgtcaatcctgctaatatcagcagtggccttcactattttgaag

SEQ ID NO: 2133 - DNA, 275 bp, Zea mays
  misc_feature: Incyte ID No: 700552137H1
gtggtttggcgttgagggtgattacaatgttttggttatggacttactgggccgagtcttgaagatctttttagcttttgcaacaggaagttgtccctcaaaactgttttgatgcttgctgatcaaatgatcaatcgagttgagttttttcattccaagtcattcttgcatagagatatcaagcctgacaattttctcatgggtctcgggaaaagagcaaaccaggtttatgttatcgattttggacttgcaaagaagtacagagatacatcaac

SEQ ID NO: 2134 - DNA, 235 bp, Zea mays
  misc_feature: Incyte ID No: 700552138H1
ttgcaaatgcagaaaaggaaaaagaggagagtgaagagtgatccacgcttatctttctgtgatgacattgagaatggaagtgacgaagatgattttgagaatcaagaaaccaagaaaaatggccctgccaaacttgggaaggatccaactgtggagacaagttttctacctgatagagtgatccttcagagaaagggaggcagaggaacaagcagaacgagaacgactgaagaag

SEQ ID NO: 2135 - DNA, 114 bp, Zea mays
  misc_feature: Incyte ID No: 700552139H1
  unsure 25, 28, 40, 95: a, t, c, g, or other
gtggaacagaaattactctttattngtnatcatctctcanataaagagtaatttctgttccacgtgaaattactctttatttgagagatgatganaaatatgagtttgctgacc

SEQ ID NO: 2136 - DNA, 278 bp, Zea mays
  misc_feature: Incyte ID No: 700552140H1
  unsure 31, 47, 49, 53, 231, 233: a, t, c, g, or other
gttttgggattcgtcccgtctgttcgcttantctacatattcgtttngntttnctgtttagtacagaatttctagatttacagacttactacttgatatcctgtactaaacagcaaagccaaacgaatatgtagagtgctctggtcttcctccaatgtctgaagctgaggctcatgcttttgacgtcaactcttttgacctctacaaagaattatcagggcttgttgagtnangaggcatggacaataacttcaacaccagcaatgtggaaaccacag

SEQ ID NO: 2137 - DNA, 277 bp, Zea mays
  misc_feature: Incyte ID No: 700552143H1
  unsure 220: a, t, c, g, or other
ttttgtatatctctcttatctgcaacaggttttccaatatttgttctctatacttcgatagcttatcatattttttctttgttgaaaaacaagaaaactaaatgtagccgcctcttcaaaaatggagtgaaggaaggatggttttggagagtggtttagagaagtttatctattggagtttttttatttgttttctaaattttgttataaagaaacatgnagaatgtcttagagattctctaagaaaaatgctagctatgaacttttataaagagaa

SEQ ID NO: 2138 - DNA, 278 bp, Zea mays
  misc_feature: Incyte ID No: 700552144H1
gagcgatgcaatggtgaggcgcatcaacgacgcgttcgggcagccaggttaccagccggtgatactgatcgatcagcctctgcagttctatgagaggatggcttactatgtcgtcgcggagtgctgtttggtcactgcagtgagggacgggatgaacctgatcccatacgagtacgtaattgctcgacaagggaatgagaagatagatagtattctaggccttggtccggcttcaaggaagaagagcatgcttgtcgtgtcagagttcatcggctgct

SEQ ID NO: 2139 - DNA, 89 bp, Zea mays
  misc_feature: Incyte ID No: 700552145H1
  unsure 35: a, t, c, g, or other
ggccttgtagcagcagcatcgacgcaaagcttacncagtcctcctaattttatgtgggcagctaacaaccgtggcgctgttccctggcc

SEQ ID NO: 2140 - DNA, 281 bp, Zea mays
  misc_feature: Incyte ID No: 700552146H1
gtgcagcagatgagcttagatggtgatttggggaacaatgtcctctccaaccaggcttgcagcagctcagatggtgggaatgcctggaagcctcgccgcgaccagaaccctggtaacccttccatcgggttctacgaccaatttgagtgacctgatcacggaaattcgagatgagaattatagctgcaaaaagcaaccagtgtccagccatctacagaattatcgccacggaaagggtaagcagatgcaggatgctgtagacgtcttggcttttatagttg

SEQ ID NO: 2141 - DNA, 279 bp, Zea mays
  misc_feature: Incyte ID No: 700552147H1
  unsure 44, 88, 142-143, 148, 155: a, t, c, g, or other
attgacataagtaatcttctcatgtcaatgttgttttgttgacnctgtaacaaaacaacattgacataagtaatcttctcatgtcaangttgttttgttacagggtaaacagaggttccttgagcaatgcagtctctaacannacaanctactgntattggtgtgagttgccgcttgatatgaactaagctttatttaccaataatataaacttcatgcctgttagttgtatataattgatttttttgttgaatgacatttgattactatgccctgtca

SEQ ID NO: 2142 - DNA, 282 bp, Zea mays
  misc_feature: Incyte ID No: 700552148H1
agcggaagaaagggaagctaccgaaggatgctcggacggtgttactagagtggtggaacacgcactaccgctggccttatcctacggaggaagacaaggtgaggctcgcagcaatgaccggtctcgacccgaagcagatcaacaactggttcatcaaccagaggaagaggcattggaagccatcggaggacatgcggttcgcgctcatggagggtgttgccggtgggtcttctgggacgacactctacttcgatacaggcacaattggaccctgaatcatac

SEQ ID NO: 2143 - DNA, 279 bp, Zea mays
  misc_feature: Incyte ID No: 700552149H1
ggctgcaatggctcgcacgcttggagggactgccgcgatggccgtgcatgagaaatgtggtgttctgcccccgttcacgcttccacctattcttgatgcatctgatgctttagcttcatgctgcttagcgttagtaaagcctaagcactagactacacaatagagggcgtgagcaatggcgaagaagggtaaacttcaatcttcggctctttattgtgttgaccccaggttatataaattatgtttttggacgagatgtgtaacgtgcctaagttccag

SEQ ID NO: 2144 - DNA, 276 bp, Zea mays
  misc_feature: Incyte ID No: 700552151H1
acatactctttgtcatctccaaaccagatgtgttcaagagcccgaattccgacacgtatgtcatattcggcgaggctaagatcgaggacctcagctcccagctgcagacccaggcagcagagcagttcaaggctcctgacttgagccagatgatctcgaatccagagacgtctggcccgggacaggaggacaatgatgaggaggtcgacgaaactggtgttgaggccaaggacattgagctggtgatgacccaggcatctgtttcaaggcccaagg

SEQ ID NO: 2145 - DNA, 275 bp, Zea mays
  misc_feature: Incyte ID No: 700552152H1
  unsure 59: a, t, c, g, or other
gtactctcttgcccagtacatgatatcaaggcgcataagaattgctgggatgagatacncttgaaataggtcatgtaactttctgaggctgtcactatacatcaatttctttcaaagctcaggaacagatacttcattgcctgatcctctcgcagcaaaattgtgctatgtagcagagaaacaagtgtcgatcaactttgctttttttgtactgaatgattgcatactgagtgtaggctaaaggtgttgtcgcatatatagatgtattttaacag

SEQ ID NO: 2146 - DNA, 275 bp, Zea mays
  misc_feature: Incyte ID No: 700552153H1
attttcgtctcctccccacagcagcccggcgaaaaccctagtaagcaaaccaccggagcagcggcgcttgcgcgggcggagcatgggcggacgacgattacaacgaaattgacatggggtatgaggatgagcccccagaaccggagattgaggaaggagctgaagaagagcctgagaacaacgaagatgcccctgatgacgtcataggtggtgagggtgaagataaggaacaggaaaagaccaagcgtgaacgcaaaacaacaaaatacatgacg

SEQ ID NO: 2147 - DNA, 274 bp, Zea mays
  misc_feature: Incyte ID No: 700552155H1
tggaaatatggtcatttcaatccaagttctccgcaatgtgaccaacaacttcagcgaggacaacatccttggtcgaggagggtttggcactgtttacaagggtgaacttcatgatggcacgaaaattgctgtaaagcggatggaggctggtgtgatgggtaacaaggggctaaatgagtttaaatcaggtattgctgttttgaccaaggttcgtcaccggaaccttgtttcgctgctgggctactgccttgatggcaatgagaggattcttgtg

SEQ ID NO: 2148 - DNA, 277 bp, Zea mays
  misc_feature: Incyte ID No: 700552156H1
ggtacattgcaggttgagaaattgcgcatttgtagattttagggacgaggcggcagtaatcacgcacattcgctcttgaacaggttgaggtttctgggaaaagtgttgactgtcgagcgagctaactgtccaaatgcaaatgagtctcacctgaagcatcaggaccaattagggcatggggcgtcccaggtaccaagtattagttcccaaactcagaaggaccacacatcgattgccgaaccaattgcccccaagcttagtgtggactacccatttc

SEQ ID NO: 2149 - DNA, 277 bp, Zea mays
  misc_feature: Incyte ID No: 700552158H1
  unsure 177, 190-191: a, t, c, g, or other
aaaaatttctttcatgtgttgaatctgggaattctacggtttcagagaaaggaattctgcaaatactgctagacttgcgtttcgttggtgatgtcctatcaggaggtaaaagttcttccaccaacagtcctgaaatgcagacaaaacaggattttttgccaagcgccgtcaccattnacttccttcaggnnaaaacagtcacaattacaggcagactcagctgtcatagagcctataaacaagttagtcaacaggctctcacagagattggatccta

SEQ ID NO: 2150 - DNA, 277 bp, Zea mays
  misc_feature: Incyte ID No: 700552159H1
cctaatactcgccttccaaatggccgctttttgccaccacttttcaatttcaagcctcacgaacttaaaggagtcccatcagacattgtcgcgaaattgattccagaacatgcaaagaagcaatgctcctatgttggattgtgaaatgaccgcgccttgagactggaacctgtggttgcaattgtgcatttcccctgggatgtttgacgatctgaggcatgcgagcctgttgttgaagatgcaaggttacgtacttgtacgacaatgtgacctgtgt

SEQ ID NO: 2151 - DNA, 276 bp, Zea mays
  misc_feature: Incyte ID No: 700552160H1
gtaatttgaaggtcattggcactgatgtggaacgctgtctgtccatgtgtgttgaggagaggttacgggggtttataagaagtataataaggttctctaaacagagggttgaggttgaaaagtcaagacatcatttttatccattatcctcagatgttcgcagtcatattatgagagtgaatcgagaagcaagagaacagtgggagaaaaagcaggctgaagatgctgagagaattaggaaacaaaatgatggagatggcaatgcaaatgttgatc

SEQ ID NO: 2152 - DNA, 66 bp, Zea mays
  misc_feature: Incyte ID No: 700552161H1
  unsure 12, 15, 19, 35-36: a, t, c, g, or other
gacttcatatancantccntaggaggacccagcannacacacagccgagctttgcttaggcaagat

SEQ ID NO: 2153 - DNA, 280 bp, Zea mays
  misc_feature: Incyte ID No: 700552162H1
  unsure 234-235: a, t, c, g, or other
agaaaagtagctgcacaagaaacactttcgaaactgaagaattatgggtacaagcataaaagaaagtcgctggaggaaattttgcgttctaccacgaaaaaagaatcggaactgataggctatgatgaagaaccaatcaatgttgaggatgacattgacatgcaaatgaataatctactgataaatggagaaagaacctccattcagagtacagcgggagataacaaggttgannagaatgatgctaatagtggaaggaataataagtccaatgtggtca

SEQ ID NO: 2154 - DNA, 211 bp, Zea mays
  misc_feature: Incyte ID No: 700552164H1
ccacatcgtcgcctatccatccccaccgctcccactgccacgattcacaagaggtgtcgagatgtctcagaacaacccctcccagctcctcccctcagagctgatcgatcggtgcatcgggtccaagatctgggtgatcatgaagggggacaaggagctcgttggcaccctctgcggctttgatgtctacgtcaatatggtgctggaggac

SEQ ID NO: 2155 - DNA, 271 bp, Zea mays
  misc_feature: Incyte ID No: 700552168H1
  unsure 202: a, t, c, g, or other
tcaaccggaaccttctctcattctccacctgcggcctctgaggaagacatgcttcgtgcttctcaagctgtgcttccgtttgcaaactccatgatatcgacggcgcaagtgattttctctggtgaaccttcaatgactctcaaagtattgcctttacttctgttcggtgctaaatatgggggccttgttacagtgtggaggntttagctgcaggatttttcatcagttttacagtcccaaagctatatagctgttattcaagtcgtattca

SEQ ID NO: 2156 - DNA, 273 bp, Zea mays
  misc_feature: Incyte ID No: 700552169H1
  unsure 240: a, t, c, g, or other
gactgcgctaccgctgaggcggtcgtcgctctcgggcgccgagcagcagtggaggaagacaaggctcatctccctcatggatgacgtctgcaggcgatacaagcagtactaccagcagctgcaatccgtgatctcctcgttcgagactgttgcagggctgagcaacgcggcccccttcgctttcatggctcttcggacgatgtcgaagcacttcaagtgtctgaaggggatggtgatganccagctacggaacacgagcaaggtcatcgccaa

SEQ ID NO: 2157 - DNA, 273 bp, Zea mays
  misc_feature: Incyte ID No: 700552170H1
gtggaatgaatgatttctttaggaacattttcggggatagggactttggaggacgagatgttaaggttgcactcgaactatcatttgtggaagcagttcaagggtgcagcaaaacggtcaccttccaaacgtctgtaacatgtgaaatctgtggtggagccggtgtgcctcctggaaccacacctgaaacatgtctatcttgcaggggttcaggatttatattcatgcaaaccgggccattcaggatgcaatcaacctgcacaaaatgtggtg

SEQ ID NO: 2158 - DNA, 274 bp, Zea mays
  misc_feature: Incyte ID No: 700552171H1
  unsure 188: a, t, c, g, or other
ggcaatgcagactggaagcctttgcagttcctatgttttgctttcttctgcagaatactacagaagctaagagctactgaaccactaataactccaatatacaatgaatatggcgaggttgaaggacgaggaataagaatggcaaaaagagtagtccgtgctctgggtttgatttttggatgtgtgtncactgcatccctggcttatacagcagctagtaacatggttgagctttcattgcagtatactccccgtatgttttactactatcagg

SEQ ID NO: 2159 - DNA, 148 bp, Zea mays
  misc_feature: Incyte ID No: 700552172H1
gtgtgtgtacctttctcttcctttcacctgcctgtctcctccctagatctgagatcatgtggctagctctcccatatcaaaatgtactagctacacgcgcacgtatggtggtctctgctaagcctaagcttcactgggtagtagggta

SEQ ID NO: 2160 - DNA, 274 bp, Zea mays
  misc_feature: Incyte ID No: 700552173H1
  unsure 27: a, t, c, g, or other
atggaaagctgaggataaagtttcggnggagggatagactttggattggggaccctgctgatattgttcttgatgatgtccacttattgacggaggcttctaatggcttggctttttgttcataggcttgtggtattctttcgataccatatctgatatattgcacccatccattttgcagcatttcaaatttagcaaaatcttaacctgcagtggacttgcaagttgcacataactatcatcgcatcggcatgccagggtgtatttcatgttg

SEQ ID NO: 2161 - DNA, 99 bp, Zea mays
  misc_feature: Incyte ID No: 700552174H1
  unsure 95: a, t, c, g, or other
cataaaatagtcgcgtttcaaactgtacattttatgtagcacgaaactggtccataagcattcccatttatttgaagctccccatccccaggaancaaa

SEQ ID NO: 2162 - DNA, 276 bp, Zea mays
  misc_feature: Incyte ID No: 700552176H1
  unsure 83, 143: a, t, c, g, or other
ggaagagagcaaaagatctcttgtacaaggactacaactttgatcaaaagttttttttgtcgacatgttctaactctggtttnaatctcacagccactggtgtgaagatcaatgaagacttcattggtgatatacggacacancataaaagcagcagaaccactgttgatgtcataatcgatagtgattctaaagtgtcaaccacagtcactgttgatgaagcactaactggtttgaagacttcatttgccttcaaggttccagatcacaagtctg

SEQ ID NO: 2163 - DNA, 277 bp, Zea mays
  misc_feature: Incyte ID No: 700552177H1
  unsure 75: a, t, c, g, or other
tccaaacacttgcgccgccactgcctcacaggtaaggccgccatggtctccggttcgggcgtgtgcgcgaagatncgttggtggacgcgcgccaccacatgctgggccgtctctcctcgatcatagccaaggagctgctcaatgggcagaaggtggtcgtcgtccgctgcgaggagatctgcatgtcgggcggcctcgtccgtcagaagatgaagtacctccgcttcctccgcaagcggatgaacaccaagccgtcccacgggcccatccacttccg

SEQ ID NO: 2164 - DNA, 276 bp, Zea mays
  misc_feature: Incyte ID No: 700552179H1
  unsure 69, 241, 245: a, t, c, g, or other
agattaccttgggcaaggctaccagggagataccaagagtttccttgtttgcaagaagaaaatggctanttctccggagatgctttgttgttattgtccagctccattcaaacagtttcttgagattgtcacaaatatgaaatttgacgaagagccaaattatgccaagcttatctctctttttgatggtttgattgaagcgcctgcttcgagacaaatcagaattgatggggctctcaanggtnggcagaacgttggaaaattggtgcagatcta

SEQ ID NO: 2165 - DNA, 273 bp, Zea mays
  misc_feature: Incyte ID No: 700552180H1
  unsure 259: a, t, c, g, or other
gggagctccagcagatcccaactacggaagtgcgtacccacagcagccagggtatggtcctcctggtcaggcaactggtcaggctggttatgcatcctctgcgccagggccagccagcctgtgtatggccaggctggatatacccagccacctacaaatcctccaagttatgatcagtctgcagcaccagcggcgactcagagcggttatgctgcgccccctgcaaatccacaacagcctgtgcagcaaaaggggttcnccacagcctgtgtg

SEQ ID NO: 2166 - DNA, 271 bp, Zea mays
  misc_feature: Incyte ID No: 700552182H1
  unsure 116: a, t, c, g, or other
aacaatctaggtgcatatggcagcagttctatttatggtgactccacctggaggttcaactcatctgaggttgatatacctccttttggtcatgatcttggaaatgttgatccagntattaaatcagaaatatcagcaaactatatgggcaactatactgttaataataatcagacaagcagaggtatcacttcctaggaagagtattattatattcatacatgacttgggataggtgaaatacccactactatatcaggctttcaggtgc

SEQ ID NO: 2167 - DNA, 112 bp, Zea mays
  misc_feature: Incyte ID No: 700552185H1
  unsure 20, 23, 50: a, t, c, g, or other
gtgaatgggatcttctacanaanaacctacctgaatctatatacggtagngtctatgaggacaggactgatctgctgagggctgccatagtcgggccagcaggaactccata

SEQ ID NO: 2168 - DNA, 272 bp, Zea mays
  misc_feature: Incyte ID No: 700552186H1
  unsure 23, 76: a, t, c, g, or other
cctgggcatataattgtgtagantcatattttctattgtgtatgctgcttattctgttagtcaataaatatgcatncaaatttttgtttagaactatttttagaaaaaaacatacttcatgtgcaaaacattgcctggcgaatttttatgctttacttgtatatttgtggatcgtactatggtcttgtaactatagtttaatgtcagtggaacacaaacacatgaagttgttctgataacgataatccttcttgaataattcctatatgtaa

SEQ ID NO: 2169 - DNA, 240 bp, Zea mays
  misc_feature: Incyte ID No: 700552187H1
  unsure 177: a, t, c, g, or other
aagcccttggtttgtacgatgatttccaatgcgatggtgaagatatctctgtggactcggatgagatcaatgatcgtcgtctatcgcatatgaacgagcgtatatgagatatttgtttgcgagagagttcagtttgccattgatgtctgtagcttatgaagcccttagttagttgtnactgttgttcctggtacttgtatgaattgggttatgaaaatgaagagttgtgttatgagttgt

SEQ ID NO: 2170 - DNA, 273 bp, Zea mays
  misc_feature: Incyte ID No: 700552188H1
  unsure 149: a, t, c, g, or other
agtgaacagcggaggagctccaataatctgatgtgggaacatgagctggcatgtttgaggataagaagataggtgatgagttcttttcctttattgttgactataaagatctgaaggcatgtactattctattgaggggagcaagttgncaattggtgcccactaatagtctggtgatctagccgaatgaaattgtcgacaaggccattagcatcatgcaggttacctccaagcatctcatgtatatctgcaaggagaatctgcacccacgaa

SEQ ID NO: 2171 - DNA, 88 bp, Zea mays
  misc_feature: Incyte ID No: 700552190H1
  unsure 20, 63, 73, 79, 84: a, t, c, g, or other
tgcctcatcaatgatgagtnggttgattctcatctagcggcaccattgctcactacaactggnttgcttgagnaacttnatgtnactc

SEQ ID NO: 2172 - DNA, 136 bp, Zea mays
  misc_feature: Incyte ID No: 700552191H1
  unsure 38, 41, 56, 69, 83, 124, 129: a, t, c, g, or other
tgcctcatcaatgatgagtaggttgattctcatctagnggnaccattgctcactanaactggtttgctngagcaacttaatgncactctcaagaggaccctcctttcgaccgacaccctgaagnaccanacaagcc

SEQ ID NO: 2173 - DNA, 273 bp, Zea mays
  misc_feature: Incyte ID No: 700552193H1
aaaaaaggcccagaggcggtgccgtgaccgattcgagacgcaagagaaggatcgagacgaggcggcggttttccgggggcagcatcggcgcggccacgaaagatgtcttactcaaggggctcaagtgaaaggtatggatctcgctcaccttactcgagaagcacaaggtaccgaagtcgctctaggagtgtcgactctagcgatgctgaaaaccctgggaacaacctgtatgtgactggtttgtcggctcgtgtaacggatcgagatctggag

SEQ ID NO: 2174 - DNA, 275 bp, Zea mays
  misc_feature: Incyte ID No: 700552194H1
gcaaggcagatctagggcgatcatgggcttacgtcgagagaggtgttggaaggtcttgtttatctgcatgaacaaggtgtcattcatagagatatcaagggcgcaaatatactgagtaccaaagagggaatgtaccatgaatcacatgaatttggtggtcatatgttcaacaccctcctagagggtgttctcgacaaagaaagcttgtaccttaaaacaggaggatacaagaagctgaagtggttgtctgaaagcttttgaactgcttgaagcat

SEQ ID NO: 2175 - DNA, 272 bp, Zea mays
  misc_feature: Incyte ID No: 700552195H1
ataatatgggatctagagttgactatgatgcaccaggtcattggtgcactacaatggcatatagcgcagatggttcaaggttattttcatgtgggactagcaaggatggtgaatcacatctagtagaatggaatgaaagtgaaggagcagtgaagagaacatatcagggatttcgtaagcgatccatgggtgtcgtgcaattcgataccacacggaacaggtttttggccgctggggatgaattcatgattaagatatgggacatggacagc

SEQ ID NO: 2176 - DNA, 275 bp, Zea mays
  misc_feature: Incyte ID No: 700552196H1
taaccaccaacacatcggtcacgcctctactgtccgccgagacgctccccctggccagaaggttggtctcattgccgctaggaggactggaaggctcaggggtcaagctgctgccacagcctccaaggctgacaaggccacctagagttattgtcgttgtttatctgtctactgtgctttagattgttaaaggacatgtgtttcagaacggatgtgttgttgcctcgtactatggtgaaacattgtctcagtttttgtggtcgctgtcaggattt

SEQ ID NO: 2177 - DNA, 280 bp, Zea mays
  misc_feature: Incyte ID No: 700552202H1
  unsure 5, 9, 14, 17, 197, 241: a, t, c, g, or other
tgganagcngaggntanagtttcggtggagggatagactttggattggggaccctgctgatattgttcttgatgatgtccacttattgacggaggcttctaatggcttggctttttgttcataggcttgtggtattctttcgataccatatctgatatattgcacccatccattttgcagcattcaaatttagcaanatcttaacctgcagtggacttgcaagttgcacataactatcatngcatcggcatgccagggtgtatgtcatgtggataaccgg

SEQ ID NO: 2178 - DNA, 288 bp, Zea mays
  misc_feature: Incyte ID No: 700552209H1
  unsure 250: a, t, c, g, or other
gactttcctgctgaaaaagaaagactgcaaaaaatgattaagaaatctaaggacccagatgccattggagaaatgaagagtcgtgtcacgtggattgataagcaggtgaagtctcatcctccaaagaacgttgaatcggaaatcttgcgtgagcatatcaagaaagagagggaggcagcaaaggctggaaaacgaccatactatctgaagaaatctgaacttcgcgaaaggaagctgatgaacaagtacnacgagctcaaggaggcaggagagcttgatgcattcatg

SEQ ID NO: 2179 - DNA, 284 bp, Zea mays
  misc_feature: Incyte ID No: 700552210H1
  unsure 53, 89: a, t, c, g, or other
aagttcaggtgatggccgtgatgcgaacttctgatcctgcttatcgaattttnactacggattactactttttaagactacatatccantcttgatggctgaatgacgaccctagttatcgagacgcaaaaccttttgttgtatgtgttccttttacagacttccttggcttgtcatgaatttctaatgtgaacttgtgctgtgaacttgttgcaaaacctcttgaacctgaagcattcaacatgctgtgaacttgtgcagctgctcttcttctgcatgagttc

SEQ ID NO: 2180 - DNA, 286 bp, Zea mays
  misc_feature: Incyte ID No: 700552211H1
  unsure 160: a, t, c, g, or other
ggtggctatgaagtgcaaattgaaacgctttgctccttctgtttttcagataaggtatggcggttacaaaggtgttgtcgctgtagatacaagatcaaatcataagctttctttgagaaaaagcatgtcaaagttccagtcagaaaatatcactcttgangtccttgcatacagcaagtaccaaccatgcttcctgaatcggcagttgattactcttctctcaacacttggggttagcgataatgtctttgagctaaagcagaaggaagccttaaggcagttgaac

SEQ ID NO: 2181 - DNA, 285 bp, Zea mays
  misc_feature: Incyte ID No: 700552212H1
  unsure 217: a, t, c, g, or other
agaaatggtatgacccgtccatccaaatattttgaacagtgcagagaaaactgttgaggccttttattctcttcatagctgagatttgcattatgtgggtagccacctttatcttctctagttcctttttttaacttgatgttgtgttatcacttaagtatatttatgtgtattcaggaatcatgagtattactatagtcatgaaccaacctttaanatacctatgtgggtgcagtaatctggcaatattattatgaccgatgtgctgtgtggtgttgaatttag

SEQ ID NO: 2182 - DNA, 285 bp, Zea mays
  misc_feature: Incyte ID No: 700552213H1
  unsure 28, 64, 103, 115, 118-119, 127, 143, 148, 221, 223-224, 260, 274: a, t, c, g, or other
tccgaattcccaggcaggcaggtcggcnaggagggcaggaagaccgaagaccgagccgtgcggnggctcgggacgggaacgggacaggaccccaaaatctcanatccttcctgcncgnncgcccgtncccgtcgacgcgtcgntcttnccggccgcgcctcacctccgcactctcctcctcgagggggatcggatacgccacaggctgcgcgatggtgctntnngtcttcggctacggctccctcatctggaaccccggnttcgacttcgaganaaaatcctcgg

SEQ ID NO: 2183 - DNA, 77 bp, Zea mays
  misc_feature: Incyte ID No: 700552215H1
  unsure 73: a, t, c, g, or other
gtagtagctattgaatgcatatgaagcatgggaagttaaagtgtccggctggtagcagcaaaatggagccaangttc

SEQ ID NO: 2184 - DNA, 118 bp, Zea mays
  misc_feature: Incyte ID No: 700552217H1
  unsure 6, 11, 15, 25, 63-64, 73, 76, 82, 86, 89, 92, 108, 112: a, t, c, g, or other
agagcnacctnaacngcacctgctnactgctcaaggccaggggcatgatccagactggggacnncgtgatcgntcnctcggncatnctncantccatccaggtgatgnacgnaccctg

SEQ ID NO: 2185 - DNA, 289 bp, Zea mays
  misc_feature: Incyte ID No: 700552220H1
  unsure 138, 171: a, t, c, g, or other
ttgccctcttccgttccgtctcattctcatccccgacccccgcaccgcagcgtaaaccctagttccccggcggcgaccttgcggcctccgctgcgctctgactggtgcgcgtttagacgaggagctgcggcggccaanaccaatcgaccatggctacccgtatccagtttnagaacaactgtgaaattggtgttttctccaagctgacaaatgcttactgtctggtagcgattggagggtcagagaacttctacagtgcctttgaggctgagcttgcagatgccatccc

SEQ ID NO: 2186 - DNA, 288 bp, Zea mays
  misc_feature: Incyte ID No: 700552222H1
  unsure 30, 50, 56, 62, 69, 78, 126, 188, 223, 276, 278-279, 284: a, t, c, g, or other
ccaaggatgatgtacgggaacatcgccaancacgaggcgttcctgatgangaagcncgaagngcagcanccaggccancgagctagagggccgccgcttcatggggctgcatctcctcgacctcangatcaggggccaccacctcggctcctcccccgccacgaccgtcgtggggcaaggcgagggcngcaagggcagtggcaatggcaatgccgtccagctngaggatgtcatcgtccaagatactcctacgaagatgaacagtaacagccttgngnncggcncctg

SEQ ID NO: 2187 - DNA, 287 bp, Zea mays
  misc_feature: Incyte ID No: 700552223H1
  unsure 37, 49, 65, 108, 119, 137, 157, 177, 198, 251, 272, 274: a, t, c, g, or other
gatacacctagattacaagccgccaagcggaaattancaacaacattanaggagaactacaagcnatgcatagacgctacatcgaccgacccaccccttggcaatcancaacaaaaatnccacaacaatgtccttgnaccgcaacactgcaatatantcccacggtccgacgattgnataggaccccacagtcgtccntggaagtgtgtattcatgaaccgaggcgatacatgccgtcggccatgaacggnccgtccatgtacagagcagcngngttctgcgggtgg

SEQ ID NO: 2188 - DNA, 285 bp, Zea mays
  misc_feature: Incyte ID No: 700552225H1
gcaaaaacttctgtgagtaaatgtaatcggaatcctgtttggaatgaagagtttaagctgtcagtttaccagcagtgcgggcctctgaagcttcaagtgttcgaccacggcatgctgtcaaaggacaattcagaagcaagaattctggtttcagaaaaaagagtgtcgatggtacagttcaagaccttggaacacatgctgcttcactcagggcatcaagattctggatgtgctcagattctgcatcgacttgagggcaagtcgagttttaaggaggagggaatg

SEQ ID NO: 2189 - DNA, 284 bp, Zea mays
  misc_feature: Incyte ID No: 700552228H1
cccagggaaactgttgacgaatcctgtcatttacagagtcgcaaacaagcgttcttccctggggcttcccatagtttccttggtgctccggtctgttgtaccattgcttcatagatagcaacgattccttgttaaacgtgtgctgtgttgcaggttgcgttagggccaagtcctagcctttgtgatggtgattacatttaggggtggtcaagattcacttatttatgtttcttcaccctttcctggactcggcgacttttttcatgtcgaactctgaattttct

SEQ ID NO: 2190 - DNA, 132 bp, Zea mays
  misc_feature: Incyte ID No: 700552229H1
  unsure 67, 72, 90, 94, 112-113: a, t, c, g, or other
gtcataatgtaccaattggtgtgtcaatgtacatctttataggacataatgactaccaacttcactngcttncatcttctgtcctaccanaganaatgaaagcaagtgaagnnggtagtcataatgtaccaa

SEQ ID NO: 2191 - DNA, 285 bp, Zea mays
  misc_feature: Incyte ID No: 700552230H1
tatagtcgtgtgctgcctaccaactgcataaaaaggtcccgaaagaaacaaacaggctatgattgtgcgtttatatggagctcatgacatattttcagggcgtgttatttgtgagcaactggacaattcaaaacatctgaatgggtacttcagccacagacttctggtgaggtgcagtgataacagcagagatatcccaatttgtatagcagataaatgtactgaacaaaccgtgggcattcttttaactatatacatgcatgacaattcttctctctctctctc

SEQ ID NO: 2192 - DNA, 286 bp, Zea mays
  misc_feature: Incyte ID No: 700552232H1
  unsure 156, 166-167, 170, 180: a, t, c, g, or other
aaccttcttggagataaactcggaaggggcgttctgtcattctgtaatatggccaatctgccatatccaaccaacatctccatgatctgttgatcagctgttcttcagtctgttcacttaagagcccagttttggcgtcttatacaaatgcatganaatctatagnngtngtattgaaanaacaatacaacttccatcctttaaaactttcagaaaccatcttgcataacacaacagtttataatatttttattcttttgaagcagacatgatgctgtattattat

SEQ ID NO: 2193 - DNA, 126 bp, Zea mays
  misc_feature: Incyte ID No: 700552234H1
  unsure 85, 87, 94: a, t, c, g, or other
caaattgcatgagattataagatacccatcttagcatgtttaacttgtagaataatgtcattgaatttgatatccataacctctngngtttgtnctgagtcatgttatggcatggcatcacatgac

SEQ ID NO: 2194 - DNA, 87 bp, Zea mays
  misc_feature: Incyte ID No: 700552239H1
  unsure 70, 81: a, t, c, g, or other
gacatggaggcggccgtattcggggccatgcttcgcttacatgtacaccgatcgtggtgcccgagcttanagcggcagganaacggc

SEQ ID NO: 2195 - DNA, 147 bp, Zea mays
  misc_feature: Incyte ID No: 700552240H1
  unsure 69, 110: a, t, c, g, or other
ctcgcatccagccgccaccaggtgcagagtctttcgtcatctcttctccggcgaagaacccccagtcgnccaccagatcacttgttaaactttgttgaggggtgatggcngtttctttcgcaaacctcaactccgaggcagggctta

SEQ ID NO: 2196 - DNA, 282 bp, Zea mays
  misc_feature: Incyte ID No: 700552241H1
  unsure 37, 93, 97-98, 115: a, t, c, g, or other
gcacttcggcggggacgctcaaccgccccgcgggcgncgtcgacggtcggttcccggcggcctcgcggaggttgcatcccgtgtcgaatcgangtanntgtcgtgcaggcaggancctacgccaaatgcctctctttgataagaaacctttctccttgctggagccccctaaggacttggattcaaaggagaaggtgttccaaattcgattcacgaaggagatattccgagattatgaagaatacctgaagaggctaaacctttatcgtcaaagagtttgga

SEQ ID NO: 2197 - DNA, 282 bp, Zea mays
  misc_feature: Incyte ID No: 700552243H1
aatagatgacattgtcagcggtatcaagaagaagcaggctcctggagcctcagctcccaagcaaccccaaattgaaactgagggtgatgccgacaatgagcagatgatcccagagtgagtagaggctgtgaccaacctgcactagcaaagttattatttactagtgccggaatagcactttgaatagagttcattttatttgagtgttggtggttagccttaggttttatatatagtttgatacactcgtccgagggttttttgtagtgtggttgctgcgca

SEQ ID NO: 2198 - DNA, 284 bp, Zea mays
  misc_feature: Incyte ID No: 700552245H1
  unsure 144-160, 179: a, t, c, g, or other
agagaggggcaaacaagcttgctactgtgatttctcgtccgagcagcggcggaggagagagagagagcatggccgaccacaaggaggagcctgtgccggagtctgtgatggacaagatcaccgagaagttccacggcggggacnnnnnnnnnnnnnnnnntgactcggacgacgagaancaggggtcctcgttggcgtcggcggcggaagccatgaaggccaagatctaccgccttttcggccgggagaggcccgtccactccgtcctcggcggcggcaagcct

SEQ ID NO: 2199 - DNA, 92 bp, Zea mays
  misc_feature: Incyte ID No: 700552246H1
  unsure 56, 59-60, 63, 66, 76, 78, 81, 86, 88, 90: a, t, c, g, or other
gtgaactcatgtggctattgctgttggcgtcaaaagattttttttattgcaaaaanggnnaanaangggccggccncngtntagcnancncg

SEQ ID NO: 2200 - DNA, 289 bp, Zea mays
  misc_feature: Incyte ID No: 700552249H1
  unsure 211, 215, 263: a, t, c, g, or other
gaaacagttggatgctcaattaaagtcccttaaagaagctcctgggacgaggcggtcctcatcacctcctattcgctccaataaatcatttgttttccaaccgttggacgagtatccaacatcttcaccagctccttttgatgatcctgatgtgtgggctccaccaagggatacaccgacccgaagagcaacaagaggtcaatctagtgcnaganaatcctcccaagatggagcctgggcacgtggttcatcaaggatggaanacctaaccgaagtcaaaactaatggg

SEQ ID NO: 2201 - DNA, 93 bp, Zea mays
  misc_feature: Incyte ID No: 700552250H1
  unsure 42, 47, 51, 63, 67, 69, 76, 84, 86, 88, 92: a, t, c, g, or other
ggccgtgctgctacatccctcctttcccaacggcaagatcangtgcntgcntcagacaatgcnacantnagatganacatgctnancnagtna

SEQ ID NO: 2202 - DNA, 109 bp, Zea mays
  misc_feature: Incyte ID No: 700552253H1
  unsure 2, 25, 35, 53, 62, 67-68, 86, 94, 96, 101, 108: a, t, c, g, or other
anagttttcttctcccgtccacctngcgtgctcgngcgcgagctactcgtggngcagcaganactanngcgaccgcagccgtcccnaacgccangngctcnagtctanc

SEQ ID NO: 2203 - DNA, 179 bp, Zea mays
  misc_feature: Incyte ID No: 700552255H1
  unsure 78, 84, 92, 94-95, 97, 104, 108, 114, 144, 154, 160-161, 165, 168, 171: a, t, c, g, or other
gatggactacatttgggtcctagttctttgcaagtagaatcactggatgctttggatagcgatatactgtatgttaanacaggngttctcgngnngnatcatanaganggttantatgaacccagtgtctaccaaatcacttcnggcatttgcncaatgnntgangcngtnccattcga

SEQ ID NO: 2204 - DNA, 139 bp, Zea mays
  misc_feature: Incyte ID No: 700552257H1
  unsure 49, 106: a, t, c, g, or other
agccatggttcacttgggaataatggctatcaatattacagaccctgcnatattgatagccatggttcacttgggaataatggctatcaatatcgcagggtctgtnataggattatataatcgtcgaacattagagtgt

SEQ ID NO: 2205 - DNA, 197 bp, Zea mays
  misc_feature: Incyte ID No: 700552261H1
  unsure 5, 9, 12, 28, 34, 36, 40, 48, 112, 118, 121, 124, 136: a, t, c, g, or other
cactnctgngcngccacccactacaggnaaggangnggangagggcangatgtcgcaccgtaagttcgagcacccgaggcacggctccctcggcttccttcccaggaagcgntcctcncgncancgcggcaaggtnaagtcatttcccagggatgaccccaagaagccttgccatctcactgccttccttggctaca

SEQ ID NO: 2206 - DNA, 281 bp, Zea mays
  misc_feature: Incyte ID No: 700552262H1
aagctgctgaaccagaagactgctaggtaccttgtagagcacaagcagaactactccggtgagggtgaagagcttatctaccactccaaggggcatgctttgaatccgggacaaagggactggacgaggtatcagccctgggagccaaagaaagagcaagcctagctcgtgagtacattgtggggaagctgctgaatgttttgcgttttcttgcattgcgctgggtcaggtatcaccgagctgaatagcctctgggttattgcctggacgggacccaaata

SEQ ID NO: 2207 - DNA, 281 bp, Zea mays
  misc_feature: Incyte ID No: 700552263H1
aattcaatggcaagctttctgattttggattggccaagctcttgggtgcagggaagagtcatatcacaactcgagttatgggaactttcgggtatgtggcccctgaatatgccaacactggtctgttaaatgagaggagtgatgtctacagttttggagtgctactactggaatcagttactgggagggacccagttgactatggtcggccagctaatgaggtacatctggtcgagtggctcaaaatgatggttggcacgagaagagctgaggaggtggtg

SEQ ID NO: 2208 - DNA, 284 bp, Zea mays
  misc_feature: Incyte ID No: 700552264H1
cgacgccgccgtcttccgcgcactagtgtctacactcccggcgacgatggcggaggacttggttttggacacggcgatccgagactgggtcctgatcccgctctccgtggttatggtcctcatcggcgtgctccgctactttgtctccaagctcatgcgctccccggcgacctctccgtctcccgaccccaagctcgttaaggaagggcaggtggtcatcagggcgaggaacctgaggaccaacgcacagttcatcccggccaaggctttcaaggcacgcaagg

SEQ ID NO: 2209 - DNA, 286 bp, Zea mays
  misc_feature: Incyte ID No: 700552266H1
  unsure 213: a, t, c, g, or other
gcagaggtgaatgccatcaagcaagtcttcaaggacccatctgggattaaaataaatgcaaccaagtccatgataggacattgccttggcgcagaggcggtttggaagccattgctactattaaagcgataactactggatgggtgcatccaagcataaaccaatttaacccagaggaagcagttgaatttgacactgtacctaatgtaaaanagcagcatgaagtgaatgttggtatctcaaattcctttggatttggaggtcacaattctgtcgtagtatttgc

SEQ ID NO: 2210 - DNA, 283 bp, Zea mays
  misc_feature: Incyte ID No: 700552268H1
  unsure 16, 28, 146, 156, 161, 177, 234, 250, 254, 278, 280: a, t, c, g, or other
gaaaattgattcctcngaattgattacnatgaagacactaaaggaaacaggtgccattgggaagcacgtaaaagatggaattcgtttaatgggccgtggagcagaagaaatcaaatggcctattcaccttgaggtgtcaagggcanctgcaagggncaaanctgccgtggaagctgntggtgggacagtaaggctggtgtactacaacaaacttggattccgggcactcctganacctgagtggtttganaagnagggccgcctgttaccaaaagcancnagg

SEQ ID NO: 2211 - DNA, 90 bp, Zea mays
  misc_feature: Incyte ID No: 700552270H1
  unsure 48, 68, 71, 75-76, 78, 80-82, 87: a, t, c, g, or other
tttgtagtcatcctcagagaatgcatgatgtgcactttgtagtaatanatgcaggttgttatcccaanaanaaanngnannnaggangat

SEQ ID NO: 2212 - DNA, 166 bp, Zea mays
  misc_feature: Incyte ID No: 700552271H1
  unsure 90, 133, 145, 150: a, t, c, g, or other
ggttcacttatcgatgttacggtaaaaacgttacgtgatcaccgtggttgaaccactgggtgtcaatgcgaccgttatatgatgctgcgngctagcatcgcgttattcaaacggttgtattgatgcgttgcanatcatgtctganacgangtcatgaacctgactt

SEQ ID NO: 2213 - DNA, 130 bp, Zea mays
  misc_feature: Incyte ID No: 700552272H1
  unsure 38-39, 69, 103, 121, 125: a, t, c, g, or other
gtctcccctccactgcgcctcaccgtttccgccatggnnccggccgccgccttcctgtaggcgtgcgcngctggttccattccccgtgcgcccttcctgatcncgaggcctcttcttctcncaantccgc

SEQ ID NO: 2214 - DNA, 278 bp, Zea mays
  misc_feature: Incyte ID No: 700552273H1
aatattcgccaagaatcagtcaacgctcgaaataattgcttgggggggagtaagagagattaatgctttgttcattgaaacatgctggctagtcaaggtgcttgtactgtacttggtaagcactgaattgtggaatggttggaatagacactaccatctcaacacttgtctctgttactagtagttttccactaagagttacaagtaagagctaccctattttctctgtacagattgattgcaattgctctataacctacagacatgttggtccactt

SEQ ID NO: 2215 - DNA, 279 bp, Zea mays
  misc_feature: Incyte ID No: 700552275H1
  unsure 7, 91, 108, 216: a, t, c, g, or other
agaagtnttacccctagctatatctcaaaagctattgggacgacaatgtactctgtaaactgggaaatatatcatcaataaaaagacttcnaaggcattcgaattgtncactgtcaacctacatgcttacttaactcaaggtgaccactataccctactaacggagcaatcggcttaagttggcaatgacttaaggcggtgtgacatgctcacgcntacttaactcggggtgaccactatagcctactaacggagcaatcggcttaagtcggcaatgac

SEQ ID NO: 2216 - DNA, 278 bp, Zea mays
  misc_feature: Incyte ID No: 700552276H1
  unsure 96-114: a, t, c, g, or other
cgtggcgagtctcggttctcggaccacaggcccgtgtacagcgtattcacggcggaggttcggattccgagccagcagcaggcagcggctcagttnnnnnnnnnnnnnnnnnnnattactcgttccgcgtccctcctggggctggcgctggacgagctgccttatccacgcagttacatggacatcaatttttactgatcgactgcgcgtgtctcgatggaggacgaaaggagccagccaagccaagggttcaccttctgatggctggctctggctgg

SEQ ID NO: 2217 - DNA, 269 bp, Zea mays
  misc_feature: Incyte ID No: 700552277H1
  unsure 202, 246: a, t, c, g, or other
gaaagattgtctgtgaaaacacactggatgctagattgcaggtagttttcagaaagaagctgccagagattcgtcagagccttttcgggcaggtagctgcgtaccaattcttgaaaggagaacgtggcccagtactctttggggtaccctgacgatgtccaggagaagctttggcagctctcaattgtgatttatcacactnttggatctcgattattattatttgtgtatacttttttcctgggnatggatacctttgaatcctgcac

SEQ ID NO: 2218 - DNA, 172 bp, Zea mays
  misc_feature: Incyte ID No: 700552278H1
  unsure 47, 131: a, t, c, g, or other
aggagctaatgttccaattggtctgtgacccgtctggggcggttgtngaagttgcactcaaggaacttgttcctgctgtagtaagatggggagataaattggatcagatatcaagagtactattggctcanatcctggcatctgctcagcgatgtccacctatttcaggtgt

SEQ ID NO: 2219 - DNA, 280 bp, Zea mays
  misc_feature: Incyte ID No: 700552279H1
  unsure 229, 236, 238, 240, 279: a, t, c, g, or other
aagaaaactagaacctaaaaaccagcgacgccgagcggatctacagccaccttggtcaccggcggcgatggcgagttccaagtccggcatccctatcaaggcagaacaagattcggatggctcggcacaaagcacagctgatatgacggcttttgtgcaaaaccttcttatgcagatgcaaaccaggttccaagctatgtcggagaacatcatttcaaagatagatganatgggtntntntttgatgaattggaacagagctccaatgacctcaaggcng

SEQ ID NO: 2220 - DNA, 283 bp, Zea mays
  misc_feature: Incyte ID No: 700552280H1
  unsure 181, 262: a, t, c, g, or other
atgcatttcaaagaagacgtaagtgggacaagaggatgctggaatttgttcaacacgtggataaacccttaatctggtgtggggacttgaatgtcagtcatgaagaaatcgacgtcagccatcctgatttctttagcagcgctaagctgaatggatacaccccacccaataaagaggactntggacagccaggattcaccccagcagagagacggcgttttggcaacatattattccaaggaaagctggtagatgcttacangcacctgcacaaagaaaaggg

SEQ ID NO: 2221 - DNA, 286 bp, Zea mays
  misc_feature: Incyte ID No: 700552281H1
  unsure 5, 264, 282: a, t, c, g, or other
cttgntgagttaggaggcgcggataacaacttaaacaccagcaatgtggaaactacagattacctcatgttgccacctgacagagaactgtcggctaatgattacatggaactaaacgatctccttgctcctgacccaagcttccccagtgaattttctgctcaggacaatcaatatatgcagcattctcttgctcagtacaatggacattatgatctgtcaggtccttcggagccaacaatgcctagcattttcgatgttttncctcccaataatggagtnctcg

SEQ ID NO: 2222 - DNA, 285 bp, Zea mays
  misc_feature: Incyte ID No: 700552282H1
  unsure 27, 194: a, t, c, g, or other
gcctgcacatgatgaactgttaatgancccgcgagtagcacctttcaatgagactggttctctgggcacaatctatcctactagaaaggatacctttggaggatttagtgtacacgttccttacgtttcaaggatgagaagggggcgccctaggaaggacttcatttcatttgcggataagggaccctcggacnaacctaaagggattcagccatcagttgagatgatattagtgaaggatggtgacaagggaaaccacctgaggaaagtacctgaggttccact

SEQ ID NO: 2223 - DNA, 172 bp, Zea mays
  misc_feature: Incyte ID No: 700552283H1
  unsure 11, 155, 165: a, t, c, g, or other
gcgtcgctgtntgtgtttcgagtcagtcagtcagttagttgcgtgccatggctggcatgctctgagtctgagatgatgatgatgcctgatggcggcgtcgtgtcctgtagtcctcccctgccccctcgggcgcttctggcggcgagcagtgtgtngtgttgtgtngtgtggg

SEQ ID NO: 2224 - DNA, 288 bp, Zea mays
  misc_feature: Incyte ID No: 700552285H1
  unsure 4, 199, 225: a, t, c, g, or other
gganaagaaacggatgctgatgagaaccaagaagaagaggaagcagaagaaaagggttctgctgataagaaagatgaagctgaagctgaaggtgacaagaagacggaagagaataaggagactccgaagaacaagaaagcaaggagtgccagggatagaagccagggaaaagataaggagcaggatggatccaaatccnaaggaagccaaaagttttcttgaacnctcccaagcccatatggtaaccaatcgccctcaacgtgagaggaaaatagttggagaggttgg

SEQ ID NO: 2225 - DNA, 172 bp, Zea mays
  misc_feature: Incyte ID No: 700552286H1
  unsure 59: a, t, c, g, or other
tagagtaaatggacatcagcataaacaaaagattgttaatcaggtaaagaagaaggctncggcacttaaggataaccgggattattcatttctactctcggatgatgctgacctgtcatcctctccaaaggagaaacctgctgctagatcttccttgactcgaagggctgat

SEQ ID NO: 2226 - DNA, 276 bp, Zea mays
  misc_feature: Incyte ID No: 700552292H1
  unsure 67, 172, 234: a, t, c, g, or other
tcaattctgattccgcatcttcaaaaccttgtgaagcaaactgcattccagcaagatctgattacgnacctactaagtagcttgcaacaaaatgagagagtcgatgcagctcagtcaagagtccagagcacgacgagtgatacagtggttgaagctgctactgctgagaganaacactcgttacttgttaaaatttttgagttacaatctaggatgatttctttgactgacganttaattgcggcaaagctgaaacatgttcagctgcaagaagag

SEQ ID NO: 2227 - DNA, 273 bp, Zea mays
  misc_feature: Incyte ID No: 700552293H1
  unsure 18, 25, 42, 57, 62, 167, 170: a, t, c, g, or other
tgctaagacattgaagtnggatgtnttacaaagaatgaaagngaaatcccaatcaanttgtncaagcttgagaaaatatttcctccttctttctttgatgtgatgctgcatttggctattcatttacctgacgaggcaatcctaagaggaccagtgcaatatgggtnccntatccggtggaaagaaggttgtatacattgaaacgttttgtaagaaatatggctagacctgaaggatccattgcagaagcatatgttgctaatgagtgcttga

SEQ ID NO: 2228 - DNA, 169 bp, Zea mays
  misc_feature: Incyte ID No: 700552295H1
  unsure 2, 150: a, t, c, g, or other
gnatcaagcaggatgggtggtactgatactgacaaaaaggattccactagggagcaacaacaaggtggacgccctagatcagaagagcctcggagggatgatcgtcgtgccgatagggatcgtgaaaaatctcgtgaaagggtacggganagagaccgtgaggagaggt

SEQ ID NO: 2229 - DNA, 285 bp, Zea mays
  misc_feature: Incyte ID No: 700552302H1
  unsure 113-114, 116, 121-122, 259, 280, 282: a, t, c, g, or other
ctaccatgccccctgaggcccttgagattacccgcaagttcatgaacaagccagtgagaatcctcgtgaagagagatgagctgactcttgagggtatcaagcagttctatgannantgtanntaaggaagactggaagctggacacactgtgtgacctgtacgagacccttgccatcacccagagtgtcatctttgtcaacacccgccgcaaggtggactggacttcactgacaagatgaggagcgggaccaactgttnctgccactcatggtgcctggncnaaa

SEQ ID NO: 2230 - DNA, 255 bp, Zea mays
  misc_feature: Incyte ID No: 700552303H1
  unsure 7, 131: a, t, c, g, or other
gcaagtnctacaccgactggaccacgcacggcaacaagaccaagtgcccgtgactccttgtccttgacgagagcagcatgagtccatgggcccactggcgccacgttttgtatgatccgaccccgtcggcntagatgtccgagcctgtagctatctagcttagatgtacgaggttgatgtgctctgctgtttgttttttgctagtacttctagtgtgtatcttgtgttgacgttgatgggtctgtgttcctgtgt

SEQ ID NO: 2231 - DNA, 281 bp, Zea mays
  misc_feature: Incyte ID No: 700552304H1
cttaaggatgtagagaaatcattcactggagttaccgagtcactttcatctttgcggagaaatttgaatcgcttccatctggtgttcttattataggatcccacactcagatggacagccgcaaagaaaaggcgcatcctggaggttttcttttcacaaagtttgccagtagcagccagacactttttgaccttttcccggatagctttggtagcaggtggttgcatgaaagaagcaaagaaagtccaaaggcaatgaaacatctgaataagcttttccca

SEQ ID NO: 2232 - DNA, 258 bp, Zea mays
  misc_feature: Incyte ID No: 700552309H1
  unsure 21-22: a, t, c, g, or other
acatgccaaagggttcacttnntgataatttacaccagcaaaacagtgacaaaaaggcattggaatggccattgaggctaaaaattgccattgggagtgctagaggtttggcgtggcttcatcacagttgcaaccctcgcattcttcataggaacattagttccaagtgcatattgcttgatgatgactatgagcctaagattccgatttggctggcaaggctatgaatcccatcgacacccacctgagcacatttgt

SEQ ID NO: 2233 - DNA, 279 bp, Zea mays
  misc_feature: Incyte ID No: 700552311H1
  unsure 43, 51, 53: a, t, c, g, or other
atccaatgcaactcaacctatatctaccagggtaatgggcacnttcggttncnttgctccagaatatgcaatgacgggtcatcttcttgtgaagagcgacgtctacagttacggggttgtcttgctggaacttctatcaggaaggaagcccgtaagcatctccgagtcgaaggatcccgagaaccttgtgacctgggcccgtcctctgctaagccacaaggagggcctggagaagttgatcgaccctctctggaagggaattcaacttcgacaagtggc

SEQ ID NO: 2234 - DNA, 286 bp, Zea mays
  misc_feature: Incyte ID No: 700552312H1
tcagaaaggtcttcttgcgaacctgcacaggaaataagtttggaggagcttgcagaacttcattcctataaaacctggaaaaaaacccagattgaagatagaatctgatgctattgatgcttcagatgggctggacacgcttgcaaaccttgcaattcttggcgaaggtgaagcgctcccttcgcagccaacaacaaaacatccccgccaccgtcccggctgctcatgcatcgtctgcatccaaccaccaagtgggaagggtccaaagcacaagcagacatgcacc

SEQ ID NO: 2235 - DNA, 283 bp, Zea mays
  misc_feature: Incyte ID No: 700552313H1
  unsure 183-184, 281: a, t, c, g, or other
cggctgaagaaaagtcagcagcttcaacagaaaagagaaaacttgaagatgaagatattgcaaacactgaaccaatcaagcgacaacgtcggtggactgcagacgttgccaaagttccagagagacaagcattgagtcaaactggtcctgaaactcctaaggatatttttcagcctgctttcnnacgatcttttgggaggtctgattcaacagcaagtgtagattctcctaaggaacggattgtaccacctgcagagaaacctgccacaacttcttgagantg

SEQ ID NO: 2236 - DNA, 285 bp, Zea mays
  misc_feature: Incyte ID No: 700552314H1
cactgggttaagtctattcccgtggaaacaacttctaaaaaaggaagcagaaccagctgatattgatagttttgttcatccatttatccgataatcacgtatttccaaacaaagttttggtggactgcacagcagatacaagtgttgcatcccactattataattggttaaagaagggtattcatgtcatcacaccaaataagaaagcaaattctgggccacttgatcagtacctgaaattgcggactctgcaacgtgcctcgtacactcattacttttatgagg

SEQ ID NO: 2237 - DNA, 123 bp, Zea mays
  misc_feature: Incyte ID No: 700552315H1
  unsure 43, 50, 67, 70, 74, 92, 95, 100, 105, 111: a, t, c, g, or other
ctttgtaaaggggtgtaaacagaagtatatgatatggttaganttcgcanacgtccattccgtatgngancctnaccatcatccatatactnccngcatnacacncctttncaaagaagtata

SEQ ID NO: 2238 - DNA, 282 bp, Zea mays
  misc_feature: Incyte ID No: 700552317H1
  unsure 161-184: a, t, c, g, or other
ccactccctaggaggacccagcaacacacacagccgagctttgtttaggcaagatgaacaggaagccaggagactgggactgcagggcgtgccagcacctgcaacttcagccgccgagacatatgccagcgctgcagcgagccacgtggagttgctgatcnnnnnnnnnnnnnnnnnnnnnnnnactacgccagcttcggtggccgcggtggctcctccttcggcggcggctttggcgctgctggctccgacgtccgccctggtgatggtatgctcctgcgg

SEQ ID NO: 2239 - DNA, 281 bp, Zea mays
  misc_feature: Incyte ID No: 700552318H1
  unsure 62, 78, 121-122, 127: a, t, c, g, or other
gcctgcgccacagctgccgattcgaaagccctcgtcctgacccctcgcaaaaccctagctcnaaccaccatgaagggnaaggccaacgcctccaagaaggccgccgcgagcggcaagcccnngcgcnctccctccgccttcttcgtcttcatgtctgaattcaggcaggagtaccaggcgcagaccctggcaacaagagcgttgcggccgtgagcaaggcagcaggggaaaatggcgctctatgtcagagcaagagaagcaaccctatgtggaccaagctg

SEQ ID NO: 2240 - DNA, 278 bp, Zea mays
  misc_feature: Incyte ID No: 700552320H1
cggcaaatgatgcctgtggactgcgagacaagctggtggtcctcacagcatcagtctcatagcacatcggagcctacatctgctccaaggaggctattcgggcaatggctcggcgtcagaggtcgtcccctgagaacagatcgcccgagggctcttcgtatcggcaaatgcactcgccacggatgtagaccatcgctgctggcaatccaatttaatttggaacccgagatgcttgtaagaaacgatgggaaacccatgtattatgttaggccaggctg

SEQ ID NO: 2241 - DNA, 278 bp, Zea mays
  misc_feature: Incyte ID No: 700552321H1
  unsure 134: a, t, c, g, or other
gtattcggcaagatggtgggactgcagatgcatctcttcgtcgtgagatccaaactgaatcggttcagctaggaatttcgatgcaacatttgggtgctatgttctttgagcttggtcggacgatgatgatgctncgcacagggcaatctccttctgaggcttttgtaaattctgggcctgctgtttagtaaactccacaggaccaaacccaatcatggttcagccatcttttcaaaacacccctccttttggtgtatctaatataccagttctgggtg

SEQ ID NO: 2242 - DNA, 230 bp, Zea mays
  misc_feature: Incyte ID No: 700552325H1
tgctactggggattttacactttgctggcaactcaatatgttggggacatccctgacctctaaaagtacttttgagtgcttggtgatgacttgctatatgtatgatggtggatgagtttgatcgtccatgcttgatgttcatattcatctgtcatctggatttgccgcacttcagtgataaaatgtcattggatactggtaaggtacgtcttgtgaagttcgctcaaaaa

SEQ ID NO: 2243 - DNA, 283 bp, Zea mays
  misc_feature: Incyte ID No: 700552326H1
cgcaaaggcaaagccaccacagcgtcgtcgtcttcgtctccagtccaagcaagcgaagagcacccctcgagatctctccctccccgcgccgccatggacgcagttgactcggtagtcgacccgctccgggagttcgccaaggacagcatccgcctcgtcaagcgctgccacaagccggaccgcaaggagttcaccaaggtcgccgcgcgtactgcgatcggcttcgtcgtcatgggattcgtcggcttctttgtcaagctcatcttcatccctatcaacaaca

SEQ ID NO: 2244 - DNA, 281 bp, Zea mays
  misc_feature: Incyte ID No: 700552327H1
agatcatcaaaagcaagcgaaggcacatctgcttgaagttgaaccttttgagcatgcttttgggccaaagggcaagaggaaacgtccgaaactaactgctcttgactacgaatctttgctgaagagagctgatgattcccaagatgtgtttgagcaaaagtatgcttcatcaaagttgccaagggaggaagaagaagatggctacgtgatctagtgaggcatacaatgtttgagaagggacagagcaaaagaatctggggtgaactatacaaagttattga

SEQ ID NO: 2245 - DNA, 279 bp, Zea mays
  misc_feature: Incyte ID No: 700552328H1
atttacgagaccagctactgaaggagagaagtttgagggcttctctggagtctgggctaatgaatatgcgaagaggacaagtgtccttcccctcaacgatagacaccaagactaaggctgatcttgaggaagttgctgccgttgaagctgatattatgaacttgaagcaaaaggtttctgatcttcggggacaactcaacaaccaagttcagttgagttccacctcgttatgtgaatcatgcaacaacaagcgatccataaatgcagacaagctgtcga

SEQ ID NO: 2246 - DNA, 277 bp, Zea mays
  misc_feature: Incyte ID No: 700552331H1
  unsure 171: a, t, c, g, or other
ggaacaccccgaagtctgaacatactagaagcgtaaccctaagtctcggaccccaaccctcgaggaaggcgaccggagatggcggcgtcgtcggcggtggagaagctcaaggtcctctgggactcgcaggtcaacgacgaggagcagtgggcgctcaattataagctgctnaaggccgctggtctgtttgcgggatccatcttcctgatgcggaacttcggtgatctgatggccattagtaggctatcagcgttgtttattggatctatgatgttgt

SEQ ID NO: 2247 - DNA, 281 bp, Zea mays
  misc_feature: Incyte ID No: 700552332H1
  unsure 208, 213: a, t, c, g, or other
taagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttgtttaagtntgcgnatatgaacaaaactgtttctgttagtttcgagcttgagtctcatgtttatctttacattgaaatgctg

SEQ ID NO: 2248 - DNA, 276 bp, Zea mays
  misc_feature: Incyte ID No: 700552336H1
  unsure 2: a, t, c, g, or other
gncagagcgtgtacctgttgttgggaagtttttaaatttgttgaagtttacagttaaagaggttgacacaactacgggggaagctgatgaggatggtgtggaggatgaataccagttagaggactttgaaattgtttcagctgattatatgctgagggttgttgtctccaacttcaggaacgcctgggaaaatatggacccagatagtgagcgtgtcgatgagtatggactcggggttagagaaagtttggactgaggctgtcaatgctgtcataa

SEQ ID NO: 2249 - DNA, 274 bp, Zea mays
  misc_feature: Incyte ID No: 700552337H1
  unsure 119: a, t, c, g, or other
agcccatggatgtttggtttactcaaggaaaagtttgaggaaagccgacgaatcccgtggacttcttaatgctgatgtcgaaaatcgtgatgtttccaattctgtttctggagagaggnaaacagatgagacaaatatgatgatgagctattatgaacaaatagtgaatgagagaagagctgggttctggggccggtgcatggaaatcatataccagactagcgcaggtgcaacaatgttgactgatgtcacatattggggcctcttgtgccat

SEQ ID NO: 2250 - DNA, 276 bp, Zea mays
  misc_feature: Incyte ID No: 700552338H1
  unsure 40, 46, 49, 64, 70, 82, 104, 113, 126, 145-146, 195, 204: a, t, c, g, or other
ctttacacgctcgattccccccgccgtttccacgggggcnaggtgnctncattactgggtccgngcctancgttcaggcaancgaacacgccggcgaccgctgncgcccttcncccagctgcccangtcttcgtcgggccctttnncagcggcgtcggcgacgagcgcctgccacaccaggaatcccgttaagtntatttatgntcaccaatttaagggcagaacttacggacctcaagctcttggttactcctgatcttctctaggcgactaggc

SEQ ID NO: 2251 - DNA, 120 bp, Zea mays
  misc_feature: Incyte ID No: 700552352H1
  unsure 51: a, t, c, g, or other
agcaggatagcttaaattgctgcagttgatgtccacttagtgcctctccangtggcataggaatgcaggagtgtagatgaatgctgctgattgtgttgattctttgccactgaatttgtt

SEQ ID NO: 2252 - DNA, 263 bp, Zea mays
  misc_feature: Incyte ID No: 700552353H1
  unsure 54: a, t, c, g, or other
atcctgttggcagggatgatgcttcacaactctctgctctgcaaatcttggttnagattggattcatcgacaatcctgagtcctgcgtcgaatggatatcacttttagagagatttcttcctagacaagtggcgattaccagagcaaagcgagattgggagcttgacatcatttcacgctttcagttaatggaacatttatcaaaagacgatgcacggcaacaattctcagaatctaaggactcttccatagggaatctgttt

SEQ ID NO: 2253 - DNA, 274 bp, Zea mays
  misc_feature: Incyte ID No: 700552355H1
  unsure 59: a, t, c, g, or other
acacgacgccacgactgacgacggagagccccggtctccttccacggctccaccgccancaccccgcataaaagtagggaagagagctttgcagcgagaaccgtatcgatctattctcgtctgaagcaattcgcccctgtcgtgagcagaatcctacagctcgtattcgcctcatctcgcagcagcagcagaagaacaagggtatggcgaaggatgggggtcccgactggaacggcctgctcaagtggagcctcgcccacggcgacacaccaac

SEQ ID NO: 2254 - DNA, 274 bp, Zea mays
  misc_feature: Incyte ID No: 700552357H1
  unsure 180: a, t, c, g, or other
ggtggtggcaaaagaaagggagcatttgctgtatatttggagccttggcatgctgatatttttgagttccttgatctgagaaagaaccatgggacggaggaaaatcgtgcaagggatcttttctatgcgctatgggttcctgatttattcatgcaaagagtccagaataatggagaatgnctcattattttgccctaatgaagctccagggttggctgattcctggggtgaggagtttgataattgtacaagaaatatgagagccaggcaaggc

SEQ ID NO: 2255 - DNA, 210 bp, Zea mays
  misc_feature: Incyte ID No: 700552366H1
agcaaagatgtgtgaagcggcaatgggatgcttgctgtaaggtaatatgtttggcttgctaggcatgctacacgctatttggatgtagcaacgttatcaccagctgtatacgctttttaatcgacaacatttgaataatatgtacataacattatgttgtgctctgttctctgtctgtttgatgtgctatgggttttgatctgtagctac

SEQ ID NO: 2256 - DNA, 273 bp, Zea mays
  misc_feature: Incyte ID No: 700552370H1
  unsure 51, 77, 113, 117, 194: a, t, c, g, or other
gcaaagaaagtggtgatatctgcaccatcagctgatgctcccatctttggntcatagctattctcattaactcccanctacaaacatgggagcatcagctgatggtgccatgnttgntgttggagttaatgagaatagctatgatccaaagatgaatgttgtttctaatgcaagttgcactaccaactgcctgntccacttgccaaggttgtccatgaggaatttggcatcgtggagggccttacgacaactgttcatgcaacaacagctacc

SEQ ID NO: 2257 - DNA, 267 bp, Zea mays
  misc_feature: Incyte ID No: 700552371H1
  unsure 247: a, t, c, g, or other
atatttggaattgaagatcttcgcaaccgtgcagtgaaaaacaaacagttgcctccagtttataaggttacaaaaaatgtatacgcgtctcctagccgtgtaaattttcatcttgacagaagaaaggctgtagaaacactaccggcatatcccaacatctttttctctgtagacgacttcgatgatacttttgatgctgtggttttgtcagatcctgaacactgctatgtgtgatctaacgcacatnatggggcagcattcccgaag

SEQ ID NO: 2258 - DNA, 133 bp, Zea mays
  misc_feature: Incyte ID No: 700552372H1
  unsure 49, 51, 77, 114, 117: a, t, c, g, or other
gcaaagaaagtggtgatatctgcaccatcagctgatgctcccatctttngntcatagctattcctcattaactcccncctacaaacatgggagcatcagctgatggtgccatgnttntgttggagttaatgag

SEQ ID NO: 2259 - DNA, 269 bp, Zea mays
  misc_feature: Incyte ID No: 700552376H1
ggcttggtggatcagtcggtggagccatgcttgcccaatgtgtgggggttcatgggtgaaagttgtttgagcgctgtatttggcaacaacttcgctgctaattgctttcctgacaaacatgtatggagttccatagttatgcatctaacgctaggctactaggatcaggttcagccgttcatgccagatggttggtctacaggcacatgcacgtggcacgaccactgtggaagtctggtagattaggagctatctgggggtcgaatagt

SEQ ID NO: 2260 - DNA, 274 bp, Zea mays
  misc_feature: Incyte ID No: 700552377H1
gcgatcgagagatgaggagggagcttgcctcccccttagctactgccgccgctgccacggccgatgcctcctacctcggctgccgccttcgctccggggctggtgggacgatgtcaacgagtcgccccagtggcaggacggggccttcttctccctcgccgccgcctacgccctcgtctccgccgtcgcactgattcagctcgtcaggatccagcgccgggtggcccgagttcggatggaccacgcagaaagtcttccactcatgaattcttgt

SEQ ID NO: 2261 - DNA, 273 bp, Zea mays
  misc_feature: Incyte ID No: 700552378H1
  unsure 43-44: a, t, c, g, or other
ttcccttcaaggtcaaccaccagtgttcatctgggctacaggnngtagccgatgtcgcagctgctataaaggctggttactatgacatagggattggtgctggtttggaatccatgtccataaattccattgctagggaaggacaagttaacccaaaaataagcgcattccagaaagcacaggattgtcttctgcccatgggaattacttctgaaaatgttgcccatcgatatggtgtaactagacaagagcaagatcaggccgcctctgagt

SEQ ID NO: 2262 - DNA, 272 bp, Zea mays
  misc_feature: Incyte ID No: 700552383H1
caacagccccttccgcgccgaaacctcgtcgcgtcgcgcggaagagaggagagggacgggggccgcgggggcgagaagagaacaccactacggattgcctcgtcatccaccaccgctccaccgctaaaccctcgagtgctcttccgcgcggcggggcgccgagcgtgaaagccacctgctctcgtccagtcgcactcgcgccgcgaggggaaaccctaggagcggcagatctagagcgggcgctctcgattcggccgcgtagacgcccgttt

SEQ ID NO: 2263 - DNA, 268 bp, Zea mays
  misc_feature: Incyte ID No: 700552384H1
  unsure 141: a, t, c, g, or other
gtagtgacgatattcaggatcatcagcacagactgctagagatcaagcggttctttgaagattataagaagaatgagaataaagaggttgctgtcgatgcattcttgcctgcgaccacagctcgagaggccattcagtacnccatggatctgtatgcgcagtatattttgcaaagcttgaggcagtagattggaagcaactatttatctgggcgtctggaatgagtgtgatttaataagtcaaaacactgatattgtgtgcaaatctg

SEQ ID NO: 2264 - DNA, 256 bp, Zea mays
  misc_feature: Incyte ID No: 700552385H1
  unsure 7, 14, 25, 28, 31, 33, 98, 147, 173, 196, 232: a, t, c, g, or other
acttcgntttctanatgtgtgcgcntgntgnantgatcgggactacgaggccaactacactaccacatcctgcatgatgagataggcttcagtcctgntgatctgcaggagctggtgcattcgctctcctatgtgtaccaaaggagnacaacagccatatcagtcgttgctcncatctgctacgcacatctggcanctgctcaggttggccagttcataaagttcgatgagntgtcggagagtcctccagtcaggc

SEQ ID NO: 2265 - DNA, 269 bp, Zea mays
  misc_feature: Incyte ID No: 700552386H1
cgtgagaagcagcgcaaatttgttgaaaccattgagctacaaattggactgaagaactatgaccctcaaaaggacaagcgcttcagcggttctgttaagctgcctcacatccctcgccctaagatgaaggtttgcatgcttggtgatgctcagcatgttgaggaggcagagagaatgggtatagacaatatggatgtggaagccctcaagaagatgaacaaaaacaagaagctagtgaagaagctggcaaagaagtaccatgcttcctg

SEQ ID NO: 2266 - DNA, 269 bp, Zea mays
  misc_feature: Incyte ID No: 700552387H1
gttcttttattatatactgccattgattgttaatagggtgcatgtcttctatttctaggtatggtgcataaaaaagtaggaaccacaatgagattgtgatgctgcacatgacacatcaaggtgcgcaagatatgtaccatagaaattatcgtaaagtgcacacagttgtatgtatagatgtttagaagtggccgaagttaggcttgctcaaccggggcaatgatttacttagcctgctgaaatgtactataggtagcatcagtttgtga

SEQ ID NO: 2267 - DNA, 271 bp, Zea mays
  misc_feature: Incyte ID No: 700552389H1
  unsure 7: a, t, c, g, or other
gattttngccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagacgtctctgcggctgtagctcaagattc

SEQ ID NO: 2268 - DNA, 273 bp, Zea mays
  misc_feature: Incyte ID No: 700552391H1
acagcttgcccaagtatgaggcatcacatgaattccagactaagaaaaagcgtcagcaacagaggcaggcagaggaagctgcaaagcgtcaaaaacttaatcatcctccaccacattctcgcttgcctccaatccagcagccagggcaagcacatcctcaaatcaggcctggccagggtatgcacaatgtgcctcctgtggcagctgggccaggccatcactatacaaagccccgaggaccaggaggccctaaccggtatcctccgggtggga

SEQ ID NO: 2269 - DNA, 88 bp, Zea mays
  misc_feature: Incyte ID No: 700552396H1
  unsure 4, 9, 32, 36, 49, 55, 67: a, t, c, g, or other
gcgngggcntgtccgttgttcgaggcaaccancttngtctccccaaagngggtgncgccagctagcngatgtcagaggaggtgttgaa

SEQ ID NO: 2270 - DNA, 131 bp, Zea mays
  misc_feature: Incyte ID No: 700552401H1
  unsure 15, 109-110: a, t, c, g, or other
gacacagtgtatgtngctggcctccagatggagctccagcaagcacgtgataggataagtgagctggaagtggagcggcggtcggctaggaagaagcttgatcacttgnncaagaaacttgcagaggagaa

SEQ ID NO: 2271 - DNA, 269 bp, Zea mays
  misc_feature: Incyte ID No: 700552402H1
  unsure 199, 202, 205, 208, 230-231, 236, 240, 244, 248, 253, 256, 259, 267: a, t, c, g, or other
gaaagattctttccccatctggtcgtttcacttcaattctctctataggaatcggagggtcagctttgggccctcaatttgttgccgaggcacttgcacctgataaccctccactgaagataagatttattgacaacacagatcctgctgggattgatcatcaaattgctcaactaggacctgaactggcaactactcntgnaantgncattctaagagcggcggcaccnntaacncccncggngacnctacnggncgnaaagcccncc

SEQ ID NO: 2272 - DNA, 265 bp, Zea mays
  misc_feature: Incyte ID No: 700552404H1
  unsure 40, 112: a, t, c, g, or other
ttcattagctaggccaatcactcgggcccgtgccagagancttaacttcgtcatgctactgaagaatgagggcccagaagaatagatgaccagcccaactgcggcccatagnggatgacctagggttggccgccactaggggctgcgccccctctctctatttatccaggagctgcgcctcctttgttcggcgagttttgttttactttagctttacatactctcgaacacgcgcaaattagcgttgtcttcgtgtatccagaac

SEQ ID NO: 2273 - DNA, 269 bp, Zea mays
  misc_feature: Incyte ID No: 700552405H1
  unsure 229: a, t, c, g, or other
ctccagagagctatagttcaaacacaaccaacttaattgatgtgaacattgagcctgctgactacagcccttagtgcacatgctaagcgcacaaaggagttccatttctgttcaactgattttcctgaacccagtaagtctgtgcctttacgttggccactacctctttgtctgcagcagctcctacaaaccaaactggtgatgttcccatgtccagtacacctgctgnctgctgtttgccctctgttaatgtgcctatgcatgaagtc

SEQ ID NO: 2274 - DNA, 132 bp, Zea mays
  misc_feature: Incyte ID No: 700552408H1
  unsure 2, 9-10, 78, 88, 97: a, t, c, g, or other
tngcaagannagagattcgaaatgtcaagatagaaatggttaagctgctggcaagacacattcggtaaaccaatggangagattgctncgggacatncaggcgtcctaaatactttagccccagtgaagctg

SEQ ID NO: 2275 - DNA, 262 bp, Zea mays
  misc_feature: Incyte ID No: 700552410H1
  unsure 26, 29, 113, 174: a, t, c, g, or other
tgaggttgaggctctattcgagctgntcnagagcataagtggttcggtgattgatgatggcctgatcaacaaggaagaattccagctagcactatttaatcaatcagaggaangaaaatacttttcgccaatcggatatttgacctttcgatgtcaagaaaaggggtgtcattnattttggtgacttgtccgagctctaaatgtgtttcatccaaatatcccaatggaagaaaaagtcgattctcgttcaagctatacgata

SEQ ID NO: 2276 - DNA, 264 bp, Zea mays
  misc_feature: Incyte ID No: 700552412H1
gaggaaacttaaatactgttcttacacgtgctcccaagtatatcacatcagcttctcgtatggtgaatgatggggctcgactgcttctgcccaatattagctgtgaaggttctgtttttgtcactgtctatgatgacgagccaaccagtgtagtgtcatatgctatgacatcacaagaatatgctgaacatgtcacacataaaatgaatgcaaatactagcttttcagattttactagcagtaatggacttgatggatctctgt

SEQ ID NO: 2277 - DNA, 263 bp, Zea mays
  misc_feature: Incyte ID No: 700552413H1
accggacgaggaagtagtggcctgtgcgtgccgtcgcggaggagggggtggcgatggagaagggcgcgggcacgcggcggcggcggctggtggaaaggggatcggatcgccttgccttcatcaccggccagacgcgcacctactcctgcgacccgattccagattcaccacttcgttcacagtttgaaggtggcactcgtgatgatgggttcagcgagagaaatcagttgcagaagtcagaacctagcgacctggtacctgga

SEQ ID NO: 2278 - DNA, 263 bp, Zea mays
  misc_feature: Incyte ID No: 700552415H1
gcaaatcaagtacttggtgtctgagggctgcatcgtgccgctgtgcgaccttcttgtttgccctgatccgagaattgtaacagtttgtctggagggtcttgagaatattcttaaagtaggggagcacgacaagaccatgggcgcaacaggtgacattaatgttttcgctcagatgattgacgacgcggaaggcctggaaaaaatcgagaacctacagagccatgataataatgaaatctatgaaaaggctgtgaagcttcttg

SEQ ID NO: 2279 - DNA, 259 bp, Zea mays
  misc_feature: Incyte ID No: 700552417H1
  unsure 4-5, 54, 175-176, 188, 191, 196, 202, 204, 212, 234, 243, 248, 251: a, t, c, g, or other
acanngttattgctgatgctttgtctcgtacgctataccatgctgtcacagttngattttaaaatctttggtttggacactgtgaaggatcaatatgttgacgatgctgattttaaagatgctttcggccattgtattaatgggaaaccatggggcaaatttcacatacaggatnnattcccaattcncgngcaancaagcngnggtcccancaaccgggtcggcctacgcganaacaggaancccanggnggggcccc

SEQ ID NO: 2280 - DNA, 262 bp, Zea mays
  misc_feature: Incyte ID No: 700552420H1
ccaaggccagagtccgcatcctcgagggccccgtcggcgccaccgagcgtatcgttttggtttctggaaaagaagatccaggcttggagctatctccagccatggatgctctcatgagagtttttaagcgtgtcattgggataacagatggagctgcggagggcactcaggctgctgctactcctggtgtatgtgctgcccgattgttggttcctggagctcaggcaataacctaattgggaagcaaggtgccactatcaaa

SEQ ID NO: 2281 - DNA, 266 bp, Zea mays
  misc_feature: Incyte ID No: 700552421H1
ggtgtcactgattgggtactgcgaggagaagaatgaaatgatcctggtctacgattacatggcccatggtactctccgtgagcacctgtacaagacccagaagccacctcttacctggaggcagcgtttggatatctgtattggtgcagctcgtgggcttcactaccttcacactggtgcaaagcacaccatcatccaccgtgatgtgaagacaacaaacatcctgctgggatgagaaatgggttgccaaggtttcagattttggt

SEQ ID NO: 2282 - DNA, 260 bp, Zea mays
  misc_feature: Incyte ID No: 700552423H1
gtcaagacatgacaaaggtacaaataatgtcatacagggttatggtggaaagcaacaagggaggtcaactgggatggcttaccttccagaagatgaagtagttttcactcgacgcaattggttttgagggtggtgaagctgttggaaaccatacaagtggcattgttttggcctccaaacggccgatgctgaagatgacctggattaaagttattctagatttttttgttgcaccatgctatcacagcgccgtatgaggg

SEQ ID NO: 2283 - DNA, 261 bp, Zea mays
  misc_feature: Incyte ID No: 700552426H1
attaacattttatttttatatttgtaggaagagttcgatgcaacccggtggcttgatagatctctcatacgtactttgttcaagatttggggattaccggaaggatgatccctcttcatttagcctgcattcaaatttctcattgttccctcagtttatgtttaatcttcggcgttcacaatttgttcaggttttcaataacagtccagatgagacagcttatttcaggatgttactcaatcgtgagagtatcactaactc

SEQ ID NO: 2284 - DNA, 253 bp, Zea mays
  misc_feature: Incyte ID No: 700552428H1
  unsure 2: a, t, c, g, or other
cnatgtgtgggctggactctgagaaaaattgcgtgcatggttcggattcaccagaatctgcagacagagagatctcatttttctcggagaagctgaatccgtaactgtggaacatgatgagctatagacgccacactggtatcaggcaagtcagcaaactgaattttgatgtgtcttgaactcttaggctatctcctgtagctctactcgtacccgtttctatatttaaaagttatatgtaaacagtataatt

SEQ ID NO: 2285 - DNA, 259 bp, Zea mays
  misc_feature: Incyte ID No: 700552429H1
  unsure 197: a, t, c, g, or other
tccaggcagagatatttaagttaagggacaagcttgagatggcattggctttagctgaggaaaatgaagctgctgctattgaagttcgtcaaactgcagagattagtaaaatttatgctgaggaaaaagaagaggaggttaagattctgaacgatctgtcgaggaactgaaggaacagtaactgttcttgaggaagnggtatgcaaccttaaagaggaagtaaggaactatcaaatacataaacaatctgaagcccatt

SEQ ID NO: 2286 - DNA, 263 bp, Zea mays
  misc_feature: Incyte ID No: 700552430H1
  unsure 226, 238: a, t, c, g, or other
gtagaatgaatttatggtaaattgggatgggttgcgcactaaagataaggagcgtgtgcttgttcttggtgctacaaatagaccttttgacctcgacgaggctgtgattaggaggttcccccgcaggttaatggtgaacttgcccgatgcatcaaacagagagaaaatcctaaaagtaattttggcaaaagaagagctgggatctgatgttgatatggactcgctnccaatatgaccngatggttattcaggaagcgacctga

SEQ ID NO: 2287 - DNA, 233 bp, Zea mays
  misc_feature: Incyte ID No: 700552433H1
  unsure 72-73, 186, 190, 203, 205, 223, 225-226: a, t, c, g, or other
cgatctagaactagaagagaaattcaaactgatgcatccgttcaaaatttagttgaaagaacagatcacaanntccaagatctagtttctttcaaacaacccccggcagatgataaaatagctcttattgaacctaactactgacagggattgccttctcagatggatctcgacatcactgatgcngagncaaaaagattatngnggctggaaaaaatctgancnngcaccaa

SEQ ID NO: 2288 - DNA, 125 bp, Zea mays
  misc_feature: Incyte ID No: 700552434H1
  unsure 2, 4, 12-13: a, t, c, g, or other
anancctatagnnttcctcccttctttgacgaatacatccgggctgacaatgactttcgtcaaagaagggaggaagcctataggttctctgagatgaccaggggcttcggaggaagaatccaccc

SEQ ID NO: 2289 - DNA, 93 bp, Zea mays
  misc_feature: Incyte ID No: 700552435H1
  unsure 6-7, 14, 63, 84: a, t, c, g, or other
gctgtnngtctggntcgcccagttagcgttgccttccgaggtgatcactggtttcaggcctgnaccaagagcggagtttacacnagcgaccat

SEQ ID NO: 2290 - DNA, 262 bp, Zea mays
  misc_feature: Incyte ID No: 700552436H1
gtctttattcagacatgtcgccaggtgctccgttcgtactctccggtttggatacattgacgcctaccttgataataggtgacagtcttaagatgatcggagaatatgaagaaactattggcacctgctatctattctctgaaactgaagctgaaccgaaacctacaagtaatgagatggcaccttctgaagaaaacacagacaaacaagttagcagcagtaaggaagcgccgtcgaaggaggtgaaccatctcgccagcgt

SEQ ID NO: 2291 - DNA, 261 bp, Zea mays
  misc_feature: Incyte ID No: 700552437H1
attaacattttatttttatatttgtaggaagagttcgatgcaacccggtggcttgatagatctctcatacgtctttgttcaagatttggggattaccggaaggatgatccctcttcatttagcctgcattcaaatttctcattgttccctcagtttatgtttaatcttcggcgttcacaatttgttcaggttttcaataacagtccagatgagacagctatttcaggatgttactcaatcgtgagagtatcactaactcgg

SEQ ID NO: 2292 - DNA, 262 bp, Zea mays
  misc_feature: Incyte ID No: 700552439H1
ttataagaaggatgacaaagaccagcaacatgaagccatctgcgtcactattgtgggtacttatttcttgctgaacgccgagaactaccattggcaatggacgtcgttttcttctgcagcgtcaaccgctctgtacgtgtatctgtactccatctactactaccatgtgaagacaaagatgtcaggcttcttccagacaagtttctatttcggctacacgctgatgttctgcctggcctaggcatactttgtggagctattg

SEQ ID NO: 2293 - DNA, 176 bp, Zea mays
  misc_feature: Incyte ID No: 700552440H1
  unsure 7, 38, 69, 78, 82, 87, 99, 125, 138: a, t, c, g, or other
tgctacnttatcaaaacgaggaaacctgaatgcttggngtataagcctcattatgttccaaacaagacnggcttcggntacnatcanctggaaatcaancagtaaacttttgctattcagttttntaaataaaaaatntaggccttacgactttcctcgcaatgtgttcacatgta

SEQ ID NO: 2294 - DNA, 241 bp, Zea mays
  misc_feature: Incyte ID No: 700552441H1
  unsure 21-22, 37-38: a, t, c, g, or other
atgtcattctcagttgttganntatgatatacagcanntctaaaatatggtgtgtagtataacgtttgaaggagagagttcatataacaggtagcaccttgattcttaagacctacaaaacctgtttcttttttcgagtcataagtccaataatcaaccattctgcggacagcaacctacagcttcgataacaacagtgtcattcacaagataacccctgtttgggtcatataggtcattc

SEQ ID NO: 2295 - DNA, 257 bp, Zea mays
  misc_feature: Incyte ID No: 700552442H1
tcacatttcttaattgaggttgcattaataaacaggttgatgtagaccaatatggtttgtgtgtggtttacatgttttaaatataaatatatgtgggcagctaacacatctaaatgtcaaacaaatcccttttgatctttgagcttacaagtttcttcgataaaaaagtaatttgattaccaagcaactactaactttatgtatgccagacctctgaactgaatgttgtttaagtctttgtgtgcattgagatatta

SEQ ID NO: 2296 - DNA, 260 bp, Zea mays
  misc_feature: Incyte ID No: 700552445H1
gtggcttcgtcaaagaagtgggaatcaaatgtgcacatagaaagtgtacaagaaccatatgaaggccacacgactaaaaaggtaaaatctgatgctaagaaaaagaagctgatagatgcaaaaaattcaaagaacagaaatgatattagtgcagttatgaaaaaggagattgatatagaaacagttgctggtcaaaagatcgtatccgaagctctcaacatatcttgctgtctgatcccagagccatggatgcaaaaggt

SEQ ID NO: 2297 - DNA, 125 bp, Zea mays
  misc_feature: Incyte ID No: 700552446H1
  unsure 42, 69, 72, 79: a, t, c, g, or other
ctattgatgccgtttgtataaatgaccttcgaaattatgttnattcttggttccaatagtgccacgagngcngcaaagngtaacggtctaacggttccacttcactcattactcggacatgatat

SEQ ID NO: 2298 - DNA, 259 bp, Zea mays
  misc_feature: Incyte ID No: 700552447H1
tcactgtgtctggatcaacaactgtgtaggatacgcgaactacaaagccttcatcatttgtgtcctaaatgcaactattgggtctctttattcatttgtgatatttctatgcgacctacttctgaaagagcatgactttgatattctatatgtgaaaatactttatatcttggcaggtgtcctcttgttcttcttaagcttgacaataggttctctactaggctggcacatctatctattgtgtcataacatgacaacc

SEQ ID NO: 2299 - DNA, 260 bp, Zea mays
  misc_feature: Incyte ID No: 700552448H1
gtggtgattgattttggtagcactacctatgatcaacaggatcagagttatattgtgtcgacgaggcattatcgggctccagaagttatactgggacttggatggagttacccatgtgatatctggagtgttggttgtattcttgttgagctttgcacgggtgaggcgatattcccgcactcacgaaaacttggaacatctggctatgatggagagggttctggaccttgccataccatatgttcaagagggcagatcgg

SEQ ID NO: 2300 - DNA, 262 bp, Zea mays
  misc_feature: Incyte ID No: 700552450H1
  unsure 2, 169: a, t, c, g, or other
gncacaccattttgctgtggtgtgtagggagcggagaactcgtgcttgattccttcctcctacaagatactccaccacttgaaggttcttgaacttggacccgttgtcgctccttatctttttcaccttgagctcaaactcattttgagctctccttagaaagcgcttnagggtcccttgggtttcagatttatcctgcaaaaagaatacccagtgaagcaggaaaaatcatcactataacaaggaccatacttacttcctc

SEQ ID NO: 2301 - DNA, 258 bp, Zea mays
  misc_feature: Incyte ID No: 700552451H1
  unsure 21-22, 30, 39, 43, 47, 64-65, 76, 151, 158, 173, 178-179, 183, 194, 210,: a, t, c, g, or other
cctctgcaaccctcagtattnntcaggtcntctggggtntagntaanaagctcgctacaaaggnngcatttcccantctgtgaattggctcatttcctattcgaaatactccaaggccctgagtcctttatgagaagtttgatccagattncattganattaggacaaaagcncgtgnngtgntgcagagggangccgatctagatgaanttgtgcnnctgttggtnaagntgcncngcanaanctgacaagantaca

SEQ ID NO: 2302 - DNA, 260 bp, Zea mays
  misc_feature: Incyte ID No: 700552452H1
  unsure 21: a, t, c, g, or other
gggtggaaagagaagcaaganaagctgaaatggaaatcgcaaaggcagaaaatatgatagctcataaggatgagatatactcacggccaaagagaacctggtttgctactgaaagggagaagaaacttttggcagcagcggctaaagaatctttggatcacggtaagagtacctctggagttattagtgctaagaaggccgaagaccttcgtctaaaagagaaaaggagacgagaactgagaagaatctaccaaggaaga

SEQ ID NO: 2303 - DNA, 262 bp, Zea mays
  misc_feature: Incyte ID No: 700552454H1
  unsure 3, 172, 182, 184: a, t, c, g, or other
ganaagattctacaattattcattctattttggctgatctaaaaccttcagaagcaattcctatcagtcagccctgcatggatgatgaggaacaagatgttgaaagtgatcctgacgtcatgaatgattatgatgagctttgaatgtgagcctgcgactacgccgactagtncatggtgctncnatgcttggcaacatgtttggaatttagataaatatgttgctgtgtcaatgtgtgttgtgtccatgtttggcaactgtg

SEQ ID NO: 2304 - DNA, 259 bp, Zea mays
  misc_feature: Incyte ID No: 700552455H1
  unsure 44: a, t, c, g, or other
taatgataaaattgatgaggataagctcttcaatctgttttccntgtacggaaacatagttacgtatcaaggtactgcgtaataaaccagatcatgcccttgttgagatggctgacgggttgcaggctgagctagctgtgcattatttgaagggggctatactatttgggaagaagctggaagttaactactcaaagtaccctaacattacacctgccccagacgcccacgactacttgaactcgagcctaaaccgatt

SEQ ID NO: 2305 - DNA, 124 bp, Zea mays
  misc_feature: Incyte ID No: 700552456H1
  unsure 2: a, t, c, g, or other
gnagcactgtctggccaccgaagtcggagctgcggcccgggatccgggcggtagcgctcttcgaccgcaaagggatgaagtacaaccatgtgaagcttctcatgcgtttcgagtttgcctagcc

SEQ ID NO: 2306 - DNA, 261 bp, Zea mays
  misc_feature: Incyte ID No: 700552457H1
  unsure 66: a, t, c, g, or other
cattggtgtcgttcattgcagtattgtgtacattgctcggttcattgatcggattcttagctcgtncatttttaccctgtcaatgcaggaagtctccgtcaaccactttttcagcaggatacggaagcaattcctgaggacacagaggaaggcaactccgatcagcttctgcgacataaaaagcgcagttgctagcttcgtgccctacaccctcctgctgaaactagtaagacttggttccggttatctacacgtgatgtt

SEQ ID NO: 2307 - DNA, 210 bp, Zea mays
  misc_feature: Incyte ID No: 700552458H1
  unsure 202, 208: a, t, c, g, or other
tggaggcgcggcgattgttcgcgggatgagctacggcggcagcagctccctcgcgcccggtgccaagaggccgttcgagtacgggagaacgcatgtggtgaggcccaagggcacgcacaaggccaccattgtctggctccacggccttggtgacaatggaaccagctggtctcaactgctggaaacgctcccccttcctatnataaangg

SEQ ID NO: 2308 - DNA, 258 bp, Zea mays
  misc_feature: Incyte ID No: 700552459H1
tgatggaagctcatcatattcaaccccgaagcagtcaaggtcaaggaggccaaaccattctggcgagcaacttcctttcaaccccgcaacgagtggcaatggtttttgatgccaccctacacgatggccacccagattggttatggaaccaaccattgcagcaagcacaccttactctgctccaagtttgttggcacccgtagatatatgttatttctagttaaattcttgcagcgttgcgctgatgaagcctgggca

SEQ ID NO: 2309 - DNA, 125 bp, Zea mays
  misc_feature: Incyte ID No: 700552461H1
  unsure 2: a, t, c, g, or other
gnacaaggtgagcagagggagcctttggtttagggcgagagactggatcatgggattcttgggggcctaagtaacactgttaaaacctgtggttaactgtggtgtatccatcaactaattgtctc

SEQ ID NO: 2310 - DNA, 256 bp, Zea mays
  misc_feature: Incyte ID No: 700552463H1
  unsure 42, 70, 177, 229: a, t, c, g, or other
tagattcttatgagattgaaggcggtgagacaaaagcagagntattgcaaaacctagctgagttccagtnttcttgtgtacatgtacaatggtgccctagagaatgcatgcagtgagcttggagcccgtatgtctgccatggacagctctagcagaaatgctggcgatatgctgatncgtctcacgctacttacaacaggacacgccaagcatccatcaccacagagcntactgagatatatcggtgcatcagccc

SEQ ID NO: 2311 - DNA, 265 bp, Zea mays
  misc_feature: Incyte ID No: 700552464H1
  unsure 53, 183, 193, 208-212: a, t, c, g, or other
cgtcgatctacacacatacatagtttcttctactacacgacgacaaacatggngaagcctgcgaagatcggagagtggggtggatacgccggcgatcgtcgggatctgagggctactccggaccggctgaccgaggtgaaggtcacggcggacaacagcagctgcatccgctccatctacttncatctacatncggagccgatggcannnnncccacgaggaggggccatggggtttcggccatgctggcacggagtacaagatt

SEQ ID NO: 2312 - DNA, 259 bp, Zea mays
  misc_feature: Incyte ID No: 700552466H1
  unsure 44, 207, 217, 221, 227, 233, 236, 240, 246, 252, 254-255: a, t, c, g, or other
gcagaatcgatctcctcccatcacctccatcacaacctctcganggcagcttcatccccacctacaatcggcggcagcctagggcttcatcccccacccccaattccatgtcatgtggatctgaatcagcccactcccaaatctccaatccactcgcgggcttttcctcgtgcccagttcacgacatttgctcggggatctgaccantggcgtcttntgcncgtgtncctcgnacncgcnaaattnggattnannggat

SEQ ID NO: 2313 - DNA, 261 bp, Zea mays
  misc_feature: Incyte ID No: 700552468H1
  unsure 187: a, t, c, g, or other
gtctttattcagacatgtcgccaggtgctccgttcgtactctccggtttggatacattgacgcctaccttgataataggtgacagtcttaagatgatcggagaatatgaagaaactattggcacctgctatctattctctgaaactgaagctgaaccgaaacctacaagtaatgagatggcaccttnctgaagaaaacacagacaaacaagttagcagcagtaaggaagcgccgtcgaaggaggtgaaccatctcgccagc

SEQ ID NO: 2314 - DNA, 258 bp, Zea mays
  misc_feature: Incyte ID No: 700552469H1
tcactgatatcccatgttttgacacgagcggtgggacgtgctgacggagatgggtggcgccgccgccgccgttcttgccgtcgcagccgcacgccggaaatctggtcccttcgtatccttgttctccagggcggcgcgcaggctccacgatgctgtagagactgcagcagcagcagcctccttcttggaccggaattccccgacacctgggacccttcatcgcgtgacacgacgccgcatctcctccgcggtgtgccc

SEQ ID NO: 2315 - DNA, 259 bp, Zea mays
  misc_feature: Incyte ID No: 700552471H1
  unsure 8, 25, 60, 67, 75, 87-90, 95, 103-107, 110, 119, 135, 154, 209, 224, 231,: a, t, c, g, or other
attctcanaggctgttaatcagcgngacgctgaccttgtctacttctggcagaagtaccngaaattngcagacanctcacatgagannnntgaancttcggannnnnttncttgaagtnatggcccacaggtctncatgttgacagcagtgttnagctacattggaagccttctctttggctctgaggacggtccaagggttctgaaanccgtccgtgcagctngtgagancagtaaaaagnatgganctgtactcaat

SEQ ID NO: 2316 - DNA, 255 bp, Zea mays
  misc_feature: Incyte ID No: 700552472H1
  unsure 191: a, t, c, g, or other
gccacctcttgcagcgtgtgttgtaaatgaggtcttggaactgatttcttctgaagctacctccactgagcgaactctaattgtcccatacatcacaagatcgtcaagctatcatcatggaacggaacatgcaacaaaggcatcgactgtacttcatggtgctgaaataggggcaacaactgactatactncacctgttggttggtgggaccactaaacctcctacatccttgcaaatacgtatgaaccatatta

SEQ ID NO: 2317 - DNA, 258 bp, Zea mays
  misc_feature: Incyte ID No: 700552473H1
  unsure 18, 31-32, 38-39, 43, 57, 71-72, 88, 127, 135, 146, 151, 155, 162-163, 165,: a, t, c, g, or other
taaatcgtacagcgaggntgacatccacaanngcgtcnngtanaatgtgtgggcaancacaaccaacgganncaagaagcttgatgcngcttaccaagaagctcagtcaaagggatctgcatgcccnatattctngttcttctcantgaanacangtgggcnntntnttngngttgcngaaatgactggcgccgttgattttgagaaaaccctcgngtatggcaacaggacaagtggtaacggactcctnctctnttt

SEQ ID NO: 2318 - DNA, 180 bp, Zea mays
  misc_feature: Incyte ID No: 700552474H1
gcccaactcaccaaaatcctcaccttgcacagcctcaccagtaaaccaggaaactgcgtgagggataatcttatcccttatggtggtcccaatgtcataatcatgctccatttgactctgcagctcatcagcagtgtcttcatcgatgtcatcatcatcttcagggacctgcgggggatt

SEQ ID NO: 2319 - DNA, 261 bp, Zea mays
  misc_feature: Incyte ID No: 700552475H1
  unsure 207, 212: a, t, c, g, or other
catctatgtcatgacccacgactctattggtctcggagaagatggcccgacccatcagcccatcgagcacctggtgagcttccgtgcgatgccgaacatactgatgctccgccctgctgatggcaacgagactgccggagcatacaaagtcgcggtcctcaacaggaagaggccgtccatcctacgctctctaccaggcaaaagctnccctncacctgcctggcacctcgatcgagggcgtggagaagggcgggtacacca

SEQ ID NO: 2320 - DNA, 184 bp, Zea mays
  misc_feature: Incyte ID No: 700552476H1
  unsure 88, 90-91, 93: a, t, c, g, or other
cggagaaattcggcgaacgatggcggactccggaagcctgaggaagcgggaggagaaggaagaggaggacgacattgtctgcctggancnntncttattcgtggaccgcagctacgagatgacgaccttcaccttcgggtcccacgagttgcgcctcctctgcctaccgcgccgcttccatgat

SEQ ID NO: 2321 - DNA, 257 bp, Zea mays
  misc_feature: Incyte ID No: 700552478H1
  unsure 35, 38, 52, 127: a, t, c, g, or other
acctccccgtcgctctcacgctcttcgtgcccgcngcntcaaatatggaaanccacctcactcctcccgtctgacgcacatggcctccatcgccggatcttccgctctctccttcgccatgcctgtncaaggcaatcaactcaaattctctagccttctccccggtgaggaagggtaacacattcctccgcctgcaaccagtgcctatgagatctgtttcctgcgctgccagaaggatacggtggacaaggtttgtg

SEQ ID NO: 2322 - DNA, 256 bp, Zea mays
  misc_feature: Incyte ID No: 700552479H1
gtcaaacattcttcttggagaaggatttcatccgaagctatcggactttggccttgcaaaacttggtccggttggtgacaagacccatgtttcaacacgtgtgatgggtacatatggctactgtgccccagaatatgcaatgactgggcagctgacggttaaatccgatgtgtatagctttggtgttgtgttccttgaacttatcacggggcgtaaagcaattgacaatactaagacccaaggggagcaaaattta

SEQ ID NO: 2323 - DNA, 257 bp, Zea mays
  misc_feature: Incyte ID No: 700552482H1
  unsure 67, 208, 211, 214, 221-222: a, t, c, g, or other
agcacggcggggcggaaccggacgtccctcgctctcaaatatctctcaccacctctcccctacagcntctccccacctttggtcaggcaggctcaggcaaagggggcggccaacaaggacgagcgatggcgaccaaggtcatctgcttccttgtgctcgcatccctgctcctcgccgtcgctttcccgtgtctgctctgcggaaaagnttnaanaagggcnncggcggcggtggtggcggaggcagtgttagcggaa

SEQ ID NO: 2324 - DNA, 257 bp, Zea mays
  misc_feature: Incyte ID No: 700552483H1
  unsure 2: a, t, c, g, or other
gnacctacacatacctcgtgacaaggaaactagccgaccaaaaggttatgcttttgctgagtatgaaacagaggagattgcccagtatgccattaagctattttctggccttgttcgacttcataataaaacacttagatttgcgatctctgggcaagacaaaccctcattaaatggcaatattcctgtaactcctagtttgaactctgtaccacagccaaagcctcctcatcaacatatgaggtctagtgatatcc

SEQ ID NO: 2325 - DNA, 258 bp, Zea mays
  misc_feature: Incyte ID No: 700552484H1
  unsure 53: a, t, c, g, or other
gaacagacaacccgtccttctccttcccatcggctccacacaaccagaaggtncttcgcttcactactgccctgcgccgccgccaacgctgcagccgcagttgccgcaggggggaacttggacgtgctactcgcgactgctctcatctgttcccgcgtaggattcgttcacaatggcccgtgtgtatgtcggcaacttggatgcacgcgtgacttccggggaactcgaagatgagttccgagtgtttggagttctgcg

SEQ ID NO: 2326 - DNA, 258 bp, Zea mays
  misc_feature: Incyte ID No: 700552486H1
  unsure 48, 208, 235: a, t, c, g, or other
cgagcttgatcggatcaggaaagaggagggggacgacagctacgttcncaagctacaaggaagccacctgggttcctcacctgttccgtgtcagcgtcacgcagcatgaatacatgaacgagaagaggcagagaatcaccgtgaggggtgaagcaccggtcgacttcgcagctgagtccaagtacttgcttgaagagatcgcgaagtncaccgcttgctagaagacgcatctttnctggtggttcttgaaggactggc

SEQ ID NO: 2327 - DNA, 257 bp, Zea mays
  misc_feature: Incyte ID No: 700552488H1
gagtatcaccaatgggtatgatcttcattccctgttacaaaggttacagccacaagccggaggagtatgcatcacccgaggacatggcgaatggggtgaaggtcctagccttgacaatggctacgctgtcgctggagtgacttgttagcgtttggaggaatcaagttcagcccgtgccaaaaaggcaaaaacaaacacctgtgttatttctaataataagctgcatagcattggcgtcatcttccctgcaccaggcc

SEQ ID NO: 2328 - DNA, 204 bp, Zea mays
  misc_feature: Incyte ID No: 700552490H1
  unsure 10, 12, 18, 23, 27, 81-82, 98-100, 105-106, 159-160, 162, 180: a, t, c, g, or other
cattattatngncctgtnatgcnccgncatataataatggtctcttctcgtgctagaaaagagaccattattatatggcanngcattacaggtctatnnnctatnntttcatgcaatgacttaaattatgagcttacgaggaagggggtgataatgtanngnattatcccatctatttanttattatattaatacaagaaattt

SEQ ID NO: 2329 - DNA, 252 bp, Zea mays
  misc_feature: Incyte ID No: 700552491H1
taagggcagggatttcagaatacccttaaatggatccttcaatgatggcggaaaacaagatattgatatctggccaggagatttggggcatgtattgaagaaatctgaaggctctagttctcagccacaaaacacttcacctgaggatacaggtttgagtggcaaacatatatcagggttctatgaggaataccccatccttaaatcagagtatgttcagaatctgttactgtcactgtgaggagagacatt

SEQ ID NO: 2330 - DNA, 67 bp, Zea mays
  misc_feature: Incyte ID No: 700552492H1
gtgttgtgtgttgcgtctgtatacgtactactagtttgttacgacttaacgtggaaacctgagattc

SEQ ID NO: 2331 - DNA, 108 bp, Zea mays
  misc_feature: Incyte ID No: 700552494H1
gggcagatgaccgcgggcgtgacggtgagccaggggctgtaccagtacgggcctttcctcatccagctgcaggactgcaccttcgtgcgcgacaccttcacgaccatc

SEQ ID NO: 2332 - DNA, 255 bp, Zea mays
  misc_feature: Incyte ID No: 700552495H1
  unsure 121, 169, 171: a, t, c, g, or other
ggtggatggataacttagtgcaaggtcacttaattatacaacttattatttgtatttcattctctctactaataatttttatatcaaatcatgaactcgttgttcattacatagattttgnatcatgatatcatcagtcattacgatacctattgattatgagaagaancncatattagagatgaaacccgcgggtaacccatgggtacccgctaacccgatgggtacgggtttgggcaaaatctcaaacccgtc

SEQ ID NO: 2333 - DNA, 267 bp, Zea mays
  misc_feature: Incyte ID No: 700552505H1
  unsure 6-9, 12, 17, 41-42, 72, 79, 87, 153, 155, 158: a, t, c, g, or other
catcannnntgngcaanatggcacatcctgctagatttatnnagatcattgctaatagggatcgtgggaganaatgcanagcactanagatgacttctggtggatggtcaaacttcgaggatcaggcacttgttgtccttgtccatgatatangncanaactgggaactagttagtgacgcaatcaacaacatcgtgcagttcaagtgtgtacataggcagcctaaagagtgcaaggagcgccacaaggttcttttggatagaagct

SEQ ID NO: 2334 - DNA, 265 bp, Zea mays
  misc_feature: Incyte ID No: 700552506H1
agatttcacaactggcttgaaggtgctcgtgattgggctgttagcagaagtagatctggggtactccacttccactgtggataagtcaagatggtgaagaaattgttgttatggattctatagagaagcttgaaaaattatctggagtcaaggtcactgatcttcaccgacactatgttgatgatattacaattccctctaagagaggacctgagtttggggtgctcaaacgtgttgatgatgttttcgactgctggttcgagag

SEQ ID NO: 2335 - DNA, 57 bp, Zea mays
  misc_feature: Incyte ID No: 700552509H1
  unsure 44, 48, 51-52, 54: a, t, c, g, or other
gtccagtcgcccaactccttcttcatggatgttaagtgccaggngtgnttnngntac

SEQ ID NO: 2336 - DNA, 253 bp, Zea mays
  misc_feature: Incyte ID No: 700552511H1
  unsure 169, 189, 201, 206, 237, 243: a, t, c, g, or other
gagagggccggagcagccgcagtcccggcgatcccgccgccggtcgccctcatattcctcgtcactgccttcgtttctctttccaacaatcaagatgagccgtggcggtagcgcgggtggtggtcaaagttctctgggttactctttggaagcggtgagccccccaaancagcagtggcaacagtgtantgctccaactgntgtgnagtgtccacctgctgagaaccactgtgcaanctgatngcacaattaa

SEQ ID NO: 2337 - DNA, 261 bp, Zea mays
  misc_feature: Incyte ID No: 700552512H1
cagcccatggatgtttggtttactcaaggaaaagtttgaggaaagccgacgaatcccgtggacttcttaatgctgatgtcgaaaatcgtgatgtttccaattctgtttctggagagaggaaaacagatgagacaaatatgatgatgagctattatgaacaaatagtgaatgagagaagagctgggttctggggccggtgcatggaaatcatataccagactagcgcagtgcaacaatgttgactgatgtcacatattgggg

SEQ ID NO: 2338 - DNA, 262 bp, Zea mays
  misc_feature: Incyte ID No: 700552513H1
cataaatcaaacaaccagcagttactttcaagagaagaaagcaatgcacatggcaatagttaccatggcagccggggggaaccctccatcgttaataatggtgagcatagtcatgcagaggcaggtccacaaactagcctggagaattcggaaggtttaccgtcaccatcagggagaacacaacctgctgtttccccacgtggccaaagctttggacaaagattatgggcaatatgatggatatcttttggttagaagtctt

SEQ ID NO: 2339 - DNA, 200 bp, Zea mays
  misc_feature: Incyte ID No: 700552517H1
  unsure 80, 100, 107, 182-183, 186, 188: a, t, c, g, or other
gagtgggagacccgcgagaggctgccgtgtagggaccgtagactcagcgactgcgaaggagggataaggggatggccggnatcggaccgatcaggcaggnctggganccggtcttgtgcgaaaaaggcacccaccgcgccgccaaaagtttaaagccttaaccccgcccccccccttggaanntcnanccataaaaattc

SEQ ID NO: 2340 - DNA, 266 bp, Zea mays
  misc_feature: Incyte ID No: 700552519H1
ctaagagaatatattgagaatgaagacatagatgaagcctttaggtgtataagagagctcagccttccatttttccatcatgaggttgtgaagcgtgctctcacctttggtatagagaacgtatcctcgcaaccatcaatccttaagttattgaaggaggcagctgcaagttgcttgatcagtcctaatcaaatctcaaagggtttttctagactagctgagggtgttgacgacttgagtctgatattcctctgctaaagttcttt

SEQ ID NO: 2341 - DNA, 267 bp, Zea mays
  misc_feature: Incyte ID No: 700552520H1
  unsure 2, 258: a, t, c, g, or other
gngggagagaggctagggacagggaatggcatagggtcaagggaagtgaaactcatagagctaaggaaggacgggacaaagttagcgataatgataggcacagggattcaacacgctcaaaatatagcgtgttctgatggttacaaagagaggacaagatctggggagaaaggtagagatgctgaccataaaaaccggaagtttgaagaaatgaaggaaaattctctcaaggaggaagatgaagaggagtaccaaganaaaatagac

SEQ ID NO: 2342 - DNA, 74 bp, Zea mays
  misc_feature: Incyte ID No: 700552521H1
gggatgctgttactcctgtcaggatttgttcctaagttaatcctaaggaaaaaatggtgcttcttggtggctgc

SEQ ID NO: 2343 - DNA, 252 bp, Zea mays
  misc_feature: Incyte ID No: 700552522H1
  unsure 139: a, t, c, g, or other
gacgcaaacagcgaacaatgacttgcgtttttggagtgagcggaattcgatgtatggtaatccaagtgaccaacagcagggtttcagctttgggcaaaacacatcaagttggttgaaccagccacttccccaggttgancagtcacgagtggtcaggccgcatgcaacggttgctccatttgatttagagaagactagagaaggcatgggttcaaaatatttggtttccaagttgatacaaccaatccatca

SEQ ID NO: 2344 - DNA, 262 bp, Zea mays
  misc_feature: Incyte ID No: 700552523H1
  unsure 89, 196, 229: a, t, c, g, or other
aagatgggcgttcataaaagaaggggtgttgtatatcttgatgttcataagctccctgaaagaccaaaaagtgaagttgagcgtaaganatgttattggggctattcttttgaaaaccttgccactgagaactcattcagcgacgatggaaggggtatcgatgcaaatgtagagttttgttctgtaataaagacanaatgggtgcccatcggattgtcagggtgctganatggaccgccgtgatgcactgatgatggcaggg

SEQ ID NO: 2345 - DNA, 129 bp, Zea mays
  misc_feature: Incyte ID No: 700552524H1
  unsure 2: a, t, c, g, or other
gnctgatcttgctctagcaaagaagatcgagtccggtcagagctagtgatgagtgaaaatcaggcacatgtaaatatatatagcatgactattcgagaacatctaatgctgcacaaattatgtaggtca

SEQ ID NO: 2346 - DNA, 256 bp, Zea mays
  misc_feature: Incyte ID No: 700552525H1
  unsure 40, 46, 104-105, 116-117, 120, 124, 130-131, 150, 221, 226-227, 233, 238,: a, t, c, g, or other
ggtgcttgtgacaagatcaagttctttagccttggctaancttttnatcttgtcacaagcaccatctagtgaagaggaattcagtatatggtgcttgtgacaanntcaaaagctannctngctngagaanntgttccatctctaatgtcnttctcattaacagagcttgggctgctgcaaaagaatctacaactacgcatgataggtcaggacataacgcntcatnntgtgcnacacnagagccagccnccnganc

SEQ ID NO: 2347 - DNA, 182 bp, Zea mays
  misc_feature: Incyte ID No: 700552526H1
  unsure 18, 26-27, 44, 48, 52, 58, 60, 85, 87, 171, 181: a, t, c, g, or other
gccgcagccaggcttgtnagccgagnncctccaactagcgtgcnagancttngacgcngnttccccatggtccaagctccaccangnccacacgtccgtcctgctcctccgtgcacacgcccatgcatctaatctccctggaaacttcacacgtgaacggctccctgtggngataatatgnc

SEQ ID NO: 2348 - DNA, 261 bp, Zea mays
  misc_feature: Incyte ID No: 700552527H1
  unsure 166: a, t, c, g, or other
cggcggcgcgaaggaagggagggtgagaatatcggagttcggcgatgtcgaagcggcagggaccgccgaaacaccagaaccgctacgctggaagccgaaccttggtcagaagataaacgaaaccgagcccgggggcaggttccgacctctgtcagaaatcaccggntttgccagcgctgccgggatcaaattcgactggaaacgcagatacggaaaatacaagcccattgttgagccagcaaaatgccagaagtgtaataa

SEQ ID NO: 2349 - DNA, 158 bp, Zea mays
  misc_feature: Incyte ID No: 700552528H1
agatactttctgtcattgccttcttaagaatgttacgtcatgacaatgacatgatgtcctgagcactggtgctgttgttggaacagtgggtagccttgacgaactttcattagctacagtcctaatctagagttctggagacgagactcgttagattt

SEQ ID NO: 2350 - DNA, 261 bp, Zea mays
  misc_feature: Incyte ID No: 700552530H1
  unsure 240, 242-244, 251-252, 254, 257-258, 260: a, t, c, g, or other
ttaagatcaaatgctggaacacttcgaactcgcgcgagactggactcagatccatggcctgtattttagttgtagaagggggcaaatttgcaccgtagtaccatggcatggttatacgcggaattgttgattgatgagtcgtcgtacggtttgtcgacttgatgatatgttgatgtgggagcccctgaatgaggcggtattaatggaaatatataggatggcaatggcaaaaaaaaaatncnnnaaggtgnnanaannanc

SEQ ID NO: 2351 - DNA, 263 bp, Zea mays
  misc_feature: Incyte ID No: 700552533H1
  unsure 153-154, 157, 160, 199: a, t, c, g, or other
aacggccataattgcccaggtgaacgaagcgatcggggcagacgggatcatcgcacggagtgaaggaagttgtgagccagtacggagagatgatcctcgacatgctcatcgcacagacggatccacagagggtgtgcagccaggttggtctgnnacnttngatggcgctcgatctgtcagcgaggggattgaatctgtngtcgggaaagaaaacctgggtcagatgtcatgtgctcggctgtcagatggctgtcgtgtggata

SEQ ID NO: 2352 - DNA, 264 bp, Zea mays
  misc_feature: Incyte ID No: 700552534H1
  unsure 234: a, t, c, g, or other
tcagacatacctttgactgatggtattatttgaagttttataatccaagaattttgaactgcatgcaaccaatgtgtgtctgccacctcacctgtgggaaacagtggtggcgtggccaaatcagcttgatatgcaaccaaacagcagccaagtcctgctgctggccaaacatttgacttggctcacattggcccataaccaaacatgcccaaatttccatagaacaaatcagcngaaatacaatttatattccagaacatgagt

SEQ ID NO: 2353 - DNA, 121 bp, Zea mays
  misc_feature: Incyte ID No: 700552535H1
agcaggatagcttaaattgctgcagttgatgtccacttagtgcctctaccaggtggcataggaatgcaggagtgtagatgaatgctgctgattgtgttgattctttgccactgaatttgtt

SEQ ID NO: 2354 - DNA, 261 bp, Zea mays
  misc_feature: Incyte ID No: 700552536H1
tcttgagaatcaagagcctgataatgttaatctgttggacaatgcaaagaggatattctggtacctgatatccagcctgatgtggaagttgcttcagatccagtcaccatcactaatgaagaaaatgttgatgaaccaccatctgttgttgctccagtggccgaaattatgcccctgcaagacatcaacaacgatgaaaatgctttggtgaatgatgtggaagagagatccaaagaagaacatcctgtactgagagcctga

SEQ ID NO: 2355 - DNA, 262 bp, Zea mays
  misc_feature: Incyte ID No: 700552537H1
  unsure 2: a, t, c, g, or other
gnaagaagaagattagaagaggcggaaagggagagggagcgtaaaaaggatagacttgctgttgaaagagcgacaagagaagcacatgagagagcatttgccgaagctcgtgaaaaggcagaaaaaatggctttggaaagaattaatgctgcacggcagcgggcatctgcagaggcccgagagaaagaagatagagcaagtgtcgaaccagctgctgaaaggcttctagagaagctaggataaaagcagaacgtgcggcatc

SEQ ID NO: 2356 - DNA, 261 bp, Zea mays
  misc_feature: Incyte ID No: 700552539H1
  unsure 208, 225, 243: a, t, c, g, or other
gaggcatcacttaggaagaccactggttcaaaattggaaaagctggatgatattagttatagtgacttgcatgttggggatatcgttgatggccaagttaagcgggtggaatcctttggattattcgttacaattcggagaagtgaattggttggtctgtgccatgtatcagaactttctgatgaacctgtcgttgatattaactctngctataaagctggtganagttaaagcccaaatccngaggattgatgagacgcg

SEQ ID NO: 2357 - DNA, 259 bp, Zea mays
  misc_feature: Incyte ID No: 700552541H1
  unsure 239: a, t, c, g, or other
gatggagataagtttacattgtcaaagcttgacattgtattaggaggaggtgaaagtaaaagagtgcaacttgatgttactccaaaggttgaaggtattttgaagttggttgggataaggtggactctttcagagtcagtagtaggttatcaatactttgaatttaatgcacagaaaaaaatcaagaaagggaaaagaggcccacaccgttcttggaataacagcctggttgtaatcanggttaccaaaacttacagga

SEQ ID NO: 2358 - DNA, 267 bp, Zea mays
  misc_feature: Incyte ID No: 700552542H1
  unsure 249: a, t, c, g, or other
cagcggaataaaatttgggaaatgcagcaagaaaaatgagaacgggaagacttgaaggtcctactgaaggatcactgggtggtttctaaacagggcacttaagcagtactggttccttgttcaactcaatgatgcagcagatgagttcttgacgtgccagacgaatcagaatatgatcagagagaagttatgtttcctctgatgagagcttgcatgctgcggaccagcgtcacgctaaactgtccactnccgctgttttgtaaaaag

SEQ ID NO: 2359 - DNA, 258 bp, Zea mays
  misc_feature: Incyte ID No: 700552547H1
  unsure 120: a, t, c, g, or other
attcttgcttccagagcaatacgggcagcacattgcttaacatccattcagttctcacctacatccgaacacatacttttggcatatggtcgtcgtcatagctcgctccttaggagcatngttgtggaaggcgaaaatggggttcccgtatatactattttggaggtatatagagtttcagatatggagcttgtgagagtgctcctagcgctgaagatgaagttaatgttgcatgctttcatcctcaccaggaggtgg

SEQ ID NO: 2360 - DNA, 264 bp, Zea mays
  misc_feature: Incyte ID No: 700552549H1
accagaatatccaccgtgttcaccatgagttcactgcgccaataggattcgcagctccatatgcacactgggctgaggtgctgatactcggcatcccctccttcgtcgggccagccattgttccaggccacatgatcacattctggctctggattatactccgtcaggtggaggctatcgagacacatagcggctttgatttcccattcaccccgacaaagtatattccatctatggaggagcagaataccatgactatcatca

SEQ ID NO: 2361 - DNA, 259 bp, Zea mays
  misc_feature: Incyte ID No: 700552550H1
  unsure 10, 16, 21, 25, 37, 46, 49, 53, 65, 78, 81, 86, 88, 97, 109, 113, 132, 142,: a, t, c, g, or other
caggcttgcngtttanagggnaganacataccatgtnagagatgtnatncganggcttgacaagntgcttattgcgcnttnctgcnangttcggaanctatgttcctgnaganccatctacatttcggctgncaacaaactnctccttgtatccgcagttcntgtacnacttgcggagatcacagtncatnnatgtnttcaacagctctcccgatgaaactgcnntcntgcaggttnatgctgcnntagggagggattg

SEQ ID NO: 2362 - DNA, 260 bp, Zea mays
  misc_feature: Incyte ID No: 700552552H1
aggagaagtcgaagcctgatggtccaaaccaagagaacctcttcccggagctgattgctgagccaactgatgctcgctcgatgtcctttgttggcactcatgagtacttggccccagaaataataaaaggggagggccatggaagtgctgtggattggtggacctttggcatattcttgtacgagctgttgttcggcaagaccccttcaaaggttccggcaaccgggctacactcttcaacgtcgtgggccagcccttga

SEQ ID NO: 2363 - DNA, 167 bp, Zea mays
  misc_feature: Incyte ID No: 700552554H1
ttcttttaatggcttatagaattgtgttttccagttgtcaaaaatatgcgctggtttgtatttttggcatatactgtgtttttatacccttgcactgcatcatcatctactttatatatgcatcagtttctcgaaaccatcatattaatttgttaaaacatttgtgc

SEQ ID NO: 2364 - DNA, 254 bp, Zea mays
  misc_feature: Incyte ID No: 700552555H1
  unsure 208, 242, 245: a, t, c, g, or other
aaggatttgaatatcaaatttcagtcgcatcgcagcagggattacaccaatccttaccttcctgtgaaccaaacagcaattgaggggattgtgcagcccacggtgggccctgatgggaaggtaaaggagcctgagagcaatgtacttttagcatcaattgagaacatgcaatatgctgtgacggtggatgttctgcacactgtgtttncgcttttggagctgtccaaaaattgcatgttganaanatgggggat

SEQ ID NO: 2365 - DNA, 260 bp, Zea mays
  misc_feature: Incyte ID No: 700552556H1
gaacctgcagtcagccctccccctatcaacccacttccagtgcacagacccaagagacctcgctctaatgctgtagcttctctgcccgagtcttcagctccaacaaaagaagctgctccaaaggtcacattagagactcaacaacatgccctgcaaaggcccttgcagacccaggataatgtggccccgaaaagtgtttttggtgataacagtgaattggactctgctcataagtctccctgcgaccgtcagttttgatc

SEQ ID NO: 2366 - DNA, 260 bp, Zea mays
  misc_feature: Incyte ID No: 700552557H1
ccttgaggagggggcgctttctgagctaattgttgcattctctcgggaagggccaacgaaagaatatgtgcagcataagatggtggaaaaggccacagatatttggaacatcatctcaaatggtggttacttatatgtttgcggtgatgccaagggaatggctagagatgtacacaaaatgctcatacaatagtccaagagcagggatctttggataactccaaaaccgagagctatgtaaagagcctgcagatggaagg

SEQ ID NO: 2367 - DNA, 258 bp, Zea mays
  misc_feature: Incyte ID No: 700552559H1
  unsure 69: a, t, c, g, or other
cagtaacttctgctgatgcaatcatggatgcacttgacactgctgaggaggaactaaaacgcattaatncaacataaaatggaagagcaaattactgcgaaggcagctaaatttcaacctaatgttataatgcaagggcattcaccttcagattatgttctaaatgtagtttcaagcatccgtccaaatgatctggagcaggccctcttggcattgccgttctcggatgcactaaagctcatgtctacttgaaggagt

SEQ ID NO: 2368 - DNA, 256 bp, Zea mays
  misc_feature: Incyte ID No: 700552561H1
tttgagagctttgatttttctcttccattggatagctcaactactgaagaaaaggcatttgggagtgttcatgattccatacaatttggtacatttaattcagatcccgctaataaacatgagatgagtgcagtaagtggcatgtatcagctattggcaactatgtcagggaaagctacaaactgcttgtttaatgatgatgaaaggcaacccggtgaaagtattgatggtagtgtaacagatatttttggttcaa

SEQ ID NO: 2369 - DNA, 245 bp, Zea mays
  misc_feature: Incyte ID No: 700552562H1
  unsure 48, 226: a, t, c, g, or other
ctgttgcttggtgcgtgctgcagatcggccggcccgtgctgttctcgntggcggtggacggcgaggccggcgtgcggaaggtgctgcagatgctgagggacgagctggagctcaccatggcgctcagcggctgcacgtcgctgagggagataacccgcgcacacgtcatcaccgacagcgaccggatcggccgctcgcggctgtagaatcatgtgcagttcacctnagaatgatgttggtctcga

SEQ ID NO: 2370 - DNA, 258 bp, Zea mays
  misc_feature: Incyte ID No: 700552564H1
  unsure 2: a, t, c, g, or other
cnattctcaccagtagtgtgggaggtgatctttggcaagagaaaatcagaccgaccattctaatctctaccagaaagtagtatgtgcacactctcatcattttgttagccttgtagttattatttctcaagagtttgcttgctttcatggttaaacaaatggctaccatgtcttcttttatggaatctataattatggcgatctgtatgcactttgtcatatgcaatcacctccatctattcaactgccccaatagga

SEQ ID NO: 2371 - DNA, 261 bp, Zea mays
  misc_feature: Incyte ID No: 700552565H1
  unsure 154, 161, 171, 180, 196: a, t, c, g, or other
caacgtgggggtggtgaccacctgattgatttacatggcctgcatgtgaacgaagcaatccacatcctgaagggtgagctcaccgccttgaagagcgcggcgagggcagcaggggagaggatgcaagtcatggtttgcgttggaacaggccacnacaccangggctctcgnactgcgagnttgcccatcgctgtgnagcattctgctggatgaaggcctccatacacgcagcctcaggcgggtctgctccgagtgatggtg

SEQ ID NO: 2372 - DNA, 261 bp, Zea mays
  misc_feature: Incyte ID No: 700552566H1
gtactagttctagatcgcgctcgttccctgcccgccgaaccactcccctcgtcgagttcatccctgcgcatgaacgaaatcacaaggttgaagacaaccccaaaatatttattttctaaatcatgttttgaatttattgtgaactattgttgtaatattgagatgatgcgatttggcgattcacgtatatgattttagagattcgatatatacgtgtaaccgaaatcgaaccccacgacaacgctttaatatgtgtatgat

SEQ ID NO: 2373 - DNA, 258 bp, Zea mays
  misc_feature: Incyte ID No: 700552567H1
ggttagaagagatgctccttggtgaagtgacgtgcatctcattttgcgtggtagtagactaatcaccctgcatgcttgtctctaatgcaactacttcactgacttggtgccattggacttagttttcgtcatgtaaaattacaaagctttttatcgaagctacgacttctgcgtgagtttcaagacagcagtgagcaggcagatggatcttccttgtcctgctgctggagcactgacacagtgacactgcggatggca

SEQ ID NO: 2374 - DNA, 260 bp, Zea mays
  misc_feature: Incyte ID No: 700552568H1
gggctggcaatgctgataagaaggtgcaagagctaaatatgaagctggagaagaggacaagcagtgatcaaaagcgcaggattcagaagactgaacatgctcttaaagctgctgaggaggagctgatgaaggctcagttggaaacaacaacaaaagtaaaacagcttagagaggttcatggagcctggttgccaccatggttagcgacacatgcagcccgctctatggaggtgatgtcaaatcactggaatgaacatggg

SEQ ID NO: 2375 - DNA, 259 bp, Zea mays
  misc_feature: Incyte ID No: 700552569H1
  unsure 218: a, t, c, g, or other
gacctacacatacctcgtgacaaggaaactagccgaccaaaaggttatgcttttgctgagtatgaaacagaggagattgcccagtatgccattaagctattttctggccttgttcgacttcataataaaacacttagatttgcgatctctgggcaagacaaaccctcattaaatggcaatattcctgtaactcctagtttgaactctgtaccacagcnaaagcctcctcatcaacatatgaggtctagtgatatccctt

SEQ ID NO: 2376 - DNA, 258 bp, Zea mays
  misc_feature: Incyte ID No: 700552570H1
gtacaaacatatgtctgaatttcctgtgaagatttcagcattttgttctgtttgtctagaaattagaacaaatcaggatgccagagagactgtgctttgatgttgatgccaattacatggaattgcatatttgcattgtgtactttgtattgattgtgatttgatgggcttttctgaccaatgtgcctgtttctgttatcaagtggcatgatgcatgattatcatcccagttcataacacgaacaggtaaaatgcacc

SEQ ID NO: 2377 - DNA, 259 bp, Zea mays
  misc_feature: Incyte ID No: 700552571H1
  unsure 82, 225, 231, 234, 240, 243, 252, 257: a, t, c, g, or other
gtgcactgtctatatatgtccatcaagtttcaatctaaattgcttaagtgcccttgcagttatatggggacaattacaggantaagtgatcttgatcctgttcgctggccaaactcgcactggcgctcagtaaaggtaggtctcgaaacaaacacagctttgtttttcttaatgccattctacatgccttcacacttctttaactgcgtcatgagtgatccgggntaaaanggnggtccnaanttcacacanatagngg

SEQ ID NO: 2378 - DNA, 259 bp, Zea mays
  misc_feature: Incyte ID No: 700552572H1
gagcaattttgtcaaggtggactccatctttggcccgggaacaaaaaggtctacaagcatttggccacactatactttgtttttgtctttgatagctctgagaacgagcttgccatgctcgacctcgtacaagtgtttgttgaaacattggacagatgcttcaagaatgtatgcgagcttgacatcgtatttaacttcaacaagctgcacaccattttggatgagatgatatcggggggacaggtgatcgaaacaagtt

SEQ ID NO: 2379 - DNA, 251 bp, Zea mays
  misc_feature: Incyte ID No: 700552573H1
  unsure 241, 246: a, t, c, g, or other
aaccactgtcgatcaagtatgggcttggtatatcagaccatgatactgaagggagggttgtgactgtagagtttgatgacttctacctgttaactgcttatgtaccaaactctggtgatggtctaaaaagattgacttacagggtcacagagtgggatccatcccttggtaactacatgaaagattagagaaatcgagccgtcatactaactggtgatctaattgtgcgctcaggagatgnatacnggacc

SEQ ID NO: 2380 - DNA, 255 bp, Zea mays
  misc_feature: Incyte ID No: 700552574H1
  unsure 194, 214-215, 253: a, t, c, g, or other
catgtacgctgcagcgtatggcacgtacccgctatatggcaaccagcagctagtgagctagagagctcccctccgacgtgtcccctctgacgggaaacaaaggttttggtccggtgagcatagtagcgtcaggtgagaaggtgcctttataaggctgtcctaagaagtgggcgagatatgttgttgcatcgtancggtatggtgcctgtaactnntgtgtgcgccgtcgccccccgaattattggatggaatngc

SEQ ID NO: 2381 - DNA, 255 bp, Zea mays
  misc_feature: Incyte ID No: 700552576H1
  unsure 154: a, t, c, g, or other
gctggctgctgctgtgcttggtggtgttgacaacatctggattgctcctggtacccgtgtgctgtatcttggtgctgcttctggcacaactgtatctcatgtgtctgatattgtagggccggatggtctggtctacgctgttgagttctctcanaggagtggaagagaccttgtcaacatggcaaagaagaggaccaatgtgatccccattattgaggatgccaggcatccggcaaggtaccggatgttggttgg

SEQ ID NO: 2382 - DNA, 122 bp, Zea mays
  misc_feature: Incyte ID No: 700552578H1
  unsure 120: a, t, c, g, or other
tatgagcaaggggatactcccatgcttttggcgcgcaccaactgacaacgacaaaggaggtttcttcaccaagccatatgcctcacgatggagagaagccttcctcgacaatgtctcgtncc

SEQ ID NO: 2383 - DNA, 257 bp, Zea mays
  misc_feature: Incyte ID No: 700552579H1
ccaggagctcacgtcggaccagagccaacaactgatagattcgtagttgtcatgtcaggatctgatggaaggaccattcctggcaatactattgccgttcaagctgacatgccattcactggtcttacaacctttgggggagcgtttctgtcgaagtttgaatgctctcagatgccacatccgctgctagagcatatcacctttgtggacactcctggtgttctctctggggaaaagcaacggacccaacgtagcta

SEQ ID NO: 2384 - DNA, 256 bp, Zea mays
  misc_feature: Incyte ID No: 700552580H1
  unsure 181-182, 206-207: a, t, c, g, or other
agcgagagcgcagaaccttgacgtctacaaagatttcaacaggctgccaggcgcggatccatgccacagccacggccacggccacggccagaccactgccggggcttccgaccagagcgggaggatcggcaggaagaggaaggaaatgcacagcgacgaggaggacgacggcgaggagaanntttccaggagggcgacgagcctcnngcggctaagaagccgagagtcgtctggtcgattgagctgcacggaattc

SEQ ID NO: 2385 - DNA, 134 bp, Zea mays
  misc_feature: Incyte ID No: 700552583H1
ccatgtgtaagtgaatcctaggtaaccaagtgctgcgttgtatatatgaccaatgtatgtatagattcagtggaacggtaaaaacacgcgaactctacggttttctccttttgttgttaccagttcaattgaac

SEQ ID NO: 2386 - DNA, 253 bp, Zea mays
  misc_feature: Incyte ID No: 700552584H1
  unsure 9, 37, 48, 55, 59, 64, 233: a, t, c, g, or other
tgttgatgngagtatccctagtgcataactgcaagtntaatgcggaanttctaangacncaatntgtttctaggtggcccatatccctggtgcttgttctttgatgttgatggaatatccgacagaacatctagtgtaagttgagttctgtagtttgtaccctttattgttgctgatcacaaaatctttttgttgctgttgatgatactaatatctattagtacctgcatctntttgttgcatattgatgata

SEQ ID NO: 2387 - DNA, 260 bp, Zea mays
  misc_feature: Incyte ID No: 700552586H1
  unsure 177: a, t, c, g, or other
accagatttgctttgctaatgattgaagaattattgtgaagttatgaagtgctgcagctatttgaggtttctgcagaacctaaaacctacctggctcccctcttatggacttccttgcaaaattggtagtgtctctgctaattgagccttcatggcattagtggaagcaatcggaancatgctagcatatgtgatttcttactgtatgttaggtggcgattgcagattctaccgtatttctggacattctcaacaaagtg

SEQ ID NO: 2388 - DNA, 249 bp, Zea mays
  misc_feature: Incyte ID No: 700552587H1
  unsure 2, 4, 20, 25, 46, 52, 79, 99, 113, 134, 174, 180-181, 202, 205-206, 232: a, t, c, g, or other
ancnaaagcaaccaactttnttctncgtcacctgactcacacctcnactcanctccggtccaccaacccctgccggccntggcggctgcggcggcgcanaagctcctcgaggngagcacgaagatcatcggcgncgggcgcaagtacatcggccacgacgaggagctcggcaancggtcnncaaggagccgtctagtctaantcnnactcggcgttctcaaagttgggtggnaatgcgccgcgaaatcc

SEQ ID NO: 2389 - DNA, 180 bp, Zea mays
  misc_feature: Incyte ID No: 700552588H1
gcgtccacgctacagcttggtcgaatgagacatgccgacccattcctgtgtgatgagcaggccaatttttttgtatggtgatcccaatatggggaaaccatcagctgtgacagaaggctttatgttgcatgcactagttgtacgtcttgaatcgagtgtatttatgaagaaattggatac

SEQ ID NO: 2390 - DNA, 252 bp, Zea mays
  misc_feature: Incyte ID No: 700552590H1
  unsure 249: a, t, c, g, or other
acgaagaacataggtccatgctgtagcttcagctcgtcttctgatggcaatggatacatggctggaaactttagcgacagtgatgaagattatgttaattctactgtgctagaagcagttgaggtgagaagtggatcggaaggatatgtgataaagatgcgagatgggaaaaactgcgttgtgtccataacatccccaggggggaatattccagagagtgcaccccaacctgctatgttttgaggatgnaga

SEQ ID NO: 2391 - DNA, 253 bp, Zea mays
  misc_feature: Incyte ID No: 700552591H1
atctacttcaaataatggtgggtttactagtataaggacaaagattttactgtgccagaggacctgtcagcatatgatggtattgagttacgagttaatggtgatgggcgacggtataaactcattatacggactagctatgaatgggatactgttggctatacagcaagttttaacacaactaaggggggatggcaaagtgttaaagtacctttctcttctctgaaacctgtattccgtgctcgtactgtga

SEQ ID NO: 2392 - DNA, 281 bp, Zea mays
  misc_feature: Incyte ID No: 700552601H1
aagagaaaatctcgaaggaaaatatctgcaagactgaattcagtatcttctgagcacacagatattcgttgttgagactgagcacaaagatgttattgtttctttggccggttccacttcaaatgtctcaatggagcagcggacaaatcaagagcaggatggtgattgtttctcaaggaaatccaatgaaaatcagatattagggaggaggtctctaagacgagctgctgaaaaggtcgtctcttacaaggagatgccctgaatgttaagatgcgacgacc

SEQ ID NO: 2393 - DNA, 273 bp, Zea mays
  misc_feature: Incyte ID No: 700552602H1
agttgttgatgacacactcgagtttcttatccttgcaagtgatgggctgtgggatgtggtctctaacgaggaagctgttgcgatgactagatccattaaggacccagaagaggctgcaaagatgctcttgcaagaggcgtacaagagggagagcagtgacaacataacttgcgtcgtcgtgcacttcttgcatgggcaaggtagcagcggatacgcttaaagcgtacagtaaaattatttacgcatggtgtgctctgatgtacatgcgtcgat

SEQ ID NO: 2394 - DNA, 273 bp, Zea mays
  misc_feature: Incyte ID No: 700552603H1
  unsure 257: a, t, c, g, or other
taaaataatgcaatacagaagtctcagatacgcctctggatagagagcagacagaacatgaaatgtgaaagtgcctcagcctcaaacagtaagggcgttgatacgtcaagcaaggcaagtcgaaagaggtctcgaccaggagagaatccaaagccacgaccaaaggaccgccagcttattcaggatcgtataaaggagctacgggaactcgtacctaatggggcaaagtgtagcttgatgcttactggagaagaccntaagcactgcttttct

SEQ ID NO: 2395 - DNA, 238 bp, Zea mays
  misc_feature: Incyte ID No: 700552610H1
gggaatcttgatgatgctgcattggatatcaagggctatatatatatggatcatgcatatatatcagatcaccagtcatatcgagttcttccttccaggcttgctagaaggcaatatataataagaaaagactgaaaggaaaaggcaccactgcaatgatggaacgcatcagtggcatctgttttgttctctaaacgattcaggtcatcaggtgagctaggttggctaataagtatat

SEQ ID NO: 2396 - DNA, 70 bp, Zea mays
  misc_feature: Incyte ID No: 700552611H1
  unsure 11: a, t, c, g, or other
aaatgaaattnccactgtggatgtgctaggaactgtcattgtgctgccgctgctgtgatttgtgaacatc

SEQ ID NO: 2397 - DNA, 275 bp, Zea mays
  misc_feature: Incyte ID No: 700552613H1
  unsure 142-161: a, t, c, g, or other
gtgagatccatatttgcatgcttgcttgatcaagtgagccaatacttaactgaagggcttgaccgtgctagagagagtttaaatgaggccgcagctttgcgggatagatatgtcatcgggacaagtgttagtaggagagtgnnnnnnnnnnnnnnnnnnnnacaagaggtggcagcttcagctggtgagagcagctttagatccttatgattgctgtgcagcgttgtaccagtagcgtactatttcttcagcagtactctcaaataccatatctc

SEQ ID NO: 2398 - DNA, 279 bp, Zea mays
  misc_feature: Incyte ID No: 700552615H1
  unsure 138, 190: a, t, c, g, or other
aaggatctacaagaaagaagtgctttcatactagacattttcttacagatgatttacttcctgtgcatgtctggaaatatagacaaggcagtttctaggattattggaattcttccaactgcaatgcctgataattcnggtgacaagttgcttgctgatgtcatttcttgcttgaccatgtccgacagcncgcatattttggatttcgtgcctatatgtcttaatttacaggaaccttccagaggaaattattgatcagctggagtttcagaaagctta

SEQ ID NO: 2399 - DNA, 278 bp, Zea mays
  misc_feature: Incyte ID No: 700552617H1
ataactaaagtttcaccttcagaagaaaaatcaggtgtaaaaacgaagcaaagcttgcaaaaggtttcaaataaaagccagtgttgtacctcttgagtccaaaaccttgaagaaaaccactggaattagtcagagcattaggtctggtatggtgaagaataaggtaccccaacctaatgacttctcaaaagataccggaagtgttaaccaagctgaagataaggagcaatctcctgtgacaaccgagccaactactaaggtactggaggctgatcttg

SEQ ID NO: 2400 - DNA, 120 bp, Zea mays
  misc_feature: Incyte ID No: 700552618H1
  unsure 96, 106, 108, 110-112, 114, 118-119: a, t, c, g, or other
tgcagtacgccaacatcgtggggcgtggccatcggctacaccatcgctgcctccattagcatgctcgcgatcaggagggccaactgcttccacacnacatacgagngncnnnantggnnc

SEQ ID NO: 2401 - DNA, 272 bp, Zea mays
  misc_feature: Incyte ID No: 700552619H1
atgttgatcttgcccttgcaggcgtgctatgggcttgcataaagcagtatctctatgtatggatcactgctatgtttcaggaacggttggtgatgacagctggtacaagacggtcattttagctggtggttcgtcgtgcttgcctggtttaccagagaggctggagaaagagcttcaccaacttcttccaccttatatgtcagaaggaataagagtactccccccttcatttggcactgattctgcctggtttggtgcaaagatgatcagca

SEQ ID NO: 2402 - DNA, 271 bp, Zea mays
  misc_feature: Incyte ID No: 700552620H1
ttgatggaagctcatcatattcaaccccgaagcagtcaaggtcaaggaggccaaaccattctggcgagcaacttcctttcaaccccgcaacgagtggcaatggtttttgatgccaccctacacgatggccacccagattggttatggaaccaaccattgcagcaagcacaccttactctgctccaagtttgttggcacccgtagatatatgttatttctagttaaatcttgcagcgttgcgctgatgaagcctggcatggtgcgagttttg

SEQ ID NO: 2403 - DNA, 264 bp, Zea mays
  misc_feature: Incyte ID No: 700552621H1
  unsure 2: a, t, c, g, or other
anaatctttcccagtttctgctgaagtgcttgattctagtttttgcctaccgattggcaaagctaaggtatgttgtgtctgggtgcatatgggtgtatgggaaggagattactttaggtaggactatttctataagtttaccttgggatggttttgagtggactcctattgctttcaaaacggttctccatttcctttctggattatactgataccatgtgcactcactgtgggcctcatcttctgtagatagaacgtgggggt

SEQ ID NO: 2404 - DNA, 274 bp, Zea mays
  misc_feature: Incyte ID No: 700552622H1
gttaagcctggcatttatgttacatacaacggtgacttttttgactggccatttttagagaagagggctgcacaccatggaataaaaatgaatgaggagattggtttccaatgtgacaataaccagggcgagtgtcgggctaaattttcttgccatcttgactgttttgcttgggtgaagcgagacagttaccttccacaaggaagccaaggtctaaaggctgttacaaaagccaagctaggttacgatcctctggaggttaatccagaagata

SEQ ID NO: 2405 - DNA, 276 bp, Zea mays
  misc_feature: Incyte ID No: 700552623H1
gtgcggagttccatccaactcactgtaatacactagcatatagtagctcaaagggtactattcggcttattgatctgcgacagtcagcactgtgtgacaaccatgctaaactatttgaggagcatgaagcacctggatcaagatccttttttacagagataatagcatcagtttcagatataaaatttgcaagggatggaagacacattcttagtcgtgattatatgacactcaagttgtgggatctaaacatggattcaggcccagttgcaactt

SEQ ID NO: 2406 - DNA, 271 bp, Zea mays
  misc_feature: Incyte ID No: 700552625H1
gggttattgcccacggaagcttaaatacttggtgctgaactgctgaagtatgatgtctcactgaaaaacaacgagatggcaatgagaagtgttcaggaagaggggtaatatttactcagagcagcaaaggaaggtgctacttcatggtcatgagtatatgcaaagagacaatgctcataatagtttgcttgatatttgttgttcatgctaaggatgccacttacttatttgcaaacaagctatttcagatgattgacagcttggcatgact

SEQ ID NO: 2407 - DNA, 151 bp, Zea mays
  misc_feature: Incyte ID No: 700552629H1
  unsure 12, 18, 24, 28, 64, 84, 96, 98, 104, 114: a, t, c, g, or other
gcaatagctgtntaatcnatcgcntctncaatgaagcgctttgaagcatgcaacgtatgtagtntctgtaggtgattgtatttntggtagtaacantnattctncctgaatttnggataatacaagctacattcgcagtagtttctgatgt

SEQ ID NO: 2408 - DNA, 279 bp, Zea mays
  misc_feature: Incyte ID No: 700552630H1
  unsure 27: a, t, c, g, or other
cgcgttcgcccagccaagctccctcgnccaaaccgcgcccccgctactcgccgcgcgcgccatctctctgttcgcctactgcgcacagctttccaagctccatggccggttccctgctcgtgtcgtggtctcccagctcgtcagcacttgttcagtagtctcggctcgctcggcctcaaattccagcgcctcgccctgctctcgtggttcagcaacggccggcgcgaacctgcaccgtggtggtgttgtggcaggcgacgtcgtgcgcgtcgcgacagc

SEQ ID NO: 2409 - DNA, 280 bp, Zea mays
  misc_feature: Incyte ID No: 700552631H1
aacacagtttaatgcaacaactgaacaaacaaaaaaactttctattttatataagttattgatgaagcatgttctttgcaaaatagttgatataaaatctaacaaatttaaataatagatgccataaaatattcaggattttatattttgaaaataggaaaatcacatagattcaatcccacatgtctgtttaaacaaccaagcaattggttctccagtaatttcgtttgatcactgataaaaagacagctctgagcgctcccctaaggtaattgccaac

SEQ ID NO: 2410 - DNA, 277 bp, Zea mays
  misc_feature: Incyte ID No: 700552633H1
tgaaaaccagctatctgaacaaaacaatgatgaacctgcggcatataatggggtttacatgattacacaccaatcaagtagtgatatgctgactttagccgtaccatctggaacagaagcacaaccaatgaatgatacacaaaaggctgataatccctacccttgtgaatccttgttggatgttcagtcaagtggaaattgcacccaaaattctgtgcatgaaccccatctgtactggaacggggcagttgaaggggctgcagtagcttatactccc

SEQ ID NO: 2411 - DNA, 273 bp, Zea mays
  misc_feature: Incyte ID No: 700552634H1
  unsure 80: a, t, c, g, or other
aacagcaccaaagcaaacgcacataagcctacatttgccctagtggacacggcaccatcaaaaccttcatcaggtaaggngcggtctgcttctcctatgcgcaggccgctgcagttcaacaggagcaccagttctgatactacgcagaaggttggcgctaagaacatatctggtgtaaaggaactttcaacattccattccttcgacaaccccaaaggtcgtgcgatccaaaaggcccctgttggcactaaaagcatgctggcggctctcttc

SEQ ID NO: 2412 - DNA, 246 bp, Zea mays
  misc_feature: Incyte ID No: 700552636H1
gggacggtggagcggcggatgctgcggttcgcggtaccacgccgtgaagaacatcatcagcgatgagcgggatgagatgtcgagggcggattcggacaggttcacagccatcatccagcaggtggattgcctacacgagctcgtgcagaggcctagggagcaaatagcggatgcagaagctctgcttggcattacaaacactttggtaacttcggtgaggtcccactcaagtgaaggaatcagccc

SEQ ID NO: 2413 - DNA, 272 bp, Zea mays
  misc_feature: Incyte ID No: 700552638H1
  unsure 148-149, 151: a, t, c, g, or other
agcatgacaatttgatgaaggagaagggagagattgctaaagaaaatcaaagccttgtaaagcagatggaggatcttaaatcaactcagaagacaacatctgaaacaacacttgagcaggctattaaagaaaaggatttcaggatacnnancttagaaagaactctggaaaaggaaagagatgataacaagaaagagaaggcaaagagtaggaggatgagaacacaatcttggtgcactttcagaaggtgcaacaggacaagaaacaagtag

SEQ ID NO: 2414 - DNA, 274 bp, Zea mays
  misc_feature: Incyte ID No: 700552639H1
  unsure 37: a, t, c, g, or other
gtccaaatcagtttgtctgctccgcccgttgcccgtngcccgtccggtctctcttgcagtctcgccgctccccttcctcccccgcaggaatccgaatcagtaagtccggcgacctaggtctctcggcttgtccgcagcccgccggtcagtaatggcgcaggatgatccggttgtttctgctcagtggctgcacgagcacctagggatgcctgatgttaaggtaaaaaaaaaaaacatctagtttgcgtgttcatattcacttcagagacacttc

SEQ ID NO: 2415 - DNA, 272 bp, Zea mays
  misc_feature: Incyte ID No: 700552641H1
  unsure 266: a, t, c, g, or other
gttgatccgaacaagctcatgcagatcacctcggtggatcgctacatcaagtaccatgtgcaggagttcgagagggcattcagggagaggttccctgcctgcacactgtcagccaagagacatattgactccactaccaccatactggacgtccatggtgtggggttcaagaatttctcaaagaccgcaagggagcttgtccaacgtatgcagagaatagacagtgactactatcccgagacgctacatcagatgtatgttgtgangcaggc

SEQ ID NO: 2416 - DNA, 268 bp, Zea mays
  misc_feature: Incyte ID No: 700552643H1
atcagcagtactggggcagctgatgataagtaacatggtaccaagcagaggccttggctccatggcatcttggccatcctctcctgtgctcatcagcagtactggggcagctacaatgaagggtatgatcggccgcatcttattagcttcccatggtgcgtatatgacaagcttgtggccatcaagcaggggaggaatctcctcacgcggatggatcgaaacttgaggttccgttgagcatgccagcagtatgctcctgtacatatcc

SEQ ID NO: 2417 - DNA, 273 bp, Zea mays
  misc_feature: Incyte ID No: 700552644H1
  unsure 2, 4, 43, 56: a, t, c, g, or other
ananccttgcctccgaggtgccgccctccccgccccgcctgcnccgcttgctcatncgcttctctccccgcggcggcctcccagatccggttggatcgaggggcaaggtcaagagatggggcaggccttccgaaagctgtttgatgccttcttcggcaacaaggagatgcgggtggtgatgcttgggttggatgcagctgggaaaaccaccatactctataagcttcacattggtgaagttctctccactgtccctaccataggtttcaatgt

SEQ ID NO: 2418 - DNA, 274 bp, Zea mays
  misc_feature: Incyte ID No: 700552645H1
gggagaaaagacgctcaaagtgaatctccagagaactatggttttgctgccatagatgaagatcctaagttttcattgtcaaaacggtacaacgcattataccggaatttgtataaaattgcagcaaaagcttcagaaagcgttgaagcttatgcattcctggagaaccaatatgaacagcttgttgaacaagtggaagtactctggcaagcaaagttggcatgataaatctccttaagtaccatcctgaaaggcaatcagccaatatgcttaa

SEQ ID NO: 2419 - DNA, 274 bp, Zea mays
  misc_feature: Incyte ID No: 700552646H1
  unsure 237-239: a, t, c, g, or other
aggtttcttgaggctgagaacatggtgctgaagacggaactttgccgcttcagcggccagaagatttatcctgggaaaggcattagatttatccgtgctgattctcaggtcttcctttttgccaactcgaaatgcaagcgctacttccacaaccgcctgaaacctggcaaagcttacctggacagcaatgtacaggaagcagcacaagaaggatatccatgctgaagcagtaaagannnggcgccgcgccaccaagaagccatatccagtcatt

SEQ ID NO: 2420 - DNA, 278 bp, Zea mays
  misc_feature: Incyte ID No: 700552648H1
  unsure 186-187: a, t, c, g, or other
ataattcctacctcactgggaaccagcttcaatagtgactccagtgacgtcccaattgtaaaggcgttgcagagaggtgttagagtcattgaactcgatatgtggcccaatccttcaaaggacaatgtcgatattcttcatggagggacattgactgccccagtggaaatgatcaaatgtttgatnncccatcaaagaatacgccttctgtgcctcaaattatcctcttgttatactctgaggatcacctcacatcagatctccaagctaaagttgct

SEQ ID NO: 2421 - DNA, 273 bp, Zea mays
  misc_feature: Incyte ID No: 700552649H1
gcagagtcttgtgacttgggctaccccaagacttagcgaagacaaggttagacaatgcgttgactacgaggcttggaggggactaccctcctaaagctgttgcgaagtttgcagctgttgccgcgctgtgtgttcagtacgaagcggacttccggccaaacatgagcattgttgtcaaggcgctacagcccctgctgaatgcgcatgcgcgggcgaccaaccctgagaaaaatgctagctcaaaagcttcgcattgctcctctccgccctctt

SEQ ID NO: 2422 - DNA, 274 bp, Zea mays
  misc_feature: Incyte ID No: 700552651H1
  unsure 67: a, t, c, g, or other
gcacggcaacatctgcctggacatcctccaggacaagtggtcctccgcctacgacgtgcgcaccatncctcctctccatccagagcctgctcggagagccgaacaacgactcgccgctcaacacgcaggcggcggcgctttgggcgaaccaggaagagttcaggaagatggtggagaagctctacaaggccgccgcgtagaggacagcacacggcgcagatgccgacttcaggttcttcaagcaccgatcttcacttggatcgattgacgtgga

SEQ ID NO: 2423 - DNA, 268 bp, Zea mays
  misc_feature: Incyte ID No: 700552652H1
aaagtaaccagcagaatctgggcacaattaaatcgtcaaacctgtgcactgaaataattgagtttacaagtcctactgagaccgctgtctgcaacctagcatctattgctttacctcgttttgttcgggaaaaggatgttccattggagtcccatccatctaagcttgtgggtagcagtgattcaaaaaatagatattttgattttgagaagctagctgaggttacctcaactgttacttacaatcttaacaaaattatcgatattaa

SEQ ID NO: 2424 - DNA, 216 bp, Zea mays
  misc_feature: Incyte ID No: 700552654H1
  unsure 37: a, t, c, g, or other
gaaggcttcaacaggaggaagaactggctaagcacanggctgaggaggaggatgacgacttctaaattagctgccttttgagcaaccacttgcaattgtggacttgttcgaacgcctggttaaaccctgcctctagctactcgagtcatgcaaaaacactgaactttgaaattcatccactgtaatgttttgttgatcaggggtttctttaaattc

SEQ ID NO: 2425 - DNA, 267 bp, Zea mays
  misc_feature: Incyte ID No: 700552655H1
  unsure 219, 226, 230, 233, 266: a, t, c, g, or other
gtcgcagatgcttctaaggctttgtcccgtgctgtttgcattgctgtacgatacagcgccatccgaaagcagtttggctctcaagatggtggccctgagactaagggtccttgattacaagactcaacaaagcagactctttccgttgctggcttcagcatatgcattagattgtgggtgactggcgaagtggctaaacatgggtgtcactcagaaacngggagcnaaanganactccacatgcaagaagcccagcctgtactgcng

SEQ ID NO: 2426 - DNA, 273 bp, Zea mays
  misc_feature: Incyte ID No: 700552656H1
  unsure 191-213: a, t, c, g, or other
caatcacttgctaccaaactatgatgaaaattctatgttgcaatgtggtttatcttgggctcctgaacagaacagcggagcccttagtacagatttctggaaaaatgttgaaactcaggcttcatcggtttccatgccaataaatggagcacctgttgcaagctttccagcaaatgttagattccacaatnnnnnnnnnnnnnnnnnnnnnnntttaccgccacaggttgctccagctgaagcaggttctgatcagtcggggttggcctttca

SEQ ID NO: 2427 - DNA, 267 bp, Zea mays
  misc_feature: Incyte ID No: 700552657H1
gctacatatggacatcatggatgggcacttcgttcctaacctgactattggggctccggtgatccagagcttgaggaaacataccaaagcatatttggactgccatcttatggtcacaaagccttcagattacgtagaaccatttggaaaggctggcgcttctggattcacattccatatagaagttgctagagacaactggcaagatctcatccaaagcattaaatcaaagggtatgcggcctggtgtatcatgaggccagtatcc

SEQ ID NO: 2428 - DNA, 268 bp, Zea mays
  misc_feature: Incyte ID No: 700552658H1
gatgcaggcatctagggcaaggcttttcaaggagtacaaggaggtacagcgagagaagtcagctgaccctgatatccaattaatatgtgatgattctaacatattcaagtggactgctcttatcaagggcccttctgaaacaccttatgaaggtggtgtgtttcaacttggcattcgcaattccagagcagtatcctctgctgcctcctcaagttcgattttggaccaaaacttccacccaaagtggcatttcaagacagtgagattg

SEQ ID NO: 2429 - DNA, 268 bp, Zea mays
  misc_feature: Incyte ID No: 700552659H1
  unsure 231: a, t, c, g, or other
atgatggaagctcatcatattcaaccccgaagcagtcaaggtcaaggaggccaaaccattctggcgagcaacttcctttcaaccccgcaacgagtggcaatggtttttgatgccaccctacacgatggccacccagattggttatggaaccaaccattgcagcaagcacaccttactctgctccaagtttgttggcacccgtagatatatgttattctagttaaatcttgncagcgttgcgctgatgaagcctggcaggtgcgatttt

SEQ ID NO: 2430 - DNA, 270 bp, Zea mays
  misc_feature: Incyte ID No: 700552661H1
atcagcagtactggggcagctgatgataagtaacatggtaccaagcagaggccttggcctccatggcatcttggccatcctctcctgtgctcatcagcagtactggggcagctacaatgaagggtatgatcggccgcatcttattagcttcccatggtgcgtatatgacaagcttgtggccatcaagcaggggaggaatctcctcacgcggatggatcgaaacttgaggttccgttgagcatgccagcaggtttgctcctgtacatatcc

SEQ ID NO: 2431 - DNA, 271 bp, Zea mays
  misc_feature: Incyte ID No: 700552662H1
  unsure 264: a, t, c, g, or other
ctctggaaggaggtggacagaatgccaaatctctggtgcttagagttctacggtaagcacatgaagatgaaatgcctgggcaacagtggtttgctcatgctctccttgaaggcgaacatatgaaccgccttgttacatacaaccttttgaaaagggagtggcagaaggttcctgattgcatgctaccatggagtcgaaaaaggcaatggataacatgtgggcacagcatttgatccggtcccctgcgcctggtctggacaggantttacct

SEQ ID NO: 2432 - DNA, 277 bp, Zea mays
  misc_feature: Incyte ID No: 700552663H1
tgaaaataacccatctgaacaaccaagtgctaagaaaatggaagacagagtgtcaaaggttgtggaagtcttcgttggaagaatccggaagatggaaaatgactttataagtttgaacaagagggcctcgatgctagatgtgcaactggagtgccaagatctggagagaatttctattgtaaatcgtctgggaagatttcatgggccggagccatgcagcggcagttgagagttcatcagctccagaaatgactcctcggagatttttccctgaaag

SEQ ID NO: 2433 - DNA, 280 bp, Zea mays
  misc_feature: Incyte ID No: 700552664H1
  unsure 219: a, t, c, g, or other
cttctccttaattccccatctttctcctccgccttcgcctccttccgcatcccttcgcctttcctccgcccaagcctctgttctcctccggctgccgaaaccctagccgcctccgccgtcatggcgagcagcaacgtctccaccgtctacatctccgtcatcgatgacgtcatctccaaggtccgcgaggatttcatcacctacggagtcggcgacgcntcctaaacgagctccaggctctctgggagatgaaaatgctgcatgtggcgcgatctcggga

SEQ ID NO: 2434 - DNA, 272 bp, Zea mays
  misc_feature: Incyte ID No: 700552665H1
  unsure 5, 59, 66-67, 77, 130-131, 148, 157, 185, 196, 199, 206, 215, 228, 245,: a, t, c, g, or other
gtggnaagatcgaggctgaactgagcaatatctgtgatggaatcttgaagctgcttggnctcccanntagtgacctnttctactggctgctgaatcaaaggtcttctacctcaagatgaagggtgaatanncacaggtatcttgcggnatttaagantggtgctgagaggaaggaatctgctganagcacaatggnggnctatacngctgctcangacattgctcggncgagctggacacctacncatccgatanggctgggattgntctta

SEQ ID NO: 2435 - DNA, 268 bp, Zea mays
  misc_feature: Incyte ID No: 700552667H1
gggcacttgtggatgcccctgatatggtcaggtgccaggtgaacttcaagcggctctcacttactgacatcaagattgacatcaaacgtgtccccaagaagacagccctgatcaaggcgatggaggaagctgatgtgaagaccaagtgggagaacagctcatggggcaagaagctgattgtccagaagaggagagcatcgctgcaatgactttgataggttcaaagtcatgctggcgaagattaagaggggcggtgctatcaggcaag

SEQ ID NO: 2436 - DNA, 265 bp, Zea mays
  misc_feature: Incyte ID No: 700552668H1
cggagaaaaaggattagtcggctgtttctctcatggtgacgaaagtcgtactggaccacaaaagctggaagctgataaatggtttaatgaaatggctccaatgacacacagactcctttcggctttaattatggaagatgacctacctgattccaatggggtgcaaagagatatacttgttgaatttccaaatagccacaatcctacactgtcaacagatacttagaaaatgaacttcaagctagtgccataacatctattttgg

SEQ ID NO: 2437 - DNA, 269 bp, Zea mays
  misc_feature: Incyte ID No: 700552669H1
  unsure 90: a, t, c, g, or other
atctgccgctccagcctttcgctagggtttatccaccggcggcgcgcgcgacggcggcaagatggtgcagcgtctgatctaccgcaagcngcacagctatgccacgaagtaccaaccagacgcgggtcgtcaagacccctggtggcaagctcgtgtaccagtacaccaagaagagagccagcgggcccaagtgtcccgtgaccgggaagaagatccagggcattccccatctgaggccagctgagtacaaaaggtccaggttgtctagg

SEQ ID NO: 2438 - DNA, 269 bp, Zea mays
  misc_feature: Incyte ID No: 700552670H1
  unsure 13, 35: a, t, c, g, or other
tgctttgcgagcntcttccgagtccgatgggagantcagccgtggactgtggcagtcttgcgtgccatgcctgacattgcgttcaccattggaggcaagaagttcaagctgaaaccagagcagtacattctgaaggttggtgaaggacaggctgcccagtgcatcagcggattcacagctatggatatcccaccaccccgtggccctctctggatcttgggtgatgttttcagggagtctaccacaccgtcttcgactatggcaagctg

SEQ ID NO: 2439 - DNA, 270 bp, Zea mays
  misc_feature: Incyte ID No: 700552671H1
cagaagataggcacattgttgttctcaagcacaatgtttggcgtgtaaaaggactaattcaggtttgtagatcaatcaatgtgcaaccactacaaccacatgaccagtttctcatatttgcatctgatggactttgggagcacttaaccaaccaagaagctgttgatattgttcacagtagcccccgcagtggctgtgctaggaggctgataagagcggcgctgcaagtggcagccaagaaaagggagatgaggtactcagacctcaaga

SEQ ID NO: 2440 - DNA, 277 bp, Zea mays
  misc_feature: Incyte ID No: 700552672H1
  unsure 184: a, t, c, g, or other
ggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatnccttcaagcagcgcctcaaggtaccaccggacgctcaaccagttcacccgcacccttcgacaagaaccttcgctacgaacctgtttaagatgc

SEQ ID NO: 2441 - DNA, 269 bp, Zea mays
  misc_feature: Incyte ID No: 700552673H1
cagaagaatcaaggaaattgcagatgactgatacaagatgtcaaagatgcagcgaaaagaaagttggcatatctgatattatccatgcaggtcatggagaccgctatcagttggaatgcacttcctgtggctacacatggttttcgtccagagatgccatcacaacacttacagaggatgccccaagcactgctgggaatgtgggcactgcccccttggcaacagcaaagttcgaggtcgttgagaagaagctcacgagcccacgggac

SEQ ID NO: 2442 - DNA, 268 bp, Zea mays
  misc_feature: Incyte ID No: 700552675H1
gcgacttgctagcaacgaatcgcatggctgctcaggatgttggtgcttcaaagtacagtatcaagcatgatactaatggtaacacgaatgtgtcggaccttacgatcattgacgtaactagtatcaacgaagtttcttctctccttaggcgggctgctcagagcagatcagttggtagaacacaaatgaatgaggaatcatcaagaagtcactgtgttttcactcttcggattttcggtgtaaatgagggaacggatcaacaagtgca

SEQ ID NO: 2443 - DNA, 268 bp, Zea mays
  misc_feature: Incyte ID No: 700552676H1
gaagagcacccagttctgctgacagaagcacctctgaacccaaaggcaaacagagagaagatgacccaaattatgttcgagacattcaatgcaccagcaatgtatgttgctatccaagctgtcctttccctgtatgccagcggtcgcactacaggtattgtgctcgattctggtgatggtgtgacccacaccgtgccaatctacgagggatacgcgctccctcatgccatcttaggctggatcttgctggccgtgatctgactgactg

SEQ ID NO: 2444 - DNA, 272 bp, Zea mays
  misc_feature: Incyte ID No: 700552677H1
cttgtgaccctccctcagccgcgtcgcgtcgcatcctacgatccaaagctctctctgctcgcagccatggcgaagaactacccgaccgtgagcgccgagtacagcgaggctgtggagaaggccaggcgcaagtccgagccctcatcgccgagaagagctgcgccccgctcatgctccgcctcgcgtggcacttccgcggggacgttcgacgtgtcgtcgaggaccggcggttccattcggcacgatgaagcatcagtcggaattggctcacg

SEQ ID NO: 2445 - DNA, 272 bp, Zea mays
  misc_feature: Incyte ID No: 700552678H1
agccctgaacattgtcatcatcaaggattataatatgaggactacaaacatgtctaatggtgtaatcaagctacgcactaaaagacttcttgcagagaaagaatctattagaattacaaggtcaaaaaaaactgctgcccagcctaatggtactgaagtgtttgacaacaacgatggccatacccaggctacagttcaagctagtgaccctgctctatttgacgagtacacccacatggctaatggaggtcttccattgctcgccctgatgg

SEQ ID NO: 2446 - DNA, 271 bp, Zea mays
  misc_feature: Incyte ID No: 700552679H1
  unsure 21, 24, 28, 56, 76, 78-79, 91, 93, 95, 166-167, 182, 189, 201-202, 207,: a, t, c, g, or other
ctggaggagcgaacgcctacngcntgcnctgaaattcctggtggtggtcgtgcacncatgaggtgtggcgcaggcnannatttcagtgcangntngatgagcgaacgcctacagaactatgcaacagactccaactatggatccactgaggcacacacggatgagnntgaaccaaacagcantggctgntgccggccaaannaccgntgccgctatgtgcgtcnaacccangcngacatncaaaancatctctttcctgtgcagcananna

SEQ ID NO: 2447 - DNA, 265 bp, Zea mays
  misc_feature: Incyte ID No: 700552683H1
cccgcacatcgccgtgatcctcaagacctcccctacgtcctcgaccacctctccggagcagccttcgccgccggtaagcccctccgcccttttctccgccgcgggtactaattaattggggaaaggaccgcgggttcgatttccagaaaccctagggggttttctgcagagccatagactcaaatgaatagtaccccggggacctgtctgtaattcctttaagaatttcgccagggaccccagtgcaaaactgcttttctttaaa

SEQ ID NO: 2448 - DNA, 212 bp, Zea mays
  misc_feature: Incyte ID No: 700552684H1
gcgagattgttcgagatgattagagtgtacatacgcggtaggaggtggccttagaagaatcaagattggctccaagccaaaccctaacctctgtacatgcccagccctggtgcccgctcacctcggcagaaattttgtgactgcatcttctcttagcctcttgctagctgtagtattgcccgatttctcagatttagaaaaaggagccttct

SEQ ID NO: 2449 - DNA, 263 bp, Zea mays
  misc_feature: Incyte ID No: 700552685H1
  unsure 2, 94-126, 141: a, t, c, g, or other
anatatataataaagatcagcgggcaatatacaagttattatctggaagaatcaaatctgaaaatgtccctgaaaataaggatgggtcagatgnnnnnnnnnnnnnnnnnnnnnnnnnnnnnnnnnacgatgagggtggtnacgacgacgatgatgctgaggaggaattctctggagaagaagatgggggtgatgacgatgatgaagatgatgattcctgaagctaatggtgaaggaggaatgacaacgacaatgatgacgac

SEQ ID NO: 2450 - DNA, 270 bp, Zea mays
  misc_feature: Incyte ID No: 700552686H1
  unsure 71: a, t, c, g, or other
atctcacgatccactcgagcaccaagccgagggaaggtgaggagcgatggcgcgcggcgtggtgtcggcanaagggcggcgcggttcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaaccttcggcgactcctcaccatctctcgcgagaagaccaaggtcaccgtc

SEQ ID NO: 2451 - DNA, 268 bp, Zea mays
  misc_feature: Incyte ID No: 700552687H1
  unsure 57, 140: a, t, c, g, or other
acatcctgataaataatgcaggcgtcatgttctgcccttttcaactgtctaaagggngtttcatcgagttgaagctagacctcagctccctcaagtctgtcagggcttttgtggaccagttcaactcgatgaaactcccngtaaacatcctgataaataatgcaggcgtcatgttctgcccttttcaactgtctaaagacggggtcgagatgcagttcgcgacaaatcatctaggacactttctgcttaccaatctcctccttgatac

SEQ ID NO: 2452 - DNA, 271 bp, Zea mays
  misc_feature: Incyte ID No: 700552688H1
  unsure 108, 165: a, t, c, g, or other
gagctccaaagaatctagcagctaggagcaggccgtgtatacgccatccaccacggcaacatgtgctccggctcctggtcctggagcagcagcaagaagcgcaaggcnccgtcctcttgttgtcgtcaacctcaagcggcgccagtgcagaagacgccgccgccntcgccacctcgttcctcagttgctatcaggaggaagaggctgagactgaggaggttgcgagccggagcagaggccatggagatggtgaacctgaagctctacctgg

SEQ ID NO: 2453 - DNA, 153 bp, Zea mays
  misc_feature: Incyte ID No: 700552690H1
atactcccggcccttgtgtctgtgtctttgtctgtaataagaacgtgtatatgcgtgaaacctatcagttctgttattttttggcatgcgcctgacttcttgttcaactggtgtgagttgtatgctttgttcatgaagcactgatcaatgatc

SEQ ID NO: 2454 - DNA, 266 bp, Zea mays
  misc_feature: Incyte ID No: 700552691H1
gacctacacatacctcgtgacaaggaaactagccgaccaaaaggttatgcttttgctgagtatgaaacagaggagattgcccagtatgccattaagctattttctggccttgttcgacttcataataaaacacttagatttgcgatctctgggcaagacaaaccctcattaaatggcaatattcctgtaactcctagtttgaactctgtaccacagccaaagcctcctcatcaacatatgaggtctagtgatatcccttgccacaa

SEQ ID NO: 2455 - DNA, 274 bp, Zea mays
  misc_feature: Incyte ID No: 700552692H1
ggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcattccttcaagcagcgccttcaaggtaccaccggcgcttcaaccagttcacccgcacccttcgacaagaacctcgctaacgaactgtttaaga

SEQ ID NO: 2456 - DNA, 268 bp, Zea mays
  misc_feature: Incyte ID No: 700552693H1
  unsure 97: a, t, c, g, or other
gtccaccgcgacctcgttcgcaacgggcctggctccgtcaagttggtgccggaggaggaggacgacttgtggcacgcgtacaacctcattgccattngtgacagcctccaggccgtcaccgtacggaaagtgctgagagaggtggcatctggaggacgtgatgccgagcgtgtgaagcttaagttagaaattgtagttcgagtctgtagactatgacaaggagggatctgttttacgtgtgctggaaaaaatatcactgagatggacc

SEQ ID NO: 2457 - DNA, 272 bp, Zea mays
  misc_feature: Incyte ID No: 700552694H1
ttcaagccacaccaaaccacactgcgacacacagtaggcgaggcgaaggagaggcaaggcggcgcggcgggcaagatgtttgacgatcaagacctgggcttctttgccaatttcctgggcatcttcatctttgtcttggttattgcgtaccacttcgtgatggcagacccgaagtacgaaggaaactgatgtcctctagtgcaaagatcctattatctggcaggccgaaatagggctatactgttagctaatgctagtgagatcgcttggac

SEQ ID NO: 2458 - DNA, 238 bp, Zea mays
  misc_feature: Incyte ID No: 700552695H1
cagacgcggcaggtcttctccaggcgggtggatctccagcgctcctcgagctggagcaggcaggcgtgccggtcttctccaggcgggtggatcttcaccggcgcggcggcctaccgggcggacggatccggtcgatctccagctgctccgtgcctctgctgctcggcgtcctgagctccggccgtctcgcgctgttgcttgctccttgaatccgcacacatgtgatggttcaaataaa

SEQ ID NO: 2459 - DNA, 273 bp, Zea mays
  misc_feature: Incyte ID No: 700552696H1
ggaggctattcctctacttcagtacttgatacagtctggcccaccgcggtttcaagaaaaggcagaattgcttcttcagtgcttgcctgggactcttactgttacgataaaacgtggcaacaatctaaagcaatcagttggaaaccctagtgccttctgcaagcttactcttggaaacaatccgccaaggctgacaaagattgtctcgactggtgcaacacctgaatgggatgaagcctttgcatgggcatttgacagtcctcccaaggccag

SEQ ID NO: 2460 - DNA, 289 bp, Zea mays
  misc_feature: Incyte ID No: 700552701H1
  unsure 195, 239, 247, 251, 257, 266-267, 276-278, 282, 287-288: a, t, c, g, or other
tgaaatttgttctccatctataattcacaagaactttaagtcgtccaatattttactggacaccgagctcaatcctcacatttctgatgctggacattcaagttttgttccagatgctgaattccaggcttcagatcaggggtctgggtatagtgcccctgaggtcgagatgtccgggtcagtataccctcaagngtgatgtctacagctttggggtcgtcaggctggaactcttgacnaggccggnaacnatttgnccagttcgnnggccccggnnngagntatcnnt

SEQ ID NO: 2461 - DNA, 282 bp, Zea mays
  misc_feature: Incyte ID No: 700552702H1
  unsure 7, 21, 55, 58, 79, 130, 134, 151, 178, 201, 203, 213, 230, 274: a, t, c, g, or other
caggtanctaatgatgccaanatggtaacacagttatctgatcagatgaaaatanaantattgaaggctctacagccanagcagcctctggtcatggaacagcagaaaatgatatttgatttgcagcaanaagnagtaaattctcatcaantgctcagcagtgctcacaggtagctanccaagtggttggtttgcatagcngnagcactaatnagtacccgacgcagcanaagactcaacctctcaaaacatttcaagattttcctgggaatgntgtttctt

SEQ ID NO: 2462 - DNA, 279 bp, Zea mays
  misc_feature: Incyte ID No: 700552707H1
  unsure 16, 101, 145, 154, 156-157, 161: a, t, c, g, or other
atcgatgctttctcanatggctctgcaagccatcccaacaatcatagctgacaatgctggtttggatagcgctgatttgatctctcagctacgagctgagnaccacaaagagaactccactgctggaattgatgtcatcacaggnactgttgtngnnatgnaaaagttggggattcaagagtcgttcaaggtgaagcaggccattcttctgtctgcaacagaggctgcggagatgatcctcagggtcgatgagatcataacctgtgccccgcgcagaag

SEQ ID NO: 2463 - DNA, 280 bp, Zea mays
  misc_feature: Incyte ID No: 700552709H1
  unsure 43, 85-87, 89, 190-191, 205-206, 219: a, t, c, g, or other
ctatcagtctcaggaataggcttatagcagtgaatttctaganctaaatttcaggtatactcatcttgcctagcagtcccgttgnnngnaattcactgctatcagtctcaggaataggctgggttgaacttatacatgagatatcccatgtccaggtgcattgtctgaatttgattagaagtgtgtaatnntagttcttataaannagcaactcaaaangggccaaagtttggatgtaccttctgggttattgacgcagatatctttatcgctatatgtg

SEQ ID NO: 2464 - DNA, 278 bp, Zea mays
  misc_feature: Incyte ID No: 700552710H1
  unsure 2, 25, 35, 51, 120, 127, 136, 146, 162, 178, 190, 192, 218, 222-223,: a, t, c, g, or other
cngccatctatggcggcgtccctgnctcctccgcnccgtgcgccgaagggngcttgcgtcccctctcggatccctgggtgccagcatacagtcaacatgtgttgccaacatatgctcaanatggggnaggtttgcnagacctttcntgcaaaagctgctggnaatgaggttattgggnttgatttggggncnacgaactcatgtgtttctgttatggngggnnagnncccaaaagttattgagaatgctgaaggtgcgagancaacaccatctgttgt

SEQ ID NO: 2465 - DNA, 279 bp, Zea mays
  misc_feature: Incyte ID No: 700552712H1
  unsure 43, 222: a, t, c, g, or other
ctttcctgtgttggctccttcctttcctgcgcctgctgctganccttgggcgcctttgatactggcggcccacaaactggtccacaacatccgtacaggtggacaccagaagaaatcaaagctgccactgggaaggatgaatgcatttcatgaaacacagtttgaaattaaggagtgtatatactgacgtcgaggattttgaaggaacaaaagacgccagcnaggaaccactggtgacaagctacaacagaaaattcatgggaacagtagactacatat

SEQ ID NO: 2466 - DNA, 279 bp, Zea mays
  misc_feature: Incyte ID No: 700552713H1
accttgacatcctgaaggaccagtggagcccggcgctaaccatctccaaggtgctgctgtccatctgctccctgctgaccgatccgaaccccgacgatcctctggtccccgagatagcgcacatgtacaagacggaccggaacaatacgagaacaccgcgaggacctggacccagaggtacgccatgtagggagggggtaccctacctggccctttgggggtccgccggaattgccgctgctgcgttgtgttcctggacctggacctggactggagact

SEQ ID NO: 2467 - DNA, 280 bp, Zea mays
  misc_feature: Incyte ID No: 700552714H1
  unsure 103, 155: a, t, c, g, or other
agccaaaggttggcaaatcttgggacgcaggctgcaaaccttcaaattggggtggccccatttgaagaaaagcacaggcgttattttgatttccagcgtaggngtggtcaattgcctttgcagaaggagggtgaggaagttgactaagaaatgtnctgcatcgtgatggttctgtactgatgtcagtttccctggatcagttgaaggctcctgatctcctttataggtctcttgcagcaaagcttgtggttggcatgcctttcaaggatctggctactgt

SEQ ID NO: 2468 - DNA, 282 bp, Zea mays
  misc_feature: Incyte ID No: 700552715H1
  unsure 253, 267: a, t, c, g, or other
cagactttaaagtacaacatgaagtcaagggctgggagaggctttacccttgaggagctgaaggctgctggcatcccaaagaagcttgctccaaccattggtatttctgttgatcaccgccgcaagaacaaatcccttgagggactgaggccaatgtccagaggcttaagacatacaaggccaagctggttatcttcccaaggcgtgcacacaaggttaaggctggtgactctactccagaggagcttgccancgctacccaggtcnagggtgactacatgc

SEQ ID NO: 2469 - DNA, 228 bp, Zea mays
  misc_feature: Incyte ID No: 700552717H1
  unsure 99, 132, 150-151, 177, 179, 182, 191, 219, 227: a, t, c, g, or other
gatgatggacgatgaagagagggtgggccatgcggagatcccgaccagtttcggtcccgagctgcgcgcctgcctccgatgccgcctcgtcagacctangaccagttcagggagaacggctgcgaaaactgnccgtttctagagatgganngagagcacgacaacgtcgtcaactgnancanccccaactncactggaattatctctctgatggacccnagtaggang

SEQ ID NO: 2470 - DNA, 277 bp, Zea mays
  misc_feature: Incyte ID No: 700552722H1
  unsure 8, 12, 21, 28-29, 115, 122, 162, 166, 196, 207: a, t, c, g, or other
gaagaaanccanaggcagaanaggagannaaagaaaaaaagtcatcaggcaaaaaggtgacaaagggtaaaggagaatccgttgaagcagttcttcccagcaaggatgatctgangaagacnattactgaaatcctcaagaaattgacttcaacacggcaantttnagtgacatccttaagaagcttgacaatcantataaaatggntctggccccaaagaaagaagccatcaaagttatgatccaagacgagttaaccaagttatcagaggaggac

SEQ ID NO: 2471 - DNA, 279 bp, Zea mays
  misc_feature: Incyte ID No: 700552724H1
  unsure 6, 28, 35, 39, 43, 60, 93, 99, 116, 122, 166, 171, 175, 182-183, 200, 205,: a, t, c, g, or other
atgtantggaccatcatcaacaatagcnaagatantccncatngttaaggatgcccaagncacgtaaagctcctgttcaaaggctcgcagatnccatcncaggaccatttgtgtanactgtnatgacgttggctacaacaacctttccttctggtgtgctcttgtnttttnattncttctannaaaatcttatgactaanaatantgcctttttatccctcacccccttcccaaggnatnacantggcacatnactatntcctgaggttcttctgaatg

SEQ ID NO: 2472 - DNA, 276 bp, Zea mays
  misc_feature: Incyte ID No: 700552725H1
  unsure 5, 22, 42, 47, 61, 64, 76, 81-82, 106, 155, 162, 166, 178, 180, 183, 197,: a, t, c, g, or other
ggcgnaggcaagtccgggaagncgctccactacaagggctcnacctnccaccgcgtcatcnccnagttcatgtgcnagggnngcgacttcacccgcggcaacggcnccggcggcgagtccatctacggcgagaagttccccgagagaagttcgtncacaagnacancggccccggggngntcnccatggccaacgcngnccccancancaacggcnctcaantcnncatctgnaccgtggagancccctggctggatggcaagcagtcgtctncgg

SEQ ID NO: 2473 - DNA, 96 bp, Zea mays
  misc_feature: Incyte ID No: 700552726H1
  unsure 5, 63: a, t, c, g, or other
tgttngctgttgacgacctgtagcacgagttccatttatgagcttgggcgatgtagatttggntaggttcaaaagatgtgctttttgttcaaaaaa

SEQ ID NO: 2474 - DNA, 277 bp, Zea mays
  misc_feature: Incyte ID No: 700552727H1
  unsure 102: a, t, c, g, or other
agcttgtgcagctcaagcgtgaggcccggttgaagggtgggttctatgtgagcccagaggccaagcttctgtttgtggttcgcatccgtggtatcaatgcgntgcaccccaagacccgcaagatcttgcagctcctgcgattgaggcagatcttcaacggtgtcttcctcaaggttaacaaggcaaccattaacatgctgcgcagggtggagccatatgttgcgtacggataccccaacctgaagagcgttagggagttgatctacaagagaggtta

SEQ ID NO: 2475 - DNA, 278 bp, Zea mays
  misc_feature: Incyte ID No: 700552729H1
acaagatcccacattacaaatatttggaagatcccagagcgtactaagagggtgtaccctccatgtgatacttctgctcttcagatgcttcccctggaaagaccaacaacacctcctgttcttatttcagttgcacagttccgccagaaaaggcccatggccttcagctggaggcatttgcacttgctcttcaaaagctagaccctgattttcctaagccaaagattcaattcgttggtagttgccggaataaagaggatctggacagactacaaaag

SEQ ID NO: 2476 - DNA, 278 bp, Zea mays
  misc_feature: Incyte ID No: 700552730H1
  unsure 76, 193, 264: a, t, c, g, or other
gcacgactctacacagtagacagacgcagagaagcatatgctacaatactgcattcagcaagtgaatatgtttgcngcgcgatacacggcagctcaaagcattcgtcaggcaggatcaacaagagacctagttattctcgtcgacacaccataagtgaccaccaccgcaaggggctggaatctgcggggtggnaggtcaggataatacagaggatccggaaccccaaagccgagcgcgacgcctacaacgagtggaatacagcnaattccggctgtgg

SEQ ID NO: 2477 - DNA, 285 bp, Zea mays
  misc_feature: Incyte ID No: 700552732H1
ttaggcagaacggagaagcttgctgaaagtagcattttatctggttccgtagttacttcaaaacattcagctttagcaaggccttcaaattacaaggatccaaatgtctgttctgcaccaagtagaaacaaaacttgtgaattgaaatacggtctgagattgaagaacagtgccagaaacatgagttagatgtagatgaacgtggcatgggtcctagcaaaaactctcgtgtgctaataggatctataattgtcgcaattgaagatggtagtgaacacttgctgg

SEQ ID NO: 2478 - DNA, 274 bp, Zea mays
  misc_feature: Incyte ID No: 700552733H1
  unsure 2-3, 6, 10, 12, 21, 31, 34, 38, 40, 60, 65-66, 71, 81, 90, 108, 112,: a, t, c, g, or other
gnnggnaggngnaggcatggnagcccctcanggngtgnanggagcccagtcagggccagnagcgnngagcnaagggccaangattgagcngtggaaccgtaaacgggngggntannagtganacnctccgtggctactgttcncggactgttgcttagctccggctctcatcgntatatnntaagtatgcttgtgtggatggcnttctgcctggctaagtaaaaacctttaagatcnagnattccaggantctcggtcnagtgatggttaacna

SEQ ID NO: 2479 - DNA, 275 bp, Zea mays
  misc_feature: Incyte ID No: 700552734H1
  unsure 4, 13-14, 93, 221, 224, 230, 268: a, t, c, g, or other
ccanattccccannaaaaatcatcctccggacgaaatcagcggcggcggagatgggagcggagtgccggtacgaggtggcgcaggcggcgtanatcaagctggcgctgcacgcactgaagcacccggcgaccgccgtcaaggcctcctcgtcggtcgcctcgtcgagccttcgtcctcaccggccgtcgtctcggtcattgacgccgtgccgctttctcancanccgcancatctgccgctgctccccacgctcgagctcgcgctcancctcgtc

SEQ ID NO: 2480 - DNA, 273 bp, Zea mays
  misc_feature: Incyte ID No: 700552735H1
  unsure 3-5, 7, 10, 113, 214, 221: a, t, c, g, or other
ggnnnantangggaggtcgaaccacggaccggaggtagtagaacgtgatccgcaccggtcaatattggatcaaacaataggggaccgtagcactgacctttctttttcaaganaataggtactgttccctaccgagacagggacactctcaacggatcctccacgcgctgggcataccatagttcttccgtgcgtctttatcgtggcggaaacngaacaanagggaagacccggccgactcgcccagggctcgagggcgagctatacgagagt

SEQ ID NO: 2481 - DNA, 270 bp, Zea mays
  misc_feature: Incyte ID No: 700552736H1
  unsure 126, 132, 187, 256: a, t, c, g, or other
cacgtttcaagatgaagctcgttgagttcagttactcgaaaatctatggggctggggctgcaaagtatgttaaggtggtcgatgatgctgtacatgagctgtataaggagtatgtggctcagccantcccantgacccagcctatgttgaccaaggcgaagggaataatggaccagccaatgcgaanagcagtcaaggggctcctgcttccactggtgatgggcttctagacttcgatatgtacctttctgagatncaaagtagccagcc

SEQ ID NO: 2482 - DNA, 270 bp, Zea mays
  misc_feature: Incyte ID No: 700552738H1
  unsure 51, 109, 112, 139, 250, 253, 260, 269: a, t, c, g, or other
gcgatggagaaacgttcatatcagcagatgatctgcgaataaacctttggnatttagaaattagcaatcagagctttaacattgttgatgtgaaacctgcaaacatggnggntctaactgaggtgatcacttgtgcggngttccatccaactcactgtaatacactagcatatagtagctcaaagggtactattcggcttattgatctgcgacagtcagcactgtgtgacaaccatgctaaactatttgnggngcatgangcacctggnt

SEQ ID NO: 2483 - DNA, 267 bp, Zea mays
  misc_feature: Incyte ID No: 700552739H1
  unsure 104, 119, 124: a, t, c, g, or other
ggaatctcggatagcaatatcaaggaaatacctcagtcagctggtgctcaagtctccaatatcactggttttgggaggagtttggataatagtctgccggaggntgcatgtagagaggnccttnctgtaaatgatatgttgtaggtagaggagaccatcaactgtgttctggtgaacaaaaggactttaatatggaggttcgtttaccactacctgatcagcattgttttggcaggattaacactgagtctggttctgttcgacatg

SEQ ID NO: 2484 - DNA, 155 bp, Zea mays
  misc_feature: Incyte ID No: 700552740H1
  unsure 28, 30, 58, 61, 137, 143, 147, 152: a, t, c, g, or other
aaactttatcggatatccatcaaagttnanaatgaagggacttgtactctgtttctangtnatattatctatttgtacgtgtgaatggagatgatcttatgtgtgggatgatggatagattaactttgatggatatnagtganattnaagtnaaa

SEQ ID NO: 2485 - DNA, 271 bp, Zea mays
  misc_feature: Incyte ID No: 700552741H1
  unsure 42, 59, 76, 191, 240: a, t, c, g, or other
tggcagggctggtgtacttttatctgtggcagaatgtttaanaggttttgttattatanatgaagggctatcttcnttcccggaaatcttccttccaatatcctctttgctgcaagaaattttggatagatctgagttgcctggatcgttacaagacattttccatgaagtcattgacttgatcaaaaagngaagtgatgaacactatgcttcaagggagcccctccgaatgcggaagangaagcccgaaccaattaagcaattgaatcca

SEQ ID NO: 2486 - DNA, 91 bp, Zea mays
  misc_feature: Incyte ID No: 700552742H1
tgatttgattgtaatatgtgcatgttgacagggcgccagagcattatgtttgtacggatcactagtgataattctttgggttcttctctgt

SEQ ID NO: 2487 - DNA, 273 bp, Zea mays
  misc_feature: Incyte ID No: 700552743H1
  unsure 39, 52, 252: a, t, c, g, or other
cgagaggcacctgatctttccttcccgtcttcctcccanacgtccccatcancattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccantaaggggaagctctacgagta

SEQ ID NO: 2488 - DNA, 275 bp, Zea mays
  misc_feature: Incyte ID No: 700552744H1
  unsure 86, 253: a, t, c, g, or other
ccagtgggaaacggtgcaaatcggcggaggagagcaatggcgcggaggagaactccggcaagggtaaggccgccgcgcagagcaanagcgacaacggtgggaagaagcaggggaaggacggcgcgtccaagcctccggaaccgcccaaggactacatccacgtccgggcgaggcgcggcgaggcgacagacagccacagcctcgctgagagggtgagaagggagaagatcagccagcggatgaagcttctgcnggatctcgtcccgggctgcaac

SEQ ID NO: 2489 - DNA, 274 bp, Zea mays
  misc_feature: Incyte ID No: 700552745H1
  unsure 83, 140, 229, 251, 264-265, 267: a, t, c, g, or other
gactagttctagattcccgtaccacccgcttcttccaactccaactctccaaggcgctgtgctggctgctggcctgctgctancgactgccgcaactgctccgcatcccggccttgattagcagcagttacgcccgcgcngacagcggccttgattagcgaagtattcctttgccctacctctctccctaccccgttccgacgcggcggccgttgagcacctgcccggnagctatagcttcggccatggcncaagatgccggcnncngcggtgg

SEQ ID NO: 2490 - DNA, 274 bp, Zea mays
  misc_feature: Incyte ID No: 700552747H1
  unsure 51, 56, 92, 111, 124-126, 129, 134, 136, 139, 141, 158-159, 181, 183, 220,: a, t, c, g, or other
tcaagcagcacgccttagctgatcttcccatcgccgatttttcaggtcacncggtncgatcctttcagacttcgtctctcttttctccccanctcgatctcgtcctatcanccctacggcttannncgncgtcnanacnancaatggatctcatctgnnatgatctgttctctttggcgtnanccgatcttccctggcttgttgaatcgagcgacccatnanagaatgcccttnnanngatctgggttagncgcggnctgtagacncgcnantt

SEQ ID NO: 2491 - DNA, 275 bp, Zea mays
  misc_feature: Incyte ID No: 700552750H1
  unsure 91, 93, 95-97, 100, 134, 194, 200, 262: a, t, c, g, or other
ttccttatgatgtgaacgggcaatatggtcaactgtttagcattattgaagaaaggtacaaagagaatacagagtcacagagtttaacttngnannnagnaaatgaaccgttatgttcccatccatttggaacnagatttgactagtctctctgaaggagacagggaggccttgggatatatccttaaagccgnaatagntattgatgacatattctatgaacaggtatggaatagtaacaaaatgctagagactggctganaggacatctgatt

SEQ ID NO: 2492 - DNA, 271 bp, Zea mays
  misc_feature: Incyte ID No: 700552752H1
  unsure 2-3, 33, 150, 174, 216, 256, 260, 265: a, t, c, g, or other
gnntggctggctcctgtcctcacgctgccagtngttctcgtcctagcaccaaccgcatcagctctcaccagatccgttcatcatttcatccccatgcctccggtgaattcgttcgtcctcatgcctctgctggatttgttgtcctcatanatccgtttgttgtgtttttggtgnggggctgtggtgaccctgagagcgagtttgagagtctgaggngggactgggaggtgctggtgcgtgagttgatgtggctgcngtgnaagcngcagga

SEQ ID NO: 2493 - DNA, 271 bp, Zea mays
  misc_feature: Incyte ID No: 700552754H1
  unsure 40, 61, 129, 132, 150, 208, 210, 213, 223, 258: a, t, c, g, or other
tagcgctgatttgatctctcagctacgagctgagcaccanaaagagaactccactgctggnattgatgtcatcacaggcactgttggggacatgcaaaagctagggattcaagagtcgttcaaggtgangcnggccatcttctgtctgcnacagaggctgccgagatgatcctcagggtcgatgagatcataacctgtgccccgcgcngnagngaggataggntgtgatattacacgctgtttctcgatgtagcgggntgctcatcaccct

SEQ ID NO: 2494 - DNA, 274 bp, Zea mays
  misc_feature: Incyte ID No: 700552755H1
  unsure 3, 37: a, t, c, g, or other
agnaacttgaattcatagctctttcacagaggactgnagatcccaaataccagcagaaggcggagaacgtcattaaacagcttcaaaagatatatccaagtgatggtttactgcctatttacataaatcctcattctggtgcagcatcatactcaactatcacatttggtgctatgggagacagcttctacgaatatttgctcaaggtctggatccaggggaataaaactgagcatgtaaaacactacagacaaatgtgggagacatcaatgga

SEQ ID NO: 2495 - DNA, 276 bp, Zea mays
  misc_feature: Incyte ID No: 700552757H1
  unsure 3, 41, 77, 184, 196, 236, 245: a, t, c, g, or other
ganatgcccatcgctgggcgatttcttctgaggaatttgangcttggccataggactatgtacatagggactagggnataaagactgaggagattgggaagcacctgcttggcaccttggggtagcatatgctcgtgtctagctcagatgcagaagtcgcattctgaaactctttggttatcgncctgttccctantttaactatctctgtatgagagccatttatgagactgaancattttacnattttgttttcccccttctttcgttgttaca

SEQ ID NO: 2496 - DNA, 274 bp, Zea mays
  misc_feature: Incyte ID No: 700552758H1
  unsure 86, 118, 121, 129, 169, 173, 177, 201, 213, 235, 239, 246, 250, 261: a, t, c, g, or other
gacagctgctgctcgccctctccctgtctcctctctatttcccagccacggtttccccttcccccgtccgcacgttagggcacgangcaaatctgttgccctctcctagtctcccgangtncgactcanccgtctcccatctcccgctcgctcgaactcgggttggggnggcncggngtcactgaccccttcgcgtttggnggtgcccctgcnccggctcttcgtctaaggtgtngtcnagctgcnggcnacgcccggcanccccctatccagt

SEQ ID NO: 2497 - DNA, 277 bp, Zea mays
  misc_feature: Incyte ID No: 700552760H1
  unsure 166, 175, 182, 190: a, t, c, g, or other
cccggaacagagcgaggcgacgccgagggcacctcatctccggcgaagggaaatggcgaccgttccaggggatctgatctggcagattgtgaggaagaacaactccttcctggtgaagcagtttggcaacggcaatgccaaggtgcagttcaccaaggagcccaanaacctctanaatgtanactcctanaagtactctggcttagcaaacaagaaaactgtaacgatccagccagctgctggaaaggactcggctgtggtcctctctactaccaag

SEQ ID NO: 2498 - DNA, 277 bp, Zea mays
  misc_feature: Incyte ID No: 700552762H1
  unsure 48, 57, 147, 158-159, 175, 177, 213, 220, 274: a, t, c, g, or other
tgttccaaagactcaaaggttaaagtttgggacacagtggctccttcnagtggttcntcatcatgtgtaggcagtgctcacctcaactcaaacggtccaccaattgctatgaaatgccatgaatccctttgctatatcgctgctggngctgaagtganngcgattgacttgaggncnatgaagaaggcttctgtccttgcactccagaaccanagaatantttcttgtgagatgatgccttctgaatggtgaatatgtactggcacgaaagacnggg

SEQ ID NO: 2499 - DNA, 280 bp, Zea mays
  misc_feature: Incyte ID No: 700552763H1
  unsure 13, 83, 188, 226: a, t, c, g, or other
tccacggagtggngttgaaaaatttcagcaaaactgcacgcgaattaattcaacgactgcagaaaattgacaatgataactanccagagactctataccaaatgtttatcgtcaatgctggtccgggcttccggttactatggacaccgtgaagtccttccttgatcccaaaacgaccgccaagatanatgttcttgggaacaaataccaaagtaagctgcttganacaattgacgctagtgaattgccagaattccttggtggcacttgtacctgtcct

SEQ ID NO: 2500 - DNA, 283 bp, Zea mays
  misc_feature: Incyte ID No: 700552764H1
  unsure 121, 267: a, t, c, g, or other
tgatttttttagttggtggcagcatgcatcaaaccttgcaagctacgagcaacaggatgctcatgaattctttatttccatccttgatcatatccatgaaaatataaaggatgatcaacanaagtcatatgcccaaggccatggggttgttgcattgctcacagagtgttttctggtatcctgaggtcagatgtcacctgcacaagctgtgggttcacatccacaacttttgagccctgtatggacatttccttagacatggatgcnggagataacagttctt

SEQ ID NO: 2501 - DNA, 271 bp, Zea mays
  misc_feature: Incyte ID No: 700552767H1
  unsure 174, 176, 183, 225: a, t, c, g, or other
caacagaggccaaggagaatgctgcagctacgctcttcagtttatctgtggtccatgactacaagaaaaagataatgaatgagccaggggctgtggaggagcttgcgtctatgctgaccaaggggacagcaaggggaagaaagacgcagtgatggcattgttcaacctctcaananacccagnaagctcaggacggatgcttgagtcatctgcagttgtatcttnaattgagtcactgaggaatgataccgtttcggaggaagctgctggt

SEQ ID NO: 2502 - DNA, 268 bp, Zea mays
  misc_feature: Incyte ID No: 700552768H1
  unsure 21, 27, 40, 50, 106, 119-120, 149, 159, 170-171, 174, 182, 189-190, 199,: a, t, c, g, or other
tcatatcaccttgggcataangcaggntggtgaaccattnggtgatgttngtctccctccatgggcaaagggttccccagaagaatttattcatatcagtcgagangcccttgaaagtnnaatatgtaagctctatctacatcattggnttgatctcanatttggttacnngcngcgaggcnagcctgnngttgaggcngcnaacanatttgannatctgncatntgagggtgccgttgatttggngancatggntgatatgttacnt

SEQ ID NO: 2503 - DNA, 269 bp, Zea mays
  misc_feature: Incyte ID No: 700552769H1
  unsure 130, 138, 143, 198, 213, 215, 226, 231, 237: a, t, c, g, or other
caggcaggcaggcggctggcctccgtccgcgcatcctcttctggcgaggagctcccccacgcagccgctgctctctccacgtcctctgttccttcccctccccgatctcccccaatccgaccaaaccggnagagcgangggcngcgatggcgctgcgacgggcgctcctcagatcggcagagatctctttcgaacgcnaggctgcaattgagnanattcattcttnatcangggcanagcctgctcgttctctcaatggtgctggcctt

SEQ ID NO: 2504 - DNA, 269 bp, Zea mays
  misc_feature: Incyte ID No: 700552771H1
  unsure 207, 252, 261: a, t, c, g, or other
ggaaggagtccgtcaggtcgagatcgaaaccgactccgcttccgccttcccgccgttggggttcatcagcagttcgcagggtaaagaaagggcggccgcgatgtgggtggaaatcctgtgcggcctggtggtctaaagatcatccaacgcgtcttcttcgccggcggcaacgacgcttcctacctcgccgacctcgactcctcccantccgatctctgcttcgccgtcgcctccaggctcgagaagctctangccggtcgntgcttcgt

SEQ ID NO: 2505 - DNA, 59 bp, Zea mays
  misc_feature: Incyte ID No: 700552772H1
  unsure 39: a, t, c, g, or other
attatgcctaaagatgtttactttggatatttttgtgtnaaaatggtactgtattggat

SEQ ID NO: 2506 - DNA, 269 bp, Zea mays
  misc_feature: Incyte ID No: 700552774H1
  unsure 2, 110, 129-130, 142, 163, 187, 192, 196, 203, 217, 240: a, t, c, g, or other
gnggtccagaccatgaacgggcacctgtaccccaaaccactgacccaggtgcgccccgagccgtcgtcctggcagctctcccggaggcccatcgaggaaccgcgcggggngatatggcgcttctcgagnnggccgacgaggncgggacctctgatgccatggnagcgcacgccgtcgccccgagagngagcnaganggcggcngaggtccgcggggncaggttcggcatcccgcggtgcntcgaggtgatgagcgccatggtggagctg

SEQ ID NO: 2507 - DNA, 268 bp, Zea mays
  misc_feature: Incyte ID No: 700552775H1
  unsure 26, 132, 191, 211, 239, 245, 266-267: a, t, c, g, or other
tatgatctacacattttacaaggcanaaggatattctgttggaaaatctctcgtggaagaggataaacttgagctcgcaacttctcttattgagaaggcgaaggcaaagggggtttctcttttgcttcccantgaattgtagtagcggacaagtttgcagccgatgctgagagcaagattgtccctgccantgctatccctgatgactggntgggtcttgatgttggccctgatgccangaaaancttcaacgaagcattggacanna

SEQ ID NO: 2508 - DNA, 270 bp, Zea mays
  misc_feature: Incyte ID No: 700552778H1
  unsure 71, 108, 113, 177, 249: a, t, c, g, or other
gggaactggatttatgcaccgtgcttttcaggcatatgctaaatacagaggtccactgggcagtgtcaganaaggagttctgatatctgttggtaagggacttatcanttcanatgcccttatgagtttagaagctctgggatcctctttgtatcccctggaatggaggcatatgangggatgatagttggtgagcactcacgtgacagtgatcttgaggtgaatcctgtgagaactaaagaacttacnaatatccgagcccctggaaag

SEQ ID NO: 2509 - DNA, 273 bp, Zea mays
  misc_feature: Incyte ID No: 700552781H1
  unsure 16, 46, 61, 111, 133, 188, 223, 269: a, t, c, g, or other
ccaagaagcgtaagangaagacgtacaccaagcccaagaagatcangcacaagcacaaganggtcaagctctccgtgctgcagttctataaggtggacgacaccactagcnaggtgacccgcctccgcaaggngtgcccaacacagagtgcggcgcgggcgtcttcatggccaaccacttcgaccgcnactactgcggcaagtgcggcctcacctatgtctanaaccagaaggcgtgattgcttgccccgatttgctttatccgcctanccta

SEQ ID NO: 2510 - DNA, 266 bp, Zea mays
  misc_feature: Incyte ID No: 700552784H1
  unsure 125, 182, 225: a, t, c, g, or other
atgaaatggcagggcttgctaagtgatacatcaaatgctgaatctggatctgatgttgatgattttggtgcatcatttgttcataaagtttctgactatggttgcttgactccagttcatgaggnagtaaagggcacagatcgtgtgacatacttcagctatgatgatcaaagccacccggntatggctcctgaatcttaccatggagcgcgacgagctactggnatggagcaccacaaaccaatggctgatttcagccaatattc

SEQ ID NO: 2511 - DNA, 267 bp, Zea mays
  misc_feature: Incyte ID No: 700552786H1
  unsure 3, 8, 154, 181, 194, 196, 199, 203, 230, 236, 238, 241-242, 244, 256, 263: a, t, c, g, or other
aanaacancatgaaaagcttaatacaggagacaacagtgtggctgaaagtactggtgttaagttaaagcctggaaatgcaggtttacttgggtgggccatgagttctgttacacaaaagggtaaaccttttgaccatgccccaatatctactgnaaatgccaataattctcaagcatcaanaacctcgactgcnantcnaganactcaggcttccacactagcgtatgcnccatcnanatnnanctcgcttgatcnagctgcntcag

SEQ ID NO: 2512 - DNA, 267 bp, Zea mays
  misc_feature: Incyte ID No: 700552788H1
  unsure 39, 85, 246: a, t, c, g, or other
gatgtacattgcgtcaatggggttgcctttcaatgggantcttcatccggtcctttgaagttgcttaaggatgcgtttggttgcnggacaaatgaggacggaatagaatgatccctgggttgggggatggaatgatcctggtattgtttggtcggagggatgagatgatccttgttttttgtttggttagaggtataaccggggatggattggtcctgtcctttgtttggtttgagagataactgntacacttgtccttcacaaaaa

SEQ ID NO: 2513 - DNA, 267 bp, Zea mays
  misc_feature: Incyte ID No: 700552791H1
  unsure 63: a, t, c, g, or other
cactggatagatgattcttggcatattcagaagagaattgtggggttttttcatgtagaaggnaggcatactggtattaagttggcacagtgctttactgaagtgatggtaaaatggtttgctgagaagaaattttttcattgaccttggataatgcatcaaataatttagtggcagtcaaagacattattcaagatcttagagtgaatgcttcttcttgtttgatttgtgatggaatattctttcatattagatgtgcatgccaca

SEQ ID NO: 2514 - DNA, 88 bp, Zea mays
  misc_feature: Incyte ID No: 700552803H1
  unsure 36, 52, 67, 77, 85-86: a, t, c, g, or other
agaatttccagaagtttctgtagtggtgcagcgagntgcaggaaatatgaanagtgttcaaacgacntttcggaatngtgggtcnntt

SEQ ID NO: 2515 - DNA, 264 bp, Zea mays
  misc_feature: Incyte ID No: 700552804H1
aagaagaggttatccacgtcagattttgaagggaatgtacgaaaccatcaagaatcttcagacaacaccaaagccaaggactgttcaccgattatatcccaacatgagaaagcattgcaagacatttatcctgatgatgagaccattggatcaatcattagaaacgtgaaaaagaagagattagtgacatcaaatttctcagcgaatgtagaagcccaagagtctttgagaaatattaacctccaagatgaactgttgtttcta

SEQ ID NO: 2516 - DNA, 74 bp, Zea mays
  misc_feature: Incyte ID No: 700552805H1
  unsure 54, 57-58, 66, 69-70: a, t, c, g, or other
ttttttaactgctgtattccgtagtgagatgaaattccgtgtgtggggcaacanatnngccttttnaannaaaa

SEQ ID NO: 2517 - DNA, 261 bp, Zea mays
  misc_feature: Incyte ID No: 700552807H1
  unsure 19, 26, 179, 194: a, t, c, g, or other
cagaacatgaagatctgtngcaaccngtatgacaactgctctctgttctgcatgctccgaggccctgggctgcttcatctcctcgtactttgacaacagagagcagttgtcataccggttgccacaagaccatgaagatctgactgctgccgtcaatgaagacgcccttgtcagaaaancagctgccgcgagancaaggtcaggtggggatgatgatatccttgatgatctggacgagatgatattcggcaagaagggagg

SEQ ID NO: 2518 - DNA, 138 bp, Zea mays
  misc_feature: Incyte ID No: 700552809H1
  unsure 23-24, 32, 43, 50: a, t, c, g, or other
cgagtgccaaaatttcaagaagnnctgcagancgatgtcagcnacttctncctgagtgatagcatcgctgcagaacttcttgaaattttgcagcgatgctatcactcagcagaagtagctgacatcttctgcagcaga

SEQ ID NO: 2519 - DNA, 256 bp, Zea mays
  misc_feature: Incyte ID No: 700552811H1
  unsure 16, 32, 107, 121, 239, 241: a, t, c, g, or other
ggttctctgaagtggncgaggtgcgggatgtngtggaggcattcaggcttcttgaagtcgccatgcagcagtctgcgacggatcatgcaactggtacgattgatatngatctgatcatganggggatatccgcaagcgaaaggcagaggcgggagaacctcgttgccgcaacccgtaacctgattgcggagaaaatgcagcttggaggcccctcgatgcgcatgattgagttgctggangnatgaggaagcagagt

SEQ ID NO: 2520 - DNA, 251 bp, Zea mays
  misc_feature: Incyte ID No: 700552812H1
  unsure 48: a, t, c, g, or other
ttcctcaagaaagttgagaaatctagtgtaatcgataatgtcctctcntgggctgatttcaaacttagcaaagaattaaagaagactgatggaagcaagaagtcaagaatttctggcatccctaagcttgaggatgcaaatgaagctggtgggaaggactctcacaagtgcaccttgattctgactgagggtgactctgcaaaagctcttgctatgtcgggcatagctgttgtagggagagattactatgg

SEQ ID NO: 2521 - DNA, 262 bp, Zea mays
  misc_feature: Incyte ID No: 700552814H1
  unsure 155: a, t, c, g, or other
agcgaatcctcgcatcgcattcgcagcctttgctgcatcacaccaccgcgaaaccccagcagccgcatcgatggcgcctaaggcggagaagaagccggctgcgaagaagccagcggaggaggagcccgctgccgcgaaggccccggcggggaagnagcccaaggccgagaagcgcctcccggcggccaagtcgtccggcaaagaaggcggcgacaagaagggtaagaagaaggcgaagaagtcggtggaactacaagatcta

SEQ ID NO: 2522 - DNA, 261 bp, Zea mays
  misc_feature: Incyte ID No: 700552815H1
  unsure 9, 12, 19, 30, 37, 47-48, 56-57, 59, 153, 205, 210, 223, 225-226, 230, 236,: a, t, c, g, or other
tgaatatcngcntcagaantgagagcgctntgaagtntgggtggttnntcctattnnanatggtaagatgtcgagtaaaatagactgaaggtttcacacatcatgtatttgtattgtattcataaagaaactgcatgcctcactgccaatctntgaccatttccagattcatataatattctgtgtgtgggcagctgtggctccnccatnccctttcaaaggnanntctntggcgnaagtatcctagtnnntangcancaa

SEQ ID NO: 2523 - DNA, 263 bp, Zea mays
  misc_feature: Incyte ID No: 700552818H1
  unsure 28, 238: a, t, c, g, or other
cgcgattcttccaccacttccacgggancggtcggatcccaatctgctgccgcccagccaccgccaccgccgccaccgccggctcctctataggggtcttccctcctcttcgcccttcgcaacccgcaagttccgagcgattgatgagtatttttctccccgtcccttggagcgactcggtggatgcgagggacctgtccgcgctcgacccgccttcgcccctatctcgccgcccggngggcaggctccgctctcgccttccg

SEQ ID NO: 2524 - DNA, 260 bp, Zea mays
  misc_feature: Incyte ID No: 700552821H1
  unsure 165, 198: a, t, c, g, or other
ggaagaaggatgtacctgattacaagtataccattgccatgttgggctatgctgatgaggacaagacaactgttctggagctgacgtacaactatggagtcacagaatacagcaagggcaatgcatatgctcaggtctctatgaaatctttatctggagcatttntttctagttgtattttggcatttcttaattgtntagctgatgtaagcgcaggttgccattggcaccaatgatgtgtacaagacgccgaggcgttg

SEQ ID NO: 2525 - DNA, 258 bp, Zea mays
  misc_feature: Incyte ID No: 700552823H1
gtggagaatgtcattgatggcgcccccaccaacggctcctcagatgtcgtcaagaaggggtacgtagggatccacagctcggggttcagagacttcctgctcaagccagagcttcttcgcgccattcaggattgcgggtttgagcatccttctgaagtgcaacatgagtgcatccctcaagctattcttggaatggatgtcatctgtcaagcaaaatctggaatgggtaagactgcagtttttgtcctgtcaatcttc

SEQ ID NO: 2526 - DNA, 256 bp, Zea mays
  misc_feature: Incyte ID No: 700552828H1
acagaaggcattctgccgttgttgaatatgtttttagtggccatcggttcaaactaacaattcctaaggagacttgcagtattgccttctcattatctggtgttcggtgtcctggtaaaggcgagccatactcagatgaagctattgctttgatgaggagaaggatactacagcgtgatgtggagatagaggttgaagcagttgacagaacaggaacattcataggttcgttgtgggagtccagaccaacatgggc

SEQ ID NO: 2527 - DNA, 257 bp, Zea mays
  misc_feature: Incyte ID No: 700552829H1
  unsure 5, 8, 50, 56, 69, 75-76, 81, 89, 93, 105, 173, 179, 207, 215, 249: a, t, c, g, or other
caganggnattctgccgttgttgaatatgtttttagtggccatcggttcnaactancaattcctaaggngacttnnagtantgccttcncatnatctggtgttcngtgtcctggtaaaggcgagccatactcagatgaagctattgctttgatgaggagaaggatactacagngtgatntggagatagaggttgaagcagttgacanaacaggancattcataggttcgttgtgggagtccaagacaanatgggctc

SEQ ID NO: 2528 - DNA, 260 bp, Zea mays
  misc_feature: Incyte ID No: 700552830H1
gaacattatccttggaaagaagaattagaatgcttagtccgtgatgggcttccaatggccctgagaggagagctgtggcaagcttttattggtattggagctcgtcgggtcgaagggtactatgagggcctccttgcagcggacagtgaaagtcaagaaaacaaatattcgggatctccaacttcggaatgtggtgatggaaaaccaaaaccatctcaaacattttcttctgaaaaatggaaagggaaatagagaaggat

SEQ ID NO: 2529 - DNA, 262 bp, Zea mays
  misc_feature: Incyte ID No: 700552831H1
  unsure 88, 90: a, t, c, g, or other
atctggacatcaatggggagcttcttatgctcagcaggctgcatatcctgcatatggaacttatgactacagccatcaaatgccacancnggactcctcaaacagctgcctatggtgcttatcctccaacatactctgttcaggcctatacaggaaggaaggtggccattgttggcagtggaccatctggtttggctgctgcagatcaactaaataaaatgggccattcgtaatgtgttcgaacgtgcagatcgaattggag

SEQ ID NO: 2530 - DNA, 268 bp, Zea mays
  misc_feature: Incyte ID No: 700552833H1
aaccatggcatctatatacaagtttttcactatcagtcttgattttgccaaatagtttctttgtcgtgtccttaaatttatgcataaagatttgcatgtgagtcctgcatcatgccgtattatgccattttgttccaagagatacatatctagttaacatgctactgcaggagttggatatctctcaaggatcagtcctttatgctgtcgatgaagctactgtccgtagtcttaatggttgcagagtagcggaccgaatcatagactt

SEQ ID NO: 2531 - DNA, 260 bp, Zea mays
  misc_feature: Incyte ID No: 700552836H1
  unsure 45: a, t, c, g, or other
cgtcatcttctttgtttcgtccttcttccgccgcagccgccgtcnccgtcgccgcagctaggggttttgcctttttggctatggacgcgacgggacagcaggagcagcatacaggaagtgtaggcggagatctctacggagtgcttctttactacaagtacgccgaggtgcctgacgccgccgcgctcgccgcgttctacgaggcgcactgccgcagccttgcgctcgtcggccgcgtccgagtcgccccgacggagtaa

SEQ ID NO: 2532 - DNA, 249 bp, Zea mays
  misc_feature: Incyte ID No: 700552839H1
  unsure 78: a, t, c, g, or other
attcaggcttgtcataagaagggatctctttctttacgaagcatgaaaagaagggaaggtgttttttcgccgaaggtncaaaaacggtatgtgtgtaaatttcatgcatcacaaagaaataaattacaataatttacatattcgattcaaagttacatacatcaaatgtcacatagttttgttataatagaaacttaatgttcattccattgtcccatacatcaagcatttcaaatattattacaatga

SEQ ID NO: 2533 - DNA, 258 bp, Zea mays
  misc_feature: Incyte ID No: 700552840H1
  unsure 19, 23, 80, 169, 181, 185-186: a, t, c, g, or other
ccttcctgtgttcactggnaggncatggtcgcccggagctacgtcagtcacaccctctccaacactctctatgataccancaggcgaccatgtccttcctgtgttcactggggagtgcaaggagtgtgcccactgcaagtcggcagagagcaacatgtgtgatctgctncaggatcaactncganngcggtgtgatgattgccgatggcaagtcgcggttttcaatcaatgggaagcctatctaccactttgttggga

SEQ ID NO: 2534 - DNA, 253 bp, Zea mays
  misc_feature: Incyte ID No: 700552841H1
  unsure 107: a, t, c, g, or other
ggaattgctgatagcttctcggaatctggagtttttcaccaatggttatcgatatttgattcagattctgccagctgcagttgttgctccaatgtacttctcagggnaaattgagtttggagtaataaaccaatcggtgtctgctttcaatcatattcttagtgatttctctctcattgttttccaatttcagtcaattagtgcattctcagcagttatcgatcgtctaggtgagtttgagatctattggatg

SEQ ID NO: 2535 - DNA, 193 bp, Zea mays
  misc_feature: Incyte ID No: 700552843H1
ggcaaattggccggaacccagactccaagcgagctaattttgtagatctgccatggtgtgctttgtcccgttagtcgatatatgtggcgttatttctagattcaagtccatttgcttctctatgatttttgtacaccgctaaataatcttcttaagcccctgaatggatgcaaaatatttaagatgttttagg

SEQ ID NO: 2536 - DNA, 256 bp, Zea mays
  misc_feature: Incyte ID No: 700552844H1
cagatgttgatcctagggcaatagatcttgccatgagaattgccgaaaggatgttcctcaaaatgaaggaagatgaggcgaagaacaaaattgaagaagaaaatgatagatggagaccaaacgacgaatccacctcttcacaaggttcgtctttcaaatccacttctcatatgtgctttattgctaatgggagtgacagtgaaagcgaaagtgaggatgaggaggagcaagaaagtgatagtgaagatgaggatga

SEQ ID NO: 2537 - DNA, 259 bp, Zea mays
  misc_feature: Incyte ID No: 700552849H1
caactcacaagggtagttcaaagtccagaattccagactcgcgttcgcacgccgcctttcgcgctgccttagcgccttagcctgctagggctcgtcgattcatcgccggctcgacttctgatctcgcgggcagagcagcgcgccggcgcgatggcttcggatccggatgtgtccggcggcgagcagggagccgcccgacgatgtggacgaccccgacgtcgacgaggtcgaccccaccggccgctattcagtacaagga

SEQ ID NO: 2538 - DNA, 256 bp, Zea mays
  misc_feature: Incyte ID No: 700552850H1
gatgggtaccgtggtggtcctcgtggtgctcctggtgactttggtggcgataagagtggagctcctgctgagttccagccatcattcaggaggcctggctttgggcgtggtggcggcagcggcttcggcgcaggcccaacctcttcttccatggagtgaagttgcccttggtttggacatggtgtttcccttcgcatgtggcctttagttttgaaggacagttattatgtactagtaatattactcggatcggcca

SEQ ID NO: 2539 - DNA, 258 bp, Zea mays
  misc_feature: Incyte ID No: 700552851H1
aaggcagtcattgttaaagatggcatgtattggctacttctcgatgaggcttcctcctattcgtctcgagaaatcctgacgctcaacctgacagacgagaggttctcaaaaattgccatcccagatgctgtaaaaagccacaagttggaactattcgagggggaaggaaagctccgtttgttgtcgacacattccgatggatctagcaatatagtgtcagatatttgggtagcggacttggctggtgaagactggatc

SEQ ID NO: 2540 - DNA, 259 bp, Zea mays
  misc_feature: Incyte ID No: 700552852H1
cgtggtcgccagcccgatcgcggcgacgtggacctacatggctagcggcggccgtaccgtagcaatagcgagataaaatcccgattgggggacggcaatggcgagcgcgcgccattctcgaatgcgagagagatggcggatatcgtcgaggatgtgctgttgtattgtgtgcatgagtccgctccggtgtgtaagctgccggtgtagtgtaatctatctgtagctgacccgattgtagcgatgcacaattaaatctcaa

SEQ ID NO: 2541 - DNA, 260 bp, Zea mays
  misc_feature: Incyte ID No: 700552853H1
  unsure 51: a, t, c, g, or other
gcagctgcccgaagccgccaaacaccgccagtcccccaccacatccgccanaaccctccaaacaccgccagtcccccaccacatccgccagaaccctctccctccctccctccctccctcatcggcgcgccgccaatggccgtgtggtgaagcgcacccgacggaagaagcaggcaccaacagccaagccccctttgcccttgcccttgcccttgccctcgccgccgccgtccgcggaaggttgagtcccaggattcaga

SEQ ID NO: 2542 - DNA, 254 bp, Zea mays
  misc_feature: Incyte ID No: 700552855H1
gaaagttgtgtaggacctcttaccggctgctcaccgaattcgcttttgtgaacttgcgtccaaaagctcatcttttgtgatggttgatccgtgggaggcaatgcagaatggttatcagcgcactttgaccgttctttcgagaatacgaaactcactatgcaaggatggtgtagctgaccaaggtagcctcaaggtaatgcttttatgtggctctgacttgctcgagtcattcaccactccagtgtttggatcct

SEQ ID NO: 2543 - DNA, 256 bp, Zea mays
  misc_feature: Incyte ID No: 700552856H1
  unsure 76, 79-80, 175, 186-187: a, t, c, g, or other
cttggaggaagctaatggtgatattcttgttttcatctcatcattcaacccaatgaagaacagcatatccaagcgncannagaagactatcatgaaactggtagttgatgctgaaactgacaaagtacttggtgcatccatgtgtggaccagacgcacctgaaattatccagggncatcgctatgnnggttaaatgtggagccaccaaagcagacttcgacagcactgtcggaatccacccttccgctgctgaaga

SEQ ID NO: 2544 - DNA, 253 bp, Zea mays
  misc_feature: Incyte ID No: 700552857H1
  unsure 148: a, t, c, g, or other
gacaatgcagacataactttatcatgcgctcctgttggagagagtcgagcatctgactatggattagttaagttcgatagttcaggccgtgtaattcagttctctgagaaaccaaagggtgctgccttggaagaaatgaaagtggaancacagcttcctcaatttcgccattgattccccagctgaatatccctatatcgcttcaatgggagtttacgtttttaagagagatgttttgttagaccttctaaag

SEQ ID NO: 2545 - DNA, 81 bp, Zea mays
  misc_feature: Incyte ID No: 700552859H1
  unsure 56, 58, 60, 62, 66, 70, 73: a, t, c, g, or other
cgttttcttaagtttcgcaggcaaccaagatttaaatgaaaatcctttaaaccaananananacangcanaanaaaaaacg

SEQ ID NO: 2546 - DNA, 254 bp, Zea mays
  misc_feature: Incyte ID No: 700552860H1
gtgccagggagagtgctttccggaacatcaaaaccattgccgagtgccttgcaccagtggtgaggaggtagatggcctggttcaccactggtgccagggagagtgctttccggaacatcaaaaccattgccgagtgccttgcagatgagctgatcaacgctgccaagggctcatccaacagttacgccatcaagaagaaggacgagattgagcgtgttgccaaggccaaccgttgaacggacttgtatcctggt

SEQ ID NO: 2547 - DNA, 258 bp, Zea mays
  misc_feature: Incyte ID No: 700552861H1
  unsure 7, 14, 53, 81, 102, 212, 234: a, t, c, g, or other
ggggccntggtcgnggctgaagctggtcgacacaagggagaattgccgctttntgaggcctgtaattgtgttgcatagatngcttaggacaccatgaatgancccgagttggctggttgtatgggggcacaaaccagaatggttcctgtgatctagacaccgaggatgcggcggtagccaggcttgttgctgttccccaaaactgtttggtngatatcatgagtatgatccaanctgttcagttcttagagttatccc

SEQ ID NO: 2548 - DNA, 257 bp, Zea mays
  misc_feature: Incyte ID No: 700552862H1
  unsure 223: a, t, c, g, or other
gccgcaagtacgatcgatgcgacggggatcgccgcgccgccctgcacctggaccattatcctatcctgtcaaactggccacaaccggtacggtgccgacggggaccgtggcccgtcgccgcatgaacggaatcgaaaagagatttcgcggcgcggaggggcacctgttaccactacagatactacctcagccttgccagagggagaagaagatcacattcagnctcaagacacaggcgtgcgagcaaacgcaaacgg

SEQ ID NO: 2549 - DNA, 266 bp, Zea mays
  misc_feature: Incyte ID No: 700552864H1
ggcataatgatttgccaatggattcattgagcgagatggcacagcaaggtgagtttctgattggactcctcaatgaactagcctgttgggctttggcacctggagcagagtcattcttcaggtcccttctgttaggaaggatttggatgcgctccttgtttgagtgctccaaatatgaaaaccaagcaggtaagaaaatgtaaaggcattggtccaatcagtaattccaagcatatttagggcacatgcattaggagtccaagtgt

SEQ ID NO: 2550 - DNA, 262 bp, Zea mays
  misc_feature: Incyte ID No: 700552866H1
  unsure 127, 131, 142: a, t, c, g, or other
ctggtaagcaactaagcaagtgtactgaggacggaggcatcgatccagcgttccagctagcacgcacgcagccagcacccagcacccagcagtagaatctatatatcgtacgcaagtagtggatcgngggnatctatctgcnagtccctttcttcttctttcccgcttgaattgataaggtgcgccgaagcttgttttgttgggtggcctttgtctctgtcgtctcgtctcgtctcgtcttccgcccggccgccaccacctg

SEQ ID NO: 2551 - DNA, 257 bp, Zea mays
  misc_feature: Incyte ID No: 700552867H1
  unsure 24: a, t, c, g, or other
cattagtccgccttctcccccganacccccgagagtcccctcgctgccgacgccacacaaacgcctccaccctcatgttcaccggcgctgcgggcggcattggcaacctgccacggccgcgcaggccgcggctcggcggaataggacacgggggcgtcatggtgtctccacagggacaggtggctctgggggcacatccgcacctagccgccccgccgtgcaccgactacgacgtggcctacttcaaggcctatcac

SEQ ID NO: 2552 - DNA, 257 bp, Zea mays
  misc_feature: Incyte ID No: 700552868H1
gcttgcgcagctcttcttctccgatcccgactccaactctccctctctccttcgcctggcacatcctcggcggcgcggcagcctgcttcttcaccggcgcggcggcctgcttcttcgacgacgcggaggcctacggcggcctaccgagcggacgggtccacggacgaacggatctccggcgcctggcagatcttcggcgcgcggcctaccggttgtggacggatctccgctgcctggtgccctggtatatcctcgac

SEQ ID NO: 2553 - DNA, 256 bp, Zea mays
  misc_feature: Incyte ID No: 700552869H1
aaaggaggaatgaacgttgcaaggttatagcaaaggatttctttcttgatttgcagaatggaactctggacctaggccctggaataactgggggtgcagcaagtaaaccaggtggtagtgatggaaattctgatgatgatacggacaatgacaagagaagaaagcatggcaaagattcctcaaagggaactgattctatttctggtgccctcaaggctcatccagttagttctgaatcacgcgagtccaagctgac

SEQ ID NO: 2554 - DNA, 252 bp, Zea mays
  misc_feature: Incyte ID No: 700552871H1
cagaagcggcggcggcggagcaaaacgcaggcgaaggcgagggtgtgagggaaggagcaccagccatggtgcacgtcaacttctaccgcaactatggtaagacgttcaagaaaccaaggcgtccttatgagaaggagcgtcttgatgctgaactgaagctggttggtgagtatgggctgaggtgcaagcgtgagctttggagggtccagtatgcatgagcaggatccgtaatgctgcaagcattgctcaccc

SEQ ID NO: 2555 - DNA, 252 bp, Zea mays
  misc_feature: Incyte ID No: 700552874H1
aaagatttaccatggctaaggctaaatcttggtacaaaaccaaatgtgttgaaaaaggctccaaagtttaagtttggctggaggactaacaaagggttcgcgagagagacacttgcagttgtgaacccagtaatcatcaaacgcctcacggttagcgttcttgcatcatttggattggcaaaatacaccttgcccccatatattaactgagtacagagccttaaaagccttttatacattcgtaccagcaag

SEQ ID NO: 2556 - DNA, 256 bp, Zea mays
  misc_feature: Incyte ID No: 700552879H1
agtcagccggcgaggtgtttgccaatgtcgctaacggggtgctgcacgtccgggtgaaccacacgtatccattgtcggaagctgcccaggcccatgcagatctggagggcaggaagacatcagggtccatagtgctcatcccgggatagactcaagggcatgtgaatgaataaatggggtgatctggttatgggaacggcgtaataataattatatctatgctgtttatgcggtatgttcgatctgtttctgagtt

SEQ ID NO: 2557 - DNA, 144 bp, Zea mays
  misc_feature: Incyte ID No: 700552880H1
  unsure 50-51, 136: a, t, c, g, or other
aatcccgaactacaagtttcgcttctcgtcgcgacgactgggcgagaccnncgccgccgcctgagttctgtagaaatggctgatggtgaggacatccagcctcttgtctgcgacaatggcatggaatggtcaaggntggttttg

SEQ ID NO: 2558 - DNA, 252 bp, Zea mays
  misc_feature: Incyte ID No: 700552882H1
  unsure 66: a, t, c, g, or other
accagcaaaatctgatccacctaagttacatgctgctggagatcgccatctccaggaaactaaaangctgaacaatgagttggatttgaccaactcatcttcagctccaacggttccactggcagttagtacagagaatgccgacagcacagcagtaaccaatacaagctcaagaagaccatcttctgagggtactggtgagcctggagtggaaagcttcatgtttctgctgttgaattgacgaaagcaaga

SEQ ID NO: 2559 - DNA, 256 bp, Zea mays
  misc_feature: Incyte ID No: 700552883H1
  unsure 27, 30, 174-175: a, t, c, g, or other
caaaagaaatgtctacctatattattnggnaactctcccttaattgttgagtgaagtgtgtcatttcgctcaacaattaagggagagtttccaaataagcttggacaggacaaaagaaatgtctacctatattattgggctctttgacaagtatgttgaggagacctccaaatnngcagagtcactcaaataatactcatgaagcacaaatgaaaagcttgaagattttcagatggttacgaggagcaatccaaat

SEQ ID NO: 2560 - DNA, 256 bp, Zea mays
  misc_feature: Incyte ID No: 700552884H1
ggcactagcgggtgcgggtccacgcttccaagggttccaaactctcggcggcgcaagcaatggcggcgcggggccgggagcactggtagtttcgcatatcgcggcggcttgttgccacctcgccatcgcagattatggggatcaacggcgaggagtgggaggagacggtactgggcgacggcgttgggaggcggaagggtggtgctgaggcttccggtttggtcgcatcctcctcctttgctgaggggatggggga

SEQ ID NO: 2561 - DNA, 224 bp, Zea mays
  misc_feature: Incyte ID No: 700552887H1
  unsure 39, 147: a, t, c, g, or other
aaacagcacatcgctctctcgatctcagccatggcggangtggagcagccccaggacgcggtgaagctcttcaaccgctggaccttcgacgatgtccaggtgaacgatatctcgctgaacgactacctggctgtgactgcggcgaantcgcgacattcctgccgcactccgcggggcgctactccaagaagcggttccgcaaggcgcagtggcatcgtcgagcg

SEQ ID NO: 2562 - DNA, 255 bp, Zea mays
  misc_feature: Incyte ID No: 700552888H1
  unsure 70, 77: a, t, c, g, or other
tgtgtttgcaagactaatggtcaaacaccgtataaccataaagttagaatactatattaatatattaaancaaattncatccaatagacatagattaacccaattaacacaggataaataaatatctaattataaaagtatgaaacatggtataatcaatgttgttactgcgtagtaaatattcatacgagactaacacaactggaacggttcaatttagaattaaaatggggaagttacgaatttccaaagttt

SEQ ID NO: 2563 - DNA, 253 bp, Zea mays
  misc_feature: Incyte ID No: 700552890H1
  unsure 7, 12, 26, 39, 44, 50, 69, 100, 114, 119, 138, 155, 160, 171, 205, 235,: a, t, c, g, or other
gtaatgntgtgncaagagctccctcncctggatttcagnattanattganttgcacttgctggcagatnatgtgtcatcagccttgttggcacctttttntattgattctgctnttgcnggtccatgaactcttaaancattgcagttcaaaatnataangtagtcgtgtncacagttgagcctgtgatgattagctagacatcntggaattaccatcagacttacttgtgaagnctgtnnctggcnttatca

SEQ ID NO: 2564 - DNA, 149 bp, Zea mays
  misc_feature: Incyte ID No: 700552891H1
  unsure 57: a, t, c, g, or other
catttcttagtatcaacaaatattatattctgactacacaaagaactgcaatattanctttaattcactgcatttcttagtatcaacaaatattatattctgactacacaaagaaatgcagtgaattaaagttaatattgcatttaatt

SEQ ID NO: 2565 - DNA, 172 bp, Zea mays
  misc_feature: Incyte ID No: 700552892H1
  unsure 104, 115: a, t, c, g, or other
gatccgaagtctatgttgggggcatcgcctctgatgtctcttctgatgatctcaaaaaactctgcgagtctgttggggaagtagtcgaagtgcgaatgccaggnaagagtggtangctgtatgcctttgtcaatttcagaactaaagagctggcttcaaaggccatccagat

SEQ ID NO: 2566 - DNA, 256 bp, Zea mays
  misc_feature: Incyte ID No: 700552893H1
  unsure 205: a, t, c, g, or other
gagcaggctaaacggttgcaggaggcaaagaaggatcctgagaaggcaagcaaaattgcttgggatgtggccagaagacgtgctgctggtgagaaggtccatgatgaccccaagctgattaaggagagcttgaagaaggaggaaaagcggcagcagaagcatgctgcgcatggaaggagaggcagaaaactgtagataagcagangaaggacaagcagaagaaaaggacagagaacatccgggatcgggcacagca

SEQ ID NO: 2567 - DNA, 259 bp, Zea mays
  misc_feature: Incyte ID No: 700552896H1
  unsure 86, 249: a, t, c, g, or other
tattcagctgcaagggttttccaaaacctcagccagattcatcaatctgaggcatctgaccatgtatttgcctctttatggggaanctaagtcaattagtgggattcttcgcttggcctacctactggaattggccccagctctagaagaattggaattgcatgtgaatggcggtgacgtggatgttgggtgggcactcagagggatatgttaccgtactcacacaataggtcagagggtcttattcangagccagtgt

SEQ ID NO: 2568 - DNA, 297 bp, Zea mays
  misc_feature: Incyte ID No: 700552901H1
tggggtttggcattccaactgtattcatggggctggcaatcataagcttcttctctggtacatcactttataggttccaaaaaccaggaggtagtccaattacacgagtatgtcaggtgattgttgcctctttgcgcaagtggaatgtgcctgtcccagaggatagctctctcttgtatgagctacctaatggggtatcaacaattgaggggagtcggcaaatagagcacacagatgaactcagatgtttagataaggctgctacagttaccgaagttgatgtgaaaacggctgact

SEQ ID NO: 2569 - DNA, 188 bp, Zea mays
  misc_feature: Incyte ID No: 700552902H1
  unsure 171: a, t, c, g, or other
agattatgtccattacattttgcttgcattgtcaagattgtggattcttggtgttcatgacgttgtaatgttaatgaacggctggtaacgccatgtggtactggtacccctgtattttcagttgctgtggcaccttggctctctctttgaaaaaccagtatgtatatgacnatgatcaatttattcat

SEQ ID NO: 2570 - DNA, 284 bp, Zea mays
  misc_feature: Incyte ID No: 700552903H1
cacctgaactatgcagctccatagaactgtgtacttgtagttcaataggactggagatagaagacccaaaagaggcgggattgtgtggtaattctgatgctgggtttccatcgtggcttgctcaattagttgggaaaccaactatttcaagcatttttgacagtgggaatgaaattctggatcacaatgacttcagatgcatctccaacttccacagcaacatgttcagttcaaactcaagttgtttgaattccatgtcgactccagagcagtcgtacaaggtt

SEQ ID NO: 2571 - DNA, 283 bp, Zea mays
  misc_feature: Incyte ID No: 700552904H1
aaactggctgaagataacaatgtcccactatcaagtgtgaaaggtactggtcctgatgggcgtattttgaaggcagacattgaagattacttggccaagggtgggctgagggaggcttttgcagctccagggttaggttacgttgatattccaaatgcacagataagaaaggttaccgcaaaccgcttgctagcatctaaacagaccattcctcattactacttgacagtagatgcacgtgttgacaaacttgtcaagttgcgaggtgaactgaatccactgg

SEQ ID NO: 2572 - DNA, 281 bp, Zea mays
  misc_feature: Incyte ID No: 700552905H1
  unsure 39: a, t, c, g, or other
aaaaaagaattagaaacggaagaagaacagcaggcgaanatcgccagattggtatatcgatcgattgatcggtggcggagggaggggaggagggcggcagatggcggcgtgccggggcttcttcgagtgcctgctcaggctgctcaacttcatcctcaccgtcgccggcctcgccatggtcggctacgggatctacctgctcgtcgagtggatgaagatatctgaggacggcagcagcggggggttgacggcggaggtgctggtctccggccggccgttgt

SEQ ID NO: 2573 - DNA, 282 bp, Zea mays
  misc_feature: Incyte ID No: 700552906H1
cgatgttcaacgattaatgaaagagaaagaatattccaaaagcatcataatgaacctaacaaaagatatggaagccatgaatagattgcatgagcagcaacttgagcaaattggaagaaaggcaaaggaaatggaggaacaattaaccaccagggtaaaagaagtagagtatctcttgctacaatcgaataagaaagttgaagaacttgagattgcttctaggctaaaatcacagttatgggatcagaaagagaacatttttcagagttacatggataatca

SEQ ID NO: 2574 - DNA, 127 bp, Zea mays
  misc_feature: Incyte ID No: 700552907H1
  unsure 5, 8, 13, 21, 23, 32, 45-46, 48-49, 51, 104, 112, 122, 126: a, t, c, g, or other
catgnacngcgcncgcatctncnccgagaacnccatccgcaagcnnanngngcacatgagctacctccgcctgcgcctctgcgcctcgatcgccgtcgtggccngcctcganaacgcaggcnaagnt

SEQ ID NO: 2575 - DNA, 277 bp, Zea mays
  misc_feature: Incyte ID No: 700552910H1
  unsure 203: a, t, c, g, or other
acaggtcaaccagcctctgcaacaacaggaggttacaaacttgtcgtatcctcagcagagcctagaaaagtgtcatctccaaccatttctaatatccagggatggttacctggatttaaaggagagggtgatagcgaacagcttccgactattgccatagttgcaaactatgacaccttcggtgctgtacctgcactttctgngggaagcgacagcaatggaagtggagttgtggctcttctagagattgcgagactattttcacgtctgtattcaa

SEQ ID NO: 2576 - DNA, 276 bp, Zea mays
  misc_feature: Incyte ID No: 700552911H1
  unsure 70-71: a, t, c, g, or other
gaggctctgttttcggccaagtcatttgaagaacttggtttgccacctttgcttgttgaccagttgaacnnggaaggtctgactgccccaactgaggtccaatccgcagcaattcctataatagcacaaaagcatgatgttgtgatccagtcatatactggctcagggaaaactcttgcttatcttcttccaattctttctgatataggccctctgaagaggactatggaacaagaccattctgagaaaagatcaggtatagaagcagtcatcgtt

SEQ ID NO: 2577 - DNA, 277 bp, Zea mays
  misc_feature: Incyte ID No: 700552913H1
gagagagtctgcaggatccagcaggccgagggaggagtcagcggcgggccggagaatatgagcggcaacggcgcgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttctcccaggaaccccagccgattgattgggagtactacagaaaaggaattg

SEQ ID NO: 2578 - DNA, 292 bp, Zea mays
  misc_feature: Incyte ID No: 700552917H1
cgtttctgaaggatttgctgggaaagttgttagtgatgaagtgaagcaactggcccagggggtccagaacaagttacgtgacctgattggttccgagaaatttgttgaagtctacaagagcgttcggatgggcctgaaacagaagcgggacggtagaaagcaggcacagaagattgttgcagccgtggacccagaacgcaatgccaagcgaaagcaacgaatggcagccaagcaccgggaacacaagaggcgaaagataatggcgatgaagattggcaggtggatgagatag

SEQ ID NO: 2579 - DNA, 281 bp, Zea mays
  misc_feature: Incyte ID No: 700552919H1
agcaactggtggatggcatgggcaaacccacaaacagaaggagatgctcccaagacagatagtgtggtccttctggttgtttatatgtcccttgcctttggaagttcactatttgtgttcatgagaagccttcttgtggctacgtttggtttagcagctgcccagaagctttttataaaaatgcttaggtgtgtctttcgagctccaatgtcattctttgacaccacaccatctggtcggattttgaacagagtttctgtagatcaaagtgttgtggacct

SEQ ID NO: 2580 - DNA, 277 bp, Zea mays
  misc_feature: Incyte ID No: 700552925H1
gagcattttggttatctacaatgtaattgactgaagctgaaccgctaaagcttgttggatctactttaatttctgcatttcctttattttctttctaattgtggttattacttattactgggaactgtaattcctttacctttgctaatgggaccctagggtcttgtgcaaaaaggatttctcaattaaacaggtgcatgtgaaacttgcaatcaagtatccaggaagtgttaatagactagtggtaaatgaaagcctacaaaatttgtacagttat

SEQ ID NO: 2581 - DNA, 276 bp, Zea mays
  misc_feature: Incyte ID No: 700552927H1
  unsure 65-66, 76, 93, 98, 100, 154, 179, 188, 191, 193: a, t, c, g, or other
actggttctatcatcttgcatggcccgcaccagttgttggcaagctctcgaaggactacgagagnnagctgaaatnctacaagctaaacacanatganancccggacatcgcaagccagtacggggtccggagcatccccaccacgatgatctnatccgatggcgagaagaaggattcngttatcggngcngntcacagagagcacactggtcacatgcatcgagaaatttgtcgagacgtagaatgcgtagtggatctcttgagcggtttccttt

SEQ ID NO: 2582 - DNA, 277 bp, Zea mays
  misc_feature: Incyte ID No: 700552928H1
  unsure 8-9, 15, 47-48, 60, 75, 77, 113, 207, 254-255: a, t, c, g, or other
ctcatcgnncctacnccacatacatagtttcttctactagcacgacnncaaacatggggnagcctgcgaagatcngngagtggggtggatacgccggcgatcgtcgggatctnagggctactccggaccggctgatcgaggtgaaggtcacggcggacaacagcagctgcatccgctccatctccttcatctacatcggagccgatngcaaaccgtacgaggaggggccatggggtttcggccatgctggcacnnagtacaagattgatctgtgcag

SEQ ID NO: 2583 - DNA, 293 bp, Zea mays
  misc_feature: Incyte ID No: 700552933H1
gctttctgtttctcaaaagatattttattgtattagctttgttggtggccaatatgtatggtcacgattacaatctttttctgctttccgtcgatggggcgattctgaacagagaccactagctcgccgtgcttgggcgttgatgcggaatgctgaagtattttatagggctgcttcattctttaacctattattgtttctttatggtggaaggtacaaaactgttgtagaaaggattctgaaggcaagacttgtttatgggagccccaacatgaatagagctgttagttttg

SEQ ID NO: 2584 - DNA, 283 bp, Zea mays
  misc_feature: Incyte ID No: 700552935H1
  unsure 98, 176: a, t, c, g, or other
acagcgggtcgggagatcgatgtctcagcgtgcgcgcgtggcgtgccagtccgcgtcgcgcgcgctggcgcctaactgttcagtacaacgcgaacgcnaacggtttctctccatctctccgtgtgtgacagtgtgtgtgtcgtagctatagcagtgcccggtgcggactgcgagtnacatgggctaaataaagtgtgcgtcgtctggtctggtggtggtagtggggcgcggtgccccatgtgtgccgctgcagcttgtgtctctgtgttgcttcatgttctct

SEQ ID NO: 2585 - DNA, 280 bp, Zea mays
  misc_feature: Incyte ID No: 700552936H1
gctttctgtttctcaaaagatattttattgtattagctttgttggtggccaatatgtatggtcacgattacaatctttttctgctttccgtcgatggggcgattctgaacagagaccactagctcgccgtgcttgggcgttgatgcggaatgctgaagtattttatagggctgcttcattctttaacctattattgtttctttatggtggaaggtacaaaactgttgtagaaaggattctgaaggcaagacttgtttatgggagccccaacatgaataga

SEQ ID NO: 2586 - DNA, 281 bp, Zea mays
  misc_feature: Incyte ID No: 700552937H1
gaaagttgatgccgttgaatgagcatggagatgattagataatactcagtttttctctttcaattatatgttctaactacctattaagaaatagaaggaacagtaccagttcaagatggtaatgtaatagtataccatagaaagataaggaaacacattgctcaacttgtaattgtatttttctcttcagaaatagatcttttggtttttgaatagcttgggagagtacattattatagtagtgcatgttgttaatccatcaatggagttctaccaagctc

SEQ ID NO: 2587 - DNA, 183 bp, Zea mays
  misc_feature: Incyte ID No: 700552941H1
  unsure 60: a, t, c, g, or other
gccatcctcggcgtggacggcttctcgtcgctccccaagaactgcctcaccctctgctanatcttcttcgcggcggccatcgtcgtcaacctggtcagggacctggtgccgaagaaggtcgccaggttcatcccgctcccgatggccatggcgatcccgttctacctcgggtcattcttcgcc

SEQ ID NO: 2588 - DNA, 275 bp, Zea mays
  misc_feature: Incyte ID No: 700552942H1
tgtgattgttggcacagtcacagatgacaagaggatccaagaggttccagcaatgaaggttactgccctgaggttcaccgagacggcaagggccaggattgtcaatgctggtggggagtgcctcacatttgaccagcttgctctccgtgctccacttggcgagaacacagtcctcttgaggggccccaagaatgcccgtgaggcggtgaggcacttcggcaaggctcctggagtgccgcacagccacaccaagccatatgtgcgctccaagggaa

SEQ ID NO: 2589 - DNA, 264 bp, Zea mays
  misc_feature: Incyte ID No: 700552943H1
  unsure 33, 60, 183: a, t, c, g, or other
catcaaatagcttgccttttgcccagtcttgtngatgtccttccaaacgatatatcagcnaatcatccaggatatgcgtgcgtccttgcaaatgttcttgaagctgcaacctggattttgtctgatgcaaagttagcttctgattcagcggctgacatcattgctgtttgtacctcgttgtancatacgttgccagcagtcacaacacctactgaaagggcagatgacgatgatgagatgcccatggatgtcaatattaaaatt

SEQ ID NO: 2590 - DNA, 273 bp, Zea mays
  misc_feature: Incyte ID No: 700552944H1
acagcgggtcgggagatcgatgtctcagcgtgcgcgcgtggcgtgccagtcgcgtcgcgcgcgctggcgcctactgttcagtacaacgcgaacgcgacggtttctctccatctctccgtgtgtgacagtgtgtgtgtcgtagctatagcagtgcccggtgcggactgcgagtgacatgggctaaataaagtgtgcgtcgtctggtctggtggtggtagtggggcgcggtgccccatgtgtgccgctgcagcttgtgtctctgtgttgcttcat

SEQ ID NO: 2591 - DNA, 275 bp, Zea mays
  misc_feature: Incyte ID No: 700552946H1
cctggggcgcgcctcgccacctcagacgtgcacgtaggcgggtaccttgtgcccgcgggcaccaccgccatggtgaacatgtgggccataacccatgaccccagcctgtggcctgagccaatggagttcaggcccgagaggttcatgggccctgccgccgaggacgtcccgataatgggttcggatctccggctcgcgcctttcgggtccggcaggcggagtgccccggcaagtcactcgcggtggctaccgtcggattctgggtcgccaccctg

SEQ ID NO: 2592 - DNA, 187 bp, Zea mays
  misc_feature: Incyte ID No: 700552949H1
  unsure 109, 114, 119, 129, 134, 147-148, 150, 162, 165, 179, 181, 184-185: a, t, c, g, or other
gcaaaatagtctcgccaattttgctgcattctgctctgctgtttagttactgatcaccaccatcgttttattcttcatcaaccactaaacagcagagcagaatgcagcngaatngtttnctgatgaagnataanacgatggtggtgnncngtttaaaaaaanaanaaaaggggggcccngnccnngt

SEQ ID NO: 2593 - DNA, 280 bp, Zea mays
  misc_feature: Incyte ID No: 700552950H1
  unsure 148, 151-153: a, t, c, g, or other
ccttgccaatgatagcttaaggacaactctgtgtgtgcgatttaagagtgaagtagtagcatgcggagttgtgtatgctgcagctaggagacaccgggttccccttcctgaagatcctccgtggtggactgtctttgatgctgatgangcnnngaattcaggaagtttgcagggttcttgctcacctctacagcttgcccaaggcccaatacattccagtatataaagacaacgattcctttactgttaagagaatctctgatctacaggcttcaaagga

SEQ ID NO: 2594 - DNA, 279 bp, Zea mays
  misc_feature: Incyte ID No: 700552953H1
  unsure 148, 236: a, t, c, g, or other
atcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgntgtcaagttcaaggtgcgctgctccaagtacttgtacacgctctgcgtcttcgatgctgagaaggcaaacaagttgaagcaatctctncccccaggtttgaccgtcgaggaggtctgattggatacatggc

SEQ ID NO: 2595 - DNA, 182 bp, Zea mays
  misc_feature: Incyte ID No: 700552954H1
  unsure 25, 148-149, 156-159, 169, 177: a, t, c, g, or other
gcaaaatagtctcgccaattttgcngcattctgctctgctgtttagttactgatcaccaccatcgttttattcttcatcatgcactaaacagcagagcagaatgcagcaaaatagttactgatgaagaataaaacgatggtggtgatnngtttaannnnaaaaaaaaangggcggcngcggc

SEQ ID NO: 2596 - DNA, 276 bp, Zea mays
  misc_feature: Incyte ID No: 700552955H1
  unsure 96, 174-175, 178, 216: a, t, c, g, or other
cttggcaccttggggtagcatatgctccccaatctcccagtctttattccataggactatgtacatagggactagggaataaagactgggagattnggaagcacctgcttggcaccttggggtagcatatgctcgtgtctagctcagatgcagaagtcgcattctgaaactctnnggncatcgacctgttccctattttaactatctctgtatganagccatttatgagactgaaccattttaccattttgttttcccccttctttcgtggttaca

SEQ ID NO: 2597 - DNA, 275 bp, Zea mays
  misc_feature: Incyte ID No: 700552957H1
tctcaagcgcaaaaccgccgagaccgaccaaggctcgcagcgtgacctcccgctcgtctgcttcgaaagccactgcagcagtacagccttgtagatcatccaagcttgctgctagtgctagtgctagtggtatcgatgaggagacgccagatatcctgcacgaacctgactctctcagtaactgtgtcaagactactacttcaccgaacggaaaacgggtctcgccgccacataacgcgctcggcagctccccgaaccgaaaaggtggcaggaag

SEQ ID NO: 2598 - DNA, 272 bp, Zea mays
  misc_feature: Incyte ID No: 700552959H1
caaagaagacagcagaagcgagtccgtggtgacatctgagtgccaggatggccatcaagccaacacggaggctgggtgtgccactccgtcgtccaagccagtctcaaggaagagaaagtgcgttgaacgaagccccgactgcattgcaagcaggctgcggtctcggctcagtatgccgtgatccccccatggacagtgatcagcatcatgagtctctttttactgtctgactgcaggctcgccttttgcgatgaagttatgctagtgaagat

SEQ ID NO: 2599 - DNA, 271 bp, Zea mays
  misc_feature: Incyte ID No: 700552960H1
gaacccgggcgccctgaactcgaggccggaggacagcggcctcgccaattcgacggagaggggctccgcatctactgctgctgctagagaggcacccggctaccagtccgcctcgtcgcttaactccgacaactgctgatgccttggcagctagctggtcgtcccaagtagtagagaacaaggcaaatgtatccatagatctccttgtagcggagttaatgcctttttttcccctttctaatatgcattggatgagcccgtagcgcaccgt

SEQ ID NO: 2600 - DNA, 274 bp, Zea mays
  misc_feature: Incyte ID No: 700552963H1
cttggtgctgcttctggcacaactgtatctcatgtgtctgatattgtagggccggatggtctggtctacgctgttgagttctctcacaggagtggaagagaccttgtcaacatggcaaagaagaggaccaatgtgatccccattattgaggatgccaggcatccggcaaggtaccggatgttggttggcatggttgatgttatcttctctgatgttgcacagccagaccaggctaggatcttagcacttaatgcttcatacttcttgaagaacg

SEQ ID NO: 2601 - DNA, 279 bp, Zea mays
  misc_feature: Incyte ID No: 700552966H1
gttccaggacatcacgacactgctgctcgaccccaaggcgttccgtgacaccatcgacctcttcgttgagcggtacaaggaccaagggatcaccgtagttgctggtgtggaagctagagggttcatttttggtcctcctatcgctcttacgatcggtgctaaatttgtacctttgaggaagccgaagaagttgccaggcgaggtgatctccgaagaatattctctggaatacggaactgacaagatagagatgcatgttggagctgtacaggccaacga

SEQ ID NO: 2602 - DNA, 278 bp, Zea mays
  misc_feature: Incyte ID No: 700552968H1
  unsure 39, 188: a, t, c, g, or other
gtttctggttcatcagcgaaggacgttgctaagcagctnaaggagcaacaaatggtgatgccaggccatcgtgagtcaaacctgcaaagggaactgaacagatacatcccaaccgctgcagcatttggaggagtgtgcattggcgcgctaactgtcctagctgatttcatgggcgcaattggctcagnaactggcattctgctcgctgtcactatcatataccagtactttgagacattcgagaaggaaagggcaaccgagcttggtttctttggttt

SEQ ID NO: 2603 - DNA, 277 bp, Zea mays
  misc_feature: Incyte ID No: 700552971H1
catcgacatgtgtgattatgctgtggggctaagtcgccaactaaatggatccattataccatctgaacgaccaaaccatatgatgatggaggtgtggaatccccttggagttgtgggtgttataacggcatttaatttcccttgtgctgtgcttggttggaatgcttgcattgctttggtctgtggaaattgtgtcgtctggaaaggtgctccaacaactcccactgatccactattgccaatgacaaaataagtggctagtgtattggagagaaca

SEQ ID NO: 2604 - DNA, 276 bp, Zea mays
  misc_feature: Incyte ID No: 700552973H1
  unsure 79-80: a, t, c, g, or other
aagaaatttaaagaatttcttctgacatatgttcatccgaagaacgatcaaggagagtttgagtatgttcggcttattnnatgagatggttttagctaacaagtgtagcctggaaatagactacaagcagtttatttatatacatccaaacattgccatctggttggctgatgcgcctcaatcggtgcttgaagttatggaagaagttgccaaaaatgttgtttttgatcttcacaagaattataggaacatccaccaaaagatctatgttcgaat

SEQ ID NO: 2605 - DNA, 272 bp, Zea mays
  misc_feature: Incyte ID No: 700552977H1
gacgggctggcagagcgttgggacgaatggcagaaagtagaggtggtgaggcaggaggctgagtcggcaccgctccgcaatgactggatcgtcgattccacgtacaaccttcgtgccgtcgagctgtccggcccaaggtagccactccacgactccgatgaaagaaaacactgaattggccaagattcagtctaattgctgcttgtgtatatgaaaggtagcttttggaattgttagcgacaatttgaaaggatcttttttttggattcctc

SEQ ID NO: 2606 - DNA, 273 bp, Zea mays
  misc_feature: Incyte ID No: 700552979H1
agctcggcttctggatgcccttcctcggctcgcccgacaggttcctccgcctcgtcaagcgtaacttctacctcctcagctccgacctcgacaaggtggtgaagcccaacatccagctgctccaggagtgcggtctatctatccaggagattgggagcctgtgcgtggctaacccgaggctgctcaccagcaagccggacagaatcagggccgtcctcgtgcgtgccggtgagatgggcgtgccccgcaagacgcttttgttcaggcacgctg

SEQ ID NO: 2607 - DNA, 278 bp, Zea mays
  misc_feature: Incyte ID No: 700552980H1
  unsure 177, 179, 261: a, t, c, g, or other
acataatgcgcaaggctggtcagttgcatcttgtgaaaccatatatggttgcagttcagagtaacaatgtctctgctgtgaatgaagccttgaatgagctttatgttgaagaggaggactatgagagactccgtgaatcagttgacatgcatgacaactttgaccagataggtcttntnccagaagcttgagaagcatgaattgctggagatgaggaggattgccgcctacatttacaagaaggctggcaggtggaagcancgatagctctatcgaag

SEQ ID NO: 2608 - DNA, 283 bp, Zea mays
  misc_feature: Incyte ID No: 700552981H1
  unsure 226, 282: a, t, c, g, or other
cagaggaggtttcctccctgcgaatctgcgatactgactctgccttcttcgttccagcgccgaaagagagggagagccaagccgcctcccgccgcgacgcacgatggatcgcgcgcagttgctcctcgtcggactcccggccttgctcttcttctccgacctcactcacatcttcgcgccgccgcctccccacctccgccacccccatcaccaccctcctcaccancaacatccgcatccgccgcatcatccccactcgcctcatccccatccgcacccgcng

SEQ ID NO: 2609 - DNA, 277 bp, Zea mays
  misc_feature: Incyte ID No: 700552982H1
cctacactgggtttgagctgtttagaattaaggagagggatatcccaattgaggtccttgaactcgagaacaagaacgacaagatcattgcatttgcatgggaacctaaaggacatcgctttgctatcatccatggtgatggccctaagcctgatgttagcttctacaccatgcgaacagccaataacactagccgtgtatccaagctcacaaccctcaaggccaagcaagctaatactctgtactggtctcctgctgggcgcttcatagttcttgc

SEQ ID NO: 2610 - DNA, 276 bp, Zea mays
  misc_feature: Incyte ID No: 700552983H1
catcaatgaatcatggtgccaaggtcttgatggttcgacttcaaggtactgatattctccaggactattgttagcatcccttgtggtccatctgcattagcagtgaagaaagtcgcatggggacttgcttgatatgttgttattgctcagacatggctgagaaggaggaaacaaagggccgctgccctgcctgccacacacgttatgacaaggatatgatcgtcaagatggccgccacttgtgacaggacagtggcagataaaaatgcggagaaga

SEQ ID NO: 2611 - DNA, 274 bp, Zea mays
  misc_feature: Incyte ID No: 700552985H1
  unsure 46: a, t, c, g, or other
acaaccacttactctcgtgcgctctccgtgggagcgaggactcgcngccggcgcagggcaggttctcctagatctccggcatcatcagtaacaaatggctgacggtgaggacattcagccccttgtttgtgacaatggaactggcatggtcaaggctggttttgctggtgacgatgcgccaagggctgttttcccaagcattgtcggacgcccccgtcacactggtgtgatggttggcatggggcagaaggatgcgtatgttggtgacgaggcc

SEQ ID NO: 2612 - DNA, 276 bp, Zea mays
  misc_feature: Incyte ID No: 700552986H1
gttgtgatttgcactaaactgcttgttcttcattcccctatcataggcttctagcgtggagtatgaaaatatgtgatatatattgtggtggtattgttttctgatgaaatgaatattattaccccataagtggacacaggccagttgaaccaatacgaacccgatcaactacatcgatgcatcaccaacccaagcatcccaatccaaacaacttgtaatttgaaactagaggtacattatagtaacccttttctttttagggaactagactattag

SEQ ID NO: 2613 - DNA, 275 bp, Zea mays
  misc_feature: Incyte ID No: 700552987H1
tgagcttgttgagcattttgatccttgccaccccattcttgttggggggattggccttggtgaggagaacacaggattcatgcaggctagtttgaagcgccataggtggcacaggaaagttctgaagacaaaggatccaatcatagtttcaattggttggaggcgatttcaaacatgcccctgtgtatgcaatagaggatcggaatggtcgacaccgcatgctgaagtatacacctgagcatatgcattgctttgctatgttttggggaccactt

SEQ ID NO: 2614 - DNA, 274 bp, Zea mays
  misc_feature: Incyte ID No: 700552988H1
  unsure 105-123, 169: a, t, c, g, or other
cttcatacttgcatccacaaatatcctcactacaagaattgcagcgggttgtttcatacttgcattgtttattgttctttttgttgcagaaaatgtaagttcagnnnnnnnnnnnnnnnnnnntgcaacttgtgacttcatttgtatttttccactcgtgcatactgtnatcatgatcatttaggtaagacttgtttgaattgtgcagtggtttcttcgctggctctgccttggtatgcatcaacatgacttagtctccatttaagaccttact

SEQ ID NO: 2615 - DNA, 272 bp, Zea mays
  misc_feature: Incyte ID No: 700552989H1
  unsure 52, 54: a, t, c, g, or other
ttcttctctagccaagttcatagaagtgttgtatatggagatcagccaagananagattggacctttatatgcccactagtacaacagggttaaagccggttgttgcgtttgtgactggtggagcgtggatcataggttacaaagggtggggagcccttttaggcagacgcttagcagaaaggggcatcatagttgcatgcattgattacagaaactttcctcaagggactattggtgacatggtagaagatgcttctcaaggaatagcttt

SEQ ID NO: 2616 - DNA, 272 bp, Zea mays
  misc_feature: Incyte ID No: 700552990H1
  unsure 180, 182: a, t, c, g, or other
gggatctactattacaaaggttgatatattcagagatgctgcagtgcttatggtgaattatgtcgatgaaattcgagcacaaggttttaagttggagtacctgaatattggaggtggtttgggaatagattaccatcataccgatgcagtcttacctacacctatggatctcatcaacangngtacgagaattagttctctctcaagatcttactcttattattgaacctggaagatccttgattgctaatacttgctgcttcgtcaataga

SEQ ID NO: 2617 - DNA, 272 bp, Zea mays
  misc_feature: Incyte ID No: 700552991H1
tctggtttcctatatgatatgctgcaaaaagaggtaatttctttgagaaagacatgccatgagaaggatcagattctaaaagataaagatgatgctattgagatgttagcaaagaaagtagacaccttaactaaagcaatggaagtggaagctaaaaaggtcagacgggaggttgcatccatggagaaagaagttgcagcaatgcgtgccagtaaagaacaagaaatcagagccaagcggcttggtacgaaaggctctggtagttcacaact

SEQ ID NO: 2618 - DNA, 180 bp, Zea mays
  misc_feature: Incyte ID No: 700552994H1
  unsure 5, 14, 32-33, 36, 52-53, 57, 75, 78, 112, 114, 150, 153, 155, 157: a, t, c, g, or other
ggtcntggtctcangatcaagacttgggatgnnttngagaccacaggcactnncccntccccaagcagcagcatnctntgaccttggggaagggggttctcatgctacatgntncagtgacctacacctccttgacactcagacaatgcnggncngncaagaccaaagcaacaaggtgtt

SEQ ID NO: 2619 - DNA, 274 bp, Zea mays
  misc_feature: Incyte ID No: 700552995H1
  unsure 177: a, t, c, g, or other
gtcatggtctcaagatcaagacttgggatgaatttgagaccacaggcactcccccttccccaagcagcagcatgctctgaccttggggaagggggttctcattctacatgtttcagtgacctacacctccttgacactcagacaatggaatggtcaagaccaaagcaacaaggtgtnactccagaatcaagagcaggacatgcaggtgtaactattggagaatattggtttattactggtggtggaaatagtaggaaaggtgtctcagatactc

SEQ ID NO: 2620 - DNA, 278 bp, Zea mays
  misc_feature: Incyte ID No: 700552996H1
  unsure 219, 233, 239, 244, 251, 254-255, 257, 267: a, t, c, g, or other
gtttgaatggagctggacagaaatatgaaatttgatgaagagccaaattatgccaagcttatctctatttttgatggtttgattgaagcacctgcgtcgagaccagtcagaattgatggggccctcaaggttggacagaaacgtggaagattgcatgcaaatctagaagatgaacaacctaaaaagaaggtagattagggagcccagcggctcaatggnttcaagttataatnctaggngcccnttagcgngtnngntaccattacnatgtggctgcc

SEQ ID NO: 2621 - DNA, 165 bp, Zea mays
  misc_feature: Incyte ID No: 700553001H1
  unsure 52: a, t, c, g, or other
tgaaatttgttctccatctataattcacaagaactttaagtcgtccaatatnttaactggacaccgagctcaatcctcacatttctgatgctggacattcaagttttgttccagatgctgaattccaggcttcagatcaggggtctgggtatagtgcccctgagg

SEQ ID NO: 2622 - DNA, 147 bp, Zea mays
  misc_feature: Incyte ID No: 700553003H1
  unsure 56-57, 62, 114, 133, 146: a, t, c, g, or other
catttcttagtatcaacaaatattatattctgactacacaaagaactgcaatattnnctttnattcactgcatttcttagtatcaacaaatattatattctgactacacaaagnaatgcagtgaattaaagtnaatattgcatttnt

SEQ ID NO: 2623 - DNA, 132 bp, Zea mays
  misc_feature: Incyte ID No: 700553005H1
  unsure 120, 123, 127: a, t, c, g, or other
gtaatgatgtgtcaagagctccctctcctgatttcagaattaattgaattgcacttgctggcagattttgtttcatcagccttgttggcacctttttttgttgatgcttgcttttttggnccntaanactct

SEQ ID NO: 2624 - DNA, 156 bp, Zea mays
  misc_feature: Incyte ID No: 700553012H1
  unsure 41, 96: a, t, c, g, or other
ggttgcttgagtcaaacataaatgagcatagttctgaggancgatatccggagcgtgccaaattctgtacatcacaacaatgagatagagttctgnttctccacctcacgtctgtgagatagaaagtgtgaaaagcaaccaagaagggtaccaatc

SEQ ID NO: 2625 - DNA, 232 bp, Zea mays
  misc_feature: Incyte ID No: 700553013H1
  unsure 187, 213, 221, 224: a, t, c, g, or other
aaccaagttgctaatgagtaaaattttggctttgctttttaaaaaatatgggttcaagttgttcctgacagatgccactgcacaaatggacgttgacacgttgtagtgatcacactgtcacgagagctgagcaaactacagcctgcaagagctacacgtggcatgcttgacacatcatggtggagantgcaagtgttaaagttgcattgaatnccatggcngtngtttcggt

SEQ ID NO: 2626 - DNA, 173 bp, Zea mays
  misc_feature: Incyte ID No: 700553014H1
ggctattcaaattttttgccagaatcaagtgtatgcaataatgctctgccagattattaagtatactagcacctgaggaacagtgtttgacttgggaacttggttgtgttactgtgtaaggttttgctcccctagctgttcacgtctgtattgtctgcgatgtggttttgaga

SEQ ID NO: 2627 - DNA, 189 bp, Zea mays
  misc_feature: Incyte ID No: 700553015H1
  unsure 14, 30, 47, 60, 143, 184: a, t, c, g, or other
gtgtgctggtcttntagcacatttttctgntctttagatgttctccntgtctaaattctngattatgacagtgtgccactgtatcttattgcatcttataccatgcagttacctctgccatatctcaaagttgggtatttganggctcctccagctaacaattccattgcaccacacaaagatngggag

SEQ ID NO: 2628 - DNA, 282 bp, Zea mays
  misc_feature: Incyte ID No: 700553019H1
  unsure 248, 265, 268, 271, 278-279: a, t, c, g, or other
gtcggagggaaccgaaaactcagggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgtggacgaatccaccgtcagctgaagcaaaggactcaggcaaatggccgcgttggtgccactgcagccgtctanttgccgcatctggatantgnctncgggttnngat

SEQ ID NO: 2629 - DNA, 165 bp, Zea mays
  misc_feature: Incyte ID No: 700553020H1
  unsure 131, 164: a, t, c, g, or other
tagcatagagagatagcacaaccattggcatcaaaggtctacccaagacttcgaaatggagcttcatgaagctgagcttgctgtgagaccggaggatccaaaaatgataagtagaccaagatatgcggtantgaacaccgcaaaaggcccaattcctatagaant

SEQ ID NO: 2630 - DNA, 197 bp, Zea mays
  misc_feature: Incyte ID No: 700553022H1
  unsure 81, 187, 192, 194: a, t, c, g, or other
gtgtgctggtcttttagcacatttttctgttctttagatgttctcttgtctaattcttgattatgacagtgttcctctgtncttattgcatcttataccatgcagttacctctgccatatctcaaagttgggtatttgacggctcctccagctaacaattccattgcaccaccaaagcttgggaganatcgntngtc

SEQ ID NO: 2631 - DNA, 280 bp, Zea mays
  misc_feature: Incyte ID No: 700553025H1
  unsure 26, 212, 229, 239, 246, 257, 260-261, 266, 276: a, t, c, g, or other
caatcttcgcctccgctccgcccgcnccgacccagatcaggagctgagagatggacgccaacaggcgccaaggtgggattcagcagttgctggctgcggagaggaggctcagcaaattgtgaatgcggctagagctgctaagtcagcaaggcttaggcaagcgaaagaggggcagagagggaaatagccgaataccgtgcccagatggaggntgagttccagaggaagntcgcagagancatggtnactctggtgcnaanntaaantgtctcgagnaaaa

SEQ ID NO: 2632 - DNA, 276 bp, Zea mays
  misc_feature: Incyte ID No: 700553026H1
  unsure 4, 6, 14, 56, 83, 97, 122, 146-147, 153, 166, 174, 201, 206, 223, 228, 266: a, t, c, g, or other
cctncnccgtgacngctgtggctttggtgatagtgcatcatcggaggctgcaaganagaacattaaagaaggcagcattccanccaaatgatgtcangtccacaacccaaggaagcgaaagncgcaccgtgtgagctcttgaggannatgatncagacgtcttggngtggagtnacatgacattgaacggctgatggattntctgnggaaacccctatgctgnctgcnccgtgaccgctgtggctttggtgatagtgcatcatcgnagctggagaa

SEQ ID NO: 2633 - DNA, 194 bp, Zea mays
  misc_feature: Incyte ID No: 700553028H1
  unsure 30, 101, 131, 134, 147, 168-169, 177-178, 180, 193: a, t, c, g, or other
cccattcctgtgaacaatgctgttgctgcngcttcagaagaagtgctgaaatcagatgaagtgacagcagatgaggataacactacttcagcaacttcaanccaaaacaatccagtggtaccacaagttanagnagcgctgaaagcngacgaggataacagtgcttcnntacttggnncnaaaacaacccagng

SEQ ID NO: 2634 - DNA, 281 bp, Zea mays
  misc_feature: Incyte ID No: 700553031H1
  unsure 14, 35, 110, 121-122, 180-181, 222, 256, 269, 273: a, t, c, g, or other
cctgccgttgctancgccccgtacctcgcttgctntcccgtcgccgaaatgacgaagcgcaccaagaaggctggaattgttggcaaatatggaaccaggtatggcgctanttggcgtaacnnatcaagaagatggaggtatctcagcactccaagtacttctgcgagtttttgggaagtnngctgtgaagaggaaagcagttggaatttggggatgcaaggnctgtgggaaggtcaaggctggcggtgcttacacnatgaacatgctantcantcctgtcg

SEQ ID NO: 2635 - DNA, 257 bp, Zea mays
  misc_feature: Incyte ID No: 700553033H1
  unsure 37, 165, 187, 195, 200, 248-249, 256: a, t, c, g, or other
caatgagaaggaccgctgcccagggtgcaagggtganaaggtcgttcaagagaagaaggttcttgaggttcatgttgagaaggggatgcaacacaaccagaagatcaccttccctggtgaagctgatgaagcgcctgatactgtcactggagacattgtattcgncctccagcagaaggacactccnaattcaanagggngggtgaagatctcttctatgagcacaccttgtctctgaccgaagctcnncccgggnt

SEQ ID NO: 2636 - DNA, 199 bp, Zea mays
  misc_feature: Incyte ID No: 700553035H1
  unsure 181, 196: a, t, c, g, or other
gcccgatcacccctcttccggacctggtgaccatccataccccgaaggaggaggacgagctgcgccctcctgtcttggcagctgaggtctaaggtcccaacagcgtcctcgaaatggcagtttgatcgggtcctagctaggtttgatcttatgataagggcagtgctaagacattcgttcngtgtcacttctgttnaaa

SEQ ID NO: 2637 - DNA, 160 bp, Zea mays
  misc_feature: Incyte ID No: 700553039H1
  unsure 126: a, t, c, g, or other
aagaagcagaaggaagcactttcagctgcaaaaaaagaaagcagcagtgaggatgaagatgacagtagtgaggaaagttcggatgatgagccaacaaaagttgaagaaaagaaggctccaaaagtntcagaaaacagtggatcggaggatgaatcttctg

SEQ ID NO: 2638 - DNA, 172 bp, Zea mays
  misc_feature: Incyte ID No: 700553041H1
cagcgcaccatggagaaggaccccgagaagaagaagtaccccggcggcgccttcgacccgctcggcttctccaaggaccccgccaagttcgaggagtacaagctcaaggagatcaagaacggccgcctcgccatgctggccttcgtcggcttctgcgtccagcagtcgggta

SEQ ID NO: 2639 - DNA, 114 bp, Zea mays
  misc_feature: Incyte ID No: 700553042H1
  unsure 8, 14, 22, 26, 40, 43, 53, 56, 85, 103: a, t, c, g, or other
caatcttngcctcngctccgancgcnccgacccagatcanganctgagagatngangccaacaggcgatcaaggtgggattcagnagttgctggctgcggagnacgaggctcac

SEQ ID NO: 2640 - DNA, 278 bp, Zea mays
  misc_feature: Incyte ID No: 700553043H1
  unsure 66, 243, 269: a, t, c, g, or other
gggacagacaggccaggactgctctctgaggtcagcgctgtgctcaccagcctcaagtgcaacgtnggtcagcgccgagatctggacccacaacacccgagccgcggccgtgatgcgggtcactgacgaggacactgggctggcggtcacggacgccgagaggctggagaggatcagggagaagctgtcgtacctgttccgtggaggcaatctctctcgaggtgccacagtgtcgtcgaggantgccaccacgcacaccgagagagggntgcacaatt

SEQ ID NO: 2641 - DNA, 125 bp, Zea mays
  misc_feature: Incyte ID No: 700553044H1
  unsure 3, 8-9, 11, 25, 29, 43-45, 82, 120: a, t, c, g, or other
tgncattnngnttcttattcaagtngcanctcactccatatcnnnccaagagatgcgacttgaataagaaaccaatgacagnttttctcagatatggagtgagatgcagacagatttctngccga

SEQ ID NO: 2642 - DNA, 193 bp, Zea mays
  misc_feature: Incyte ID No: 700553045H1
  unsure 184, 192: a, t, c, g, or other
caggggttaaagggacttatccagtttcatttaccagttcctgtgaacaatctggactgcgaaatgcattgtgcacctcaaatcaacctggtgagtttcaagatactgatggcatggaacctgcatacatggaagccctgaactgtggtgattatgatgatctgattgacctaatggatagaantggaccant

SEQ ID NO: 2643 - DNA, 202 bp, Zea mays
  misc_feature: Incyte ID No: 700553046H1
  unsure 5: a, t, c, g, or other
cgtancgccgtcgccgcctcgctttctcctcttccgccccaccccggtgaggcgctgatccatcgcctcggacagcggctccagaacctccgcgttgcagttgcagtggttggggttggcttcgtgctattcagaaacacagtagcgagaactattcggtggggccaagatggtgtcgctgaagtgccaaagcgcctcgccg

SEQ ID NO: 2644 - DNA, 284 bp, Zea mays
  misc_feature: Incyte ID No: 700553051H1
  unsure 192: a, t, c, g, or other
gcaaagagctgagcgggacggagcagctagcgctagggataacgcacacccaccaccatggcgacgcccggagagcagccggcggaggtcgtgtccgtcgagatgcccgcacccgacgggtggaccaagaagtttactcccttgagaggggggagatctgagattgtttttgtttcaccaactggcgagganattaagaacaagaggcaattaagtcagtacctaaaggcacaccctggaggccctgctgtttcagagtttgattggggaactggtgatacccc

SEQ ID NO: 2645 - DNA, 279 bp, Zea mays
  misc_feature: Incyte ID No: 700553053H1
  unsure 103, 229-232: a, t, c, g, or other
agcaaccaccgcctccccgatctcgtcgagaggaagcccaatcccgaaaccgtcgccgtattccaatggcgcccaaggccgagaagaagcccgccgccaagangcctgcggaggaggagccggcggcggagaaggccacggcggggaagaagcccaaggccgagaagcgctccccgcgggcaagtccgcaggcaaggagggtggcgagaagaaggggaagaagaaggcnnnnaagtcggtggagactacaagatctacatctttaagtgctgaagcagg

SEQ ID NO: 2646 - DNA, 277 bp, Zea mays
  misc_feature: Incyte ID No: 700553055H1
  unsure 22-23, 87, 176, 178-179, 205, 229: a, t, c, g, or other
gtcttcatggaggagttcaggnngacgaagaacgcgctcggaggcctcttgggcttgttcttcgtcttcatggaggagttcaggaanccctacaaggagaagcaccccaatgtgaagcaagtctccctgattggcaaggctggtggtgacaattggaagtccctgtcgatgccgananngctccctacgtgtctaaggcagagangctcaaggctgagtacaccaagangatcgacgcttacaacaacaagcagttggagaccccacggcgtctggt

SEQ ID NO: 2647 - DNA, 277 bp, Zea mays
  misc_feature: Incyte ID No: 700553057H1
  unsure 271: a, t, c, g, or other
gttgggatcctcaagacaggctgcggcaactcgtacgccccatttcctaaaggttgcttctacaccacctccggtgggctgcagagcttcgagcacccgttgcacgaggtcaaaggcggtgccacgcgtggacagccaaggccagatgtgcggctccatcttcaaggtcgacagcgagagcaagaagaagcaggacgctagcatcccccgcgtcggcagtgctgccgactggtccaaccagttctgaccatcttcttgccatccattgtcncggtag

SEQ ID NO: 2648 - DNA, 272 bp, Zea mays
  misc_feature: Incyte ID No: 700553058H1
  unsure 263: a, t, c, g, or other
gtggccaaaaccggcatctgaggagagtgtgcacttgcaagttgataatgctgtagtgacgcctcgttctgagcttgttgcactctgtgaggaaatgaatgtgaaggggcttcataagttcatatccgacaacaggaagaacttggctgccatccgcgaggaaatcccagtgcactgaagaaaacatctcatccgtatggcttggtgttggattccctggaagacttctattctggagataatcttgtattagatggcaaaanggaggggct

SEQ ID NO: 2649 - DNA, 155 bp, Zea mays
  misc_feature: Incyte ID No: 700553059H1
ctcaaatggagacgctcagtgccgaactgataagattgtcttcaagctttttgacaaagttcccagtgatttacccccagttttgcggtcacagattcttggttggttgtcaagtagccctactgatatagagagccatattagacctgggtgta

SEQ ID NO: 2650 - DNA, 90 bp, Zea mays
  misc_feature: Incyte ID No: 700553060H1
  unsure 2, 17, 23, 34, 37, 40, 55, 65: a, t, c, g, or other
ancgaatccctcgcatngcattngcagcctttgntgnatnagaccatcgcgaaancccagcagcngcatacgatggcgcctaaggcggat

SEQ ID NO: 2651 - DNA, 230 bp, Zea mays
  misc_feature: Incyte ID No: 700553063H1
cctgcagttccttccagacctgcacccccaataacagagaagcaagcctctcctgcccccactccagttactgaggctccagctttctcccctaatcctcagagcggcggctttcaagatccagaagttgatgcacatgccatatatgtgcgaagtctgccattaaatgccacaccacaacaattagaggaagagttcaagagatttggaaccgtgcagatgaaacaaaa

SEQ ID NO: 2652 - DNA, 148 bp, Zea mays
  misc_feature: Incyte ID No: 700553064H1
  unsure 45: a, t, c, g, or other
cttatttatgagctaccactagcagagatggttggcgatttcttngatcaactgaaatcacgaagtaaaggatatgctagcatggaatattcagttgttgggtacagagaaagccaactagtaaagctggatatacaaatcaacgggg

SEQ ID NO: 2653 - DNA, 244 bp, Zea mays
  misc_feature: Incyte ID No: 700553066H1
  unsure 125: a, t, c, g, or other
tgatttttttagttggtggcagcatgcatcaaaccttgcaagctacgagcaacaggatgctcatgaattctttatttccatccttgatcatatccatgaaaatataaaggatgatcaacaaaagncatatccccaaggccatggggattgttgcattgctcacagagtgtttctggtatcctgaggtcagatgtcacctgcacaagctgtgggttcacatccacaacttttgagccctgtatgt

SEQ ID NO: 2654 - DNA, 227 bp, Zea mays
  misc_feature: Incyte ID No: 700553068H1
  unsure 117, 126, 225: a, t, c, g, or other
aggatctaattcgagcccatatgcttaatgtagatgaagaaaattacaaagaagctgtggactcttcatataaagtatcagtcactccaggaatcagtaatgagattcgtcagatanttgatgatnactctgccgaggtcaattcctcatcgtcagatttttggatttagtggctgctttaaaggagtttattgcaaaggagggcaacggtgagctacctctggngg

SEQ ID NO: 2655 - DNA, 132 bp, Zea mays
  misc_feature: Incyte ID No: 700553070H1
  unsure 44, 84: a, t, c, g, or other
ttatagcgtgtttgctttaatatatttgtttaacttcttggtanttacatatggtctagataaccacgcagttaaacaaatatnttatagcgtgtttgctttaaggaatgagaaaatacatcttctcaaaaa

SEQ ID NO: 2656 - DNA, 274 bp, Zea mays
  misc_feature: Incyte ID No: 700553071H1
agtgtttactgaaaatgatgggttttttgcttggatgtttctgaaaagaaggaccttgtggcagacaattctttcatttgtttggcctctttttgcactggcagtctgcttatttccagtttacccataccagtgcaagattgttgtactgtactcatgtgctgagctctacttttcattgtctccattcttttgctaagagctgctatctttggtatcctatgggttctccttgggaaacgcgtgtggttcttccccaatataaatgcggagg

SEQ ID NO: 2657 - DNA, 200 bp, Zea mays
  misc_feature: Incyte ID No: 700553074H1
cacaagagcttcgaaggaactcccaaggttgtcaagccagaaagaaacgttgggaatgagaatgctactaaagtctcaagcgcctttgctggcaccagagagaaatgtgttggatgcagcaagacagtctatccaactgagagggtcactgttaacaacactagtaccacaagagctgcttcaagtgctgccatggaggg

SEQ ID NO: 2658 - DNA, 232 bp, Zea mays
  misc_feature: Incyte ID No: 700553075H1
  unsure 203, 231: a, t, c, g, or other
gtgggacgactggaaggacgacaaccctcgcggcgctggcaacaagaagctcacgccctgtggctagactgcaaatcgaagcacgctcgctgtgtgatcgtacggtgtttgactcgaccagtatttagtttgtatctgacgatcagtgtatttattatataggtgcttctgtaacagtgtgtttatacaccatccactgcagntcttcacagaggttttccgaattaagtng

SEQ ID NO: 2659 - DNA, 197 bp, Zea mays
  misc_feature: Incyte ID No: 700553076H1
  unsure 38, 185: a, t, c, g, or other
tagaagactgtgaattcacctatttgtccactcagatncttcactttttgggaaatgaaggccccaaaacatcagatcccagtaaatacatacgctatatatacaatagggtgatacttgaaaatgctacagttcgagctagtgcagtcagcacattggcaaatttggtgccttggttgactcantcaagctcgcat

SEQ ID NO: 2660 - DNA, 92 bp, Zea mays
  misc_feature: Incyte ID No: 700553077H1
  unsure 2, 38, 46, 80, 90-91: a, t, c, g, or other
cnccaccaacaggcccgatgtgctggactccgacgctncctaacgnaccagggggatttgatatgcaggttcaccgtttnaacatgccannt

SEQ ID NO: 2661 - DNA, 278 bp, Zea mays
  misc_feature: Incyte ID No: 700553079H1
ggactagttctagatcgccgacgcctacttcggcctgcttaaggtcggtcccgaaggcgggctggccacgccgctcgcaacggaggccgagggcgtgcgcctcaacttcaccaacgacctcgatctcgacgacgagggcaatgtgtattcacggactccagcatcactaccagagacggaatttcatgcagttagttttctcgggggatccctctgggagacttctgaaatataacccacagacaaaggaaacgacagtactgcatcgcaacctctat

SEQ ID NO: 2662 - DNA, 230 bp, Zea mays
  misc_feature: Incyte ID No: 700553081H1
  unsure 162, 224-225: a, t, c, g, or other
accatcttcagatgtcagcaagagcatgtgtttagacctttctgtgaaggataattctgccaaacccccacggaggcactcaatacaaaccaagccaggagctagcccaaggccaacaccttctggaactgtgactccggtgtctggggttcggtcaaagangtcggaagccaggggaggtttgataccccgacatcagaagtgtccatgtccatctcaagggnngttct

SEQ ID NO: 2663 - DNA, 167 bp, Zea mays
  misc_feature: Incyte ID No: 700553082H1
  unsure 141, 157: a, t, c, g, or other
tggtggattggcatctcttatcttctgtggctatatcatctatgacacagacaatatcatcaagcgccacacatatgatcaatacatatgggcagctgtttcactctacctcgacgtcatcaacttgttcctgtctctgcngcagctgctgagggcngccgatagtg

SEQ ID NO: 2664 - DNA, 87 bp, Zea mays
  misc_feature: Incyte ID No: 700553083H1
  unsure 16, 20, 23, 29, 47, 51, 57-58, 61, 69: a, t, c, g, or other
cggaccccggcgtgcncacngtnctcgcncaggacggcgtacagggnccancatgtnnagnaccaggangaggaccggcaaaatgct

SEQ ID NO: 2665 - DNA, 155 bp, Zea mays
  misc_feature: Incyte ID No: 700553084H1
  unsure 146, 153: a, t, c, g, or other
gatgaaatggcagggcttgctaagtgatacatcaaatgctgaatctggatctgatgttgatgattttggtgcatcatttgttcataaagtttctgactatggttgcttgactccagttcatgaggaagtaaagggcacagatcgtntgacatnct

SEQ ID NO: 2666 - DNA, 273 bp, Zea mays
  misc_feature: Incyte ID No: 700553086H1
  unsure 102, 183: a, t, c, g, or other
acgctcgtcacccgcaccctcgagaagaagggcgtcctcgccaagattagggctgagctaagagcaagcgtgtttgaagccattgaagaggaggatcgggtngagaatgatgatggagggaaccctgctttgcttggtagctgtaatgaccgagctaagcaatgcatgcctcaccttcagggnggttactaactgcacttgtatgcgaatacttggagtgggcgcaactaagtcacacaatgaaagtttacttgccagagtgtaacctgccca

SEQ ID NO: 2667 - DNA, 268 bp, Zea mays
  misc_feature: Incyte ID No: 700553087H1
  unsure 82-83, 167, 222, 248, 253, 255, 260, 264-265: a, t, c, g, or other
aaaagaaccgtgtgctctgctcgactcaactagcttttctccattcctcaaggctgcaggggtcggaggcagtgatgggatnngtcagtactttactgacactgcttggtgcaccatgcatgagaactttgatgtctcatgtagtagtcatgtctgcttcgcttgtngtaattctatgcttcagttcggatgccaggatgtaatacgagtctacgactctangagacaacataaggctgtctcaaaantagcngnaattntgcnnaaa

SEQ ID NO: 2668 - DNA, 167 bp, Zea mays
  misc_feature: Incyte ID No: 700553088H1
  unsure 152: a, t, c, g, or other
taaagcgtagaagaattggtgaaatcatggattcatctgcaatagactcacctggcaaaaacaaggacaccatattgccaggaaacaataccccacctagttctcatcaaatatcagttgaagatacatggcaggaactagagcgaagaatnttcatgccacacaaa

SEQ ID NO: 2669 - DNA, 233 bp, Zea mays
  misc_feature: Incyte ID No: 700553089H1
atgcaaaggagttgcacactgccatagccatggtgtccttcaccgggatttaaagccacaaaacctgctggtggacaaggagaagggtatactgaagattgctgatcttggactcggtagggctttcactgtgcccatgaaaagctacacccatgagattggaccctttggtacagagctcctgaagttttgcttggagcaacacattactcaactggcgttgatatgtgggt

SEQ ID NO: 2670 - DNA, 210 bp, Zea mays
  misc_feature: Incyte ID No: 700553090H1
agaaggctgaggagctcatcaggatgggcttgcatccaagtgagatcatcattggctacactaaagccatcaacaagacaattgagatcttggaggatcttgttgagaaaggctcagagaacatggatgtgagaaacaaggaggacgttgtgttgaggatgagatccgctgtcgcgagcaagcagtttggtcaggaggatataatgtgcc

SEQ ID NO: 2671 - DNA, 129 bp, Zea mays
  misc_feature: Incyte ID No: 700553092H1
acctgaactatgcagctccatagaactgtgtacttgtagttcaataggactggagatagaagacccaaaagaggcgggattgtgtggtaattctgatgctgggtttccatcgtggcttgctcaattagt

SEQ ID NO: 2672 - DNA, 276 bp, Zea mays
  misc_feature: Incyte ID No: 700553094H1
  unsure 33, 51, 152, 186, 201: a, t, c, g, or other
caaaaagaaaaattaaatgaattaataggagcnattcatgagaaggatganctcttggatagccaagaggaattccttattaaggaaaacaaaaagcatgttaaggcgaaaaatgcttatgctcaggaagtagagaaatgtgaaaaattaanctagtgagcttgaattttccatgacactatctcnaaccttagaattganaatgccaaattaattgctaaggttgagaaattaaatgcttgtgatgattctcttgtcaaccttaagaatgataat

SEQ ID NO: 2673 - DNA, 277 bp, Zea mays
  misc_feature: Incyte ID No: 700553095H1
  unsure 174: a, t, c, g, or other
acgtaagtgggacaagaggatgctagaatttgttcaacacgtggataaacccttaatctggtgtggggacttgaatgtcagtcatgaagaaatcgacgtcagccatcctgatttctttagcagcgctaagctgaatggatacaccccacccaataaagaggacgtggatggccnggattcaccccagcagagagacggcgttttggcaacatattattccaaggaaagctggtagatgcttacaggcacctgcacaaagaaaaggacatagacggtg

SEQ ID NO: 2674 - DNA, 131 bp, Zea mays
  misc_feature: Incyte ID No: 700553096H1
  unsure 29: a, t, c, g, or other
gagaccaaggccctgaattcctactcggnggcgattcagaacaccctgaagctgggttacaaggccgggatggccaaggggcttggcatcggctgcacctatggaatcgcctgtatgtcatgggcgtggtt

SEQ ID NO: 2675 - DNA, 283 bp, Zea mays
  misc_feature: Incyte ID No: 700553103H1
  unsure 234, 261, 265: a, t, c, g, or other
gaggagtggggagttcccgtgcacaatgataggagattgttcgaactacttgtactatctggtgcattagctgagcttacgtggcctgaaattctcaagaagaggcaacttttcagggaaattttcatggagtttgaccctgctgctgtctctaaaataaatgagaagaagcttgtcgcacctggaagcgttgcccattctcttttatcagagcaaaagctccgtagctgtacntgagaatgctcgccagatactaaagancgcngatgaattggatccttga

SEQ ID NO: 2676 - DNA, 289 bp, Zea mays
  misc_feature: Incyte ID No: 700553104H1
  unsure 69, 77, 157, 179, 189, 226, 232, 250, 284: a, t, c, g, or other
gtaactgccgcatctcaagtctcaaccctcgcctccaatcgcaacgctcccgaggagagccaggaggangtgacggnggcgcgcgaggaaggagggatcgatcgaggatggtggacgtctcgcgcgtgcagaaggagctcaccgagtgcaaaccgcnaaccggagaggtatcgggcgtnctccatcgcnctaccacgacggcgccaacatctcccacctcaccggnaccatngccgggtccgccgacagnccctacgagggcggcacgttcgtcatcgatatcngcctg

SEQ ID NO: 2677 - DNA, 278 bp, Zea mays
  misc_feature: Incyte ID No: 700553107H1
  unsure 34-35, 40, 184, 196, 210, 213, 224, 235, 241, 250, 255, 264, 269: a, t, c, g, or other
agtgcgtacaagaggcccccgcgattttggccgnnatggnttcagacgatatccaagaaggtatggtagagatccatactgggacagaagggacagggaacggagctatgatcgtgaaagagatccctaccatgacagggatagtgatagatcccgtgagcatgatagaggcagagattatgancatggtggattnaatagagaaattgnctntcccatggacngactcgtgaangagatnagagacgtnctaanagcacatgntcgtncagcagaaa

SEQ ID NO: 2678 - DNA, 271 bp, Zea mays
  misc_feature: Incyte ID No: 700553108H1
  unsure 25-26, 67, 164, 183, 218, 230, 242, 258-259, 265, 270: a, t, c, g, or other
gagctggcagaactaagacaactgnngatgatgttgtagtcgaggaagtcacagaacaagagtcctncgactacaacatcatcaagagctggcagaactaagacaactgttcctgttgccccatcatttgtgtgtgctaaccgtgctgacaagaggaaggaganctacacaaaattagagganaacataaagctttggaagcagagaagacgagctgngccaggaaaagnacgcaaacgtgncataagccccaagggnncatggnggatna

SEQ ID NO: 2679 - DNA, 274 bp, Zea mays
  misc_feature: Incyte ID No: 700553109H1
  unsure 216, 222: a, t, c, g, or other
aacaattacctcattaaacgatgtcaacctatgtgatatatagaaactatagcaatgcactggcatctaaaaatgcaatggtatgcaattctacatatttgagaaaaaatgttggacatcaacatgtaagaaactagatagctttaatatgtttgttctattatccctaagacatttgcgctaattgtttattactccgctattaatttttaaaanggactntaaaattatcatccagacaaggttataattattttccagtcaatgtttttgg

SEQ ID NO: 2680 - DNA, 182 bp, Zea mays
  misc_feature: Incyte ID No: 700553110H1
  unsure 148, 150, 157-158: a, t, c, g, or other
attcccatcttctcgtcctcctcttcctctccatcctccttcctgtgacaagtggcgcgtcccgcaggcgttccgagaagaagcagttccaacccgatgcgggagatcaaggtgcagaagctggtcctcaacatatccgtagggagancngggaacnncttcaacccgcgccgccaaggtgc

SEQ ID NO: 2681 - DNA, 177 bp, Zea mays
  misc_feature: Incyte ID No: 700553111H1
gactagttctagatcgagaaccagcatgtcgatgctcttgaggttctactccagggactctctggtgtcccgaaagagcgttttagggtgcatgagctctgccttaaaagtgggcccaatctaggtgttgtcccatcggaggttcgtttgttgtgtgacttagctcagcccacacca

SEQ ID NO: 2682 - DNA, 178 bp, Zea mays
  misc_feature: Incyte ID No: 700553112H1
  unsure 26-27, 30: a, t, c, g, or other
gagctgggcagaactaagacaactgnngangatgttgtagtcgaggaagtcacagaacaagagtcctcgactacaacatcatcaagagctggcagaactaagacaactgttcctgttgccccatcatttgtgtgtgctaaccgtgctgacaagaggaaggactgtaccacaaaattag

SEQ ID NO: 2683 - DNA, 176 bp, Zea mays
  misc_feature: Incyte ID No: 700553113H1
  unsure 156, 159: a, t, c, g, or other
aacaaagacatgcgagtaccagacatgtgcaactctagtagtatggtgcgtgttatcactaggcacgcgtactcgtatagttgtgttcagttctgggtctatagagatatgtagccctgcattatcgaaataaatactgtgtccactcgttcgtgnaangaaaaaaaaggctgatg

SEQ ID NO: 2684 - DNA, 274 bp, Zea mays
  misc_feature: Incyte ID No: 700553114H1
  unsure 187, 268: a, t, c, g, or other
acatcttgtaaaacatttatttcaatctgcttctgcgctccggaagggattaaggttttctttggcagcggcagctttatatgaactcaaagaactttgttttcacagagatgagagcactatgacaaatacctatttgcttgcacggcttgaagacgctaaattgctcagagctcaagggcagcantgatatggctattagtcttggaaaatacatactacagaagctttctgacaagaaaaacctgtcagatgtctatcgattatngcaagt

SEQ ID NO: 2685 - DNA, 275 bp, Zea mays
  misc_feature: Incyte ID No: 700553115H1
tacaagctggtggagtagctagcaactcgagggatgaattgaagactagatgataggcttctccttctgatgtgccaccgataaaactgcagctagctagcaccttgttgccaagcaatgcaagatctctctgctgagatcgatctgaatacctaaaatatctatccggccggtcatcagctcgatcttaagcaggataacaagatggcagaaacattcgacgtggtttcagtgcacggccgtcagttcaaaatggcgacttcgcctctagcaaa

SEQ ID NO: 2686 - DNA, 183 bp, Zea mays
  misc_feature: Incyte ID No: 700553116H1
gcgtggccgtgggttttcatcgacgaacgacgacgactctgccgcgcgcgtttaggcgcgttcgccgccggccacccggccggccacttcgacgcggctgtggtggtttaaaattctccggctcgccgcccacggcctcgctgcacgtagttgcagatcaagctctctcacgagggtttaatt

SEQ ID NO: 2687 - DNA, 280 bp, Zea mays
  misc_feature: Incyte ID No: 700553118H1
  unsure 214, 227, 256, 268: a, t, c, g, or other
agatgggggatctaagatttcactgaagtaaaaacacgtgccaaggcacgaccacggaaaaggagattttggtgatgttatcatctttgtaggaacaattctatgaagtacagtaaaaatagactaaaaacaggtagaacgagtataaaaatatattgaagaattatgtaaacattacgaataaaggagttgagttattacatgcacctatggnttatagtcgccanatttatttgccacgtcacccttcctccantctgtcaaaaanccagttcctgac

SEQ ID NO: 2688 - DNA, 185 bp, Zea mays
  misc_feature: Incyte ID No: 700553119H1
  unsure 24, 150: a, t, c, g, or other
aacaaagacatgcgagtaccaganatgtgcaactctagtagtatggtgcgtgttatcactagagcacgcgtactcgtatagttgtgttcagttctgggtctatagacgatatgtagccctgccattatcgaaataaatactgtgtccacncgttcgtgaaatgaaaaaaaaggctgatgctcgac

SEQ ID NO: 2689 - DNA, 277 bp, Zea mays
  misc_feature: Incyte ID No: 700553120H1
  unsure 141, 187, 193-194, 197, 258: a, t, c, g, or other
gaacgacgaggagattgcttggtgggaggagttggtgaggagaggtcgcgaacatggagaaccttgctctgctttggggcatcatcggcccgggcgtatccggcgccatcttcggggccggatggtggttctgggtggacncggtcgtttgcagcgctgtccaggtctccttcctccactaccttcnaggganntcnattcatggcggcgctcatgttcaatgcgtgaacaaggatgagatcggatacgactattacncaccctacggggacgatca

SEQ ID NO: 2690 - DNA, 287 bp, Zea mays
  misc_feature: Incyte ID No: 700553121H1
  unsure 169, 229, 254, 257, 267: a, t, c, g, or other
tcaatgtcgctgaggcaacaattacaagatcctagaagaaaacccgtggcagctctacactacaataagggtgataaatatgtctcgcccaatggaaggcgcgaggatgctgcagcattcgaacagtgccaacgagctgctcttgcgccggaagctggaggagcagcancaggctgccgaacttcagcacgccattgagctccagagccgccgcctcatggatctccanctgctcggcctcaaggctcgcgcantgncgacagcagnagcggcatcggcatgccaac

SEQ ID NO: 2691 - DNA, 279 bp, Zea mays
  misc_feature: Incyte ID No: 700553122H1
  unsure 100, 152-153, 190: a, t, c, g, or other
aagaaagtcatacacatacacacacgcatccgcagcactccctcctcggtccctcctactgcttcacacagaccagtgcgcgctcaattcccccctctancgcctccaccgcaccaaaccggtccaacgggacctatgctctagcctcagannaaaccaccgcctgaattgtgcggcaattgggggaggnttcacggcaggcagggcgcggatccgttggcgggatgattgcggctgtcaacagagtgccggcgggctggggcgaggatgagatgtcct

SEQ ID NO: 2692 - DNA, 277 bp, Zea mays
  misc_feature: Incyte ID No: 700553123H1
  unsure 59, 82, 110-139, 156, 275: a, t, c, g, or other
gatccgtgttccgtgtccgcgtccagtgtgtccgctactccgctccccctcagtcctcngttcctcacctagcggtagcgtngcgcgcgggagacgtagatggcggcttnnnnnnnnnnnnnnnnnnnnnnnnnnnnnntgacgccgacagagcgnccggtgatcgcgatccacagcctggaggagtggagcatccagatcgaggaggccaacagcgccaagaagctggtggtgattgacttcactgacaacatggtgtcctccgtgccgcgccngg

SEQ ID NO: 2693 - DNA, 281 bp, Zea mays
  misc_feature: Incyte ID No: 700553124H1
  unsure 91, 125, 132, 147, 270: a, t, c, g, or other
caccaatagagctgtgtactataatgatagatctcctccggctgaattgaagcgagacatgccggtgggaactgaagctgccagctaccgnctccccgtttcagctccggacgctgctgcggcantgcagcnacggcgggaaaacangcccctcctggatatgtgcttgcccagatgcatgcgccttccgccaccgcagcaacctccaccacagcagcaaccacaacagccagctccttcagcagattgttgctgctgggaattcaacanttcatccacaa

SEQ ID NO: 2694 - DNA, 272 bp, Zea mays
  misc_feature: Incyte ID No: 700553125H1
  unsure 78, 166, 185, 242, 248, 263: a, t, c, g, or other
ctcaaatcttccgggatatcatatgaagttcacatataccctggatgttcgcatgccttcatgaacacttcgcctgangcactcaagaggaagaaggggatgggtctgactgatgagaaccaggaagccgtcgacctggcctggtctcgcttctcttcttggatgngccggttcctcggatctgnttgattatgtgccgcgtgagatgtgtggagtcaggtcccatgaataaaatagaatanaataanatgttcagatcaggnaccatgcaa

SEQ ID NO: 2695 - DNA, 270 bp, Zea mays
  misc_feature: Incyte ID No: 700553126H1
  unsure 2, 8, 165, 228, 267-268: a, t, c, g, or other
gncttcancttcagaccgtttttcgttcgaggcagtgcttggcactgaaacatggatgaaccggacgacgacccatggtatcctatccaggggcaatcgaatataaattttcttccggcgtggccaagggaggtgccgagtctgtaccagtacgacgactcaggncagaacacacggcgtatggtatggtacacagcaaggccgtgttgttgctgtaattttgtaatnactgtttccttctcggctcgcagcatgcgttgctgtatnnga

SEQ ID NO: 2696 - DNA, 272 bp, Zea mays
  misc_feature: Incyte ID No: 700553127H1
  unsure 169: a, t, c, g, or other
ggattcatgacaatgagccattgatttctaaagttttccaagctaacctatttgctttgtaggcaagaaggtgagcaaggcacctaagatccagtgcttgtgaacccttgaccctacagaggaagcacactagaatcattgacaagaagattgccaagaagaagtctgnggtgttcgagtaccaaaagcttcttcccataggctgaaggaatagagaccgccacaacgagagcttggccaagagaagatccagctttctacctctgccaagg

SEQ ID NO: 2697 - DNA, 102 bp, Zea mays
  misc_feature: Incyte ID No: 700553128H1
gggaacgtgtcgttttttgtcaaagcggttcctgtgctgtataacatgttgcatgagtattggcgcaacttataagacaatgtcaaatgggtttttgggagt

SEQ ID NO: 2698 - DNA, 269 bp, Zea mays
  misc_feature: Incyte ID No: 700553130H1
  unsure 264: a, t, c, g, or other
cccagcacggggtgactgctcctgccggaatccacaacctgttctccttgataagcaagaggatagagatgaaggggttcatccagagcgattacgtgcacctgttcccgcagttcgtcgatgacatcaccaggcattacagagacgggaagatcgtgtatgtggaagacatgagcgttgggctggagagtgggccggcttcctcgtcggtctgttcagcgtaaaagttggccagcaggtcgtcgtgtgtcgcgaggttgaaancctgg

SEQ ID NO: 2699 - DNA, 150 bp, Zea mays
  misc_feature: Incyte ID No: 700553134H1
  unsure 3, 5, 7, 11, 13, 29, 38, 67, 71, 79, 81, 84, 88, 94, 103, 127, 132, 149: a, t, c, g, or other
ggnanangatnangatgctgaaaaccaanaagatgatngtggtgatgagggatacagatgccaatgngaangaggaggnanatnacgncgacgntgatcacgntcctgcagccaacggtgaaggagnaagtnacgacgatgatgatggng

SEQ ID NO: 2700 - DNA, 282 bp, Zea mays
  misc_feature: Incyte ID No: 700553135H1
cccgatccttcttccaccacctcaccggtggtgtcagggccggctcgcggacggtgcttggactgcccccgtcccgtcatggatcgcgccgagctcaccaccgaacaggttctgaagcgagatattccatgggagcattacatgtcaactaagcttatctccggaacgtgccttcagcttttacggcgatatgaccacaaaccggagagccagcgagctcctttgcttgaggaggatgggccagcatatatccgagttttcctgaatatcctgcggagcatc

SEQ ID NO: 2701 - DNA, 181 bp, Zea mays
  misc_feature: Incyte ID No: 700553138H1
  unsure 126, 149, 152-153, 155-156, 163, 169, 172: a, t, c, g, or other
ggagcagggagcgtggcaaccaatctagcacaatgtggcacttgcagcgccgtgttcagtggtgatgataaagaaatggcaaactgccaaggttgagcatgtgagctctggcgcttactcgcacantcgttgcaagtggtgaaaatggncanncnnccaatantggctntgnaggcagctg

SEQ ID NO: 2702 - DNA, 273 bp, Zea mays
  misc_feature: Incyte ID No: 700553139H1
gacggacacagattgttcaagtttaataaagtgtttagtccatttgcttctcaagctgaggttttttctgacatacaaccactaatccgatcagtcctggatggattcaacgtttgtatttttgcatatggtcagactggttctggcaaaacttacaccatgagtgggcctagcacatcgaagcaagattggggtgtcaattatcgggcttaaatgatttgtttgatatttcactaagtagaagaatgcctctcatatgaggtgggtgtacag

SEQ ID NO: 2703 - DNA, 276 bp, Zea mays
  misc_feature: Incyte ID No: 700553140H1
  unsure 153-154, 158-160, 231, 242, 259, 263-264, 269: a, t, c, g, or other
aacaagggagcttgtgcaagatttgcatttgctgctgcgatttttggtgatttccaagaagcacttttctggctacagctgcctcaagctcttcgccacttcctgggtaaatcaacaagtagatcaagagagaagatctcacaatcaagtttnnaccnnnttctgaacaaagctccagattaatcggatagcttcaagagagagatctgctctgaaaagttcacggaaaantgctgcgattntgggccattaagcccangggnntttancccaagg

SEQ ID NO: 2704 - DNA, 279 bp, Zea mays
  misc_feature: Incyte ID No: 700553141H1
  unsure 213, 274: a, t, c, g, or other
accctcacccctcatcaacccaagccgcaagcaaaacccgcagcagagaagaggagaggagtcgccgcgaccgagagctccagagcacgcccccggcacagcctccgacgatggatccgaagatgacagaggtgacccagatgttcgcccgcttcaaggcggcctacgcccgcaacgacctcaacacctgcgtcaccctcctcttcgcagctncaaggtccatcttcacccattccccagccttccgccttgttttcagcagacaccggaacantgtgg

SEQ ID NO: 2705 - DNA, 274 bp, Zea mays
  misc_feature: Incyte ID No: 700553145H1
  unsure 155, 158, 162, 269-270: a, t, c, g, or other
aggaaccctagcggagcactgtgcaggcgaccgcggcgcgctatcacttacggggggatacggcggcatcgtccccctcggcccctcctccatccctggtgcggcggcgccagcctgcaggtgttgaatgctgatttgttgtggctgattaatcncanctgntgttcgattaatcgtgattagtcggctgatcgcccttctggcgatcagaaacgataaggcaatctgaaaacattggccgccaaactccagagcggattcccgggganncgtg

SEQ ID NO: 2706 - DNA, 272 bp, Zea mays
  misc_feature: Incyte ID No: 700553146H1
  unsure 129: a, t, c, g, or other
atcaagaaatggaaggtgatctacacagatgacgaggacgatatgatgctggtcggggacgatccatggagtgaattttgcaggatggtaaaaaggatatacatttattcctacgaggaggccaagtcnttgactcccaagggcgaactgccggccatcggtggtgacaccggcgtcaagccggacccaagcaaactgccaccagaatctgacgtgcccacagagcgactccgacaacagtgctcccgttgctgctgataggatgatggacg

SEQ ID NO: 2707 - DNA, 273 bp, Zea mays
  misc_feature: Incyte ID No: 700553147H1
  unsure 268: a, t, c, g, or other
acgcagcacacagaacatgctcgctgatactcaactaagtcagtccaggattaaggatgctctaatgcgcaaaaggatcactggtggagttctcaatagtaatagcttaaggacactaaaagacaggagagatttgttttacccattttctcatatcttgcacaattcgaaaccagttgggcatcaggatcttgttggtttggtatccccatactgctttcttgcagatttcagcttagttttgcttactttctccagctgtatcatntctag

SEQ ID NO: 2708 - DNA, 284 bp, Zea mays
  misc_feature: Incyte ID No: 700553148H1
  unsure 164, 190, 274: a, t, c, g, or other
acgcattctctgaaggcggtcgacatctctctcaagatcgacaccgagctcgctcttcaggttggaagacgtacaaatcgtgcttgactccaccgcgttacgttgtacaagcgttgcccacatatgcaagatgatagagagacggggacgggcgttgcaaaatncaacttaaataacgtagggcctagtnctgactaatatagtattgaacccaatccacatgtgctgaggtggattagggtcagttactagagtatccaaacaaagccttatnaggtgtttgg

SEQ ID NO: 2709 - DNA, 281 bp, Zea mays
  misc_feature: Incyte ID No: 700553149H1
  unsure 165, 172: a, t, c, g, or other
ctagcatccgcagttcccccgcgcccgagacgcaaccccgcgccaggagtaagtttgttcttttatcgatattatcgatatggcgagggaggagaatgtctacatggccaagctggctgagcaggccgaaaggtatgaagagatggttgagtatatggagaaggnggctaanaactgtagatgtggaagagctcactgttgaggagcgtaacctcttgtcggtcgcatacaagaatgtgattggggctcgccgtgcttcatggcgcatgtctctctattgg

SEQ ID NO: 2710 - DNA, 269 bp, Zea mays
  misc_feature: Incyte ID No: 700553152H1
gggaggtttttttgctgaccagtttgagaatttggcaaactattcgagcacattatgaatgtactggtcctgagatttggaaacagactaaaggtaacctgcatgccttcgttgcagcagctggtactggcggtacaattgccggagtctcacgatatcttaaggaaaagaacaggagcatcaaatgttttttaatggaccctcctggatctggtctgttcaataaggttaccagaggggtgatgtacacaaaagagaggccgagggca

SEQ ID NO: 2711 - DNA, 281 bp, Zea mays
  misc_feature: Incyte ID No: 700553153H1
gaagatttgagcaaaatgtacttcagtgacttcaagatgattgacatcaatggatatgcatgctttctgacgagaactggctacaccggcgaagatggttttgagatctctgttccgtcagagaatgcagtggatcttgcagaggccatcctagagagatcggaaggcaaggtgcgggctgaccggcttgggcgcccgtgacagtcttccgactggaggcaggcctgtgcctgtaacggcaacggacatggagcagcacatcacgccggtggaagcccgcc

SEQ ID NO: 2712 - DNA, 275 bp, Zea mays
  misc_feature: Incyte ID No: 700553154H1
  unsure 264, 267: a, t, c, g, or other
cctgacaggaaagcctgttattgtcaaactcaagtggggtatggagtacaagggttatcttgcttctgtggactcatatatgaatctccagcttgccaacactgaggagtacattgatggtcaattctctggaaacctgggagagattctgatcaggtgcaacaacgtcatgtatctccgaggcgttccagaggatgcagagatagaggatgcagagtgagaagatgcgatcaatgttaggttgataaatgtaatatggttctnacntctatgtt

SEQ ID NO: 2713 - DNA, 250 bp, Zea mays
  misc_feature: Incyte ID No: 700553155H1
  unsure 191, 204, 213-214, 222, 230, 240, 245, 247: a, t, c, g, or other
tggtgacgacggactgggggccgatcatcgtggcggtggtgctgttcatcctgctgtcgccggggttcctgttccagctgccggcgagggtcagggttgtggagttcggcaacatgggcaccagtgcgcttcgccattcctcgtccacgccatcctctattctgcatactcaccatcgtggtggtagccancggcgtgcatgtntacacaacnnaaccgganccggggantaattgaaanttccngngtg

SEQ ID NO: 2714 - DNA, 276 bp, Zea mays
  misc_feature: Incyte ID No: 700553156H1
  unsure 47-48, 56, 58, 71, 87, 123, 154, 174, 267: a, t, c, g, or other
gctgatctgctatcccaggcagaacatggtccagatagtcaggttgnnctagttgntnctggagacggtgntgatctgggtgccatngaggcagaagttagcaagcagtgcaacgcgcttccnaggaggtgattccgcctcaaaagcacttagnccacagctttcactgtgttncgcgaaagatatggttgaggcgatatcattctcaaatctgtatgcccctgagcatttgatcatcaacgtaaaggatgctgagcagtgggaganttcatcgac

SEQ ID NO: 2715 - DNA, 270 bp, Zea mays
  misc_feature: Incyte ID No: 700553157H1
agctgagactgtatgtcactattatatgaggcaaaagatcattcggcgcgagaatttttcagaagagaaatggaaaaagatatactacttatcaaatggaaatggtgcagagatgagatggcttgctgcctttgtttgagtttctgatacctggattgtactcagttttggtggtggtgtagaaaggttgccacctctgtttcagcatccgttacacaccacagttcatgttgtgtacttgtagtccgtctctggacacctctagaagaa

SEQ ID NO: 2716 - DNA, 272 bp, Zea mays
  misc_feature: Incyte ID No: 700553158H1
  unsure 241: a, t, c, g, or other
accttgggggttcattttgtgttgttgggttggatggggagaagtgtcgagcacatggtgcttgcagtttggtttgttcgtgttgacaatttctctgtggggcgttgcagggaagatgggggtcgaggagaggcaggcgcagaagagctcctaggaggagcatcccaagaacctcatcgtccgatgccatgatgctggactcccgcgctgttcaatctcgacaaggggccacctgtcgctnctggacaaggggctgccctaagaatgaaagc

SEQ ID NO: 2717 - DNA, 268 bp, Zea mays
  misc_feature: Incyte ID No: 700553159H1
  unsure 154: a, t, c, g, or other
gctccgcagatattcaaaagcacgctctggtaatagtgttacatcgcaaaatgatgttaaccaagcatataagccaccaaatatcgaaatgtatgaaaaacgtgtccaagaactgacaaaaacagccgaggattctcagaagaaagcagatcantgcgagaagatttacagttgaagacaaaacaagaaacagagatgcaagaagagttggaagggctaagagatacttgcatctgaacgacaagttccaaagacataaaaaatgagc

SEQ ID NO: 2718 - DNA, 273 bp, Zea mays
  misc_feature: Incyte ID No: 700553162H1
  unsure 88, 189, 238, 243, 246, 255, 260: a, t, c, g, or other
cataggttctccgcgacgcgccacctccgccaccgccagcgccacctgctagggtcaacacccgctctctgcggactgcgtgagcgtnaagcaccagcggcggccaccgggcaggacgagccccctccccaaacagagagggccggggatcagtgcgtgcgctcctggtggagggcgtggaagagcttnggcagggcggccagcaggggtttgggaggatggtttcgctctcgattgnttccnctntaccggcanaaaanttcgagtatgcgt

SEQ ID NO: 2719 - DNA, 114 bp, Zea mays
  misc_feature: Incyte ID No: 700553163H1
  unsure 85-86, 88, 91-93, 98, 105, 107, 109-112: a, t, c, g, or other
atatgaccgtgccacaggcacatcaattacatcctcactatagtagacctctctgatgtcagaagcatgtatttttctgtgcacnnangtnnnaccgngccagtngngnnnnca

SEQ ID NO: 2720 - DNA, 259 bp, Zea mays
  misc_feature: Incyte ID No: 700553166H1
  unsure 23, 40, 174, 226, 251: a, t, c, g, or other
aagctctcaagtctcccctgatnggattgtttgagaaganaagagctgggacattcttcctttatgtccaagattataaggaaaatgacccaagtactcataagggttacaaccttactaaactaacgacaaaagaacttatctcaaaatatggtttggaggataatacgatanacttcattgggcatgcagtggcttctcatagagatgatagctacttgacagnactgcccttgacatgtaaaacggtnaacccttt

SEQ ID NO: 2721 - DNA, 278 bp, Zea mays
  misc_feature: Incyte ID No: 700553168H1
  unsure 159, 164, 205, 211, 220-221, 267, 275: a, t, c, g, or other
cgtggactccgcggaagggatcgcctacctgcaccacagcgcgacgccgcacattcatccacagagacgtgaaggcgagcaacgtgctcctggacgccgacttccaggcgcgggtcgccgacttcggtttcgccaagctggtcccggacggcgcgacgnacgtnaccaccaaggtgaaaggcacgctggggtactggcgccggantacgcntatgctcgnnaaggctccgagagctgcgacgtcttcagtttcgggttcacgctgcnggagtggncag

SEQ ID NO: 2722 - DNA, 278 bp, Zea mays
  misc_feature: Incyte ID No: 700553170H1
  unsure 7, 20, 33, 56, 58, 75, 94, 103, 111, 121, 124, 129, 141, 159, 172-173,: a, t, c, g, or other
gtaacanctcaatgacttgntcataatgtcttnacaagcattaccaaataacagananaacacaaccactataanttaacataatgtaacctancaaaattanctctccgnaagctaatgngcngtttnggaagaagaganatcttgggcccgagcagnctgatttgcccgnnggannaacccnagacaatccccccnttccaagcacgcttatcnaancatcaaccctaacatattncaggcactgacttaattccacagcaggaatcaaggtttgc

SEQ ID NO: 2723 - DNA, 272 bp, Zea mays
  misc_feature: Incyte ID No: 700553171H1
  unsure 149, 185, 220: a, t, c, g, or other
aaaggacaaaaggagggcatttcttaaaatctgcagcaactttaggcctgtgatgcaccacttctttcttgaaagattcttgctgcctgctgattggttccaaagtagacttgcttacacaaggagtgtagcagcaagctcgatggtangatatatagtcggtcttggggatcgccattccatgnatattctcatcgaccaagacacagctgaggttgtncacattgatctggtgttgcatttgaacaggtctcatgcttaaaacactggaa

SEQ ID NO: 2724 - DNA, 271 bp, Zea mays
  misc_feature: Incyte ID No: 700553173H1
  unsure 255: a, t, c, g, or other
gaccaggaatgctgtttcagggaatgtatatacatttacagctcttatcagtggtttctgcaaggatggaaatatggatgaagcaactaggttgtttcataaaatgatggagagttccctagtgccaaatgaagtgacttttaatgttatgatagaaggtattgccgtgtaggcaatattaggaaggcattccagttatatgatcagatgctagatagaggcctaacgcctggacaatacactacaggtcactgnataagtgtagtttgtt

SEQ ID NO: 2725 - DNA, 272 bp, Zea mays
  misc_feature: Incyte ID No: 700553174H1
  unsure 181-182, 224, 226, 229, 240: a, t, c, g, or other
taaagaagcgcaggaaaaagttaaaacatactatccatgttgaatccagtgatttggattttgagattcactatgcctttacatgatgaacctcatattttactagctcagattgccaaaaagatagctaggactattcttgtgaaggcctgcaataacattgatcattgtaagatcgtcnngccaatgcacaaccatacgcgtccagagaccgccggatggancnttnagtggtatggnctctcagtggaatacatcagcgtcatgacatc

SEQ ID NO: 2726 - DNA, 257 bp, Zea mays
  misc_feature: Incyte ID No: 700553175H1
  unsure 3, 175: a, t, c, g, or other
ggnatgtcctgtcagaattgatgatttcgtcactaccatgccaatttccctcgaaacgttacagactcgaatgcctataccaccttattgtttacattttgaaggattcatctatggttagaaagagagaaattattagttcattcatcactgaaatacttcttgcattgaaggngccaacaagaaaaccagaaacagagctatgatttgctattgaattgcccgtgcctgtgaaaatgctggaaatgacgagggga

SEQ ID NO: 2727 - DNA, 274 bp, Zea mays
  misc_feature: Incyte ID No: 700553176H1
  unsure 18, 20, 40, 77, 176, 178, 180-182, 188, 191, 205, 209, 212, 214, 218, 222,: a, t, c, g, or other
ctgaactgactccgatgnangcccatgatgtgaaggcggntgacgatggtggtgaaggagagaatctcccccctggntcatatgtaatcttgcaactggataaggaggagattttagcaccacatactgcatttctgctgatctgtggtaagggtttcaaaagagatgctagcctnangnnntcacangtngggccatggagatnagtnacnanactnccanctgncncttgccaaacgcaccaaaagnntcnagtgccagatcaggcacggnt

SEQ ID NO: 2728 - DNA, 275 bp, Zea mays
  misc_feature: Incyte ID No: 700553178H1
  unsure 171, 240-242, 248-249, 251-253, 255-256, 263-265, 270-271, 273: a, t, c, g, or other
gttgcggaggcaggaagagagacgacggcggccatggcgacctccttccaggggacgaccaccaagtgcaccgcctgcgacaagactgtgtaccttgtggacaagctcaccgccgacaaccgcatctaccacaaggcctgcttccgctgccaccactgcaagggcaccctncaagcttcgccaactacaacttcctttcgagggagtgctctactgcaggccttcattcgaccagctgtnnnaggggnnannngnnaagaaannnaaaanncnat

SEQ ID NO: 2729 - DNA, 270 bp, Zea mays
  misc_feature: Incyte ID No: 700553179H1
  unsure 94, 162-163, 168, 174, 261: a, t, c, g, or other
gagagttgttcaggagaagatgcctgaaggcgtaaatgaaagcggccttaccttgactgggttccttttctgcatgccctctttattgaaaaangtcgtttggaaactacttggactgtattgaggaaatttggttacgacaatgacattcaagcttagggnngatcncatggnatgccaattaaaagagctcctgatcaaactctggaaatgacaagcgaagtggttcgattctgagagggatattcaacatgtttgacntgataagat

SEQ ID NO: 2730 - DNA, 278 bp, Zea mays
  misc_feature: Incyte ID No: 700553180H1
  unsure 191, 248, 263: a, t, c, g, or other
cttcaacacatttattcgtgcatgtgagaaatatggtcgcaatgatattaaaagtatatcatctgaaatggagggtaagacagaagaggaagttcaacgttatgctagagttttcaaggagagatacaaggaactgagtgattatgatagaattataaaaaatattgaaaggggggaagcaaggatatccngccaaggatgagattatgaaggctattgggaagaagctagaccgctacaagaacccnggttagagttgaaantcagtacggccaaaa

SEQ ID NO: 2731 - DNA, 276 bp, Zea mays
  misc_feature: Incyte ID No: 700553181H1
aatgcatgcaactgaagtgcattaccaatgtcccaagagggtaagggtacagtctgatgtatctgaaaggattgctaatggaactagtgttcatgtaaatactcatgttcaaaatttgaatctggatattgaagagcaatcacacaaacactcgatttcacacatcgaggagccaaacactaataattcagaaggatccctggctggtgctgctgtctgggatgtatttcgcaggcaggatctccaaagctaatgatatctagctgttcatcggga

SEQ ID NO: 2732 - DNA, 278 bp, Zea mays
  misc_feature: Incyte ID No: 700553182H1
  unsure 92, 261: a, t, c, g, or other
gagaaaaaggacactcctgaggccaacaagcagctcaatgacaagaaacagttcatgatccaaagaactcaactcctacgtaaccctgaggnaaacgtaccagagcagcctaggtaacaagaggatcgaactattcgatactggtaccgaccaagtggccgacaaatctccagttcaaatggcatcagaaatgtcaaatcaagagctcattagcgccggaaggaaacaatgggaccaaatgaccagccatgacgctccaanaatggttgtagcacaac

SEQ ID NO: 2733 - DNA, 281 bp, Zea mays
  misc_feature: Incyte ID No: 700553183H1
  unsure 72, 190, 192, 236, 238, 265: a, t, c, g, or other
gaggcacttaaattgtgtgtgcacactgtgcctgtgatgccaatcacactgacttctaaacccttttgcagncctgtccacaagggtgaagccatatatctgcacgatgccgttgaaactcgacgatggctggaacaacatccagttgaacctgctgatctgacaaaaaagggcgtacggcacaaattcncntcgagacgctgcgggtgcaagttcatgcgaactgccggctccgngncctctacttctctgaccgcctctactncggaggaggagctgcc

SEQ ID NO: 2734 - DNA, 276 bp, Zea mays
  misc_feature: Incyte ID No: 700553185H1
  unsure 149, 214, 229, 234, 237-238, 241: a, t, c, g, or other
gaggaaattcttgagcctgctcctgttgaagaggaaaaagtaccagttgaagaacctgttcttgtaccacctgttactgaagttgtttcacctcctcccaaggctgaggtgcccgatactggtgacttactgggcttagatgatacaantcctgctgtatcagctatagaggaaagcaatgctcttgccttggctattgttccaacagatggcngcttcaacaactggnaacantcnnttnacaagataaggggtttgatcctacaggatgggaac

SEQ ID NO: 2735 - DNA, 276 bp, Zea mays
  misc_feature: Incyte ID No: 700553186H1
  unsure 48, 113, 224, 266: a, t, c, g, or other
ggagatcagcgtgctctgcgacgccgaggtcggcgtcgtcgtcttctnccagcgccggcaagctttacgactactgctccccgaagacatcgctatcaaaaatcctggagaantaccagaccaactctggaaagatactgtggggtgagaagcacaagagccttagtgcagagattgaccgtataaagaaagagaacgacaccatgcagattcgagcttcaggncacctgaaagtgaagatctaaactcgtggcaacccaaagacngattcatgat

SEQ ID NO: 2736 - DNA, 266 bp, Zea mays
  misc_feature: Incyte ID No: 700553188H1
gtgcggcctctactgacctggagaaggctgaggcccagatcggagtcgatgttcacagtgccctcaatgctgcattgaccggttaattggtggcattttaaattgtctgtatttttcatctacagttttagagtgagtttaagtttgcaaactcatgggcatgggatggagggaatgatcctaaataaattatactccatctaaaacatggacatatgtttctgtttcctgaatcctgcatggattcttttgtacggtgaacattt

SEQ ID NO: 2737 - DNA, 263 bp, Zea mays
  misc_feature: Incyte ID No: 700553189H1
  unsure 136, 157, 166, 175, 197-199, 208, 253: a, t, c, g, or other
ctcttccccaaccccgcgcgcgggggagcgataaaccctagtcttcgccgtcgtcgcaggaggacccgcgatgtcgcacttcgggaggtcaggcccgccggacatccgcgacaccttctcgctcctcgtcctcaanatcagcttccgcaccaagggngaacgaccntcttcccgntcttcgagcgctacggaaaggnnnccgagtctnaatccccgagggacaggaggaccggggactcgaggggtttcgcgntcgtgcggta

SEQ ID NO: 2738 - DNA, 272 bp, Zea mays
  misc_feature: Incyte ID No: 700553190H1
  unsure 193, 201, 206, 211, 219, 268-269: a, t, c, g, or other
atttaaatcttacagttcaggcaccagctaagcctaagatgctgagtttccatatgtgataatgttggactgtcttgttcatatcggtgtggcatatcattatgcttgaggtggtggtatgtaccttccattaggcagggatccaccaaggagtttgttcaacatggatgaagaatacaattcttctggaatnatagcgangatgncattngggccccnatctttgtggaggcagtcaaattcaagttacgtgctgcatctgtccccnnttt

SEQ ID NO: 2739 - DNA, 270 bp, Zea mays
  misc_feature: Incyte ID No: 700553191H1
  unsure 257: a, t, c, g, or other
agaaaaagctagaggaagacgaggacttcctcgacaatctcaacccttgcacttcgacgggaaatcccagcccttggagatgcgaacatgaggaacatcaagcgtggagaggtcatacagctcgagaggaaaggctactatagtgtgatgccccttttatcagatcgtccaaaccggtggtcctgtttgcgatcccagatggcaggcagcaggcctcgcttagctaggcatggtgaccaccttttgggcacatggcnattcctgagttgg

SEQ ID NO: 2740 - DNA, 271 bp, Zea mays
  misc_feature: Incyte ID No: 700553194H1
  unsure 171, 184, 188, 197, 201, 204, 213, 229: a, t, c, g, or other
acataacttacccaatcaatagagtcttaatggattgcataatctatccaaccaccacctaacatcaaacaaacttttgacctacatcatgtagtctatctcatccatacctatattaaccatattccccagcccaataatatacactaactcctaatcaatgagacaagnctgaagaagatgntcancttcatcanaggnggntgagcaccnatcaggtcttcaaggntcaagtgtggtcaccaagatgagtcaaggtccacaatcttgg

SEQ ID NO: 2741 - DNA, 273 bp, Zea mays
  misc_feature: Incyte ID No: 700553195H1
cgggacctcggttggtttcgtcggtcgctgggaggacaggtgacggaacggtgatatgaggcggtggttatgttgtaactgccactatgacgttgaggaagatgaccacgccaaggaacaggccaaagctcagagcaataagaccgactccaagcagaagtcttcaaagcctcctggtagtcaacctgagccagagttctcccctcctacaattgatgtccctgaattgtctttggatgattgaaataaagactgatgatttggatcaagtgc

SEQ ID NO: 2742 - DNA, 285 bp, Zea mays
  misc_feature: Incyte ID No: 700553201H1
  unsure 201, 274: a, t, c, g, or other
taaagaagtacggagaaaaccttgctgtcttgagttcaggcgaataccttgctgtctccaaggtttagccttcaacctaagggaatctaaaaggtaaacatgatggactcatcaaggagccacaacacgttcattcttttagaatgttcggttattaggtgaagtatacagagctgtaaactggtgatgcacattcatgcntcatctaaaacaaccgaagttatggcttctgatagcggatagcctactcgacgcagatcgttaaatgatcagntattaagatgg

SEQ ID NO: 2743 - DNA, 292 bp, Zea mays
  misc_feature: Incyte ID No: 700553204H1
ggcggcatgatcagggagctgttaatatccttcaggaaggccactgggcagaagccattgagaataatattctacagggacggtgttagtgaaggccagttctatcaagttctcctttacgagttagatgccatccgtaaggcatgcgcatccctagaaccaaattaccagcctcctgtaacatttgtggtggttcaaaaacgtcatcatacgagactatttacaaacaatcacaaagacagaagtagcatggacaagagtggaaatattttgccaggaactgttgttgatt

SEQ ID NO: 2744 - DNA, 292 bp, Zea mays
  misc_feature: Incyte ID No: 700553205H1
gcaaccaggcagaaccttggatggccctatgacacattctttgtaccagaggacgtcaagagtcactggagccgccacacacccgaaggtgctgcacttgaggctgattggaacgctatgtttgcagagtacgagaagaagtatgcagatgatgcagcaaccttgaaaagtatcatcacgggggagttacccactggctgggttgatgctcttcctaaatacactccagagagcccaggagatgccaccaggaacctctcccagcagtgcctgaacgcgcttgctaatgttg

SEQ ID NO: 2745 - DNA, 173 bp, Zea mays
  misc_feature: Incyte ID No: 700553206H1
  unsure 42, 45, 51, 54, 64, 72, 90-92, 94, 111, 113, 121, 133, 138-139, 143, 145,: a, t, c, g, or other
gatatttattttattttataacgatttatacttttaattaangcntgtcangtntgactaatanattaaatncaaagtataaatcgttannnantaaaataaatatcattnantttatttnataacgatttanacttnntatntnatatatnagtcaaacttgacntgcgtta

SEQ ID NO: 2746 - DNA, 289 bp, Zea mays
  misc_feature: Incyte ID No: 700553207H1
  unsure 89: a, t, c, g, or other
gaagtttcttctctctacaagagaagactacaaagctcctccggtgtgtgaatttgttatcaaaactgctttgtcaatggttgaaagangccgtgttctgccaaacaggggaatgcagatccagtataacagatcctcttcggttaggttcctgaatggcttttttcttgtattgcgcgaacgatgtgaagcattgcaattgtcgaacacggcactagaggatcattctttgtcaaaaacttcgtgtgcaataacgccgctcgttactgtgaaaacgtgcttcgggaat

SEQ ID NO: 2747 - DNA, 292 bp, Zea mays
  misc_feature: Incyte ID No: 700553208H1
tcaagactatgaagattgagagagtctgtcggaagtggcgtggtttctgtccttattttgtgttcctgccatccatgtcacaaaggaggatataatgtggactgaattcacatccaggtttggggcttcttccaatccattctgctggtgtggagttgagctaggtgatggcacaggcccttcatgtagatgtagcacatctgcaacactgtcccatgttatcatcctagtctggcgtattaatctaggcatctagcttacattagtagctactgaaactttagttatatcc

SEQ ID NO: 2748 - DNA, 288 bp, Zea mays
  misc_feature: Incyte ID No: 700553209H1
  unsure 259: a, t, c, g, or other
aagcaatgcctgataaagtgtttgatgtgctgaatgaagttgttgttgatcgaggttccaatccatacctatcaaaaattgagtgttatgagcataaccaccttatcactaaggtgcaaggtgatggggtgatagttgcaacaccaacaggcagcacggcatattctactgcagctgggggatcaatggttcatccaaatgtcccatgcatgctgtttactccaatctgccctcactcactgtcatttagacctgtcanccttccggattccgcacggcttgaattaa

SEQ ID NO: 2749 - DNA, 289 bp, Zea mays
  misc_feature: Incyte ID No: 700553210H1
caatgagcttggagcaatggtggatcgcatggaatcggcgaaactgaagactgttaatcttactgataatgatttagcaaaggaccaccttagatactttattggaggtagatcagaaataaaagatgaacttgtttaccggttcatttttccagaaaggcctggtgcccttatgaaatttttggatgcattcagccctcgttggaacatcagtcttttccattaccgtgcacagggtgaaactggagcaaatgtattagttggtatacaagtgccgccagtggacttc

SEQ ID NO: 2750 - DNA, 289 bp, Zea mays
  misc_feature: Incyte ID No: 700553211H1
  unsure 109: a, t, c, g, or other
aacaggtgtctccccattgcagctgaggactgctgccatggtcttctacgtcatggataccactatgccattgaagagatgtgaagagctaatgcagattgtgaagtcntactatggtggtagagatgtgactcctgaagatctcgagatggcattacttgttggtatgagccctcatgagcgaaggcgtcttgaaaagaaaaagggatattcgtttagagctcaggctcaaactattattagaaagagcagcagcaataccatctcagaagacagtggacatggatca

SEQ ID NO: 2751 - DNA, 286 bp, Zea mays
  misc_feature: Incyte ID No: 700553212H1
accgtattgtgagcaagagagcagttgaagctggcgaagatgcagcatctgggcctggcaagggcgagaagattaacataaaggatgatgtttcggcggtgaagaagggtggctgctgctctagctgacctgccctgctgtattttttttggagctgtggtgatgtagcttatggtacggcatttccagcgaccgagaactggtagtggcatagcagcttctatgttacctagagagtttattgtcaaactgggggaaaaaaactgaaggttagatcggtgtagat

SEQ ID NO: 2752 - DNA, 284 bp, Zea mays
  misc_feature: Incyte ID No: 700553213H1
caatatacaaggaaattttacccttaatcagagtactggcactggatcaactcttgtgtttgatgatgcattgggcagacagtacaaagacaccagtcaacacatagctctccagcagcccgacaactctggaatgtggcttcatggctctggttcaagagcggcggcgcttccgcctaaccacttttatggttaccagggacagagtcagctgggtggctttggtcaggcgcacagcaacagccttcccattcggaggccagggtacccgactttctaccagt

SEQ ID NO: 2753 - DNA, 287 bp, Zea mays
  misc_feature: Incyte ID No: 700553214H1
attgaaagctgtagctgttttcaaatgttggagaagcagatgggaccagactcatttcggaagattttgcaggtgatagtggctccaagtcgtgcataaaatctaggcatgagcttcctagcctctcttctcaagcaaattgatcggttcttgcaatttgacaactttatgcctggttataatggggtcttgactgtcagctgcattcgtacccttgtacgaatagcaaagaaggtgccatcttttgtatgccttgatcacatttttgaatggttgcccctttccgc

SEQ ID NO: 2754 - DNA, 289 bp, Zea mays
  misc_feature: Incyte ID No: 700553215H1
ggcaacctgcaaaatgaacctcgctcaatgaactccacaaaatcagttgaggttaggcctgctcctgttgaaccaatagttagccaaaatgtgaagctgtcacctgaattgattaagatgataaatttaaccacagttggactggagaaagggcacctgcctgtgatgtcagctgaaggttcaggaggtgtatatttcatgcgagatgcaacaggtcagaagaatattgctgtgtttaagcctattgatgaggaacccatggccaaaaacaacccaagggtcttccttg

SEQ ID NO: 2755 - DNA, 291 bp, Zea mays
  misc_feature: Incyte ID No: 700553217H1
  unsure 28, 37, 39, 216, 264, 274: a, t, c, g, or other
gtcaagggataggagtcggtccaggagnccagatgananaaatccagggaataacctttatgtaactggattgtctactcgtgtaacggaagatgatcttgagaagttctttagtaaagaaggaaaggttaagaactgtcatgttgttcttgatcctaggacaaaagaatcccgtggctttgccttcgtgactatggatactcttgaaggtgcaanacgctccatcaagtatctgcaccgcactgtacttgaaggtcgcctggncatctagagnaggctaaaagaactcgt

SEQ ID NO: 2756 - DNA, 299 bp, Zea mays
  misc_feature: Incyte ID No: 700553218H1
  unsure 3, 6: a, t, c, g, or other
aangcncatcagtcgtcgtcggagatgtcatgtacaagctgcagagcgaagagaagtacatcatggttgtcgacgcggtccagatgactctgtcggcggtgccccttcctgatgccagaacgctcctctacgctggtaaccactggattggcaggacaccggacggccggctttgtttcttcgtgatcagggagcagcttactctcgccacctgggttctccaagcacctgggaagtgggtggagcagcaacccgtggacctgcgcacgctgatgcacccggcgtttatgggtgatctc

SEQ ID NO: 2757 - DNA, 289 bp, Zea mays
  misc_feature: Incyte ID No: 700553219H1
gccagtactgcaatggctacgaagcttgtggttctcggtatcccctgggatgttgacactgaagggttacgagagtacatggccaagtttggacccctagacgattgtgtcgtcatgaaggagcggtcttctgggcgatctcgcgggtttggctatgtaacattcgcctcagctgacgatgcaaagaatgttctgattgcgagcatgttcttgggagccgtacattagaagtgaaggtagctactccaaaggaagaaatgaaatcacaaggatcaaagaaagctacaag

SEQ ID NO: 2758 - DNA, 192 bp, Zea mays
  misc_feature: Incyte ID No: 700553220H1
  unsure 157: a, t, c, g, or other
tcgagagtgaagaaagggcagtaacttaaacccaagtattgaagaccaggcaaattggggagatgaatatgtccggttaaaatccaaacttgatgcacttcagaagagtcaaaggcagctgttaggagaacaattgagttcactgaccataaaaganctccagcaactggagcaacaactggacagttcttg

SEQ ID NO: 2759 - DNA, 289 bp, Zea mays
  misc_feature: Incyte ID No: 700553221H1
caaacctctgtcgaaagtttcacctccggtcgctggtttcctccaatctccgtggtagttcagcgcgagcgggcggcggggtttgagctcgatggtcacttccggcgaacaatcggctgcggtcggcgagcaaggggaaggcggcggtcgtttccccggcggctgatgctcctcccaccatctctgctccgcgacgggcaaaaccatcttcagatgtcagcaagagcatgtgtttagacctttctgtgaaggataattctgccaaacccccacggaggcatcaatacaa

SEQ ID NO: 2760 - DNA, 287 bp, Zea mays
  misc_feature: Incyte ID No: 700553222H1
ctgagcgaaaagatcagtctcggaagggccattgtcggcagcaaggtcaaggaggtggacgagcggtaccaggtctcagaactcaccaagtccgccttggctgccgccgagcagaaagccagcgtcgcgggctccgctatactgagcaaccagtatgtctcggctggtgcctcgtggctaacaagcgcgttcgatatggtaacgaaggcagcgggcgacatgacctcgatggccaaagataaggtggagagggccgaggaggagaggaaagccatcatgtgggagga

SEQ ID NO: 2761 - DNA, 290 bp, Zea mays
  misc_feature: Incyte ID No: 700553224H1
tgatgtttggagtgaagctgaggagacatctaaaaaggttactgcaaatatcaaagaaaaaatgtttgctgctaaagaagaggtaaaggaaagttttggagttggaaaagaagagagtacaagttgcagggatggtttgcctgaaggttcaaaacatgagaaaactgaggcatcctcacattcagatggcacgactgaagatgccacagacagccatacattgtttactaaattgaagtcaacaatctcatctgcttcaccagtagtatccggtgcgtttgcaaagttga

SEQ ID NO: 2762 - DNA, 289 bp, Zea mays
  misc_feature: Incyte ID No: 700553225H1
  unsure 156, 161, 192, 209: a, t, c, g, or other
ctcaggggctgatgccagcataagccaaatcagcttgcagctaagattgggccaacaaatcaagcaacttcagctagcatacgcaagaacgtcgctgatctacatgcaggagatcactgatccatttgctggctgcttcatgagtctactcgggtngtatntccttttgctaatttttctgacatacatgancttggtctgctgatgangcagtaggctataggattctaggaaccgactgtgtacatgtaatcagagtgttcggagaatcctatagcctactgcctca

SEQ ID NO: 2763 - DNA, 288 bp, Zea mays
  misc_feature: Incyte ID No: 700553227H1
ccgagaggtacaagcgatccacgagtggcagatattttgaggatatgtatgctacagacgctctgcgttcttcagacaagacgattgttctacctatgccggaagtggtaaaagctaaggtcaaatgtgatatcactaaggaagctcaacccgggaggggagcacaaagcaccttgagaaaggagattcttcagctcgagaagcacctcaaggatcaacaggctgtgcgtggtgcatggaaaaggctttagggcctaacgctggccctgtcagcttgtcgccagagaa

SEQ ID NO: 2764 - DNA, 281 bp, Zea mays
  misc_feature: Incyte ID No: 700553228H1
  unsure 49: a, t, c, g, or other
tgaaagaaagggcagtacttaacccaagtattgaagaccaggcaaattngggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctg

SEQ ID NO: 2765 - DNA, 287 bp, Zea mays
  misc_feature: Incyte ID No: 700553230H1
  unsure 51, 208-210, 241, 267: a, t, c, g, or other
attagatatgtcgctgatggaagtccaactaatggcgaactgaagaccgcngaccttgtgtctacacccgcacattctgttgcatctatacctccttctacaccagcacttcatgttgctcctgcacttttgtctacccctgtcagatgctcatctctatttatcacgccaccatactgttcctcaggtatgcaagcaatttttattnnngatctttctccttgttagcttgattgatctntctccaatacttatttgtgggctggntaatctaggttccattagtt

SEQ ID NO: 2766 - DNA, 289 bp, Zea mays
  misc_feature: Incyte ID No: 700553231H1
atcgatattttctgacattgaaaaaatctgtccgaaacattgcatacttgcgacaaacacatccaccattgatttgaatgttgttggcgagaagacaaattctcaagatagaattataggggctcactttttcagccctgctcatattatgcccttgcttgaaattgtccggacggagaagacatcaccacaagctatccttgatctcatcactgttgggaagataataaagaaggtccctgttgtggtcggcaatgcacaggatttgcagtcaaccgtacatttttcc

SEQ ID NO: 2767 - DNA, 292 bp, Zea mays
  misc_feature: Incyte ID No: 700553233H1
  unsure 70, 115: a, t, c, g, or other
cgagaaaaaggaaaggaaaggacaaaggagcggcggcgaggtctatggcgtcgacggcggggtacctggngcggcgggcggcgcagaaggagcgggtgcgcctgctctaccgcanggcgctcaaggacacgctcaactgggccgtccaccgccacctcttctaccaggacgcgtcggatctccgggacaagttcgaggccaaccgacacgtggataacctggacgtggtcgataggctcatcgacgatgcggaggtcagtacaggaattccagcaccccgatccctacattg

SEQ ID NO: 2768 - DNA, 237 bp, Zea mays
  misc_feature: Incyte ID No: 700553234H1
gttcaagtataatctgtgtactatgaattctgtgtttgttggataccaaatgcactgccagttttgcgtctgtgcccataattccatcttgatcagactagcagttaggaacaaatgcactgccagttttgcgtctgtgcccataattccatcttgatcagactagcagttaggaacaaataactgttttgattgtgttaatgtgagctcgccagcaaaatctgaggaacatttatc

SEQ ID NO: 2769 - DNA, 290 bp, Zea mays
  misc_feature: Incyte ID No: 700553235H1
  unsure 183-208: a, t, c, g, or other
aaatatctctcaccacctctccccttcagcttctccccacctttggtcaggcaggctcaggcaaagggggcggccaacaaggacgagcgatggcgaccaaggtcatctgcttccttgtgctcgcatccctgctcctcgccgtcgcctttcccgtgtctgctctgcggcagcaggtgaagaagnnnnnnnnnnnnnnnnnnnnnnnnnncagtgttagcggaagggaggcggcaacctgaatccctgggagtgctcgcccaagtgcgggtcgcggtgctccaagacgcata

SEQ ID NO: 2770 - DNA, 288 bp, Zea mays
  misc_feature: Incyte ID No: 700553236H1
ccagagcgtgagtaccatggtcggggtaatggtttcattcctatagctgaatataaataattattgtctagactgtgtcggcagccaataattatttatattccagagcgtgagtaccatggtcggggtaatggtttcattcctatagctgaatatggtttggaattcaccaaaaatacaaagcagtggaagaaaaagaccccagtaagactattatacagtggaaggaaccattatgattgcttgtgtgacatagttgcagagcaatgtatttttttagtgcccgtc

SEQ ID NO: 2771 - DNA, 277 bp, Zea mays
  misc_feature: Incyte ID No: 700553237H1
  unsure 52: a, t, c, g, or other
gatgttcacaagagcgttaagtacaatgtgtgggctagcactcccaatggtnataagaaacttgatgctgcctatcaagaggctaaagaaaaatcaagtgaaactcctgtttttcttcttttctctgtgaatgcaagtggccagtttgtcggccttgctgaaatggtgggtcgtgttgattttgaaaaaacagtagagcattggcaacaggacaaatggactggttgtttccctgtcaagtggcacattgtgaaggatgttccaaacagcttgctga

SEQ ID NO: 2772 - DNA, 287 bp, Zea mays
  misc_feature: Incyte ID No: 700553238H1
ggttggtggaagcagcactcggtcttgttgcacttttcacactgctggggttcttcagggcactgatgttatacaatgggcagaaggcactggccaaggccgacaaggttgtcttgtctgaacgccaactggggcttcttgggttaaagatggcaggttcagaaggaggtgggaaaggtgagcaaatcaaaaggcctcccaagaccaagccatcaacaccatcggaaccaattgtgcctatcaggaggtcttcgttcagccatacaccatctcggccttcggggcaa

SEQ ID NO: 2773 - DNA, 289 bp, Zea mays
  misc_feature: Incyte ID No: 700553239H1
aaaaaaaactctctttctctctctttcccagccctctctctccctctccacccggccgccaccatgtcaggcctctacagccagggcttctcccctgcaagaaccctctccccccagattaggagcaaccccgacgctgacagccagtacttggccgagcttctcgcggagcatcagaagctggggcccttcatgcaggtgctgccgatatgcagccggctgctcaatcaagaaatcatgcgggtatcaagcatggttcatgaccatggatttagtgatcttgacaggc

SEQ ID NO: 2774 - DNA, 285 bp, Zea mays
  misc_feature: Incyte ID No: 700553241H1
agaagaggaagggggaggcgactcgaccgaggccggcgactcgaccgaggcccggtttcaatctccggtcctccgattgcgtccagatctaccagcaatggcatcatcttcggacccatggatgaaggaatacaatgaagcatccagacttgctgatgacatcagttccatgattgccgacagagggtctcttccacagtcaggcccagaaattatgcggcatacttcagccattcggagaaaaataatattcttgggactagactggatagcttggagtcatgc

SEQ ID NO: 2775 - DNA, 285 bp, Zea mays
  misc_feature: Incyte ID No: 700553242H1
actgctggagacaaacatgagagacgacatggggatgacgatcgaagacatgatcgaggagtgcaaggtgttctacttcgtcgggatggagaccacgttggtgctgctcatgtggacgatggtggtgctcagcatgcacccggagtggcaggaccgcgcgagggaggaggtgacggctctgttcggcagggacggcaagcccgagtatgacggcctaagccacctcaaagtcattgcaagaacgggactgctaagcaagctaagatttcaatggcatattccttc

SEQ ID NO: 2776 - DNA, 286 bp, Zea mays
  misc_feature: Incyte ID No: 700553244H1
tcttgtgttaccaaaatataagtatatggttatgtgagcatatttgatgcttgtgctactctatatacttcataattatatgttgctcagttacattaagattttagattatgtatatgtaatctcgattaaccaaacagttgatgaaccttattgctataaatggctacatttacagttttgattaagacattatgataaaaaaaaaattcatgccagtgccacgtatatacgcggacgttttggttctgttagaaccaacctcttaagagcttacatgaccgta

SEQ ID NO: 2777 - DNA, 282 bp, Zea mays
  misc_feature: Incyte ID No: 700553245H1
aatggtacaattttcaagtccccgaaacctcagtatttgctcctaaaactgaagtataatatttggaagtatcgttcttttaggtagtctatataatatttcatttttccataattgcatgatcatttctttaatcctatcaagaagcttaacaatatgtaagcctttaatgtctcgtctctgattattgaagatctttttctgtattcaatattgacctctaatgatatgaacctagcaagaggtctcataacaagatataagacatcagacttaagtgtg

SEQ ID NO: 2778 - DNA, 288 bp, Zea mays
  misc_feature: Incyte ID No: 700553247H1
gtgaacttgcaatcacttcccataacaatctatcgaagttggtgcctgattatgcattaattgatggtatgatgcatccaaaagatgtgaatgtatcaactggttttcttgattctgtatcaagtgcaactaatctaggaggatcaccatgctctgaaggttcggtcatttctgtacaacgtgctgagagtttcaaaagtgtgagtgactatgggcctgaggattatggtactatggactgtggtgggtacaaagagggaatcagtaaagaaaattgcagccatgttg

SEQ ID NO: 2779 - DNA, 289 bp, Zea mays
  misc_feature: Incyte ID No: 700553248H1
aaacaagaaaaactattggagcagtgacttatgtatatatttttttaaaggaacgaatggatctttcggagcctcggtttacaattacatacatgcatcgatctcactgacttactactgaatcaaacattactcagataccatgagtcacactgctcactgactttagtgctgcaaggctatatggggacatcttaaaaaaaaagctactaatggttgataaggttgaagcaaattttggtgagtggccaataatgaacaatactggaatataaagatgatatgggga

SEQ ID NO: 2780 - DNA, 290 bp, Zea mays
  misc_feature: Incyte ID No: 700553249H1
  unsure 262: a, t, c, g, or other
gaccaaaggactgctatcgccatcaatattgggcacactgcattaactacgcctggcatcaagacgcgacatgaggaggagccagtctgcccccactcatgacctacgggtcctaggtctgagccccactcatgacctatgggccctagacctgatcccaccatgacctacgggccctaggcctaagtcctcttacaccctacgaagcacgtaagatgtcgaagggaagccagaggtcaggctacaaagtccaatggtcacngcatgcagatgtggacaaaaggagtaat

SEQ ID NO: 2781 - DNA, 288 bp, Zea mays
  misc_feature: Incyte ID No: 700553250H1
gcaaatccagaaactgaaagtgagctatggcgagcgaggctccccaccgaagattccaggcggagcgactctggtcttcgacacggagcttatcgccgtcaacgggaagacatctggcggtgcaaatccagaaactgaaagtgagctctgatacgatgcatttggatggagagtttcagctcgagggagtagtagcagagtcacgtagttcatttggtgccgtgaaagggctgttgtcttgtttccttcatgcatggcaatttatgttttagagatgtcatactctgg

SEQ ID NO: 2782 - DNA, 288 bp, Zea mays
  misc_feature: Incyte ID No: 700553252H1
  unsure 54, 250-251, 253-255: a, t, c, g, or other
cgggaagaccctccttgcgcgtgccgtcgctggggaggccggggtgcccttctnctcctgcgctgcctgctgagttcgtcgagctcttcgtcggtgtcggtgcctccagggtgcgcgacctcttcgagaaggccaaggccaaggcgccctgcattgtcttcattgatgagattgatgccgttggaaggcagcgcggtgccggacttggtgggggtaatgacgagagagagcagaccataaccagctcttnncnnngatggatggcttcgctggcaacagcggtgtcat

SEQ ID NO: 2783 - DNA, 287 bp, Zea mays
  misc_feature: Incyte ID No: 700553254H1
cctcagtcatccatatggcttaggtttatcacatcatcaaagatctgatatcgctcatccatatggcttaggtttctcacatcatcaaagatctgataaactcaacacagcaagttacgtggagaggatccgaatgagacctgatgttggaaattcagtaaatttttttgatttatcttcctatgctcgcttgctgaactccccgttcttgtcctcacaatctgatacatataaatccattgatgaagtgatgggaagagtatgcatgctgtcaaaggatcaagatg

SEQ ID NO: 2784 - DNA, 286 bp, Zea mays
  misc_feature: Incyte ID No: 700553255H1
  unsure 149, 152: a, t, c, g, or other
aatgatacaaaagagggaccaaatttgcaggttgctgggcctggcggcgaaataactgcaggttaccttttgaagaaaagtgcaaaaaataatgaatggagtaaaaggtggtttgttctaaacgagaagagtgggaagcttggatacantangaagcaagaggagagacattttcgaggtgtcattgtcctggaggaatgtaacctggaagagatagaggaggaagagatatcgaagagttctaaggattcgaagaaggcaaatggacaagagaaaggcccaagtc

SEQ ID NO: 2785 - DNA, 288 bp, Zea mays
  misc_feature: Incyte ID No: 700553256H1
acaatggtgagtgttgtggcttgtctgtggcttagtctgactcaggaaaaacctacagccagcagcaagtatgtatccaggaactaatggtagtagcactataactgttcccttggctattcaataacatctgtttaaaaaactgatgcccagccccgcctaggcagtcataagtagagctgcatcgcctaggcatttctgtcttcttttgtgcatggaacctcactcatccctttcccagatcccaactcatgtgggagcctacgctattgggtatgtccttttttc

SEQ ID NO: 2786 - DNA, 285 bp, Zea mays
  misc_feature: Incyte ID No: 700553259H1
  unsure 42: a, t, c, g, or other
ctctactcgacgcccggtggaaggagttctccgggatttganctgtttctgccctcacctccgctaggccggcgtcgagtggagatccaatcggaaatcgaactgacttcatcttctgttgcatccccgtcaggataagccatgccaggagtgatcacaaagttcgcggttacatccatggtgatgtggatggccccggttgcgatcgtttatgggttctactaccaggcgtttccaggtgtgagtcggatgtcatcctcggcgcagacactcgccagcgggttc

SEQ ID NO: 2787 - DNA, 284 bp, Zea mays
  misc_feature: Incyte ID No: 700553260H1
caataatatgcagatacagatttcttctcttgcgttccattgcatctcaagatccacttagtgtttcaattgctgttttgcaacagttcaacattccccctgaaatgtatcaagttggctacacaaaattatttttccgtacaggacaggttgttgcactggaaaatgctaaaaggcagatgcttcttggaaccctccatattcaaacacagttccggggtttgcattctcggcggggatatcaacgactaaagaaagggcgatgaatttgcaatcattatacg

SEQ ID NO: 2788 - DNA, 93 bp, Zea mays
  misc_feature: Incyte ID No: 700553261H1
  unsure 86, 89, 91: a, t, c, g, or other
atgtttggtttgccaccgcccaccaatttggtgtaaacaaggtaattatcatagatgcatcttgtgatcaggttttgattgttgcnccnanat

SEQ ID NO: 2789 - DNA, 287 bp, Zea mays
  misc_feature: Incyte ID No: 700553264H1
gaaggcttttacatcttggtgcagaaccagttctagagataggtcttggagatgaccaacacccttcaggatatgaaggggctttagatccttggttgctatctatgtggaagtctctgaatgaaattaatccgtcactcttacctagagtgtctgatatcaatgatcctaatttgagttttttgggggatccaaaagttcatgtcatttatactcttccaatgaagttacacaagatcctatgctttggatccaataaaataataagtagcgccagatccatgtcc

SEQ ID NO: 2790 - DNA, 290 bp, Zea mays
  misc_feature: Incyte ID No: 700553265H1
gttcctagcttcgtatctgaaggcagcaacattttcaagaccaggattgaaggtgcaaacatcgctgatacagggcttacagataaggatgacttaattgtcattcattcagatgaatctctagatctctctcgatcagattatcttgataatgaactttccagcttggcaaactggttggagggatcttatcagaagtctaccggcaaactagtcattcccttggagaatggaaacagtcttactttgcaacttgataaggaagcagacaaggaattcatgtccagctt

SEQ ID NO: 2791 - DNA, 221 bp, Zea mays
  misc_feature: Incyte ID No: 700553267H1
ggaaggagttcaagatgatgccaagggcagatgcaaatgttatgaatgtttcttttggtaagggaaaatcagaagattcttttggcacaattaatggtaccaacagtggagataaaatagaatctcctagtggtttagcagaaagaacattgactcagcctaccactaagggttgcagtaagcagcgtggccgtagttctaatggtagaggaaacaggact

SEQ ID NO: 2792 - DNA, 288 bp, Zea mays
  misc_feature: Incyte ID No: 700553269H1
cctactctcatctctctctttcatgatagccttcaccctgtgaacctctccccatctccaaagaaaacattccaaagcaatctacccaatgctcccataaagattggccatgcaccagtagtgcgcaaatgttggcttgataactatttcctatctggactctacttgaaagagaaaacaatgcacactctagtctccatcccactgttatatcctaaacggtttaaacgctgtttaaatgctactcagtagctaaacgtttaggttgtttatgttgtttcatccgtt

SEQ ID NO: 2793 - DNA, 286 bp, Zea mays
  misc_feature: Incyte ID No: 700553271H1
  unsure 23: a, t, c, g, or other
cgacgccgccgtcttccgcgcantagtgtctacactcccggcgacgatggcggaggacttggttttggacacggcgatccgagactgggtcctgatcccgctctccgtggttatggtcctcatcggcgtgctccgctactttgtctccaagctcatgcgctccccggcgacctctccgtctcccgaccccaagctcgttaaggaagggcaggtggtcatcagggcgaggaacctgaggaccaacgcacagttcatcccggccaaggctttcaaggcacgcaaggtt

SEQ ID NO: 2794 - DNA, 285 bp, Zea mays
  misc_feature: Incyte ID No: 700553273H1
gtatttatagttccttcagattagctatgaaagctatcactgctaccaaattttggttgtggagcaatcagcaaccttacacaatactaattgcatctctcaactcctagagtcgaagatccatcgattttgtgcataaggggtatacatcactcacttggtatttatcacctttctgttaacttcgttatcattctgtttgtttggaaaacgaaggctgaacaaatttcaccgatggagggcaacttggtatagtatttagttctatcgtacaccctttccttt

SEQ ID NO: 2795 - DNA, 286 bp, Zea mays
  misc_feature: Incyte ID No: 700553275H1
gataagcacacactacattctttggcagctgctgcagctgcagtggttaagcctgggaaaggaggtgaaatgaaaatcgcagacaatgaggtaaagactgaacaagatgaaaactcagaggaacgagattttccaaagatcaggaggctttcagacctgtactgtaggccttcggaggacagcactgaaatttcccagcctatgcctgcacgcttgcccgacaagtttcaggagcagagacccgagaaacgtcttgtgcatccacgggaggaggtcgggcggcgat

SEQ ID NO: 2796 - DNA, 282 bp, Zea mays
  misc_feature: Incyte ID No: 700553276H1
gaagggttgtactgcatggcaactagaaacttcaagaaagctgctagtttattcttggattcaatttcaactttcacgacatatgagctattcacatatgatacattcatcttctacacagtcctcacgagtgttatatctctggaccgtgtatctctgaaacaaaaggttgtagatgcgcctgagatcttagccgtaattggcaaagtacctcacctctcagagtttctcaattccctctacaattgccagtacaagtcatttttattgcatctctggctg

SEQ ID NO: 2797 - DNA, 282 bp, Zea mays
  misc_feature: Incyte ID No: 700553277H1
atggtttcttgttggaagctgatgagttggatgttcagcatgatggctttacatcgcattccaatggcacaatccacagccattagccgaggatttgatattcatctgtttggctactgtagtgccacttgtgatcaaatcctgatctttggtcgatatctaatgtttttatgaggctacgaaggattcggctttagagctactacccatcagaagtctaggaattgttcagagctactacttaggattttgtttagagattaatgatactgtttggttttt

SEQ ID NO: 2798 - DNA, 285 bp, Zea mays
  misc_feature: Incyte ID No: 700553278H1
  unsure 81: a, t, c, g, or other
acttttttggcccttcaaatgagttccacgcatcaagaagtcaagattccaggaggcctaaaataggagaggagggcgcanttgattcaatccatgtcaagtcagaggctgctgcgaggtttgcacatgcaagtagaatttagatggtcctgcttcgctttcatgtggatttatcttgcaaatggtatgtggatccgttccagaggcaatgagccttgcagccagtttgcagtataaaaaacccaattatgtccactgctggttcgacgcagcgtgtgccgagga

SEQ ID NO: 2799 - DNA, 289 bp, Zea mays
  misc_feature: Incyte ID No: 700553279H1
aacgtcctcggcaccatgagtgagggctgacctagagttcatcgacaacccaaaggctcggagatacatcaagtcccttccctatacccctggtgttcctctcgtaagtatgtacccacatgcgcaccctcttgccattgatctgttgcagaagatgctcatcttcgaccccaccaaaaggatcagtgtcaccgaagctctcgagcacccttacatgtcccctctgtatgatccaagcgcaaatcccccagcccaagtgcccatcgatctggacatagacgaaaacatc

SEQ ID NO: 2800 - DNA, 286 bp, Zea mays
  misc_feature: Incyte ID No: 700553280H1
ctcctcatgacgacaattcctttgtatttgtctaccgcgaagttaatacaatcagtcgtgtagagaatggggctcccattcttaaaaggaagtcagtggagggtggttctggaagtaagaggctaaagggtcttggtattggttctcctgatggtcctgtttcactagatgatgtccgaagactagaaaaatctaatgctgatctcagggaacaacttgaggcacatgttgtgacaatgagactttgagggctgaaataaaaacagcccaagtgcagcatggaaag

SEQ ID NO: 2801 - DNA, 71 bp, Zea mays
  misc_feature: Incyte ID No: 700553281H1
gtgaacttgtgctgtgaacttgttgcaaaacctcttgaacctgaagcattcaacatgatgtgagcttgtgc

SEQ ID NO: 2802 - DNA, 285 bp, Zea mays
  misc_feature: Incyte ID No: 700553282H1
  unsure 86: a, t, c, g, or other
cttctgtttaggggattcctgaacaaatggaggttcctgcaccgcctccgagttcccaaccagtcgaccctgttcaggcggtacanccagctcaagctggaccaaatgctaaccctctcgacctctttccccaatctcttccgaatgattccgctaatgccaacacaggaaatcttgatgttttgcgtaataactcacagttccaaaacctacttggtttggttcaggctaaccctcaaattttgcagccattgcttcaagaattgaggaaacaaaatccccggg

SEQ ID NO: 2803 - DNA, 288 bp, Zea mays
  misc_feature: Incyte ID No: 700553285H1
  unsure 11, 29, 35, 61, 102, 127, 137, 147, 154, 227, 233-234, 237, 240, 253: a, t, c, g, or other
gaaaactaganaaggctcctcccgaccgnaacgcncctcatctccctcgaccccgacatgncccgacccgatggcgcccaaggcggagaagaagccagcggngaagaagccggcggccgaggagaantgcggagaanacgaccgcanggaagangcccaaggccgagaagcggctgcccgcgtaccaagtcctccggcaaggagggcggcgagaagaaggggaagangaaggnnaanaanagctggagacctnacaacatctacatcttcaaggtgctgaagcaggtg

SEQ ID NO: 2804 - DNA, 285 bp, Zea mays
  misc_feature: Incyte ID No: 700553286H1
gggaacacaagatacaaaagatgctcacggagaaggctctaggaatgccattgtccctgcaccacttatgctgccaaaagcacctgaatctaccatacctggcaaaaatacaactctgtcaattcctggatcatctgacagattttctacatccgcactgatggaaaggatacctagtagatggccacggcctacatggcatgctccttggaagaactatcgggtcatcagtggtcattgggatgggttcgatctattgcatttgatccagcgaatgaatggttc

SEQ ID NO: 2805 - DNA, 287 bp, Zea mays
  misc_feature: Incyte ID No: 700553288H1
  unsure 11, 74: a, t, c, g, or other
gtgctgccggnggcgcggacaagaaggatctattccatgtcgtccacaaggtgcccgccggcgacagcccgtancgtcgtagccaagcacctccagctcgtggagaagcaaccggatgtggcgatcgtgtggttctggaaggcaatcaactcaggggatagggtggacagcgccctgaaggacatggccatggtgatgaagcagcaggaccgtgccgacgaggcagtcgaggccatcaggtccttcaggcacctctgctccaagcaggcccaagagtcccttgacaa

SEQ ID NO: 2806 - DNA, 282 bp, Zea mays
  misc_feature: Incyte ID No: 700553289H1
gaaaaagggaaaaaagtcaggcgtcgggtcctcagtcgtagcggcggcgatggcgcgcggcggcggggggcggtcgaagaaggaggatgaggaggagctgcggggggcgaacgcggttacaaggaggcgtcggcggagggtaatcgggaggaggaggcgcgctgggctaacgtcatcggcgacatctacaagcgccgctgcgagtacgtcgaggccctccggtggcttcgggcggactacgaggtctccgtaaagcacctcccgcagcggcacctcctcccc

SEQ ID NO: 2807 - DNA, 282 bp, Zea mays
  misc_feature: Incyte ID No: 700553290H1
  unsure 95, 112, 123, 148, 217, 225, 232, 243, 259, 266, 274, 281: a, t, c, g, or other
cgagaaagaagaaacccacagcagaaaaggagatcaaagagaaaaagtcgtcaggaaaaaaggtgacaaaaggtaaaggagaatcagctgaagcngttcttcccagcaaggncgatctgaggnagaccattactgaaatcctcaaganggttgccgtgttgaagtcaactttcttgaggatttcagtaatggtcttcctcagatcgtcttgctgggnagaacatntactganatcctcaaganagttgacttcaacaanggaacanctggtgtnagacttna

SEQ ID NO: 2808 - DNA, 282 bp, Zea mays
  misc_feature: Incyte ID No: 700553291H1
gttatccatgtttctgaaatcgaagagtggaatatggtcaaaagcctacatatcaagacggtggatgaacttggacttccaagatctgtaatacaagacatgctagatgaactggagcaactattgaaaggtatcgctatgatgaaagagctgacgcctaggaccagtgactaccttgtttcatttggagaatgcatgtccaccaggattttttctgcttatttgaacaaaattcgtgtcaaggcacggcagtatgacgcatttgatattggtttcatacaa

SEQ ID NO: 2809 - DNA, 264 bp, Zea mays
  misc_feature: Incyte ID No: 700553292H1
  unsure 13: a, t, c, g, or other
gttccatctcctnccgtcaccacgatcggactatggggcggacagggagggtcggcacaggacatcacggcagagcagccaccacggcgtctgcacagcatcaccgtccgcgctggcgttgccgtcgactccatcgagttcacctacaccgacgacgctgggcagaggcgcactgctgggcggtggggtggacttggcggcaatgttcgaacgatcgaccttggcgacgcagaggatgtcagggaagtctcgggaacatacggc

SEQ ID NO: 2810 - DNA, 286 bp, Zea mays
  misc_feature: Incyte ID No: 700553295H1
aacgcctgcggcagctgcccgaccccaacgcccccggtcgagccaccgccgccgcctcctgctaccccacccccttcatcctccagtgggaagtgcccgctgaacgcgctcaagttcggcgtgtgcgtcaatgcgctcggcctcgtcaaaggcgaggctggcaaggtaccagctgagccatgctgcaacctcatcaaaggccttgcagacttcgaggccgccgtctgcctctgcacggccatcaagggcaacgtcctcggcgtcgtcttcgatgtccctatcaatt

SEQ ID NO: 2811 - DNA, 280 bp, Zea mays
  misc_feature: Incyte ID No: 700553302H1
tgggcacccgactattgattgtccagtcaagggcacttctggtaagaagatggatgatgaataccagaacttcctggctgagcttggtggcggcagtgcacctgagtccatgaacaaatctggtggtccaatgttggctcttacaggaagtggtggtagcggtggtgcttctgctggaacggggagtaacccgccttggtcagccggtggtggtgctgctggcattgggctcaatggtatcaagaaagactatgacgagacaaatctgtatatcggctac

SEQ ID NO: 2812 - DNA, 285 bp, Zea mays
  misc_feature: Incyte ID No: 700553304H1
  unsure 7, 21, 27, 55, 57, 73, 77, 95, 105, 116, 168, 245, 257, 271: a, t, c, g, or other
gttgaangctgacctcgagangaccanaagagtgctgaacgcgaccgtggcgaananataggcgctggtggangagntggctctggagtctgtgncaggagctgncctagagccangaagaggatgttctgttgataggacatggaggtcaacagcacgggaccccgnaccatgtcgtcgacattaaccgaccgaccaaccgaccgtgaagctgacgcgactctctggccaccagccagccgganccatttttgacntcgctgctgccgcngaagccgacgccgc

SEQ ID NO: 2813 - DNA, 285 bp, Zea mays
  misc_feature: Incyte ID No: 700553306H1
  unsure 267: a, t, c, g, or other
aaaccgaactcgcacctcgcacctcggcattcgtcttgtcgacacacctccagctccgaaaccctactcccgccggcgatgtcgtcatccggcgccccggcaccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagatnaaggaaaaccaagagaaa

SEQ ID NO: 2814 - DNA, 279 bp, Zea mays
  misc_feature: Incyte ID No: 700553307H1
acttggggtacttcccagtggtgactcctgatgaggtcaaggaacatgttgcacaatccaggaaagctcaaaggatatgggcaaaaagcagcttcaagcaaaggcgccagtttcttcgaatcgttctcaagtatatacttgaacatcaggatctcatatgcgaggtatcatctcgggacactggaaagactatggttgatgcttcattaggagagataatgaccacctgtgagaagattacctggctttggatgagggcgagaagtggctgaaacctga

SEQ ID NO: 2815 - DNA, 279 bp, Zea mays
  misc_feature: Incyte ID No: 700553308H1
  unsure 58, 130: a, t, c, g, or other
gaagacaacccgtcagcccctctcgtttttcatccgccttcgcctccaaccgcgtgcnctccacgcctcctccaggaaagcgagagttctgcataagaacaacaaatcaaaagcgtgatcagctcggtgncaaaaaaacctcaacaaccaagtttcatgtctgatctcgacgtccagcttccatctgcctttgatccgtttgctgaggcaaatgctgaggactctggtgctggtcctggaacgaaggattatgtgcagtgcgcatccagcagcgcaacg

SEQ ID NO: 2816 - DNA, 279 bp, Zea mays
  misc_feature: Incyte ID No: 700553311H1
  unsure 35, 61: a, t, c, g, or other
caaatagttccttcctagggaactctgggattgtntggaccgccgctaactgaatgttctnttctatcttcaccaacaccgtcgcaagtgccttcaccaccaaaattaccaaatcatgagaagaaggctggcaatggcttggtaatcgtggctgttgctgggagctttgtcatatttctgctagctgctgtgatgttcactatgtgcatttcaaagaggaaggagaagaaagacgaagcgggttacaacggtaaggttactgatggtggaaggttgaga

SEQ ID NO: 2817 - DNA, 277 bp, Zea mays
  misc_feature: Incyte ID No: 700553313H1
  unsure 266: a, t, c, g, or other
gagattcgcaagaccttcaacatcaagaatgacttcacccctgaggaggaagaggagatccgcagggagaaccagtgggccttcgagtaaggaggtgctggatctattgatgcctaagtttcgtggtgtctactactatgtctactttatgttgtcctaatggttgtaagtattttgggagtcactttgcttgcgaatgtctcgcgtaagacttatgtggtcaatggtcggttataacttattaccatgaaagcacttcgtctgcnccctaagaggt

SEQ ID NO: 2818 - DNA, 282 bp, Zea mays
  misc_feature: Incyte ID No: 700553315H1
aacaggtggaaactagcccagaggcaaatgatcttggagaaattattttcttgtacaaacttgttgctggagcttcagatagaagctttggacttaatgttgccctgcttgcacagcttccgtctagatgtatcaagagggcatccgtcatggcagccaaactgcaagaggagttaagtccgcgggaggaaatcaagcttcggaggacaacggatgcacaaactgtggacggaccatctgaaagttccgcagaagttggtttgttttgtgcacatccttatc

SEQ ID NO: 2819 - DNA, 281 bp, Zea mays
  misc_feature: Incyte ID No: 700553320H1
gaaggatctacagttaatagcatcttctgttttacttgctgcactatccgtgtcaccttatgacaaaaaatatggtggcatttgagacagcgaatgagaaagagcgcaacatgcgtgctgtccaaccttgttaacttttcgcttgataacaagcgtgaaaacagggaaatgccttcaagaccatatcttctatcagagttggcctccaaaggagtcctttcatgtgcttcccaagaagtgcgagatttgtacaacctttggaacatgatatctacctctgg

SEQ ID NO: 2820 - DNA, 155 bp, Zea mays
  misc_feature: Incyte ID No: 700553322H1
  unsure 53, 68, 80, 90, 93: a, t, c, g, or other
cccgaaggcgatgttgatgaggatacagtaagaatctctgaacatcataagantgtcactggtttgcnttattgcatcanctggacacanggncaatccttatgatgttcagagattcttactgtatcctcatcaacatcataagattggccctg

SEQ ID NO: 2821 - DNA, 281 bp, Zea mays
  misc_feature: Incyte ID No: 700553324H1
  unsure 84, 183: a, t, c, g, or other
cgacgaatgtgcacggagatgaactcattatcacaaccacaagtccatatgagcaacaagcattcgcatcgaagactgattggngtgtcagagccatctctgccacaaacttgtatctacgtgtaaatcacatttatgtcaattctgatgatataaaggaaactggctacacttacattatgnccaaagaacatattgaagaaattcatatgcgtagaggatctgcgtacacaaatcgctggattcttatatgggctgagtccacaggacaatcctcaagt

SEQ ID NO: 2822 - DNA, 284 bp, Zea mays
  misc_feature: Incyte ID No: 700553326H1
  unsure 7, 9, 54, 96, 107, 177, 183, 190, 195, 210, 282: a, t, c, g, or other
cgcgcanancggcaacgaaacacacgagcaggtttccgttctatcctgcgcttnctcgactccgtagcagtcgcgtcgaggcagaccagacccgcncggcctggttntggtcgaggaggagactggactggaggaggacgggatagcagacgagaggagaggacgcgcacgccatgncaggtnccaccgncaaanccttgggagcgatcntggaactgaaggaacttcaggtccagcacctttcaagcccccatctggtggaagcaccagtgatgttgttgnag

SEQ ID NO: 2823 - DNA, 276 bp, Zea mays
  misc_feature: Incyte ID No: 700553328H1
gtggatcctaatgtcaacaagtgggaccaaccttttgtgttgggagttgttgatctgcatgactcatatctcatcctgccggggtttctgatgtccaggctgagtccaccacttgtctagatcctgatctatttacgaactttttggtacgtgagctatatattcctttcattattgctatcttatgctagacttgaaaaaactcaaatgcagttaaaaaagttttatgatgagatatctcttgctttgacaacatgttgcgtctgatgcatctgc

SEQ ID NO: 2824 - DNA, 278 bp, Zea mays
  misc_feature: Incyte ID No: 700553329H1
cggtgaagttgccattggtaatgatgagaaggatgtgaaagacttcctatttggatcttttgatgtgccattagccaacctggaagcaagcctaagaacttatgaaccttcagaggagccatttgacatatctttggtgtcaagagaagtcaggtcgctaccacctaaagagaaggcagcccctggcaagaggccacctggctggtgctgccgccgccgccacccctgtttcaactgttgatgcttatcagaaaagctttcgttcatcccgagttctc

SEQ ID NO: 2825 - DNA, 279 bp, Zea mays
  misc_feature: Incyte ID No: 700553330H1
agatatattatccgaacagtgtactcgcaacaaaaccaattatgaatttctacagaagtcctgatatgggcgaagcaattgacttctccattcatgttgcaactcctgccgagaaactggccctgatgaaggaacggatactgcgctacattgacaacaagaaggaacattggtacccgggcgcgatggttgtactccgggacgtcgatgataccaacaaactgaaagtgtcaatatggctgcgacacacactcaacttccaggactgggcacgcgttt

SEQ ID NO: 2826 - DNA, 154 bp, Zea mays
  misc_feature: Incyte ID No: 700553336H1
  unsure 88, 104-105, 107, 111, 113, 118, 122, 124, 136, 138, 140, 145, 148-150, 152: a, t, c, g, or other
gggccaacatcacaatcattggactctgaaaacgggagttcatgtgaaacaacctccatcacaacttcagatgattctgccatctgantcatcgattgatgacnntnctcntngatanagtngnatggtcatcaancnangagtnagnnncngt

SEQ ID NO: 2827 - DNA, 278 bp, Zea mays
  misc_feature: Incyte ID No: 700553337H1
  unsure 90, 105: a, t, c, g, or other
gcaagggaacccattgggcgcggtgcgcgccaccttcgagaggacggccgccgccgctgcggggagtctggaggagccgaccctgtggcnggcgttccgtggcanagactggggcgccggcgacctcttccgctccttcctcttcgagcaagacggtcttggcaaggttccggtgttggattcgtcaaatcttggattgatcaaaccgaacaccctggtccggtatcggggaatggttcaggatatgcttgggaatgagtactacttggtgctttcaa

SEQ ID NO: 2828 - DNA, 279 bp, Zea mays
  misc_feature: Incyte ID No: 700553339H1
  unsure 42-43: a, t, c, g, or other
tcaggcttccacgaatctccccgccgccctcaattcccctcnncgccgccgccctcaattcccctcggcgccgccgccttcctcccctcgcttcggtcctcggttagttaaccatccaggttctgtcaagatgtctgatagccatgagactgacaggaacattgagatttggaaaattaagaaactgatcaaggcattggaatcagccagaggcaatggcacaagcatgatctctctaatcatgcctccacgtgatcaggttgctcgagtggctaagat

SEQ ID NO: 2829 - DNA, 279 bp, Zea mays
  misc_feature: Incyte ID No: 700553342H1
  unsure 266: a, t, c, g, or other
gagattttgtgacatctgtggaacgattcaacaagtgaccacggactaaatttggtgggaccagttggagatgaagagacaatgagcagcatctcacaccaacattcttcagaaattaatcctgttgatgtatggcatgtgggcaatgtgaaggctcaaaatactgcagaaatggttaaggaaataaatgattcttttgacgattggcaagattctactaccatcggtccaagtccaggacacttcgttgaatcaaactggggacngatggaggtctca

SEQ ID NO: 2830 - DNA, 279 bp, Zea mays
  misc_feature: Incyte ID No: 700553345H1
  unsure 29, 31, 148-175, 268: a, t, c, g, or other
cccgaaggccacagcggcacagcgccagngncaaacagtcaccagaccaccactaccagtctacccacccacctgacctgagcgaccccttcgcttccactccactgaagcgggccaaaagaaggaaagaaggcgggcaagcgacagnnnnnnnnnnnnnnnnnnnnnnnnnnnnccatggcgagcgacggcgacgggaagggccgggtcgcgacggcgccgggggcaggagggtacggctacggctacggctacgccggcttcgagnggaggaggacc

SEQ ID NO: 2831 - DNA, 278 bp, Zea mays
  misc_feature: Incyte ID No: 700553346H1
  unsure 40, 190: a, t, c, g, or other
atgtaattttgtttgggttgtgtcccgtgcctataaatangtgaacagtacccccgtactgttccacgctgacttgggcattcgctttctacgtcacgtttgtactatcatctccttccagttaaaggtacacttgtaattcaacgatatttctgtttatggcctgataataatacataattgtttatgntggcttttatattcctatatttcctccctcgtcatgtataataaagttatgaaggtacgcctctcataaccttcgtccaaaaaccatt

SEQ ID NO: 2832 - DNA, 276 bp, Zea mays
  misc_feature: Incyte ID No: 700553349H1
  unsure 262: a, t, c, g, or other
ctcggagttcactgctgtaaatatgggtaacaccctaccagtgcatgatatgtcggaatccacaggtaaaatccgaatctatgttgcttcaaaagttactcccttttgtctgttcttggctagaacaaggtctggtcaaaataagaatgttttttgttccattttagttggagtttgggttttcaaatctgggccagattagttggatttaataatttggtttctaaggtgcagcagccataggatctcccaacaaggaggntctgcaacaatgac

SEQ ID NO: 2833 - DNA, 277 bp, Zea mays
  misc_feature: Incyte ID No: 700553350H1
gcaaaccaggtgggacagcaacgcgacgtgcttgctattctctcgaggagctcatgcaaggtgtaagtcttactggcaagaagggcagctgtgcatgttaagacccatacatagcctctcttgattacacagcacggggggtgaaaacttgagatacagttgatctcctggttcagagtatgggttcaaggtttgcatcgcatgcagctgagcaatggcctgtatgtttctggtcgacctgagcaacctaaggagaaggccccaaccatttgttcca

SEQ ID NO: 2834 - DNA, 276 bp, Zea mays
  misc_feature: Incyte ID No: 700553351H1
agatagaacatctggggagtacttggtgaagaatggcatccgcacctttgcttgcagtgagacagttaaatttgggccatgtcacatttttctggaacggtaaccgttcgggatactttgatgcaactaaggaggagtatgtagaagtacctagtgacagtggtattacattcaatgttgcacccaatatgaaggcgcttgaaattgctgagaaagccagggatgctctcctaagtggaaagtttgaccaggtacgtgtcaactgccaaatggtga

SEQ ID NO: 2835 - DNA, 277 bp, Zea mays
  misc_feature: Incyte ID No: 700553353H1
  unsure 148: a, t, c, g, or other
gaagaaaatggaggggtcctcgaagggtacgaattctgagtacggcagtgtgagcgcttcaggtgcatgagacggagggtcttgtcttggaacagatcaattccaacaacaagttgaccaggaaggctgagaactatcccgcattgtnagataatacgagcaccgagcgaggagggtattccagcaggaggaagatctcggagcaggtgcagagagggtcggaaaacgtggcaaggttggaactggagctccagaagatccagtacgtcttgctgaa

SEQ ID NO: 2836 - DNA, 274 bp, Zea mays
  misc_feature: Incyte ID No: 700553355H1
  unsure 36, 130: a, t, c, g, or other
ctcaaatagttccttcctagggaactctggattgtntggaccgccgctaactgaatgttcttttctatcttcaccaacaccgtcgcaagtgccttcaccaccaaaattaccaaatcatgagaagaaggcncgcaatggcttggtaatcgtggctgttgctgggagctttgtcatatttctgctagctgctgtgatgttcactatgtgcatttcaaagaggaaggagaagaaagacgaagcgggttacaacggtaaggttacgatggtggaaggg

SEQ ID NO: 2837 - DNA, 274 bp, Zea mays
  misc_feature: Incyte ID No: 700553358H1
  unsure 71: a, t, c, g, or other
ctcggagttcactgctgtaaatatgggtaacaccctaccagtgcatgatatgtcggaatccacaggtaaantcgaatctatgttgcttcaaaagttactcccttttgtctgttcttggctagaacaaggtctggtcaaaataagaatgttttttgttccattttagttggagtttgggttttcaaatctgggccagattagttggatttaataatttggtttctaaggtgcagcagccataggatctcccaacaaggaggacttggcaacaaga

SEQ ID NO: 2838 - DNA, 276 bp, Zea mays
  misc_feature: Incyte ID No: 700553360H1
  unsure 29, 57, 73, 146-169, 252, 273: a, t, c, g, or other
gccaaaggttggacaactcaccgatccgncaccacgccacgaaatcatctcctactnccagcagttccgctcntcgccgccgccaccggcgccaccgacacgatgccggaagacgtgcagatgaacgactcggagccccagtctgnnnnnnnnnnnnnnnnnnnnnnnncgcgccggcgctctccacactacaccatctgaaggagatcgcgtccgtgatcgaggctggttctctgtccaaggaggtccgcnggatctcccgcgccttccgcntca

SEQ ID NO: 2839 - DNA, 275 bp, Zea mays
  misc_feature: Incyte ID No: 700553361H1
aatctgctcacgtacgccatttggcctgacatttttatgtatgtactcccgatgcaaatttaaataaacactgccatctactaacaactacgacgacatatttgtttcttgggaaggccaggccaaaaactaaggttcatgagcagttgtctccttccctttgtttcctcatacatcaaagcaggacacatgctactgatcatcctgtcgtccgtcccatgcatatggagccagtagccacacaaagctagctgtaacttttacagttctacctc

SEQ ID NO: 2840 - DNA, 278 bp, Zea mays
  misc_feature: Incyte ID No: 700553362H1
  unsure 152, 155, 267: a, t, c, g, or other
gaacaggacgatggccgagggaaagaggtggcggttcgcgatggtctgctccttcgaacatgaaccggagcatggaggcgcactcgcagctgggccgcgcggggctcgacgtcgagtcctacggcacgggcacccacgtcaagctccccggnccntccctccacgagcccaacgtctacgacttcggcaccccctacggcgccatctacgacgacctccgccgcaaggaccccgaactgtcagtacgagcacctactgtcatcttcntctccccacct

SEQ ID NO: 2841 - DNA, 278 bp, Zea mays
  misc_feature: Incyte ID No: 700553363H1
  unsure 252: a, t, c, g, or other
gaagaagaccagttcccctctcctgatcgtcctgttcctcacagcagcagccatggcggccgagccggagaagcaggcggcccccgcggcacaggagacggccgtgcacatcgtgtacgttgaccgccccgaggacgccgaccctgaggagttccacatccgcaccctcacccccgtcctcggcagcgaacagaaggccagggacgcatgctctaccactacaagaacgccgccagcggttcttccgcgaanttcaccccccagcagtcaaggatctc

SEQ ID NO: 2842 - DNA, 102 bp, Zea mays
  misc_feature: Incyte ID No: 700553364H1
  unsure 92: a, t, c, g, or other
gagctgggctcagaaaacctttttctggatccgtgtttccaagtcgtaaaactaatataactacttagcgatcccgttctggagttaaaaanacaaaaaaag

SEQ ID NO: 2843 - DNA, 276 bp, Zea mays
  misc_feature: Incyte ID No: 700553368H1
gggctggccaccagtccgatcgtaccgcaggaacgccatgacgaccgtcgtccaggccgtgaggagcaagaaggaagaggaacctgagaagcagcaacagcccgctgccgccaacgccttcgtgaaggtcagcatggacggcgcgccctacctgcgcaaggtggacctgaagacgtacagcagctacaaggacctctccgctggcacttcaagaagatgttcggcaccttcaccgcatctgggaacagcatgaacgaggggagttggttgatccgg

SEQ ID NO: 2844 - DNA, 271 bp, Zea mays
  misc_feature: Incyte ID No: 700553369H1
  unsure 145, 194, 221, 252: a, t, c, g, or other
cctcagacccgagaagcgcagtgcggccatggacgccaccggcactggagctggagggaaggcgaagaagggagcggccggtcgcaaggccggcgggccgaggaagaagtcggtgacgaggtccgtgaaggccgggctccagttncccgtcggccgcatcgggcgctacctcaagaagggccgctacgcgcagncgtcggcagcggtgcccccgtctaccncgcggccgtcctggagtacctcgccgctgangtcctggagtcgccggcaa

SEQ ID NO: 2845 - DNA, 270 bp, Zea mays
  misc_feature: Incyte ID No: 700553370H1
cctatggataattatggaatactgtggtggtggaagtgttgctgacttgataggcatcacagaggagcctcttgatgaatcccaaatagcttacatttgtagagaagcactaaaggttctaacaccacatttgtggggcaattaaatgtcttcgaatatttaacttttgtgtgcttattttcttctccagggcctgcttacctgcactccattttaaagttcacagagatattaaggggggcaacatcctctaactgagcaaggcgaggt

SEQ ID NO: 2846 - DNA, 270 bp, Zea mays
  misc_feature: Incyte ID No: 700553371H1
  unsure 167: a, t, c, g, or other
gccgcgatccccgcagtgatgtgcggatcgggtcatgggtgtgacccagccgggaagtagtggaggctgctggaggactagggccgggacctgcggccacgacgatgtacgtcgcccgggagtctaccaagctgtggaggagggtgtgcgcggagacgacagcggantgcagcttctgttcgagaagtggcaattgctccttgcagggttggtgtttcagtacatccatggattggctgctcgaggagtgcatacttgcatcggcccgga

SEQ ID NO: 2847 - DNA, 273 bp, Zea mays
  misc_feature: Incyte ID No: 700553372H1
  unsure 14: a, t, c, g, or other
atctgttgatagcnctcggcgtttccacaatagcatgagcacattcctaaggcacgccgaggaggagatcctgaagctccagtcccaggagagcatctgcttgtcatcagtgaaggagatggcggagtggtttattggagagtcagtcaacgatgaagctcacatgttcagaatctttgctggagtgaaggagttcctagctatgctcgatcatatctgcaaggaggctggggaggtgagcagcaacaattgggtcggcgcgacaacggcgag

SEQ ID NO: 2848 - DNA, 273 bp, Zea mays
  misc_feature: Incyte ID No: 700553376H1
aacaaagtcctattttatccagcaagacagcagtattcagtttctatgaatggatgccaagatactgttcctctaattcactgcaagaactggtctatatcttgaaggatcagtgttacctgcaacttctgatgttgacatcaagattctagcagctggaaagagcaactatgcccatctgaacaaaggggatgtagcaacagaggcaaagacagattctgaaggatcattttttgcaggtcctttgtatgatgacatagtatataaagttga

SEQ ID NO: 2849 - DNA, 274 bp, Zea mays
  misc_feature: Incyte ID No: 700553377H1
gagctgctccgagccacctgagctcgagccaactcgcgagcctcaagctttttttccagcccctctttggtacttttgccaaagattgaaaagcagctacagttgggagattgttaatggataagattgaattagcagatgaagattcattgcttgaagaattggatggaagtaaatttacgccctagcagtggtacttcagttgtattctttctttagaagcctgcctcaatgcttgaagaattggatggaagtaatttactctctagcagag

SEQ ID NO: 2850 - DNA, 274 bp, Zea mays
  misc_feature: Incyte ID No: 700553378H1
  unsure 272: a, t, c, g, or other
aggatcttgggatttccggttacacaattttctttcaatcagcttctgttactctacaaaaggctggacaggaagaagattgctgatgttcttggcaatgatggaaaaggaggatgtgaaaccatctctctttacttacaagattcttgtagatgccaagggttcagttggagatatagaagctatggagaaagtgattgaatcaatggagaaagatagcatgagccagatctcacgtttaatgctacaatgccagacactacgtattttangg

SEQ ID NO: 2851 - DNA, 281 bp, Zea mays
  misc_feature: Incyte ID No: 700553380H1
  unsure 63: a, t, c, g, or other
aaggctagcaggtaggctgggctctcgccgagcgatggatctcgagttcggaaggggcctgangtcccccaaagagagactcgtggaagaccaccttgctgctggcgtaccagagcctgggggtggtctacggcgacctcagcatctctccgctgtacgtgtacaagagcaccttcgtccgaggacatccagcactcggagacgaacgaggagatcttcggcgtgctctccttcgtcttctggacgctcaccctcatccctctcgtcaatacgtctccgtt

SEQ ID NO: 2852 - DNA, 271 bp, Zea mays
  misc_feature: Incyte ID No: 700553381H1
  unsure 260: a, t, c, g, or other
aagggagcggtgttatcttgaaagacaacccagttgctggcacaaatggtggtgccacgtgggcctacgaggttgctggccaaactatggtttgcccaataatcattgaggatctttcgccacctggtcagatgcttgttgagatgctttgcgaggaacaagggctctttctggagatagctgacaacatacgtggaattggtctgacggtcttgaaaggacggatggagctctgtgatggcaagatatggtcgcggttncttgtcgaggc

SEQ ID NO: 2853 - DNA, 270 bp, Zea mays
  misc_feature: Incyte ID No: 700553382H1
gttatccatgtttctgaaatcgaagagtggaatatggtcaaaagcctacatatcaagacggtggatgaacttggacttccaagatctgtaatacaagacatgctagatgaactggagcaactattgaaaggtatcgctatgatgaaagagctgacgcctaggaccagtgactaccttgtttcatttggagaatgcatgtccaccaggatttttctgcttatttgaacaaaattcgtgtcaaggcacggcagtatgacgcatttgatattg

SEQ ID NO: 2854 - DNA, 272 bp, Zea mays
  misc_feature: Incyte ID No: 700553383H1
aaacaggatgggaatgaacgaatccattgtgagaagagctcttctgattatgcatcaaagagacgaggtggagtacaagagagagcgccatgtgatcgtccggaaggcttgatgtggagagtccagtcagactcattcatggcatacaacgaacgttcatggcgtcctctcctgcagacgcgtccataccttcactgagactgcacatctgtccgtcctgaggggacgagacacgccttagttggtctctgacatgactgactgttgtaatc

SEQ ID NO: 2855 - DNA, 92 bp, Zea mays
  misc_feature: Incyte ID No: 700553384H1
  unsure 64, 68, 74, 78, 81, 85-86, 89-91: a, t, c, g, or other
ggactagttctagatcgcgactgcccttgtccgaaattaatgaaatgcccttgtttccttcaanaaangaaagnacanganaaannttnnnc

SEQ ID NO: 2856 - DNA, 271 bp, Zea mays
  misc_feature: Incyte ID No: 700553385H1
  unsure 46: a, t, c, g, or other
actccctccaccatcaggagggaccacagcggccgaagcgatgggngcggccgaggcccaagagaggagaacggcggatcgacgccgccattgaccacctctcccagtacggcttcgccaagccccaaatccgcaagattatcaacaacctcttgcagctgtacgggaaagatgggtggttgttcctggaggaggcgtcgtaccgtgttgtgcttgacaaactcctggaagaacaggcgcaggatgatcagaaacaagagcagcggctgca

SEQ ID NO: 2857 - DNA, 268 bp, Zea mays
  misc_feature: Incyte ID No: 700553386H1
  unsure 257: a, t, c, g, or other
gtttcaattcatataagtttgtaccagcactgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatgtcaacttggatgggatggactctcgaattttggcggtatgggtngtatgggtggc

SEQ ID NO: 2858 - DNA, 263 bp, Zea mays
  misc_feature: Incyte ID No: 700553389H1
  unsure 6, 37, 54, 105, 252: a, t, c, g, or other
cgagcnaggttcccctcccgactcggtgatggcggcnccggcggcggaacgaangcatggtgccgaaagacggtgccacgggtgatggaactggtgtgtcggcgnttccgcagcgggacgcatgcgcgctgcttgctgtcagtccctggtgctaccgtgccctcgttgctaactccaggctctgggaggtacttgatctacgtgagatgaagaatgctggaaaccgacttatttcagcactttcactggcanggtatcgtcac

SEQ ID NO: 2859 - DNA, 269 bp, Zea mays
  misc_feature: Incyte ID No: 700553390H1
ttcgttacaaggatcttcttgatgatgtttactctgatatatcaaatttgctgaaatcaagcgggaatgtttgctcaattatatattgccttgaacgggcagcttgtgatgatctaagcatgcatttgtcacagcagggtgtctcttgtgctgcttatcatgctggcctaaatagtaaagtgcgaagttctgttctcgatgactggctttcatcgagaactcaagttgttgttgcaactgtagcatttgggatgggtatgatagacaag

SEQ ID NO: 2860 - DNA, 271 bp, Zea mays
  misc_feature: Incyte ID No: 700553391H1
ctaatcctgccggaggtccaagcaacatctctttcagcgaagagcctgtagtgaagacagcaaagaaaatccacaaccagaagttccaggagctgacaggtaacaacatcttcaaggaggacgtccctgcctcggccgagaagtctctgagctctgcgaagttaaggagatgagcggcagtgacatcttcgccgatggaacgccagctccccgagaataccttggcggcatccggaagccccctggcggtgagagcagcatcgcgctgatc

SEQ ID NO: 2861 - DNA, 271 bp, Zea mays
  misc_feature: Incyte ID No: 700553392H1
  unsure 179: a, t, c, g, or other
agccggcgtcagaggcgaacagagaaatggcgggagcgaacttcctctccaccgcgggcgcttcgtcgcccgcggcgtcgtgctgctcttctatttcaactccgacacggaggcacccgcaaatccgggtgttctgccgggctgacgctgaggccttggaggcctatgcccatgaagancgcctgcgattccgtcggagagatttcatcggcacctgcgtcggcaccgctgttgctttggaaatgatcgacggctgtacgagtttctctgg

SEQ ID NO: 2862 - DNA, 276 bp, Zea mays
  misc_feature: Incyte ID No: 700553394H1
  unsure 11, 34, 45, 72, 89, 102, 182, 189, 263: a, t, c, g, or other
ttttgtggaanctatatactcgagtgagaaactnccaatgctctnaagggtcaggcagtgtacctcgtgcanagcaaaacattaggggntatgaccatccantggcctgcatttggtacttgccataggacagagaaatcatcgtctatttatgggcccttttgacaggatttgttgttgcngaatcancatatacgatgtgctcaacaaaatatattaccagatgcatcagttcagggactataagatcggagaatctgtgnctttaaacatagt

SEQ ID NO: 2863 - DNA, 184 bp, Zea mays
  misc_feature: Incyte ID No: 700553395H1
cataaaggtgaacaagggaccattaagctagaactatcacaataaccaaatgagatgggagagctagtaggtcatgatatttagttgtttttagcttgtatgtaacaccctgaatttgggggtataaaatttctttcttattatcatccaaattcaagtgttactcttctctatctctccctag

SEQ ID NO: 2864 - DNA, 307 bp, Zea mays
  misc_feature: Incyte ID No: 700553401H1
caggacagaagtctctcttggcaagaagctgaagttcacttatcttccagagattgaaaagattcacaagaagaaggagaagttgctaaaaaagcaacaaagagaagccatcctccttgacagctgcttgacagtgaatggattgacatctggccgctctcgacgtgaaagaaaacatgtgacttatacttttgatgattatgagcgttcaataaatgaagccataaaaacaataaggaaaaatgagaatgctgttgaggttggcccctccccattatgcaaaggatttatggagaaactccagaga

SEQ ID NO: 2865 - DNA, 303 bp, Zea mays
  misc_feature: Incyte ID No: 700553402H1
ctggaaagactgtggatcttagtgtggatttgagtgcagctagtgctgctgaagaatactgatttcagtcataatgtttatcaaagatcacatccattggggacagcacatgaccaaacttcaatgagtggctagtatgagtttagtcggttccagattataccatgccgacttctactgtacctcgtgaatcgtgatgtctattgggcacttgttgctgacagaactgtgcacaatgttgatccaatttgatggatggtggtggttctgttatttactagtcggtcaaaacactaaacggtg

SEQ ID NO: 2866 - DNA, 297 bp, Zea mays
  misc_feature: Incyte ID No: 700553403H1
cagctccccgagaagaagtccacaaatcaattgacacatgttatggttgcaacaagagacaacaaagaaacaacagaggccatttgccgtaagattggggttttcagccctatgaaggtcaaactggcatggtccggcatggatcctgccttgcccacctaggaggatgctacagctttgaaggaacgctccctgcacgcgtcggcttggggacaagccgcatttgaagacccggggaatgtcagcactggatgatccacaagagaaggagacgtggagctgaagactgacaaaggc

SEQ ID NO: 2867 - DNA, 161 bp, Zea mays
  misc_feature: Incyte ID No: 700553406H1
  unsure 2, 22, 55, 57, 69, 89, 106, 121-122, 138, 141, 160: a, t, c, g, or other
antgcgtacaagaggcccccgngattttggccgagatggtttcagacgagatccnanaaggtatggtanagatccatactgggacagangggacagggaacggagntatgatcgtggaagnnatccctaccatgacanggntagtgatagatcccgtganc

SEQ ID NO: 2868 - DNA, 292 bp, Zea mays
  misc_feature: Incyte ID No: 700553408H1
  unsure 181-182: a, t, c, g, or other
gattgagccacagtttgcttcaaacaattatacgtttgatgtgtatgtgaggacagatgggcgagtcaagctcatagatttcaatccatggggtggttataccttgccgctgctgtttacttgggaggagcttgaggagaaggggagagggtctgagctggagtttcgggtggtcatgcannagggtgcagtgaggccaggattgatgacagctgtgccatatgatatgctggatggggtgaggggagtggctgggatgtttttctgaagaaggctgacgaggacttgacac

SEQ ID NO: 2869 - DNA, 295 bp, Zea mays
  misc_feature: Incyte ID No: 700553409H1
  unsure 4: a, t, c, g, or other
ggcngccggcgctggagatggtggtggcgccggtgatgggtgcgagcactgccaccttcttcgctgctcgaggactggctgctcgatgacatgccagggcaggccatggatgggttcatggggatctccgccggttgctgtgcggatcccatcatgttctagttgctgtatcgtcgtcgtcgtggctgtctgtcatataggcttcgttctcaatggtagttcttgcacttgtaagttggttgatcgaagacatgatcaggtcgatcggccctatgtttccggtaataagccgtta

SEQ ID NO: 2870 - DNA, 220 bp, Zea mays
  misc_feature: Incyte ID No: 700553410H1
  unsure 121: a, t, c, g, or other
ggaaggagttcaagatgatgccaaggcagatgcaaatgttatgaatgtttcttttggtaagggaaaatcagaagattcttttggcacaattaatggtaccaacagtggagataaaatagantctcctagtggtttagcagaaagaacattgactcagcctaccactaagggttgcagtaagcagcgtggccgtagttctaatggtagaggaaacaggact

SEQ ID NO: 2871 - DNA, 294 bp, Zea mays
  misc_feature: Incyte ID No: 700553411H1
ggtcggatcaaagtctgaagctagtggaattgccaaagctggagcaaagatggtcatggcagtttcctgtgctaaggttcctaaaattacaataattgttggtggaagttttggggctgggaattatggaatgtgcggacgtgcatatagcccaaactttttatttctttggccaactgctaggatatctgttatgggtggcatccaggcagcggagttctcgctcaaatagaaaagaacaacaaaaggagacaaggagtggagtggagcaaggacgaggaagaagcctcaaag

SEQ ID NO: 2872 - DNA, 295 bp, Zea mays
  misc_feature: Incyte ID No: 700553412H1
  unsure 49-50, 60, 201, 209, 216, 218, 221, 225, 231-234, 238, 240, 242, 244-245,: a, t, c, g, or other
tgaacgaacaaagccaatcatcgcatcgctcgatcacgtgcaccctggnncattcttatngccgctgctgcttgttaaaacatatgtatgaccagggtgcagcggcataagaatgaacctgttcgggggctaatcttattccttttggattgtaagtgcattgacattggataattcatgtttgtggcactgagtttcganaaaaaaangaacgcnanaanaaanaggggnnnncccnananannacnncgnccaccccggacattnnttcgggncgggacnctnnggntncccc

SEQ ID NO: 2873 - DNA, 295 bp, Zea mays
  misc_feature: Incyte ID No: 700553413H1
caggcgtcttcgtactcgcctatctccgcgactcaaagcttcttccatttcctaccgccgccgctgcagctccaccccattccgtgcgacaccatgagggagtgcatctcgatccacatcggccaagccggtatccaggtcggaaacgcgtgctgggagctctactgcctcgagcatggcattcaggctgatggtcagatgccggtgacaagaccattgggggtggtgatgatgctttcaacaccttcttcagtgagactggtgctgggaagcagtccctcgtgctgtttttgtt

SEQ ID NO: 2874 - DNA, 110 bp, Zea mays
  misc_feature: Incyte ID No: 700553415H1
  unsure 65, 68, 85-87, 106-107: a, t, c, g, or other
agaacccgtactgctcgtttaagctcatggtgaactacgagctaaaaggctgttgccaaaaaaanaanaaaaacaaacgaaaaannnaagaaaaaaaaacaaaacnngcc

SEQ ID NO: 2875 - DNA, 301 bp, Zea mays
  misc_feature: Incyte ID No: 700553417H1
ggtcaagggataggagtcggtccaggagcccagatgatagaaatccagggaataacctttatgtaactggattgtctactcgtgtaacggaagatgatcttgagaagttctttagtaaagaaggaaaggttaagaactgtcatgttgttcttgatcctaggacaaaagaatcccgtggcttgccttcgtgactatggatactcttgaaggtgcaagacgctccatcaagtatctgcaccgcactgtacttgaaggtcgcctggtcatgtagagaaggctaaaagaatcgtgaaaggacccc

SEQ ID NO: 2876 - DNA, 295 bp, Zea mays
  misc_feature: Incyte ID No: 700553418H1
  unsure 52, 74, 178, 227: a, t, c, g, or other
aggactttatggccctcctggcttatgaagagccggagaagtcacctatgtntcatctactaagcccagagcanaggcagaatgttgcagagggcttgaatcgggctgtccttgcacatgctaatcttccagcatattcatcgttggagagggtggtccagcaagcgactgtggttanacaatacctacagcaggaagttggctaggattcttaccaccatttcttngaaggccttctgagcaagtaaatgtgcaatggtcactcttcagaacagggtaaccacctctccaggcc

SEQ ID NO: 2877 - DNA, 296 bp, Zea mays
  misc_feature: Incyte ID No: 700553419H1
cccttacctgagactgctcctatttctaaacggccatacaggatgtccatagaagaactaaaggaacttaagaagcaattaacgggattacaagaggctgattacattcgtccgagttcctcaccttagggagcgtcggttctgtttgtacaaaagaaggatggatcacaaagagtgtgtgtggattatagatttcttaatgatgttacgttgaagaacaagtattcgttaccccatattgaggattattcgatcagatgagatgtgcaagggtattttcgaagattgatctccga

SEQ ID NO: 2878 - DNA, 289 bp, Zea mays
  misc_feature: Incyte ID No: 700553421H1
cgcagaaatactcggaaaaggtcaccaccaagagctcgttcaaggaccccacccaggagaaggcactgatgtttccccagcatgtcttgaactacttgctatgtgtgacgaagagcaagaagtctggggattccaaatattaccttggtgtatgtggatcacctgatttcgatggtggttattaaattgcctgttgtttcctattgggatccaaatattagcttgaactctggtgtaagttgatgagacatggatgtgcactagacgcttaccattatgtttggcagcc

SEQ ID NO: 2879 - DNA, 289 bp, Zea mays
  misc_feature: Incyte ID No: 700553422H1
aaaataaagggcactgatgcctgctgtcttgttctgcccccctgttttccttttattctgctccgctctgttctcctgcgggcctggctgcgccggggaggcaaatgcttagcacagattcttcattttaagatatttgaaaattgaaatgtcggtaggacttggccttctggaatcccccgctaaaccataggcgtgttctattggaagttggaacaaaaccatggagagtgaaatcatggcctcctatgaaacaaagcagaatgcgaaattagggtattgagagttc

SEQ ID NO: 2880 - DNA, 293 bp, Zea mays
  misc_feature: Incyte ID No: 700553423H1
  unsure 266: a, t, c, g, or other
tactaaaggattacatcaacaaaatcttactgatttttttacaataagcatgttgatttttatttctttacatcttctcaatcaattaagcatcataatcggtatcaccttctttcacagcaacaccaagcttttcatggatttcagttggcctgcattaaacatattaacatgtaaggattcgaggaacacatggtggaacacaaaatggcaaaaagtagggaaaggaaccttcgactttgagatgaagatgcgcacggtatganaggcacggtctggagattgatgaatca

SEQ ID NO: 2881 - DNA, 287 bp, Zea mays
  misc_feature: Incyte ID No: 700553426H1
  unsure 2, 23, 181, 220: a, t, c, g, or other
gnacatgttaaattgattgcttngaatcattcttgcttggctagataggattaattagttcttggttattgattggtgaagtcttgtagttgcatatggttgttcattttctttcttaacacttgctttagacttgaatgaattaagaagggggaaacacttttgtgggtgtaaataattnagttcaagcaataggtaatccaacgatcagatgcttgtnatggtttagtagtagcttatctatgctttgtgctcgctttacctgtggttgcatatcagtatattaa

SEQ ID NO: 2882 - DNA, 293 bp, Zea mays
  misc_feature: Incyte ID No: 700553427H1
  unsure 269: a, t, c, g, or other
caaccatgtgatccaggacatgctggtgccgctgtacaaggttggggatgcgctggagttcgtgcaccgcgagatggaggtgtatcctctgtggctgtgccctcaccggctgtacaagctgccggtgaagacgatggtgtacccggagcctgggttcgagcaccagcacaggcagggcgacacgagctacgcacagatgttcacggacgtgggcgtgtactacgcccccggggcggtgctgaggggggaggattcaacggcgcggaggntgtgcacaggctggagcagtggct

SEQ ID NO: 2883 - DNA, 292 bp, Zea mays
  misc_feature: Incyte ID No: 700553428H1
caggcctcaaattaatgccttcctggaagggtttaatgaactcattccacgggagctgatatctatcttcaacgacaaagagcttgaacttctgattagcggtcttccagatattgacttggacgatttgaaagcaaatacagaatattctggctacagcatagcctctccagtcatccagtggttctgggaaatcgttcaggggttcagcaggaagacaaagcccggttcctccagttcgtcactggcacttcaaaggtaccgttggaaggttttagtgcattcaagggat

SEQ ID NO: 2884 - DNA, 295 bp, Zea mays
  misc_feature: Incyte ID No: 700553429H1
aacaattacctcattaaacgatgtcaacctatgtgatatatagaaactatagcaatgcactggcatctaaaaatgcaatggtatgcaattctacatatttgagaaaaaatgttggacatcaacatgtaagaaactagatagctttaatatgtttgttctattatccctaagacatttgcgctaattgtttattactccgctattaatttttaaaacagacttataaaattatcatccagacaaggttataattattttccatgtcaagtttttggacacttgctggttttagttg

SEQ ID NO: 2885 - DNA, 298 bp, Zea mays
  misc_feature: Incyte ID No: 700553430H1
  unsure 275: a, t, c, g, or other
gaagaaagcatctctccaaagaagccaacttcgatagcagaggtcgcaaagcagcgcgagctaagcggcacgcttctgagcgaggacgacagcaagatgaagaggcagatatcggacctgaaatccaaggagctgagcggccacgacatctttgcccctccggaggatccgaggccacgcaactcggagaacggctcgacctcgcagactccgggcaaaatgcacacgtcctgacctctgactctgaatcaccctcatcatattatatgaaccanaccaacccattacaaaaaagctg

SEQ ID NO: 2886 - DNA, 297 bp, Zea mays
  misc_feature: Incyte ID No: 700553434H1
  unsure 202: a, t, c, g, or other
tgttgccaggccatttcaaacgtaccacactatacccagccagggttatgtcatctactctattcgaagaaagttgaaaaaacagtatgctcatttgaagggtagtcaaataatgaaactgaagcaatcaggaaccgagattacggataccatactgtacccagaagttgccttcacaggagatacaaagtctgattttatnttgacccaagagatgcagatgccttgagagcaaaggttctcataactgaggcaacgttcctagatgaccatgttgatgttgagcatgctagggac

SEQ ID NO: 2887 - DNA, 210 bp, Zea mays
  misc_feature: Incyte ID No: 700553439H1
  unsure 197, 202: a, t, c, g, or other
aagtaggtcaatataatcctgtaagttatggtgatttatgggtgtgttagcaatgcaataataattagagagggcaggatcagggtttctgttgtttgtactggttagagatttagtcctaatgtaacttcctgggacatggggggcggaatgggaagagagtaacaagaatcttcctttggttactgtagtaaaanaaaanaaaaaaag

SEQ ID NO: 2888 - DNA, 291 bp, Zea mays
  misc_feature: Incyte ID No: 700553443H1
  unsure 171: a, t, c, g, or other
tagagcccttttacgaggacttcggatggatgcggcgagcatgcaaggggcttgaccggcatttgatcgaggatggactggcaaacacaatcctgacgctgcctcttgcaactcagcaggagatccttctggcatggtttaaccgcttcctcaactctggggaggattgcncaaatattcagagagggtttgaggtgtggtggcggcgcgccttctggaaaaggaactctgaaccagaaccaccatcccgtttgaggattactgcgatctgcgagaatcttgatgacgacg

SEQ ID NO: 2889 - DNA, 290 bp, Zea mays
  misc_feature: Incyte ID No: 700553444H1
ataggaaagaatgcaattttgaaattaatggacgcagttgatgagtacatccctgatcctgtgaggcagcttgataagcctttcttgatgccgatagaagacgtgttttctattcagggtcgtggaactgttgttactgggcgtgttgaacagggaacaatcaaaactggtgaagatgttgagatcttgggtttggcacagactggtccttgaagactacagttactggtgttgagatgttcaaaaagatactggaccatggagaggctggtgacaacgttggccttctt

SEQ ID NO: 2890 - DNA, 291 bp, Zea mays
  misc_feature: Incyte ID No: 700553445H1
ttctgtatcatagacatacagagagtgttcctccaattctagtccatgctggtctacactatgctgccattaccgatattgcatggtcttctgatgctaagtacctggcagtgtcatcacgagatggctactgtactataatagagtttgagaatgaggaactgggacagcctcacatactccccggatcaaaggaagttgctaatgggattctgacacctgagaccaagaagcctgtatgtgcagatagcatgaaggttgataatagtgccaacaagctaagatggaagc

SEQ ID NO: 2891 - DNA, 304 bp, Zea mays
  misc_feature: Incyte ID No: 700553448H1
  unsure 138, 178: a, t, c, g, or other
aacatatctcctcgcattttccttgcaaccgattgcctatccccctcccaaccaaagaccgatggcgcccaaggccgagaagaagcccgcggcgaagaagccggcggaggaggagcccgcggccgagaagacgaccgncgggaagaagcccaaggcggagaagcgggtccccgcgggnaagtacgccggcaaggagggcggcgaggcaagcgtggcaagaagaagggcaagaagagcgtggagacttacaagatctacatcttcaaagtgttgaagcaggtgcaccccggaccttcggcatttc

SEQ ID NO: 2892 - DNA, 293 bp, Zea mays
  misc_feature: Incyte ID No: 700553450H1
  unsure 2, 199: a, t, c, g, or other
cnccctccctgaccgagcgatccagcgagagggagcgagtagcagccgcagccggaggagctcgccgaggccgccgaagacgaccatggggttctgggcgacgacgctcatcttcgtcctcgccggcgtcgccgcatccctcttcacgctcctctgctgcaaccgcgggccctccacaaacctgttccatttgaccttngtgactacagtgtaatttgttgctggatgatgtatgcaatcgtctaccttgctcagatgaagccatgatcgaccccattctgagcggagagtga

SEQ ID NO: 2893 - DNA, 293 bp, Zea mays
  misc_feature: Incyte ID No: 700553451H1
cagcacacctacgacattggcgactacgagttccccgatgagttccgcaccccctctacgcccaccaagaacgtcatcagaagcgtcgccgcgcttaaagggaagctgcatttttgcttcatggaatcgcaccaaaacaagatgtgcgtcgttgacttagatttcccgtccgatcatggccaccctcccaccgcagagttccacgagtttgatgtctccccagagttcggcatcaagtttcctgacggcgtctgctctgccagcatccacttggtagagtccatggacgagct

SEQ ID NO: 2894 - DNA, 288 bp, Zea mays
  misc_feature: Incyte ID No: 700553453H1
tcgattggttgttgttgattgcactgcattgcaggttgagggcaccagcagatacgactgcttcgagcctgggacggtcggccggatggagctcctcgtcctgatggcgctcaactggcggctccgctcggttactcccttcaccttcgtcgacttcttcgcgtgcaaggtcgacccaggagggaggcacaccagtgcctcattgcccgggccacgcaagtcattctggctgcgatgcatgacgtcgagttcttggaccactgcccgtcatcaatggcggcagcggcc

SEQ ID NO: 2895 - DNA, 286 bp, Zea mays
  misc_feature: Incyte ID No: 700553454H1
  unsure 190: a, t, c, g, or other
ccaaagaggaccatcagctatatggctgagcgagttgttggaactggatcgtttggggttgtcttccaggcaaaatgcattgagactggtgaaactgttgcaattaagaaggttctacaggacaaaagatacaagaatagggagttacaaataatgcgatcaattgaccattgcaatgtcatttccctgnagcatgtttcttctctaccacaagtagggatgaacttttccttaacttagtcatggagtttgttccagagtcatttatcgcgttctgaaacaccta

SEQ ID NO: 2896 - DNA, 291 bp, Zea mays
  misc_feature: Incyte ID No: 700553455H1
  unsure 231: a, t, c, g, or other
cgcttagcacgggcattcaaacccctcacattccaagataaaatacaacagtttgtattcattaaaagatgaaccctcctctacttgaacagacattgccacataaagaatataacatagttaacatttgatgcagactggcaaccttgttcaccaacagtaagatacacatggcccacgacacacacaaaagttccaaactgatgttagtaagatacagagggacaaggnatccttgattcgaaaaccacctccagaccaccagataccatgcgacgaccaacagtctgg

SEQ ID NO: 2897 - DNA, 289 bp, Zea mays
  misc_feature: Incyte ID No: 700553457H1
  unsure 33: a, t, c, g, or other
gagcaaaaagcccaagccccatgcaagcaagangtcgctggctagtcctggcagcgactcagtcggccggagcagcaccgacaacttctcaaaggaatcaaggcatcccaagagagagagctcaagcaaggctgctaaatccgaccacgtcgaacaagaacctcgcacgagcaacagcaacagcaacctgttgccagctacatgcatttacagaatctgcaagagccaaggcgtcgtcgtccccgaagatgagcccagatgtgcaggacagcaacccaaggaaaaggca

SEQ ID NO: 2898 - DNA, 241 bp, Zea mays
  misc_feature: Incyte ID No: 700553459H1
  unsure 107, 167, 170, 179: a, t, c, g, or other
ggataagggaaaagagaaagaacgtaatgaggagcatgaacggcgtcctggtggcgaacgagagagggaacaccatgacagagaaaagaacaatcagggagaagganaatctgaaaagataggacatgataagagaggagaaggaagaagagaagcagcggagacgnttntaggtagcngaggtgctctctgtgtgagtgcctccatggttagtcacgctccaggtttacctgttactgtt

SEQ ID NO: 2899 - DNA, 199 bp, Zea mays
  misc_feature: Incyte ID No: 700553460H1
  unsure 28, 45, 69, 125: a, t, c, g, or other
gatgatggacgatgaagagagggtgggncatgcggagatcccgancagtttcggtcccgagctgcgcgnctgcctgccgatgccgcctacgtcaagacctacgaccagttcagggagaacgctgngaaaatgcccgtttctagagatggacagagagcacgacaacgtctcaactgcaccacccccaattcatggatta

SEQ ID NO: 2900 - DNA, 289 bp, Zea mays
  misc_feature: Incyte ID No: 700553461H1
  unsure 219: a, t, c, g, or other
gcattcctcccatctcccaagacctcctcagacccgagaagcgcagtgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagncgttcggcagcggtgcccccgtcttacctcgcggccgtcctggagtactcgccgctgaggtcctggagtc

SEQ ID NO: 2901 - DNA, 295 bp, Zea mays
  misc_feature: Incyte ID No: 700553463H1
caagcgggttgccgtggccgctacgggcatggtcgcggacgtgattggcaaggagtacacgcgacccgcggctaattctgtagtaagcatgccaaatgcttggaagggtcgggacggggagagcgatggcagcgggtctggtggccgcaaggacagtgttgaagaggcagagcagttcctgtgctccatgctcggggataatccgagcttggcatgggtgttgtcagagacgtgctaggccagtatgggtacgatgttgagaaggaacaactcgctgctttgtgttctgatggaa

SEQ ID NO: 2902 - DNA, 297 bp, Zea mays
  misc_feature: Incyte ID No: 700553465H1
  unsure 163, 168, 182, 295: a, t, c, g, or other
gtaaccaccaacacatcggtcacgcctctactgtccgccgagacgctccccctggccagaaggttggtctacattgccgctaggaggactggaaggctcaggggtcaagctgctgccacagcctccaaggctgacaaggccacctagagttattgtcgttgtntatcngtctactgtgcttnagattgttaaaggacatgtgtttcagaacggtgtgttgttgcctcgtactatggtgaaacattgtctcagtttttgtggtcgctgtcaggattttgcattatgcctaaagacntt

SEQ ID NO: 2903 - DNA, 158 bp, Zea mays
  misc_feature: Incyte ID No: 700553466H1
  unsure 2, 45-46, 133-135, 147: a, t, c, g, or other
cnatcatgaagttcacccttgtaaacagtgccaaaccctcctcgnnccaaggatgaacttcatgatggcacgaaaattgctgtaaagcggatggaggctggtgtgatgggtaacaaggggctaaatgagtttnnntcagagattgcngttttgaccaa

SEQ ID NO: 2904 - DNA, 285 bp, Zea mays
  misc_feature: Incyte ID No: 700553467H1
  unsure 99, 206: a, t, c, g, or other
ggagcacccaagtttcttttgtgtgttctagcggaaagaaagaattccgatatttatgggccttggaagaagaaatgccttgctgaatttgggatcgtnacacagtgtgtggcaccaactagagtcaatgatcagtatcttacaaatgtcttgttaaagattaacgcaaagttgggtggctgaattcgttgctccaaattgaaacntccccagcaattcctctcgtatccaaggtcccaatataatcttgggtaggacgtatcacacggatctcctggacatctg

SEQ ID NO: 2905 - DNA, 288 bp, Zea mays
  misc_feature: Incyte ID No: 700553468H1
  unsure 63, 105, 152, 189, 202, 255: a, t, c, g, or other
tgaggatgagatctgctgtcgcaagcaagcagtttggccaggaggatatgctgtgccctcttntggctgatgcctgcattcaagtttgccccaaaaatcctgcanactttaatgttgacaatgttagagtggctaagctacttggaggtggnttgcacaattcttctgtggtccgtgggatggttctgnaaaatgatgctgntggtagcatcaaaagggcggagaaggcaaagattgtcgtatttgctggtggtntcgacacctcggcaatgaaacaaagggaacgtg

SEQ ID NO: 2906 - DNA, 154 bp, Zea mays
  misc_feature: Incyte ID No: 700553469H1
  unsure 125, 127, 152-153: a, t, c, g, or other
agctgaactgctaaaagtgtaaaaccgtagaaggtagatagagaatgctgtaggtttgtttattttggttattagacgagttatacatagcatagatgcatgggaagttcgcatgctaaaaaaananaaaaaagggcggccgccgtctggtnnc

SEQ ID NO: 2907 - DNA, 283 bp, Zea mays
  misc_feature: Incyte ID No: 700553472H1
  unsure 151: a, t, c, g, or other
accctcaaggccaagcaagctaatactctgtactggtctcctgctgggcgcttcatagttcttgctggactgaagggtttcaacgggcagctggaattctacaatgttgatgaactagagacaatggcaacaggagagcattttatggcancagatatcatgtgggatccaactgggagatatctcgcgactgcagttacctcagtcatgaaatggagaatggcttcaaatatggtcctcagtggcaagcatctttacaaggtgtcaaaggatcatttctatc

SEQ ID NO: 2908 - DNA, 288 bp, Zea mays
  misc_feature: Incyte ID No: 700553473H1
attgttcagagagatctgtccttcattgttagtcaagaaagatcgtggccgtcctgtggatccaaagggctcggcccaaagcatttggagaagtcactgttgctagcaacgttcctggtgccgagttgctagatgaaaatatttcttcagaaggggaaagttcggacgatgagtctgatggttttgactccgatgtgagatggactgacacctgcccctcctggaacagaagaaaatatggagggttcatctgttgcaaacaaacatgatgccgatggagataccaaa

SEQ ID NO: 2909 - DNA, 285 bp, Zea mays
  misc_feature: Incyte ID No: 700553474H1
attatgcttagcgtatgcatgtgtgctagatttcaatccgatcctaaggagtgtcacttagtggcggtgaagcgaattcttagatatttggttgctacgccttgcttcgggctctggtatccaaaggggtctacctttgacttggttggatactcagactccgactatgctggatgtaaggtcgataggaagatacatcagggactgccaattcttaggaaggtccctggtgtcgtggaatctaagaaacaaacctccgttgccctatccaccgctgaggccgag

SEQ ID NO: 2910 - DNA, 289 bp, Zea mays
  misc_feature: Incyte ID No: 700553475H1
ggaacacaaagcttgcttatcccctggagaagttccattctgatgttgctggtaggagctttcacaatgggaggtttatacagaggatgcgtcaaaaagctgcgtctttgcccaatgtccaattagagcaaggaactgttacctcacttcttgaagaaaatggtactgttaaaggtgttcaatacaaaaccaagtcaggtgaagaactaaaggcttatgcgcccttgacgattgtatgtgatggctgcttttcgaatctacgacgcgccctttgctctccaaaggttga

SEQ ID NO: 2911 - DNA, 288 bp, Zea mays
  misc_feature: Incyte ID No: 700553476H1
ctcagtcgcctgcgccgccgcttcgttcgtgtggaggggagaagacaggaaatggcggcgactgagggcgtgctcttggggatgggcaaccccctcctcgacatctccgccgtcgtcgatgacgccttcctgcacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaatcct

SEQ ID NO: 2912 - DNA, 287 bp, Zea mays
  misc_feature: Incyte ID No: 700553477H1
gatcatgactgtggttatgatggagtgagcgttgaagagacactggctatccttagcaggttcccggcaaatgtagcagttcaggtcaccaaggacaagaaggaattcagcatccatttggactcttccatcgcagcaaagcatggagagaatgcatcatcacttgctggttttgatatccagactgttgggcgccagttgcctatattctccgcggcgaggcaaaaatcaagaacatcaagaagaacaagaccacaggaggcttctcggtaatttcctgggtgaca

SEQ ID NO: 2913 - DNA, 291 bp, Zea mays
  misc_feature: Incyte ID No: 700553478H1
gtacatacatagaaggatattgcttggccttgattgatcatgtctgatctaagtcgatcattattttcttgaaacttcctttcggacgtggtgctatggttgatgaatttggatgtgtgcgttctgccaggtgtaagcccaaaggtttatacagaccgagttaaggttaggaagagcacgagtgaacttgttctggtttgcagtggttaaggcagaaagttgtttcactgtagttctgagatgtattaccagcggcgctgtaattttagggtgtataatgcggatgctagt

SEQ ID NO: 2914 - DNA, 297 bp, Zea mays
  misc_feature: Incyte ID No: 700553480H1
  unsure 181-182, 296: a, t, c, g, or other
ctcgccttggagccgaggttgcacgcggttcgtcctgcggccatggaggacgaggagcacgaggtgtacggacaggagatccctgttgacggcgaggacgtcgacatgtccgccggcgacgacgcgaccaagcttcaggagctcgatgagatgaagcgccggctcaaggagatggaggagnncagccgccgcgctccgcgagatgcaggctaagttcgccaaggatatgcaagatcccaatgcaaccacatctgaaaacaaagaggagatggattctcggtcggtattcttggaang

SEQ ID NO: 2915 - DNA, 285 bp, Zea mays
  misc_feature: Incyte ID No: 700553483H1
atacaacttaccgataggaggaatgcttccctgtgtgcccaaagcattgataaagccagcaggtaatgatctagcacaagatggactactcctgtggttagaagaacaccttaggcgtttacagagtggcatgatcaagacccgtatgctgatggcatcgagatatatcagcttatatccagaagcacctcatcatgcagttcgctgttacaaatggcattaagaacatcctgggaggcctggggaaaaatttatgttcacttactcaattcgcatgtcagttcc

SEQ ID NO: 2916 - DNA, 288 bp, Zea mays
  misc_feature: Incyte ID No: 700553484H1
  unsure 111: a, t, c, g, or other
gaaacaatcaaccagcaacactcttctcttataacatagtacagcgaaggtaactcacatggcaacttccatgggttgtctcgtcttgctctgccttgtttcttctctccnctcccagtgccgtccttggccacccatggggtggcttgttcccacagttctatgaccattcgtgccccaaggcgaaggagattgtgcagtccattgtggcacaggctgtggccaaggagaccaggatggcggcatctttagtcagactgcatttccatgactgctttgtcaagggct

SEQ ID NO: 2917 - DNA, 282 bp, Zea mays
  misc_feature: Incyte ID No: 700553486H1
  unsure 70, 73, 89, 127, 157, 160-161, 176, 186, 203, 215, 218, 227, 243, 250,: a, t, c, g, or other
gattgtctaggctgctgaaatcgcaaaaggattggagttctgttctcttgtgcctgtatgaagctggaangcntgacaaagtgcagctnttggatatcttctgtgaggcagccagcccagattggcnaactgaaaatgcaccagataattacctatntgnntctaaagtggctttnttaggagtanagtcagggtctgctaanagatttatagcncangtaatgaanacaataaggtattgcntacaganattttgttacacatcctcgaggtnnggagcac

SEQ ID NO: 2918 - DNA, 155 bp, Zea mays
  misc_feature: Incyte ID No: 700553487H1
  unsure 51, 53, 56, 61, 77, 79, 85, 94, 99, 106, 110, 117, 120, 145: a, t, c, g, or other
gagaagcagctcaagcaaagagaacagacaactaccaatggccactacacntncgnaaagnggaaatggcacgacgnancactcnggtgatgancccangacaccnctgncccctgncgncgttcctgcacagaagcagatctantattctggtg

SEQ ID NO: 2919 - DNA, 283 bp, Zea mays
  misc_feature: Incyte ID No: 700553489H1
cggtctcaaccccaggcgagctcggctccggtcacccgtcgatccacgcaaccatgtcgaggaggaagaccagggagcccaaggaggagaacgttacccttggacccactgtccgtgaaggagagtttgtctttggtgttgctcacatctttgcatccttcaatgacaccttcattcatgtcactgatttgtctgggagggaaatttggttcggatcactggtggcatgaaggttaaggctgatcgtgatgagtcgtctccttatgctgctatgcttgctgcc

SEQ ID NO: 2920 - DNA, 291 bp, Zea mays
  misc_feature: Incyte ID No: 700553491H1
  unsure 184, 228: a, t, c, g, or other
accctcacccctcatcaacccaagccgcaagcaaaacccgcagcagagaagaggagaggagtcgccgcgaccgagagctccagagcacgcccccggcacagcctccgacgatggatccgaagatgacagaggtgacccagatgttcgcccgcttcaaggcggcctacgcccgcaacgaccttanacacctgcgtcaccctcctctcgcagctcaaggtccatcttcanccaatttccccagccttccgcccttgtttcagcagacaccgaacattgtggaggagctcaaat

SEQ ID NO: 2921 - DNA, 286 bp, Zea mays
  misc_feature: Incyte ID No: 700553492H1
  unsure 50, 69, 97, 102: a, t, c, g, or other
attgatcactcaatcaaagctcgatgaactgaaattgcaacacaatccancatttgttcctttaaccanagaggagaatgcggtgaaagtgtttganagtgnaactggtatatcacaacgccgtctttctaacggaatttccatcaactacaagattacacaaaatgaagctagggttggtgtcatggcggctcatagtagggggagggagagcgacagaagattctgaatcaaagggatctgtcatgttggtgttcgttccctgagtgaaggtggctgtgttggt

SEQ ID NO: 2922 - DNA, 287 bp, Zea mays
  misc_feature: Incyte ID No: 700553494H1
  unsure 142, 248: a, t, c, g, or other
gaacaatttcaagacatttcattgttctacttttttctatagcaccagcttattgagacttctgtcttagatgtggtatggacaaatatacatgccactttccagatgaagtgaagagaccaaatgtggatgtcaatcaatnctctagatgaaggaatgaaaggaaggagctaagttattgcactggatgtacggggtctagaaaaggtgtcactttgatgccatttattagtgcgttgtacaaaagnaaggttgaattgatgattcagggctacctataaaataaa

SEQ ID NO: 2923 - DNA, 300 bp, Zea mays
  misc_feature: Incyte ID No: 700282002H1
ctttatcagaagaggaggtggcagccaagctcgccgcacagggcaaaggaaaaaagggataggaggtgttagcttccattttcggctagcttggagtttgttgcggaacatggcgtgcggtggtcacagcagctgacacgtgctactgctgtggcgaaagagttgtagccttgtagggctgttctgtggaaaaaggacactagtgtaggagcagcagcttgtatttcctaatgagattgttagttttgattgggtctccgagtagagtgtgtgctgaagttatttgatctacatgaagtg

SEQ ID NO: 2924 - DNA, 301 bp, Zea mays
  misc_feature: Incyte ID No: 700282006H1
  unsure 29: a, t, c, g, or other
tagagacattggaaattaagcttgcagcngccaatgaaaagttaaagaggtctaatatgacggcctcggaaaccatgaccgagtatgagaacatgaagaaaatgctggaaagtgttcagtctcgccttgaagaggccgagcaaacaattctggaaggagagaatttacgaaaaaagttacataatacaattcttgagttgaagggaaatatcagagtattttgtagagttaggcctttgctgccaaatgattcaggagcagtatcatatccaaagaatggagaaaacttaggccgagccat

SEQ ID NO: 2925 - DNA, 137 bp, Zea mays
  misc_feature: Incyte ID No: 700282011H1
  unsure 10, 63, 93, 95, 121: a, t, c, g, or other
ggcatatgtnctcccagtagtcagtgaaaacatatgcctgtacattgtgctcatgcatatgtnttcactgactactgggaggacattgggaanantcagatctttctttgatgcaaacatngccctctgcgagcagc

SEQ ID NO: 2926 - DNA, 256 bp, Zea mays
  misc_feature: Incyte ID No: 700282012H1
  unsure 4, 25, 69, 102: a, t, c, g, or other
aacnagcaaccactaaccactggtngtaaagcattaaacattagaacatctgaatctttcaagacagtnaggttcggccggccttaatttaattcgctagcncctaaccacctgacgctgctgcccatttaagttggtccacgttttgcctggaagattttgtcactcataggcttacttctccgactccggtgaggtcagctgccttaggttgaacttcgagagctctttgtacctttccacaactccaatcatg

SEQ ID NO: 2927 - DNA, 299 bp, Zea mays
  misc_feature: Incyte ID No: 700282015H1
  unsure 92: a, t, c, g, or other
attggatgtggtttggtgttctttcagcaggtcactggtcaacctagcgttctatactatgctgctacaatttttcagagtgctggattctntggggcatctgatgccactcgtgtgtcaattcttcttggcgtactgaagctaatcatgaccggagtagcagtccttgtggtcgacagacttggcaggagaccattgcttattggaggtgtcagtggaattactgttgccttatttttgctgtcctcctactacactttactgaaagatgcctcctatgtggctgtaatagcgcttct

SEQ ID NO: 2928 - DNA, 138 bp, Zea mays
  misc_feature: Incyte ID No: 700282016H1
  unsure 24, 28, 100: a, t, c, g, or other
gcttcttgccgcctcggaagcacnagcngctcaggccacacaggggaacttcgacaagggatcaatcttcccgcccttcaccaacattagaaagatctcngcgcgcattgccgcagccgtggctgcaaaagcttatga

SEQ ID NO: 2929 - DNA, 294 bp, Zea mays
  misc_feature: Incyte ID No: 700282017H1
  unsure 259, 277: a, t, c, g, or other
gcagcagcggcggcgccggcagcggcaccggctcaccagcgataccaggaagaatggggaggtacagtcccgcgtacagccccccgaggagaggacatggcggcaggggaaggagcccacctcccaggagaggatatggcggtggccgtggtgaccatggctctgtcagcctcctggtccgcaacattccattgagatgcaggcctgaggaactacgtgtccctttcgaacggttcggccctgttcgggatgtttaccngccaagagattatcacanggggagccaagaggatt

SEQ ID NO: 2930 - DNA, 295 bp, Zea mays
  misc_feature: Incyte ID No: 700282019H1
  unsure 46, 48, 50, 52, 63, 208, 215, 237, 287: a, t, c, g, or other
atcgatcccgagttccgctgactgcagaggagagagatctagagcnangnanggagggaaatnggccacgaggctgcggcgccggggtcgtcggtaactcggccgcgcggtggaggaggtgcgctcggccctcaacgagcacgccgacgtggttgccgacctcttcggtcgcgtctcctccgaagtgcgcaccggcttcgcgcccgcngtcgacnaccttcgttggcttcttccacnccgtcgactggaaggagccttggctgatcagcatactatctttccatgcnattctgct

SEQ ID NO: 2931 - DNA, 233 bp, Zea mays
  misc_feature: Incyte ID No: 700282021H1
  unsure 20, 171: a, t, c, g, or other
gagtgggagacccgcgagangctgccgtgtagggaccgtagactcagcgactgcgaaggagggataaggggatggccgggatcggaccgatcaggcaggactgggagccggtcgttgtgcggaagaaggcacccaccgccgccgccaagaaggatgagaaggccgtcaacnccgcgcgccgcgccggtgcggagatcgataccatgaagaagtacaacgctggtacgaacaag

SEQ ID NO: 2932 - DNA, 241 bp, Zea mays
  misc_feature: Incyte ID No: 700282022H1
  unsure 14, 202: a, t, c, g, or other
agaacaagtagacnctaggactattgctgtatctccgctgccttgcaatgtaaagcaggaagacgtccaatcttttttcacaaattatgcaaaggtaaacagcgtgagacttccacgcaatattgccaacaaaaaacacttctgtgggactgctttggttgagttttctgaagaagaggaagcaaaaagaattatggagacngctttagtatttgcaggggcaaatctggaaataaggcca

SEQ ID NO: 2933 - DNA, 242 bp, Zea mays
  misc_feature: Incyte ID No: 700282023H1
  unsure 13-14, 62, 68, 84, 92, 98, 103, 106, 147, 198, 204, 209-210, 240: a, t, c, g, or other
atgaatctttatnncctgtaaagacatcccactgtctctttcgttttcgataagatgttttngccgtnacataatgcctgtaangtagaatnccattncagtngtngcatcagaaagcagccatttaacgccattgtaaagtgagtnatgattaaatacaaccacacttctgtctctcaggtttctgtacatggagtntttatngcacnncttcttccccagcaattagtacttgcagtnag

SEQ ID NO: 2934 - DNA, 292 bp, Zea mays
  misc_feature: Incyte ID No: 700282026H1
  unsure 33, 45, 117, 175, 200-216: a, t, c, g, or other
agatcaactgatcgatggaaccatagtggaggnagctcgctcgtnggatggcagcgtacgtggccatcagcagcatgcagtcgtcgtcgtagcagagatgtcctagctacgtgtgtntcatgcatcagactggcacataataaagaagtagatcatgcacccactagtgatcacntcgtctagtgtccctccgttcaatnnnnnnnnnnnnnnnnngtaccttacgtgacatgctgtagcacgtacgctagcagagcagcacctcaatgtccttgggttgctttgctggctc

SEQ ID NO: 2935 - DNA, 226 bp, Zea mays
  misc_feature: Incyte ID No: 700282028H1
  unsure 13, 58: a, t, c, g, or other
agtaaagccagtnatgatggagtattacatttgttgaggaaatggagagttacttgtngctactagtagcacatgttcactcaatggttttgtgcatacctgtcagtacatcttgagtttatcttgcatacctgtcagtacatcttgagtttatcttgcatacctgtcagtacatcttgagtttatcttgcatacctgtcagtacacctcgattctatcctctcgt

SEQ ID NO: 2936 - DNA, 252 bp, Zea mays
  misc_feature: Incyte ID No: 700282031H1
  unsure 4, 36, 43, 249: a, t, c, g, or other
aagncctcctgtaccgatgtctttccttgtagtggngcagggngccatggcactgcactgccgccacacttacgatgatgatggtgggttatggattttgtctacaatgtcagcaggataggctcacaattgccccctgccctccggtttggtcgcctctcaggttttcatttggtagttgttcgcagggaaccatatgagaattgcaatgtcaatcaggtgtttgccaataataattgggtggtttcngct

SEQ ID NO: 2937 - DNA, 295 bp, Zea mays
  misc_feature: Incyte ID No: 700282032H1
  unsure 23, 39, 107, 121, 130: a, t, c, g, or other
cagagcagccgcatccacaaccngcctctctcgtccccnggcggcgtccgcggcaggatggcggaatctacggcgaggacggtgaaggatgtcaacccgcacgagtncgtcaaggcctacnccgcccacntcaagcgctccggcaagatggagctccctgagtgggttgacattgtgaagactgcgaggttcaaggagcttcctccttatgatcctgactggtactacatcagggctgcatccattgcaaggaagatctacctaaggcaaggcatcgtgtgggtggctttcagaa

SEQ ID NO: 2938 - DNA, 266 bp, Zea mays
  misc_feature: Incyte ID No: 700282033H1
  unsure 22, 29, 37-38, 56: a, t, c, g, or other
gttaaaggtagcaatatgaacnatttacntcggtacnncgaattgaagagaagaanaacgatatacctgcaggagtgctaaggcaggctattttgcttctatgtacaagagatctggcaacttatgctatgtctttggagctttaagagcctttgggggacataataatcaagatatgagaataaaggtaaatggaggagaatagagaaccgtccataaagtgactgctctgtgcatagggaatgctaagtactttggtggtggta

SEQ ID NO: 2939 - DNA, 287 bp, Zea mays
  misc_feature: Incyte ID No: 700282035H1
  unsure 35, 66, 72: a, t, c, g, or other
attcactgaagttgattgatcaagagacgtctgcnccccccaagtccccagcgaagtccgcgactncgagtnctggaccagagaagcctaaacgtgttgtcacccaaccattgtctctttctactcaacgaaggtcatctggagtaaatggtggtgtgaccaatccatcacccaataaggataaatctggtgataaaagtagcatctctccagcaagcatgacaaagaagtgtacgccgttggcacctaggaagactttgcagcctgagcaagcattcaccctctgg

SEQ ID NO: 2940 - DNA, 287 bp, Zea mays
  misc_feature: Incyte ID No: 700282037H1
  unsure 75-76, 119, 222, 244: a, t, c, g, or other
gcatgtctgatgagcgtgctctctcactcctttctgtcaagccacccaagtcagggcagcttgatcctctgcacnnctgctgcaactcgcatacaaaataagttcagaggatggaaggngagaaaggaatttcttcttattaggcagcgaattgtgaagatccaggctcatgtgcgaggtcaccaagtgaggaagcattatcggaaaatagtttggtctgtngggatcgtggagaaagttatangcgttggaggcgtagaggggctgggttacgtgggtttcggtct

SEQ ID NO: 2941 - DNA, 289 bp, Zea mays
  misc_feature: Incyte ID No: 700282038H1
  unsure 11, 75, 86, 137, 143, 270: a, t, c, g, or other
caaggcaagcngctctgggtgcagggataccaaacactgttgtttgcaccactgttaacaaagtctgcgcatctngcatgaaagcnactatgttcgccgcacagtcaattcagctgggtatcaatgatattgttgtngcaggnggcatggaaagcatgtccaatgccccaaagtacattgctgaagctaggaaagggtctcgttttggacatgacacacttgttgatgccatgcttaaggatggactttgggatgtatacaatgactgtnccatgggaatgtgtgccga

SEQ ID NO: 2942 - DNA, 288 bp, Zea mays
  misc_feature: Incyte ID No: 700282040H1
  unsure 29, 121, 145, 268: a, t, c, g, or other
gctttaaagcttttccgattccgcaatgntcaccgttcggttccttctcgtaccgagccgcgggtagccagccaaccgccgacgcagtccacaagcgatgaagcgcttcttccagccagtncccaaggacggctccccgtccaanaagcggctagcgggtgctgctgaaccgggcgacggccccacatcagccggtgccgccaccggcgctggcggggatgtagaggggaggcccaccgaggagccgttcaagttcctgacgtggaanccaacagcctgtctccggat

SEQ ID NO: 2943 - DNA, 289 bp, Zea mays
  misc_feature: Incyte ID No: 700282042H1
  unsure 110, 172: a, t, c, g, or other
aacatttgcagagcaggctgagaatgactgcaaagctggctccagctcttctgcagtcaagcattgccgcatggaaaccatgcttcaggagtgcgcatgcactgttgacnccgcagttcagcaatggaagaagtcacatgctgctgtcaacgatctcagcagaaagcaagtngctgaagttgaagcactcgtcaggactgcaattgagaacaatgagcaacatgaagtggaagttgcatcttctcgagctgtggctgaagaagacaccaccaatagcagcaaggacata

SEQ ID NO: 2944 - DNA, 285 bp, Zea mays
  misc_feature: Incyte ID No: 700282044H1
  unsure 18, 166: a, t, c, g, or other
gtgtttgtcatgtcagtnccagtcagcagggtcagtccttgtgctgcatcaccagtggtgctgcatggaagtggtcagtcttcaaggtcagccggttggatcatttgggctcttgctcccaccgcctctggtggtaggcatgaagtcgcaggtgttgtcgggagtngggttttgcctccaatatagcatgaatgaattatattgttttacctatttgatgaggtagaagaaaagaaccttggaagatagggaatgtgttggtttttgtcaaagcggttcctgtcc

SEQ ID NO: 2945 - DNA, 289 bp, Zea mays
  misc_feature: Incyte ID No: 700282045H1
  unsure 22, 89: a, t, c, g, or other
aaagatatatcccatgaatacngccgtagaagaaaagaagagactgatgtagctcgaagcagggtagagacatacataaggtcttcacnacggacagcttttgctcaaagaatggaagaagcagattcaaaacgatcatcaagaaaccctactccagttctttctatccttgcgaaggacattagtgacctagctacgaaggagaaaaaattgtacagtccaatactgaagacatggcatcctcttgcttctggtgttgctgttgcaacccttcattcttgttatggaa

SEQ ID NO: 2946 - DNA, 233 bp, Zea mays
  misc_feature: Incyte ID No: 700282046H1
  unsure 6, 18, 27, 31, 81, 84, 106, 140-141, 197-198, 228: a, t, c, g, or other
tcaacnccggtgacactngggttgaantaanacttctcttgatatcctggtccatctggaatgtgtgatttgcgatagcanccnagatatcaagagaagttttatntcaaccccggtgacactggctttaaggctttcannaccaagtatgccaccattggtgttggaatctgctgggatcagtggtttccagagtnngcaagagcaatggcacttctgggggctganatact

SEQ ID NO: 2947 - DNA, 284 bp, Zea mays
  misc_feature: Incyte ID No: 700282048H1
  unsure 51, 126: a, t, c, g, or other
acgaaacaagagcttattgattctcttgggactattgcaagcagtggaacnaccaagttcctgaaggcattgaaggagagtcaagaagcgggcatggacaacaacttgattggccaatttggtgtnggtttctattccgcatttcttgtttcagagaaggttgttgtatcaacaaagagcccaaaatctgacaaacaatatgtttgggaaggacaagcagattctggttcttataccattagagaggaaaagacccggagcagtcatcctagggaatcgcttac

SEQ ID NO: 2948 - DNA, 269 bp, Zea mays
  misc_feature: Incyte ID No: 700282050H1
  unsure 28, 41, 129: a, t, c, g, or other
acgtggtacgcggaacctaccaaaaacnaggatttaatacnactggaacgagatcgttcccacgttcccggaacggaacgaacgttcccggaacgaggaacgtggccaagttcccggttcccggttacnaaggtctagatcttcgcagcaaccacaacaactcttccgaatcttcgaccaatgctgcaaatcagagtggtcgtggaggtcctagccggtttggacgaggtactcatggaggaaggaactcaaacgctccaacctagcgg

SEQ ID NO: 2949 - DNA, 259 bp, Zea mays
  misc_feature: Incyte ID No: 700282052H1
  unsure 36, 38, 43, 56, 73, 76, 87, 97, 115, 141, 158, 182, 195: a, t, c, g, or other
gggacaatctcatctgtagcggatgaagagggaatncnacacngcatcgcagatcnacccggaaaagaagtcnccncccaacgaacncccgaaaatncctggaaagacgctaccncccagctcttcggaagaaaatcgtcnccggaaaggctggagcnggaagctcgctaacccggaagacncccgctgtctacntccccgacgaaagaatggacacggatcgcgaggaagaaggagaccaaggaaaggcaagtcgttc

SEQ ID NO: 2950 - DNA, 289 bp, Zea mays
  misc_feature: Incyte ID No: 700282053H1
  unsure 10, 16, 23, 116, 264: a, t, c, g, or other
atgatcatcnggtacncatgacngcaaacggacatgcaggccacattagcgccatcaaaactggtttctgttcaacaagtagccaaccaaaaaacaggagaaaaaaatagcatacnagttattcgtcgcttgagcaatgtctgccagtagagatccatgtggaccccacggctcgttgcttgtggcatcaaggatctagcaaggtaaagtaataacggagtgtccaaaactattccttcttgtaacaatggcaaggtaaagtantataacagaaaacaaacaacgcccc

SEQ ID NO: 2951 - DNA, 309 bp, Zea mays
  misc_feature: Incyte ID No: 700282054H1
  unsure 28, 40, 43, 45, 71, 82, 85, 91, 145, 211, 219, 230, 262: a, t, c, g, or other
gtctcgtctcttgctcgcatcgtctggngaccgcggaggncgngncggcgtggcgcagcggcacggcagcntccccctcgcnccncctacnccggctcttcccctctccccctcagccctacgcccctgcgcggctgcgtgaccngcgtccagccgcagcggctggtgcccatcggcggcaagtagcagagcagcagcagccgccggcggncctccccnccccctcggcntcgctccggctctcccagtcccagctcgagcnccgtactgaaggttgaagcaaggacccaaaacagatgccgccatcaa

SEQ ID NO: 2952 - DNA, 257 bp, Zea mays
  misc_feature: Incyte ID No: 700282058H1
acatggtatacgtgaccagctatttaagttcctaggtttgtaacatgtatgtccgcctgcagttcagttgagatgcttcaaggctaaggttctgttgtgtgacctgtagacacgaggctgtcagcttgtattctcttggtaatgtgtgtcagcagagcgttacattaagtctaattgaacagtgctgttatctgtaacgtctgagtttgatcagaaactgaagttaattgaggaagacatcaacaatgttctgatac

SEQ ID NO: 2953 - DNA, 251 bp, Zea mays
  misc_feature: Incyte ID No: 700282063H1
  unsure 21, 59-60, 73, 83, 100, 120, 145, 151, 186, 204, 206, 236, 239: a, t, c, g, or other
gtccatcgtgaaggaggagtngaccagcgaggtgttcgacctggagctggtgcgcgacnncgccgcggggacngccgcggacnagcagctcatggacacnctgaagctcgcgctgcactncgtcgacccggcgccggcggtcagncccgangcgcacgaggtgctgcggcagctcgagcagatcangcctggtggcagcgaggncngcgctgggccaagcgaagaaggtggtggtngcnccgccgccgccc

SEQ ID NO: 2954 - DNA, 306 bp, Zea mays
  misc_feature: Incyte ID No: 700282064H1
  unsure 69, 165: a, t, c, g, or other
catatgtgaagaaactgtttctcaaaggaaccacatattatctttatgttcatagttatttgcattatnggttgctggcagctagagcagaggtcttaaaagctggcaatggcaatggttacagcaactgtatgttagagggatttcaagggcaatacaaatatngcgacaattcatttgaagcatctgcttcaccttctggtgctagttattcaaaatgcaaggatgatgcagtgaaagctcttaaggttgatgaagcatgcacccacatgaagtgttcttttggtggcattggaatggtggtgg

SEQ ID NO: 2955 - DNA, 161 bp, Zea mays
  misc_feature: Incyte ID No: 700282065H1
  unsure 20, 32, 49, 59, 83, 119, 132: a, t, c, g, or other
acggaacttgttagaagaanttccgtccagcntttccagttggatcacntctaattgantcaatccttgctgccagagttganccaactggaaaagctggacggaacttgttagaaganattcgtaagaagnttgagaagtggcaagaaccgcctcctgcg

SEQ ID NO: 2956 - DNA, 252 bp, Zea mays
  misc_feature: Incyte ID No: 700282066H1
  unsure 43, 47, 73, 80, 137, 226, 249: a, t, c, g, or other
gtttctttttttattagcagaaaattcaacagctgaaattaanaggngtttttgctgcatcaagtatgaagtngtcactncaaatgatgtgtgcacaggcttcaagcaaagtttcagtgtccaatggcatgctagtngccaaaattggctacagatgtataggaaccacattgtcttggataggctacgtgtttcaacacaagcaaaagatggcatcatcatgcantgccatagatgatgcagtcaagntaa

SEQ ID NO: 2957 - DNA, 300 bp, Zea mays
  misc_feature: Incyte ID No: 700282067H1
  unsure 164: a, t, c, g, or other
acgggatggcgcggagtatcgtacgtttcggcggcgaactggtatccatggcgcgaggcaatccccgcctcgccatcatcgacgtcagggatgaggagaggagctaccaggctcacatcgcgggttcgcaccacttcgccagcggcagcttcgaggcgcggatnccggagctggtgcgggccgccagcggcaaggacaccctcgttttccactgcgcgctgagccaggtacgaggtccaacttgtgctcggatgttctcagactatctatcggagaccaaggaggattcagggataaaga

SEQ ID NO: 2958 - DNA, 299 bp, Zea mays
  misc_feature: Incyte ID No: 700282070H1
ggattaccagttcaacagatcggcatacttgtcggatgtctggaaactgaaattacatgctgtccaattcatggaaggcaagtgcaattaacttaaccttcaaggaggcaaatgcagtttaaggaaaacttacacgttgaaagcacccatattatgttttcggatgagttcctatgtagctacgttgaaagagtacttttctacacaattgattgaggtgttctcgatttgatctctttttgagcttttggtgtcgttgggattttgcgctaaatattggaaattagaccaaggggctg

SEQ ID NO: 2959 - DNA, 301 bp, Zea mays
  misc_feature: Incyte ID No: 700282071H1
  unsure 4, 9, 86, 293: a, t, c, g, or other
acanccatngcctccgggtgatatcaagcaaatatctacacctgtacgtgtgcaaggccttgagaaagtgagggtcattgctgtangtgcattccataatttggcactaacggaggatgtaattttgtgggcatggggtaataatgagtatggtcagctggggactggagatacccaaccaagatcacaaccgatacgtgtcgaagggctatctgatctctcactggttgacattgctgctggaggctggcattcaactgcactaactatagatggagaggtgtatgcttggnggagagga

SEQ ID NO: 2960 - DNA, 275 bp, Zea mays
  misc_feature: Incyte ID No: 700282073H1
acagcacatcaggacattgagcaagtaaaagctgatgctgagggcctggcaaagaaactggaagcacttgaagcttacaaaagaaaacttttgggtgagaggttggaagaatgctcctttgaagaactgcacagtttggaagtgaaactcgaaaagagccttcattgcatcaggggaagaaagactcagctgctggaggagcaactccataagctgaaggagaaggagatgaatctgcgcaagagcaacgaagatttacgtgaaaagtgcaagaa

SEQ ID NO: 2961 - DNA, 300 bp, Zea mays
  misc_feature: Incyte ID No: 700282074H1
  unsure 17, 26, 30, 109: a, t, c, g, or other
ttgataaagtacaaggnatatcaggnaccncctgccgaactggagcatatcctgaattctcatcctgatatcatggacgcagcagttattccttatccagacgaagacnccgggcaactcccaatggcttttatagtgaggaaaccagggtcaaaccttaccgagcaacaagtcatggatttcgtggctaaacaggtcgcaccctacaagaaagttcgtcgagtggcctttgtttctgcaatccccaaatcgcctgctgggaagatcttgcggcgggagttgtagagcaggccgtgtcca

SEQ ID NO: 2962 - DNA, 298 bp, Zea mays
  misc_feature: Incyte ID No: 700282075H1
  unsure 13, 19, 113, 257, 278: a, t, c, g, or other
aagattcatttcncccatntctcagccatctacgaagaacataggtccatgctgtagcttcagctcgtcttctgatggcaatggatacatggctggaaactttagcgacagtnatgaagattatgttaattctactgtgctagaagcagttgaggtgagaagtggatcggaaggatatgtgataaagatgcgagatgggaaaaacttgcgttgtgtccataacaattctcaagggagaaatattccagagagtgccnccaacctgctattgttttgangatgaagatggaagcgaaac

SEQ ID NO: 2963 - DNA, 231 bp, Zea mays
  misc_feature: Incyte ID No: 700282077H1
  unsure 33, 194: a, t, c, g, or other
tctttgctcatattcacaaattcaggtgttacntcccttttctcatccttcctcattcttttctttctcatttctataggagaaaagtgcttattttatttgtaattatagtttaataggttaaaccctaagggagtatgaattgttgcatcatgttgaaccctagatttcacttttgcttggtgcataattcntggaaagtctaatttgaatttgtggcttattttgatt

SEQ ID NO: 2964 - DNA, 302 bp, Zea mays
  misc_feature: Incyte ID No: 700282078H1
  unsure 68: a, t, c, g, or other
gaacaagggtatggcgaaggatgggggtcccgactggaacggcctgctcaagtggagcctcgcccacngcgacagcaccaacccgccgcgtgctctcagcgaggaagacagaaaatggttcatggatgctatgcaagccaacacggtagatgttgtgaagaggatgaaggagatcactcaggtgatgaaaactcccagaagatgtcttgcagtctcagggcgtgacccctgagaacatcgaagatatgttggatgagctacaggagcatgttgaatccattgacatggcaaatgatctacat

SEQ ID NO: 2965 - DNA, 300 bp, Zea mays
  misc_feature: Incyte ID No: 700282079H1
  unsure 25, 299: a, t, c, g, or other
caaaccaggggatgctggtgtcacnccagaagagcagtccagtgacgaagagctgagtgaagatgaagacgactcgggtgatgaggagataatgggcaaaccagacccatagtcaagttggcacctactatacctgtaatctgcactcgatgtttattgcagcaactgcaattaaacaccccatgaacgtccgcgtgcagtctgagtgccatgtaaataaactgcagtttcaccaattggatttccagcataactatgtcttcgaatcatgagtgtagtgtaggttcgtgcgttgaatng

SEQ ID NO: 2966 - DNA, 301 bp, Zea mays
  misc_feature: Incyte ID No: 700282080H1
  unsure 23: a, t, c, g, or other
gaaggacgaaaccaaagacagtnacttcaaggatgcagctcaggcctgtttaccattgataaatgctgctttggatgacattgagaaaggaactttcctcagaggttgcctattgaatattggagttccaagtgcaccatctgcaaataagggtttcaagttgaccaaacagagtggatacagtcctgctcaaagttgggaagctgtgtcaacaagcaggcccttatctgctactcattcatgggcatgcatcaaagcctcggtattcagttggcacagcttgggaaggatgcatctgcag

SEQ ID NO: 2967 - DNA, 155 bp, Zea mays
  misc_feature: Incyte ID No: 700282081H1
  unsure 2, 13, 19, 21, 43, 48, 57-58, 81, 95, 97, 114, 137: a, t, c, g, or other
cntcatccagatnctgtcnancccaagggtatagtcaatgaancagtncagcaaatnncctatgctgacagaattatagtnaacaagattgatcntntcaaagaacctgaagtnttgtccttggttgagcgtataangggtatcaaccacatggc

SEQ ID NO: 2968 - DNA, 192 bp, Zea mays
  misc_feature: Incyte ID No: 700282083H1
  unsure 37: a, t, c, g, or other
aacattcacctgtgggactaaaaaaatgtttttgacngggaattggaacgcatcgccaagttcttctgttcttggttctattatatgtaaaggtgatttgctttgagaacttaatacgttagtacggttgcctgaaacgatggagggcatgagagctcgccgtattcctatgtaataacaaaatgtacatat

SEQ ID NO: 2969 - DNA, 296 bp, Zea mays
  misc_feature: Incyte ID No: 700282086H1
  unsure 34, 95, 294: a, t, c, g, or other
agcaggaggatgcggctgcacaccgacgggagcngcggcgacgcgcacgcgtggcctgggtacctctacacccgagcagttgggagatgcacacnccaattctggagcagcggagccgagccctggcccaacatcgtcccacaggaagcggcggtggcgaaggtgttcgggtctaggtccgtggagcgctacgggccgcgcctcaccctgctggaagctaccatgaggaccgacgatgccggtggcagcgccttcgtgaagctcgtgaagcaagggagcgccgccctcctcaancc

SEQ ID NO: 2970 - DNA, 155 bp, Zea mays
  misc_feature: Incyte ID No: 700282087H1
  unsure 13, 17, 19, 25, 34, 44, 50, 98, 131: a, t, c, g, or other
ctctccggccgcntccncngccgcntcgcctccnccgcctattncctccnccgccgaggcctcgcgggcgacggagacgttggtggtcgacgagaggntcgcctcacacgtggacccgttcctcgtagagncgctcgacaaccctcgccaccgcc

SEQ ID NO: 2971 - DNA, 209 bp, Zea mays
  misc_feature: Incyte ID No: 700282088H1
  unsure 2: a, t, c, g, or other
anctgcaacagtcatcgtctttgtttgttgcagggtcaagtgtcgcagcgctgtacttgctcacctgtcgaacgctttccggccagtcaggagctcgctcttttgagagtactggccggacatttccacctccggaactctgtatccggggctgtcatctgattcctgaaggtgtcaacgtgtaagggaagtctgctcattcatgtttc

SEQ ID NO: 2972 - DNA, 249 bp, Zea mays
  misc_feature: Incyte ID No: 700282093H1
  unsure 32, 52, 118: a, t, c, g, or other
aagaagcaagccaacatgcacaaccacaagcntcgttcccttccctacctcncagtcacgatgccgctagcctaggctgcacaaggatcttctgccaaaaatatacagaaatggaacngcagtagcagcagacgagtcgcaaaagcagctacggaaagagcttacggatgtccctcttattgctgtttactcagacgatgtataagcacggattaaacaggcgtccagctcgcgattcggtcaccgaac

SEQ ID NO: 2973 - DNA, 295 bp, Zea mays
  misc_feature: Incyte ID No: 700282095H1
aaggctgtagtgtaaaattctgtatgaggacaactttgagtgacaatgccataacaaatgccatagatatacacagattcgataagtggaagcctgcacattacagtatctaacaacgattgtggtgttcgtgaatatgatatggagagatatcagctcgtgaaccactaccgatataactggccggttaatcacacatccgtgagcccagataagaaacttttggctgtggttggagatgatcgagatgctcttcttgtggattcacgaaatggaaaggtaacctctaccctag

SEQ ID NO: 2974 - DNA, 230 bp, Zea mays
  misc_feature: Incyte ID No: 700282096H1
  unsure 11, 19, 51, 53, 65, 111, 157, 168, 227: a, t, c, g, or other
gatctcgcacncgtaagtngcgacgaatctcgcggtgcggaggcgcgacanangcggtgtcgacnaccgacggactcgcagccaccggtggagacgccccaccggcgcacncctccaacgttcatagtttaagggcttgatttggataattagtcancaacagaagtnataaaaaatggtggttcttgcagcatcaatcgtttcaaagtcgggaaaagcacttgttncaa

SEQ ID NO: 2975 - DNA, 212 bp, Zea mays
  misc_feature: Incyte ID No: 700282102H1
  unsure 3, 9, 136: a, t, c, g, or other
atngacacnagccaacggtactggtgtgattgatattcaacacccttgcaggtctaatgttgctgttcggaaggagctgcacaaaccagcttcagatcgctcttgtatccatctcgagtttgacatttctggcacnggtcttgtgtatgaaaccggagaccatgttggtgtatatgcagaaaattctgttcagactgtggaggaggttgaaa

SEQ ID NO: 2976 - DNA, 305 bp, Zea mays
  misc_feature: Incyte ID No: 700282103H1
gtcgtcagatttggatccgctgctgaaggatctcacggagaagaagttgacctttaggaggaacgtggtgtcattggcagctgagctcaaggatgcgaggaacaagcttgcctcccaggagcagctgtttgtaaaggaatctcaaactagaaaggttgttgagacaaaggcaaggagcatggaagaggaagtaagcaagctgcagaaatgcttgcaggacaaggatgagcaactgcgttcatccgcaagtagcacggaacagtacctccatgagttggatgatcttagaacacaactgtcaatta

SEQ ID NO: 2977 - DNA, 302 bp, Zea mays
  misc_feature: Incyte ID No: 700282105H1
  unsure 21: a, t, c, g, or other
atgggcttgctgttgttcacnccgatcgcattcctcgcttggttcccgtttgtttcggagttccagacaaggatgctgttcaaccaggccttcagtagaggtctgcagatttctcgtatcctaggcggacacaagaaagaccgggctgcacggaacaaggagtgagtagccgagcagcgtgagcctggtagtgctgacctacatacaattcaaccatgccccacgtggcattatactttgtactggctattatgccaggttgtatatgcaaggaaaggaattcatctctgctaacgtgccag

SEQ ID NO: 2978 - DNA, 301 bp, Zea mays
  misc_feature: Incyte ID No: 700282108H1
  unsure 21, 24, 27, 33, 39, 45, 51, 82, 141, 143, 157, 170, 220, 231, 243, 263, 290: a, t, c, g, or other
ctctactctctcgtggcaacnacngcncgagcnccggcncctacnccaggngcccaggcctccgtcggtcatttcgccaggnattcgtcgcgggctcttcgccggcgacgagcacacccaccaaacagattctcgtgacantncctccctggttgcntttcgctgaagtnactgaatctgaaatctgaccatcatgaaccaggttgagggttggtcctanacgagcatgtnataatgggaganaacggagttcagctgacatnacctccatttgaagagcacagcaagcnacggatcatgc

SEQ ID NO: 2979 - DNA, 300 bp, Zea mays
  misc_feature: Incyte ID No: 700282110H1
  unsure 12, 25: a, t, c, g, or other
ctcaccgtcacngacatcgcttgtnctgcactaaatggtatcaagatgggtgacaaaacccttactgtcagacgagcaaaccagggggcatctcagcccagaccagagcaggaaagtatcctattgcaggcacaacaacaggtgcagttgcagaaacttgtgtatcaagttggagcgcttcctacaaaggttgtatgcctcacacaggtggtaactgcagatgaattgaaagatgatgaagagtatgaggacattatggaagacatgaggctagaagcaggcaaatatggtatttggtga

SEQ ID NO: 2980 - DNA, 305 bp, Zea mays
  misc_feature: Incyte ID No: 700282111H1
  unsure 11, 24, 107, 124, 280: a, t, c, g, or other
agaggtgtatncccaaatgacacngcaaccattgagcccggaagagcaaaaggatccttttcttccaattgaattgggtgctggtagcaagcagccaaccaattacntctgcaagacgttgacngcaagtgatacgagtacccatggtggattctctgttccgcgccgagcagctgagaaagtcttccctccattggatttttcacaacagcctccagtgcaagagctggttgcaagagatctgcatgataatggaatggaatttcgtcatatttttcgnggtcagccaaaaaggcatctactgg

SEQ ID NO: 2981 - DNA, 207 bp, Zea mays
  misc_feature: Incyte ID No: 700282112H1
  unsure 7, 10, 30, 192, 203: a, t, c, g, or other
aaaaacnacngcaccaaggaagtgattgancgctgcaaaggagagagagaagcttatgcatcacagggaatattttttgatcacaaaatcctgcacatttcagaagctgatgttttggaaacaaagatgtttggatcttcacccataattatcttacgcttccaaacacagcagatatactgtgttcgagancgagaaggacnagtc

SEQ ID NO: 2982 - DNA, 298 bp, Zea mays
  misc_feature: Incyte ID No: 700282114H1
  unsure 17, 44, 51, 57, 103, 158, 170, 174, 179, 181, 242, 259, 281, 285: a, t, c, g, or other
gccacaccacaacaacncagaggaagagttcaagagatttggcntttaatngcaganttcgcacatatatggcatgtgcgaagtctgccattaaatgccacanccacaacaactagaggaagagttcaagagatttggcgccattaaacatgatggcntccaagttagangcantaaancnccaagggttttgttatggctttgtagaatttgaggatgccagtgcagttcaaactgcaatngaggcttctctgttacnattggtgaacgacatgttatgntgangagaaaagaactc

SEQ ID NO: 2983 - DNA, 205 bp, Zea mays
  misc_feature: Incyte ID No: 700282115H1
  unsure 27: a, t, c, g, or other
ggcgctgaataatcttggtgtcaagtngccaaaaccggcatctgaggagagtgtgcacttgcaagttgataatgctgtagtgacgcctcgttctgagcttgttgcactctgtgaggaaatgaatgtgaaggggctcataagttcatatccgacaacaggaagaacttggctgccatccgcgaggaaattcccagtgcactgaaga

SEQ ID NO: 2984 - DNA, 206 bp, Zea mays
  misc_feature: Incyte ID No: 700282116H1
  unsure 43, 69, 180, 205: a, t, c, g, or other
agaaggatccaggagacttgagtggaatctaaagaagattgtnggtggttctgagcacaccctccgtgncaaagctgacattttctcaggagtcacatgggaatatcacaaaggaagctggcccagtgaacatgaatttcactataccgatgtacaatgcatcaaagttgcaggtcaggnatcttcagatcgcaaagaaatcgang

SEQ ID NO: 2985 - DNA, 302 bp, Zea mays
  misc_feature: Incyte ID No: 700282117H1
  unsure 13, 155, 276, 299: a, t, c, g, or other
gcggtcccttacnctggatcttttgaagtcataaggtacagactgaaacaaatatacgagagcgtggagtcagcaacagaggaatctgatgttccgacgttaatcgtgcatgaaagagtgacggttcgcctggattcagaaagttatgttacacngcagtggtcgtccgatcccatcagcgacatggtgtctgattctgtggtggctatggtcttgaacatcggtcgggaaggccccaaagttgttccggtcgaagaagcggtgaagaccaaagangagacggagaaggtgccctaaangtg

SEQ ID NO: 2986 - DNA, 300 bp, Zea mays
  misc_feature: Incyte ID No: 700282119H1
  unsure 4, 29, 36, 133, 297: a, t, c, g, or other
agtngaacaaagttcttgtttattgatcngcacatnggcagtcatacatatatgtgtgcgtttgccgctgcgcctgttatatcagttgcagtagagaaaggttggaatgagtctgcaagtcctaatgtgaggngccctcctgcacttgttttcagcttctcacaaatggaagatagactcaaggctgcctacaaagccacaactgagggcaagttccccgaagcactgagacagttccttagcatcttgcataccattccagttattgtggtggattcgcggagagaagttgatgangtg

SEQ ID NO: 2987 - DNA, 294 bp, Zea mays
  misc_feature: Incyte ID No: 700282123H1
gaaccgtgatcaccaacaacctcactctatctgcgcagaagagctcggattccctcttcaacatcgtgcccgggctcgatggaaaccctagctcggtctccctcgagctcgggaccaaaccaggatgcttcttggtgacgggcacgaactactccgcaggacgaggattgaagtcaactgcaagagttcccttcagagcattggcgggatactcgagcaggcggcgagcttttcgcaaatgacccattgaggcagtatcacccgatcagcttcgtcgcgaagggatggccagga

SEQ ID NO: 2988 - DNA, 298 bp, Zea mays
  misc_feature: Incyte ID No: 700282124H1
  unsure 93: a, t, c, g, or other
agtgaatgtcagaacagcccttgccattggagtaaaggccaaagatagcgttctcaacaagaccattgatgagttcctgaaagacagtaaacnggttgccaatgaactataaagtaaccccaagtctagtgacacgtttgtactaaaaagcctgtacttctgggcatgcaacatcccaggatcatctcataaatgggtttaagtttgagaaggggatcaagtatcttgagcagattgtggcaatatcaatttggagggacttcttgagagaacagtcatgggaaataggacagactat

SEQ ID NO: 2989 - DNA, 298 bp, Zea mays
  misc_feature: Incyte ID No: 700282126H1
  unsure 40, 59, 186, 189, 224, 293: a, t, c, g, or other
tacaagggaagggcttcaaataaccagagaggaggaaagngtttcaacgcgaagagganagaaacccagactccggagaagaattctaacaaggcccggaaggttgaagctgtcgcatgaggttaatttaggtaccttagctcgacaaaagaagtaacatgttatgccagcatgatcgacttcacnacntctccaagtttctagaatcgacttgttttttagcnatcgttttcatttggtcgttttgccaccttattcgatgttcatacctaagctataatccttttgtaatngctta

SEQ ID NO: 2990 - DNA, 145 bp, Zea mays
  misc_feature: Incyte ID No: 700282127H1
  unsure 25, 94, 110, 113, 117, 125, 134-135, 139, 141, 143: a, t, c, g, or other
atcaccaccaaggccaatgttgacnacgagaagattgtcagggagctgccgaacatggtttggtcaacgtgtggctgacgcgacatgcagtgtntacatacacatcctgntgnaggngatgcatnacacgcggnntgangncnta

SEQ ID NO: 2991 - DNA, 298 bp, Zea mays
  misc_feature: Incyte ID No: 700282128H1
  unsure 3, 91, 197: a, t, c, g, or other
acntctgatgctcagaggctgttgagcatccaagcgagcattgaagagctgaagcagaaaatggaggggcagtcaaagggaaaattccccnatgaactctgagtacagcagtgtgagcgctcaggtgcatgagacagagggccatgtcttggaacagatcaatctgaacaacaaattgactaggacggctgaggacnaccccacactgtcagataatatgagcaccgagcgagaagggtattccagcaggaggaagatctcccgagcaggtgcagaaagggtcggagaatgtggcaag

SEQ ID NO: 2992 - DNA, 199 bp, Zea mays
  misc_feature: Incyte ID No: 700282130H1
  unsure 15, 197: a, t, c, g, or other
gcaattcgcatcccnggctccgtggacttgcatccgcacatcaggaaggtcttgaggaagctacggctgacgacggtcctcaccggcgtattcctcagggccaccgagctgacgctgaagaggcttcttgtggtcgaaccctttgtcacctacgggtttccaaacttgaagaacgtgaaagagcttatttacaagangg

SEQ ID NO: 2993 - DNA, 170 bp, Zea mays
  misc_feature: Incyte ID No: 700282132H1
  unsure 52, 66, 169: a, t, c, g, or other
aggatgacgctcgaggcgcaggtcgtcgagaagaccgtcgaggtcgccagtnccggaccgcaaganattccttccgccaagggaggtggtaacaaggacgccaagcgcaaggcttcgcccaccgccttcttcctcttcatggacgacttcaggaaggagttcaaggccnc

SEQ ID NO: 2994 - DNA, 202 bp, Zea mays
  misc_feature: Incyte ID No: 700282134H1
ggagacacgacgccaagaggttacccccacaccgcgccgaggccaccccgcttgggattgtgaggtaaagcgtgatggcagcgccaccggcgagggcccgagccgactacgactacctcatcaaactgctcctcatcggtgacagcggtgttggaaaaagttgtctcctgttacggttttcagatggatcattcaccactag

SEQ ID NO: 2995 - DNA, 294 bp, Zea mays
  misc_feature: Incyte ID No: 700282135H1
  unsure 35, 99, 191: a, t, c, g, or other
gtccttctcgtacgtggtccacgacctggtgatcnccgcggcgcttcctctacttcgcgctggccatcataccggcgctcccaagcccgctccgcaacnccgcctggccgctgtactggatcgcgcaggggtgcgtgtgcaccggcgtgtgggtcatcgcgcacgagtgcggccaccacgcttctcggacnactcgctcctggacgacgtggtcggcctggtgctgcactcgtcgctcatggtgccctacttctcgtggaagtacagccaccggcgccaccactccaacagggg

SEQ ID NO: 2996 - DNA, 286 bp, Zea mays
  misc_feature: Incyte ID No: 700282136H1
  unsure 6, 259, 281: a, t, c, g, or other
ctagtnggacaactggctttacctttccactctctccttgagaaatatgcagtgtcttgctgacgtgaagagcttggaatcagttctcttatttggtgtataagtgaatgttaggattctcaggtcgtcacacttcttgtggagttgcacctgccactgaataatttatcttctcaagtgaagggaagggggagtagtctgtcagaggccaccaggtgattgctgtagtgttgtcacataacgctgatctagtgatgtnggcccagactcattttagcccnaaaaa

SEQ ID NO: 2997 - DNA, 186 bp, Zea mays
  misc_feature: Incyte ID No: 700282139H1
  unsure 43, 91, 142, 179: a, t, c, g, or other
attagagttttttgagacctatatgcggttttggttttcagtnccacaattaaaattactgagtaatgtagttgattgggaacagaaagtnccctggtttaccgaactccatttctcttgtcatttttctttattctgtagnctgtattatgtatgcgtatgagtattgagatgattcngcatttg

SEQ ID NO: 2998 - DNA, 294 bp, Zea mays
  misc_feature: Incyte ID No: 700282140H1
  unsure 6, 13, 23, 29, 31, 48, 60, 76, 93, 174, 181-182, 210, 235, 254: a, t, c, g, or other
aaggangcgaagnaaaggtagtngggacncngggaaggaatggaagtnatctcagagacngacaaagatgccaatnctggatatgagattgtnggatttgaagttgtcccatgcagcgtgaagcgtgatcctgaatccatattgaagcttaatatgtatgataaagtcgatccngtgaacnngccctgtggagttggaaaaatctcaatnggttagggagaaagagaagattacnctttacttatgaggttganttgtaaacagtgatatcaggtggccatcacggtgggatgc

SEQ ID NO: 2999 - DNA, 294 bp, Zea mays
  misc_feature: Incyte ID No: 700282141H1
  unsure 6-7, 60, 118, 153: a, t, c, g, or other
aaaagnnggtggccaaagaaagcaggggcagaggaagcagagtagtagagcgaaggcgangcgtatcaatgatggggcctctgcctctccgccgccgcgtgggcgtcctcctgttccnggccctcgtgctcctgggcggcggcggcgcggacnccggcacgacaagctcgtacaggcggaagctggaggcgacggtggagatgccgctggacgccgacgtgttccgcgtcccgccgggctacaatgcgccgcagcaggtgcacatcacgctgggcgaccaggagggcacggcca

SEQ ID NO: 3000 - DNA, 293 bp, Zea mays
  misc_feature: Incyte ID No: 700282142H1
  unsure 6, 9, 11, 13-14, 16, 83, 89, 123, 146, 158, 180, 187, 189, 191, 197,: a, t, c, g, or other
ctcgcngcncncnncnctcgccggagcgagccccgggccggatggcggcggcagcagcagctcctcccgcctccgcgatcgcntgatgnacgccgacgccgacgccgccgcgatccgccgatngacgacgccggaagggcaccacnacccgcgccagngcggtgaccgtctccgccaccnccgcacncncncctacnccgcccttccgccacnnccgccgccgacaagtcctccctcgacnccgacgcgctttatgaagttggaacntccgctactctcnccgttcgcncncc

SEQ ID NO: 3001 - DNA, 292 bp, Zea mays
  misc_feature: Incyte ID No: 700282144H1
  unsure 11, 21, 99: a, t, c, g, or other
tttccagagancctgcatttnccaaagattgataattcagattctgagaacataatgtatccagataggtcaggagaaaaaacaagcaaaagggaaacnaggatggcacatagtggaatgctagagtatgctgatatgcagaagaagaaagcaacctcaaggcttccacagaacggtactaataatgtcatagtgtctcgaatgcagaaatcaatatccacatcagataatgaggaaagaagtagaaacaactctttgattgagacaaagacaggtagaaagagaagagacc

SEQ ID NO: 3002 - DNA, 288 bp, Zea mays
  misc_feature: Incyte ID No: 700282146H1
  unsure 9, 21, 34, 59-60, 65, 86, 90, 122, 127, 148, 163, 169, 175, 196, 225, 237,: a, t, c, g, or other
aggctagancttgcaaacacnaccagcgaagacntcgtggcgcgcatgtaggcggtctnngcacncggcgtcccaccgccaccgcnactntcgtagtcctagatccgaccgcctcacgagcnacatncccctcgaggccggccttccnggtgtctcagcagcngcggcncatggngatggctgcggggcgtgggcnccttggccctcttctcggtcgtcgtagtngctgggctcacntctgcggcgaatggncctttcctgtccgatagcgtcttccagccgagcgcc

SEQ ID NO: 3003 - DNA, 196 bp, Zea mays
  misc_feature: Incyte ID No: 700282148H1
  unsure 143, 180, 183-184, 189: a, t, c, g, or other
tttctttcctgatagaatcttccagagtacaaagctaacacaatacctttctaggataaatttgggagtatcaactcctaatattttactttaccttgtctcgaggtgtgctcgccactcagaccatttcaataatttgcatnaggttttcttgagatattaataatgtgtaaaggtatnganncaccnttccagc

SEQ ID NO: 3004 - DNA, 300 bp, Zea mays
  misc_feature: Incyte ID No: 700282149H1
  unsure 21, 23, 36, 48, 57, 59, 61, 64, 66, 161: a, t, c, g, or other
gaacatcgcaggaagtatganangttgagaaaaganacggaggaaaanagagcgcangngnatncngcttcgtcaacgtgcagaggcgcaggctgcttacgacaaggccaagaggaaggagcaatcgtcaagtcgctcatcaggaggtgcatctcccagangctttcctggagggatgcctggtggtggtttccctagagggatgcccggtggaggtttccccgggggtggcatgcctgggggtttccctgggggtggcatgcctggaggtttccctggtggtgttcccggtaatgttga

SEQ ID NO: 3005 - DNA, 285 bp, Zea mays
  misc_feature: Incyte ID No: 700282152H1
  unsure 4, 9, 12, 22, 28, 36, 46, 50, 52, 79, 82, 94, 118, 123, 218, 231, 242, 277: a, t, c, g, or other
atcncagcntcnggagcctgtngcagcncctccggngcatccagtncatncnccagccaacaagcaaccagcgcgcccngcnccacagaaagcnacagctgaagatgatgagcttgcngcacngcaagctgaaatggcattgtgatcaggtttccaatgaagaggtggaatgtgtatatgaatggtgttatgctaccaagatgaaagttgagtcaggntttattatatttnccatgtgtatnatcttgggggatatttggcaagcagaaaaaaagcngctccagg

SEQ ID NO: 3006 - DNA, 95 bp, Zea mays
  misc_feature: Incyte ID No: 700282154H1
  unsure 30-31, 91: a, t, c, g, or other
gctttgggaacaatctcatccatagcagannaagaggggactctacaccgcattgcagatccgccgaaaaagaagtctcctccaacaaacncccg

SEQ ID NO: 3007 - DNA, 295 bp, Zea mays
  misc_feature: Incyte ID No: 700282156H1
  unsure 20, 28, 44, 77, 79, 81, 101, 150, 187, 223, 234, 247, 259, 289: a, t, c, g, or other
gaatccgcgaatcacagacncgcctatntcagcttgctgcactnccctgccatcatatcaatatcatatcgtacgtnancncggccgagagcgagggagangcatggctgctccgaagctcgcgacgctggcgctggccgtgctcctggnggcgaccgtggtggctcccccggccgcggtgcgcgcngcgatgtcgtgctccaccgtgtacagcacgctgatnccgtgcctgcngttcgtccagatnggcggggccatnccgccccagccgtgctgcggcggcatccgnacctgc

SEQ ID NO: 3008 - DNA, 298 bp, Zea mays
  misc_feature: Incyte ID No: 700282158H1
  unsure 4, 6-7, 32, 34, 95, 105, 111, 120, 125-126, 137, 148, 157, 176, 183, 188,: a, t, c, g, or other
aaantnnccatcaatgaagcaaccacagattngngcctgaagtgtatccgctatgagatcagtatgttgttttgtcctatttaatcatttgagcnataattttcnaatgtnttggagatnttatnncccctacactntcaaatttaanacattaganacattgacatttgaaatantgcatgnatagnagctcccngcccggtcanggtgtgccgatgtctgtnnncccaagcacccnncgccgtgaaatnccgtcggancntcaagtcgattcanancgcgtgaggttgcnttcccc

SEQ ID NO: 3009 - DNA, 305 bp, Zea mays
  misc_feature: Incyte ID No: 700282161H1
  unsure 4, 6, 9, 11, 34, 53, 55, 97, 105, 142, 240, 242, 264, 282-283, 301: a, t, c, g, or other
cgcngnacncntctaagatagcgtggcgccacgnccgctgcgttgtgcgagangngcgtccaggtccgtcatgaacccaaacaaggaatatgatatnctcaagtncacaggttgcagatagcaaagcaagctattgggaacnacgctccgacaaccaccacacgcctcaggtttggctagtagacaacatcgacgacgaggaacagaagatggcaccgaaaggagccgtattcgtcccantntcacagttccccatcaagaaantccgcaaggattgcaccnnacctgagcataccagcantgaa

SEQ ID NO: 3010 - DNA, 307 bp, Zea mays
  misc_feature: Incyte ID No: 700282164H1
  unsure 2, 8, 16, 30, 103, 117, 133, 177, 265: a, t, c, g, or other
anctgaanaacgaacngctggtggtttgcnattgacgcaggcaactaaggagaaaccttctgttggatcagtggtagccgttggcccagggccgttgggcgangacggcagcaggantcccctgtcgatcacncctggaagcaacgtgatgtattccaagtatgcggggagtgagtncaagggcgaggacggtgagtacatcgtgctcagggcgtctgacgtgatggctgttctttcctgatccccaaaccatacagcgccaggngcgcgataggaagttttgatgttgaggccgaaccttatcttt

SEQ ID NO: 3011 - DNA, 295 bp, Zea mays
  misc_feature: Incyte ID No: 700282165H1
  unsure 2, 23, 54, 107, 134, 140, 148, 246: a, t, c, g, or other
anggtgaaattgtagctgaaggnagtccttccaaagatcaaacggatgattttngactcaagctgaaagaagaggctatgctgaatagagtactgaaggaggcagtnttgtcaaaagaagttgccattgaacanttgcantctgatcnggcatcttcacttcgcatccaagacgttatgagaaacgagatccagagggttcaggatgagctttcttgcataacccacaaagctaagcagttggagntcaggtatccaagaaggatgagtcaatcgatgagatccaacaggatttc

SEQ ID NO: 3012 - DNA, 293 bp, Zea mays
  misc_feature: Incyte ID No: 700282166H1
  unsure 8, 18, 148, 256: a, t, c, g, or other
acagaacntctctaagancctgctagatgttgctgacaatttgttgaagtccaaagatggtgaaatcaaagatatgaaggataaggttttgcgcactatgcagaaatggaaaatatcattgctcggacaaaacgtgaatctgagaacncccaaaaaatatgcagtacagaacttctctaagagcctgctagatgttgctgacaatttggctagggcatcatctgttgtcaaggaaagcttctcgaaaattgatacntcaaaagattctgctggagctgtcccatactgaaaac

SEQ ID NO: 3013 - DNA, 291 bp, Zea mays
  misc_feature: Incyte ID No: 700282167H1
  unsure 94, 159, 211: a, t, c, g, or other
gtagactgtagttctgttcctccccactcactccctgcgcttcctcgccgcgcggttccttctccctgatcctcctttggcttcgcggttcatngcgatgtggagggccgccgctaggagctggtcgaccgggcgctcggctcaagggccgcgcacacntctacaggcagcaaaaagatagtcggggtgttctacaaggccggggagtatnccgacaagaaccccaacttcgtcggctgcgtcgagggtgcactcggcatccgcggctggctcgagtcgcagggccatcag

SEQ ID NO: 3014 - DNA, 289 bp, Zea mays
  misc_feature: Incyte ID No: 700282168H1
  unsure 7, 9, 22, 54-55, 104, 262: a, t, c, g, or other
atgaacncntcgaaactgtatnccaagctctgaattcatcaatagaccgtgacnnccttagtgggtggggtggctatgttctgattgtgacaccgactgaagtnagggagcatgtgattaagagcaggatggactaaatcatggccactatcactataattcttagctggtttccaatgcttagaccaatgttgtgtttggattctgaagtaacattgtatcatcacagctggtatgagaatgaacggttgttttatttacncctatcttgcaagacttatgcctggat

SEQ ID NO: 3015 - DNA, 291 bp, Zea mays
  misc_feature: Incyte ID No: 700282169H1
  unsure 18, 74: a, t, c, g, or other
atgcaactcgtgtaaaangggttgttgtttttggtaatagcaatgatggatcacagctctccaatctaatttcnccctgcttcgtccgatggtgtcataaggatatgggacattcgaacaattgggaatggaaagcctactccattagcagaggctaatacaaaagcaaggctaacttgtcttgctggaacgtcactgaaatgactcaaggaacctacagtttgctaggcgtctgattctgcattgttagctgaattagaaaacctggaaatgaaagaagaaattgaaggt

SEQ ID NO: 3016 - DNA, 292 bp, Zea mays
  misc_feature: Incyte ID No: 700282170H1
  unsure 7, 69, 99, 165, 215-216, 245, 252, 270: a, t, c, g, or other
gttgacngcaatatcagtcaatcccagtctgcttccagctttgaatcagttgcttctccgaggcgtatnccattctacgtcccaagccgcttgactatnaccagcgcaacaccttggttgatgtcttcaggaagatggtgaatcaaagatttggtagcaacagtnggtctccggttgtggaaccatttggatcattcacgatggatttatttacnncctcacagtgaccgggacctctctatcanttttagngctaatactgatgagcantatactcgcaagcaaatgatct

SEQ ID NO: 3017 - DNA, 295 bp, Zea mays
  misc_feature: Incyte ID No: 700282171H1
  unsure 15, 57, 78, 134, 148, 158, 179, 188, 224, 229-230, 242, 245, 251, 258, 272,: a, t, c, g, or other
atctttctgcacatnagtactagctttttttttgtcttgagcatattttttacactnatgccatgcgatgttttttcnttggctagtaaacaaggtaaagcatatgaagctatctcacttcatcacccttttcnatcattccatgtcntcagagcccntgctaaccatagggagcatcnaccctgtcntgtggtccgatgactggaccgcagtgacagaagacngcagnntgtcagcacagnttnagcgcncgatacntattaccgaagatngccctgnaatactgacncagngt

SEQ ID NO: 3018 - DNA, 293 bp, Zea mays
  misc_feature: Incyte ID No: 700282172H1
  unsure 8, 12, 18, 21, 42, 48, 54, 61, 163, 180, 247, 261, 281, 285: a, t, c, g, or other
atcaaggnagcntacacngcngcagtttctagagccctctcngccacnccgtgntcccacnagtcacgatgcctgccctcgccaagcccgcctcccgcaccgccaagcccgccgcggctccgaagccgaagcctgccgccgccaagccgaaggcgccaccgcnggtgcctcccacccgcnttactttgagatgatcaaggaggctatcacggcgctaaaggagaggaccggctccagtcgcaagcgntcgccaagtatgtnggggacaagcacggcgcgtntctnccggccaa

SEQ ID NO: 3019 - DNA, 234 bp, Zea mays
  misc_feature: Incyte ID No: 700282173H1
  unsure 5, 10-11, 17, 65-80, 162, 169, 232: a, t, c, g, or other
gcacnccgcnncctgtnctggcatttctcttaggttttaacacccagtatggaaccatagcgccnnnnnnnnnnnnnnnntctcttcttctccggtttgagttttttctggtgttgggtaggcatacctgtcgtctgtcagcgtagacataaaaaaaaaaangtctctnggacgctcgcccatgtatgtatgtatatgatgtgaagtgatccaaggtggttcgcgtactatngc

SEQ ID NO: 3020 - DNA, 292 bp, Zea mays
  misc_feature: Incyte ID No: 700282174H1
  unsure 29, 109, 111, 142, 177, 203: a, t, c, g, or other
aaaagaagcacatgcaagaagaggaggtncctaatattctctgtttaatctgtttcatttaaactgtatttaggtaaatactaacatcatagttattgattttagcacncnggacattcaatccatcactgtttctgaaatntctacatacactaagaacagaggtatctaccagtnccctgcaatacaaattcttgaatacngcatgctatttaatctgatcctctaaacatcttggtttgtagggttcagtttatgctccatcatttgatcatggtgttggcgacccagt

SEQ ID NO: 3021 - DNA, 216 bp, Zea mays
  misc_feature: Incyte ID No: 700282175H1
  unsure 35, 64, 73, 116, 209: a, t, c, g, or other
cctgaacgaataaattcagaactagaaaacagatntcagtaaacaacatgtggtgaatgttggnacttgaacngctctagttcagtgggcatctgttgttgcatgtttgggatggntttaatgtttcgttttttttccttgtactgactgatcggtaacgatcactgtgtgtgaagtgcttgattgttatgtggtatcatgagaatgantaaacat

SEQ ID NO: 3022 - DNA, 294 bp, Zea mays
  misc_feature: Incyte ID No: 700282176H1
  unsure 82, 88, 165, 194: a, t, c, g, or other
ggcgagggccagcaacagaagatagaaattaacgagctccatttattatttgagacagcaccaagccggttgcatgtgaatntccacnggctacagaatgcttcaagaaaatatgccacctcaatgctgaacaatctacctgagatccacaagctcgagcttatnccgaaaggaactgaagattctgttgcacnacatggttgtctggaagcctttctaaaagaggagccgttggggccggaggacatgtggtattgcccgcgctgcaagaagcatcagcaagcgatgaagaaa

SEQ ID NO: 3023 - DNA, 303 bp, Zea mays
  misc_feature: Incyte ID No: 700282180H1
  unsure 3, 12, 14, 21, 26, 31, 33, 35, 38, 58, 62, 65, 94, 96, 109, 140, 161, 168,: a, t, c, g, or other
tcngctgcaacncnacctgtntcgtngcgantntnggngctatacagccaagcaggtnggcnccnggggaagggcggtagtgtggttaagcaantngcagcagataacngctgtgaaatccgtgttttgaaagacaaccntccgtcatgtgctctgttgantgacaanctttgccagatcacnggagagnttgactcagtaaggaaaggtctcnntnctgtntctgaagtnctcttagctcntccacccaaggaaanaatgcagtngctgntgttcnttcttctggntcatcgtcagttcttt

SEQ ID NO: 3024 - DNA, 286 bp, Zea mays
  misc_feature: Incyte ID No: 700282183H1
  unsure 87, 108, 146, 200, 239: a, t, c, g, or other
gggaaaaaggagaggccgagaagcgctttagcgatcaagactggtgcacccgtagcggcacggcatggcggccacggcgtactccgnggcgctcctcggcggcgcacncctgccggccgccctcctccctcggcgcacagcgtgtnccaccagcagcttcgcctccaaggtaggagtaaacaacagcagcagcagcggtntatttcacgcgccgaggctctccctgcaccgtgccaggnccgcttccgaggacacgtcggcctccggcggcgacgagctcatcgaa

SEQ ID NO: 3025 - DNA, 284 bp, Zea mays
  misc_feature: Incyte ID No: 700282184H1
  unsure 2: a, t, c, g, or other
angaccatgatcgtgcggaattgcgagaactagagaagaatcataaaagagacaatactgcagtcagccctccggaggaacaacgtccaaagaaagcaaggattcagatgttttcccctgcagagggggtgccagataatgtaacagtctctgttgagtatgcgaagtctggtcgctctacctgcaaggctgcagtgagaatattgccaaaggtgccctccgccttggtgcctcttttcctgatccccgtggctacgaaaatactaagtggtaccatgttgtgt

SEQ ID NO: 3026 - DNA, 286 bp, Zea mays
  misc_feature: Incyte ID No: 700282185H1
  unsure 36, 50, 215, 263, 276: a, t, c, g, or other
gcgctcaagttctcgcgcccagagccaaatttttcnccactccaatcacngcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaagggccggtacgcgcangcgtgggcaccggcgcccccgtctatctcgccgccgtgcttgagtacntcgccgccgagtnctggagctgg

SEQ ID NO: 3027 - DNA, 284 bp, Zea mays
  misc_feature: Incyte ID No: 700282186H1
  unsure 74, 101, 130, 167: a, t, c, g, or other
tcagattggcaaccttgaagatactcggaatcgtactctgcatggtattttaagggttcaaagctgtttcaggnggcatcaagcccgtcatcatgcaaganaacgaacaagaggagttttggctcttcantcattcattcgtggtgagaatgcacgacaaatttacncctctttgttgaagaaacatagagcagcagttgttttgcagagaaatgtgagatgttggcttgcaagaaggtatttcataaatgtccggaaggcctcagtgataatacagtctggta

SEQ ID NO: 3028 - DNA, 287 bp, Zea mays
  misc_feature: Incyte ID No: 700282188H1
  unsure 4, 6, 11-12, 17, 24, 26, 40, 76, 78, 98, 110, 112, 123, 173, 183, 215,: a, t, c, g, or other
atcntnccatnnccccnctaaacncnagccgcctagcgcntcgatccgagcagccctaggtctcgcggaggtagtncnggttgatttggtccaagatngcggaggaaaangnggggcggatcntcgtcggcgggctgtcgtggaacaccacggagcgcacgctcgagcgcacnttcggtcagnacggcaaggtcatcgaggctcaggttgtagtngaaagggagacaggccgctctaggggatttggatttgtcacattttcagaanncgggctgtggatncngcca

SEQ ID NO: 3029 - DNA, 278 bp, Zea mays
  misc_feature: Incyte ID No: 700282195H1
  unsure 8, 22, 120, 170, 198, 248: a, t, c, g, or other
tgacttcncctccccttcaagncctctccactccatcgtcaaggaaggaacacggccctaactaaaccctagctaagggaagggaaacaagaccatggatgcctccaagctccgcgagcntcgcgacttcgtcgaggcgtgcaagaagaatccttcgctcctcgccgacnccaacctctccttcttccgggattaccnccagagtttgggtgccaaaattcccgccgccgccccctctttcgaaagtnccaagagatcttccatggacgacattgatg

SEQ ID NO: 3030 - DNA, 283 bp, Zea mays
  misc_feature: Incyte ID No: 700610705H1
  unsure 8, 83, 183, 250, 254-255, 259-260, 262: a, t, c, g, or other
cccacatngagtaaatggaatgcttgctggatcagcaactgtcttctttgcatacataggctttgatacagtcgctagtacanctgaagaggtaaagaatccacagagagatttgccattgggaattggagttgcattggctatttgttgtgcgttgtatatggctgtttctgttgttattgntgggctggtgccatatttcgccatggatccagatactcctatttcatctgcctttgcaaggcatggnagcnntttnntntgtacgttgtgacaagtggtg

SEQ ID NO: 3031 - DNA, 284 bp, Zea mays
  misc_feature: Incyte ID No: 700610708H1
  unsure 34, 217: a, t, c, g, or other
agaaggaagaaggtcatgtcgtcggcggcgcagngcagcagaaagcggcggcagcggagcaggaggaggtggagcacgggccattccccatcgagcagctccaggcttctggaatagctgcattggatgtgaagaagctgaaagattctggtctccacactgtggaggctgtggcttacactccaaggaaagatcttctgcagatcaaagggataantgaagctaaagctgacaagataattgaagcagcatccaagatagttccactgggatttacaagtgcc

SEQ ID NO: 3032 - DNA, 283 bp, Zea mays
  misc_feature: Incyte ID No: 700610714H1
  unsure 13, 15, 36, 50, 183, 237: a, t, c, g, or other
ttggttcaatatntntctggctgttggatgtactcngtctgcttttagtntcaatcggtttttcttgatattatctatgcctaccagaacatctcatattctgtatatatttaaattttatcattgcacaggctgctggacaaattcatggactggaggactatagaggactgccaagtgctnctggaaggttctcgagcactattgaactaagggatccaaatagttctttggagnctattgttggtgttggcggggtcaatttagcagagatacgtcagat

SEQ ID NO: 3033 - DNA, 290 bp, Zea mays
  misc_feature: Incyte ID No: 700610715H1
ttctccccgtcaaggccttttgagagtccgtgagtttactttagcggaaattgagcactttgtggacccagaggacaaatcccatccaaagtttggtgatgtttctgatctagagttctggatgtttccgagagaggatcaaatggcaggaaggtcagccacaagacttaaactcggaaattctatatctgaggtattatctcctgatatttctctgttatatatttttggacaatatgatatctgagctcttcttttgctacagtttgataccatctataaacttgtaa

SEQ ID NO: 3034 - DNA, 292 bp, Zea mays
  misc_feature: Incyte ID No: 700610716H1
  unsure 22, 33, 47, 277: a, t, c, g, or other
taacagagccctttattgggangagtgccttanggaattttattcgncatatgatgataccctcgtgcagtggaatggggctgaacttatgacaagagtgataagcaatatttctagcagagcagatgaaaacagggggcatcttgacattaagttggagccctttgttaaattttaccctataagctctactgatattatacgatatttctcagagcccgataacatggtccaaaaagcacatcatgatgcaatcttttctaggatcgtgaaggantctaccactttccat

SEQ ID NO: 3035 - DNA, 290 bp, Zea mays
  misc_feature: Incyte ID No: 700610717H1
  unsure 48, 226: a, t, c, g, or other
tgaagcccaagatggtacaggcccgtggatgatatgcttggatatggncattcctgaaacttctcaagaacttcagaaacccataccgagtgaacccatacaggcggttgaaagatgacttcgatctgcaacagaatgagggattgattgtcaggcgatgtgaatcatagtggtcaatgtctcttggggcgttcattgccatccatgcttagccattgttatatanctttatgcataagaatcatagagccattgctcaagctttcaccagcacatctgattatgtaaaa

SEQ ID NO: 3036 - DNA, 283 bp, Zea mays
  misc_feature: Incyte ID No: 700610719H1
  unsure 2, 30, 33, 42, 46, 57, 137, 143, 153, 156, 166, 181, 244, 253: a, t, c, g, or other
gnagcgacggcgatgcggttgccatctgcngcntcggcgtcncgcnttccctcttcncttttcttacaaccccgcgcaaggacaagatgcatcccatcctcctccctcgcctgtcgggcatcttcttcatcagccgntggcgntggtgacggnggntcgcggaagncgtggctcttcgtanggctgggtaaccccggaaaggtgtaccagggaactcgtcacaacgttggattcgagatgatcnatgttatancagcagtgagggtatatctctgagcagtat

SEQ ID NO: 3037 - DNA, 281 bp, Zea mays
  misc_feature: Incyte ID No: 700610724H1
  unsure 190, 267: a, t, c, g, or other
gggaaagactccacataccaatgttgatccatatccagattatgttgattggtttgaatatgaggataaaggtcatcctctttctaatgcccctgagccaaagaggcgatttgtaccttcaaagtgggagcagaagaaggttgttaaacttgtaagagccattcgcaatggatggataaagtttgacaancccaaggaggaacaaaacttgtatttattatggggagatgaaactgatacaacagataataagcggcatggcttganctacattcctcctc

SEQ ID NO: 3038 - DNA, 281 bp, Zea mays
  misc_feature: Incyte ID No: 700610725H1
gaaggatggcggcctcttggaagtttacataaaatgggagtctggcaacctgatcaaagggctgaagctactgcacaactcgtgcctttcagatctgaggaagtttatagaggctcacttcgaagaagcaggcagcaaacagaagcatcagttcaccttccttctcctcggggatccgtccggtgctccggtgtcccgggacacggaagcttcggtgcagataagcaggctgcctcactggaacaaccagccggacagctacctggcgtgcctgcgcgcgg

SEQ ID NO: 3039 - DNA, 280 bp, Zea mays
  misc_feature: Incyte ID No: 700610729H1
  unsure 8, 15, 19, 28, 43, 59-61, 65, 73, 94-95, 119, 135, 154-155, 166, 171-172,: a, t, c, g, or other
cttcaganatcatgntcangcggttcanagtatttgaagtggnacttgtaatgttcccnnncttntgttgccntgttggtctgcagagttcacnnggctatgtttacttcacgtatttntgctgaagttctgggnttgcttaacatgctagtanncttcttctgtntgcgnngatttgtgactactgttngtttnaactaggctcatgctttntctnatgngacntnnnantagaccacactgaancttttanaangagncatgtaattgtgtcatcaga

SEQ ID NO: 3040 - DNA, 289 bp, Zea mays
  misc_feature: Incyte ID No: 700610731H1
  unsure 2, 5, 8, 11, 14, 27, 38, 47-48, 104, 106, 120, 142, 148, 153, 155, 165,: a, t, c, g, or other
gnganatntantcntgacaagtatgcngagaaggattncgtgcggtnncatagcatggatgggattcaacttgccagaacagatgtgggacaatgtaagttcgnanaacaagaagggggngtacatcttgatcgtggggtcnaatgcngacgnanatttttcctntggtcatnnatcatncnattcggcnttggactctgggnaaaggtntccncctacaagagcaatcagcctctcanatctaacggaagctctagntgttatgncngccatccnctcgagananggt

SEQ ID NO: 3041 - DNA, 293 bp, Zea mays
  misc_feature: Incyte ID No: 700610732H1
  unsure 53-54, 85, 284: a, t, c, g, or other
acaggtacatgactgaggtgaggcgattaaaccttccacagaaccaaacggannaatgtctaaccgtggtttccgtgaacttgangagaaattactatcttcttattaggcagattgcagtcattcctcaagatagtgaagaatgatcttgcatctgttgtaccacaaaaccaaggaatagagtcgagggcttctggattcacctcagcatgatctgtattgttccttacacttgatctgcaagaaccttctggattcacctcagcagatctgtattgttcctnacacttatc

SEQ ID NO: 3042 - DNA, 286 bp, Zea mays
  misc_feature: Incyte ID No: 700610734H1
  unsure 2, 17, 29, 112, 126, 149, 282: a, t, c, g, or other
gngccagagcccgatcncgatccagcgangcggcgaccctccctcctccccttgtcttcgctcgtgccagccctgaccacccgcatccccgtcagtcatggcagcggcagcnggcggaggcgcggngcgtgcgctgtcccagaaggagnaggacatacagatgatgctcgccgccgacgtccaccttggcaccaagaactgcgatttccagatggagcgctatgcctttaagcgccgcaccgacggcatctagatcatcaaccttggcaagacatgggaganatgc

SEQ ID NO: 3043 - DNA, 275 bp, Zea mays
  misc_feature: Incyte ID No: 700610743H1
ccaaaatgttttcaacaacaaactattctgattcatctaaacttcatagcaatagtgtttggtaatgaagtttgcatgacataattgcatgtactgctttccattccactattgttaatttttggatttaatctttttcagtcttgttcatgttcatagccaacaaaactgatgcaaaaatgttttgttatgtaccactaaaacttgaaacgtctctgtctcttctatccgtctgttctagaaagagtgtgtggagggcgaagaggttgggaggc

SEQ ID NO: 3044 - DNA, 280 bp, Zea mays
  misc_feature: Incyte ID No: 700610746H1
gaggcatgccacatatctatcaacaagacaccaatttatggggataatggctcaatatcccctggtggtgtgcggatcggaacacctgcaatgactactagaggttgcctagaagaggacttcgagtcgattgcagacttcctcataaggtctactcagattgctagcaatgttctgaaagaacatggcaaagtggcaaaaggagtttctaagaggcctaatgaacaataaggatgttatggaactccgaaatcaggttgaggcattgcgtcacagtttg

SEQ ID NO: 3045 - DNA, 173 bp, Zea mays
  misc_feature: Incyte ID No: 700610749H1
  unsure 125: a, t, c, g, or other
ggttgataaatgaattttataaccatataaagtattagaaaacattttggtagccggcagtgcctctgtgaagataccatatccctacccatgctattcaatatccagtatcaatcactgttgantgttcgagatgaaaggggaaatgaaagtctgctgagctatgtttcatc

SEQ ID NO: 3046 - DNA, 258 bp, Zea mays
  misc_feature: Incyte ID No: 700610751H1
  unsure 2, 18, 43, 56, 116, 164, 192, 215, 226: a, t, c, g, or other
cnaagaatctgatcggtncagacatgagatgttctgggatgtnatactatggcggnacttgtccatctgaccaagtcactatttcatgtttgagtccacgacaaggactaggatangaacgctgctttctaggttgagcttactgtaactactaagaaattttnattatgtaccaaccttatcatttctacnatgttgcgggatgtctgaagtanttctttgttanaagatcgggtatcctgctcccttttgcttctc

SEQ ID NO: 3047 - DNA, 275 bp, Zea mays
  misc_feature: Incyte ID No: 700610753H1
  unsure 2: a, t, c, g, or other
gngtttgctcccaaggttatccgtatagattgagcaactcatagcaagaggaacgatcttccgcactccgaatttatttctaaccctaaccccaagtgtagtgcgtgttcaaagtttataattttcagattttgtctattcacccccctaggcgactttcaaaactccatgttttatattatatgtgtataaatatataaaccgtagggagggttggggaccaaggcccctgcctgcccccttggttccgccctgctcgtgtgttacgacagcac

SEQ ID NO: 3048 - DNA, 272 bp, Zea mays
  misc_feature: Incyte ID No: 700610757H1
  unsure 40, 162: a, t, c, g, or other
aagcatgccgctcagctctgcgtgcttgccgaggactgcnaccagcctgattatgtcaagctggtgaaggctctctgcgctgagcacaatgtccacctggttactgtgcctagcgccaaaactcttggagagtgggctgggctttgcaagatcgactctganggcaaggcgaggaaggttgtaggctgctcctgtgttgttgtcaaggactacggcgaagaatctgaaggccttaacatagtgcaggagtacgtcaaatcgcactagataca

SEQ ID NO: 3049 - DNA, 209 bp, Zea mays
  misc_feature: Incyte ID No: 700610761H1
  unsure 23, 26, 28, 31, 51, 56, 77, 80, 87, 89, 97, 99, 109, 119, 125-126, 143,: a, t, c, g, or other
gtctcacaggcgacatttttagntcngnaanatgcgattgcggtgaccatnttgcnatggcaattgagatggttganaangccggangnggtgtaanantttatctccntggacacganggacgnngtatcggtctgggccanaancttcgtgcttatnncttgcangatgatgggcgtgatactgtgnaanctantgangaacttggt

SEQ ID NO: 3050 - DNA, 277 bp, Zea mays
  misc_feature: Incyte ID No: 700610762H1
  unsure 3, 11, 15, 37, 44-45, 47, 52, 68, 73, 77, 102, 134, 165, 171, 220, 224: a, t, c, g, or other
gtnctgttgtntatnatcgctgttgcattgtgcgcanagcctgnntncgacncaaacatgaacttgcngtacntccnttaatttatccccatctgaatgacncttcatacccaggctcatgttggtggtttatnttgcggtttttgattgtgctgtatgttgggnggcctnacagaagggaggaatcggtcacggtggctgcggatcgagtgcatccgtnttgntggtgttgagatccaaaccacaagatggtggagtactcgctgcagtacataca

SEQ ID NO: 3051 - DNA, 277 bp, Zea mays
  misc_feature: Incyte ID No: 700610763H1
  unsure 40, 57, 115, 211, 226, 232, 237, 263: a, t, c, g, or other
gaagtcaagaatttctggcatccctaagcttgaggatgcnaatgaagctggtggganggactctcacaagtgcaccttgattctgactgagggtgactctgcaaaagctcttgcnatgtcgggcatagctgttgtagggagagattactatggtgtatttcctctcaggggaaaactattgaatgtcagagaggcaaaccacaagcagatnatggacaacgctganttcagnacatnaagcaatccttggtttgcagcatggnaagcagtagatagc

SEQ ID NO: 3052 - DNA, 286 bp, Zea mays
  misc_feature: Incyte ID No: 700610764H1
  unsure 2, 7, 40, 46, 89, 147, 226, 254, 257, 271, 275, 277: a, t, c, g, or other
cntcgcngttaagaaggtgaaagggctgacaagagaaganattgcnacccgtagtgatcctggttgccgctttacctgacagaatacantcaatcccagatggtagttctactgccacaaagaaaaatggaagttggggagcctcangatctcgcactggaggagccataaagttcgactctactgctgatggaaactttgatgatgagtactttaaggggacagnagaatctaatcagttccgtcgggaatanganatgcgcagaatganacangngaagtttgg

SEQ ID NO: 3053 - DNA, 277 bp, Zea mays
  misc_feature: Incyte ID No: 700610767H1
  unsure 53: a, t, c, g, or other
gcaacagcaaagcaactacagagagtaggagatgcttactctccacaccattncagtccatgcccctcgctgcgcagatcctctctgttccggcgtgctctgctaggcaggaagagatctttcatttctgccagcagttctgaggatgccgaatccggcactcccccgccgcttggtggcgacaaacaccagcaggaggttcttgcacagatcgccatgcttcagacgcagaaggtgcgcatcacagacttcttggacgagcgctctgcttacctga

SEQ ID NO: 3054 - DNA, 276 bp, Zea mays
  misc_feature: Incyte ID No: 700610772H1
  unsure 34, 41, 45, 48, 148, 150, 228: a, t, c, g, or other
ggaagagagcaaaagatctcttgtacaaggactncaacttngatncanaagttttttttgtcgacatgttctaactcctggtttgaatctcacagccactggtgtgaagatcaatgaagacttcattggtgatatacggacacagcananaagcagcagaaccactgttgatgtcataatcgatagtgattctaaagtgtcaaccaccagtcactgttgatgaagcantaactggtttgaagacttcatttgccttcaaggttccagatcacaagt

SEQ ID NO: 3055 - DNA, 273 bp, Zea mays
  misc_feature: Incyte ID No: 700610773H1
  unsure 156-176, 183-184: a, t, c, g, or other
caccgcgctgagctccaaagaatctagcagctaggagcaggccgtgtatacgccatccaccacggcaacatgtgctccggctcctggtcctggagcagcagcaagaagcgcccgtctcttgttgtcgtcaacctcaagcggcagcagctgcagaannnnnnnnnnnnnnnnnnnnntcgtgcnncagttgctatcaggaggaagaggctgaggctgaggaggttgagagccggagcagaggccatggagatggtgaacctgaagctctacctg

SEQ ID NO: 3056 - DNA, 271 bp, Zea mays
  misc_feature: Incyte ID No: 700610775H1
  unsure 13, 26, 32, 186, 195, 215, 263: a, t, c, g, or other
ttattttacaganaatgagatacganacatanctgatgggtataagtctgttatgggaagaggggcatttggtgaggtctacaaaggaacgctagaagaccaatcctcagttgcagtaaagagatatatacatgggacccacaaagaggtgtttgccaaggaagtcatagtgcactctcaaataanccacaagantgttgtcagactcttgggcngctgcacagaagaaaatgctctaatgattgtcatggagtttatctccnatggggac

SEQ ID NO: 3057 - DNA, 272 bp, Zea mays
  misc_feature: Incyte ID No: 700610777H1
  unsure 2, 125-127: a, t, c, g, or other
gnctcacaggcgacatttttagatccgcaagatgcgattgcggtgaccagcttgcaatggcaattgagatgattgagaaggccggaagaggcgtaatagtttatctccgtggacacgaaggacgnnntatcggtctgggccacaagcttcgtgcttataacttgcaggatgatgggcgtgatactgtggaagctaatgaagaacttggtcttcctgtggactcacgagaatatgggatggcgcacagatactacggggacctaggagtccgt

SEQ ID NO: 3058 - DNA, 272 bp, Zea mays
  misc_feature: Incyte ID No: 700610782H1
tgttgagtcaagtgaagttgatctctctgacttccaagatgctgaagatggaacaaatgtaccttctgagagtgacgccggacagccagctgaagaagatgctgctcctcagcagcagggtgcagaaaatgaccaagcagcggataatggtaagaagaaattggtaataactgaagaacacttccagagagttactcaagctttggttatgagactaaggcagcatgaagagtcagtcaagaaagatggagatggtttagctggcagaagca

SEQ ID NO: 3059 - DNA, 271 bp, Zea mays
  misc_feature: Incyte ID No: 700610783H1
  unsure 47: a, t, c, g, or other
cttcccgtcgaaagacgagagaggaaaagggacaagggcaaggcaanagagaggcgtcgtcgtttgatctgctgccggagtgcgaagaggaagaggaagaggagcgccggagttgtaaagatgttcctggtggactggttctatggggtgctggcatcgcttgggctgtggcagaaggaggctaagatcctcttccttggcctcgacaacgccggcaagaccaccctcctccacatgctgaaggacgagcggctcgttacagcaccagccg

SEQ ID NO: 3060 - DNA, 269 bp, Zea mays
  misc_feature: Incyte ID No: 700610785H1
  unsure 3, 41, 164: a, t, c, g, or other
tangcatgccgctcagctctgcgtgcttgccgaggactgcnaccagcctgattatgtcaagctggtgaaggctctctgcgctgagcacaatgtccacctggttactgtgcctagcgccaaaactcttggagagtgggctgggctttgcaagatcgactctgagngcaaggcgaggaaggttgtaggctgctcctgtgttgttgtcaaggactacggcgaagaatctgaaggccttaacatagtgcaggagtacgtcaaatcgcactaga

SEQ ID NO: 3061 - DNA, 271 bp, Zea mays
  misc_feature: Incyte ID No: 700610786H1
catatctcctcgcatttccttgcaaccgattgccttcccccctcccaacccaagaccgatggcgcccaaggccgagaagaagcccgcggcgaagaagccggcggaggaggagcccgcggcggagaagacgaccgccgggaagaagcccaaggcggagaagcggatccccgctggcaagtccgccggcaaggagggcggcgagggcaagcgtggcaagaagaagggcaagaagagcgtggagacgtacaagatctacatcttcaaggtgctg

SEQ ID NO: 3062 - DNA, 266 bp, Zea mays
  misc_feature: Incyte ID No: 700610790H1
ctttcataacttcacgaagacaagttagaattgaagactatgtccatgagtactactcagttgaacgtttcaaagctacttattagtttgatattaacccgatggttgataaggctcagtggcccgtggttgatcctgggtttgtgatggttcctccgaagttagagaggcctgcgggtaggccgagagtacgtcgaatcagaagtagtggtgaggctgggaaaagaggcccttaccaatgcaagagatgctttcagtttggtcat

SEQ ID NO: 3063 - DNA, 269 bp, Zea mays
  misc_feature: Incyte ID No: 700610792H1
gccaatgttcgaccccgcgtggtgccacctgcagcttgtttatgagctcctgctgaaatttatcggatcctcgtccttggacgcgaaggtagggaagaagcactttgatcactcattcatcgtgaagctccttaatcttcttgactccgaggatccaagagaaagggattgcttgaaaactattctgcacagggtatatgggaagttcatggtacaccgtcctttcatccgcaaagcagtgagcaacatattctaccagtttgtctttg

SEQ ID NO: 3064 - DNA, 277 bp, Zea mays
  misc_feature: Incyte ID No: 700610795H1
  unsure 29: a, t, c, g, or other
gaagtgttcgacagcaggctggacctganctcgaggagagtcgtggaagagatgtccctggtgctaaaaatcgcgctgttctgcaccaacgagtcaccgttcgataggcctagcatgagagaagtcatttccatgctgatcgacgctagagcgtcctcctacgactcattctcttcgccagcatctgaggcacctatagaatatgattcgtccccaaaaaattagaggccagtgtcgtcaatctattttaccagtcatgcatcgagggagcatccat

SEQ ID NO: 3065 - DNA, 285 bp, Zea mays
  misc_feature: Incyte ID No: 700610796H1
  unsure 16, 71, 93: a, t, c, g, or other
gcaagaagtgctccgnggaagcaccgtggacacccttgctcgcccgcatctctctaaaccgccggcgccgncgccggcgccggccattcgttncacatgggctgcgatgccaccggccttcacgggcaacctgaagaaagcacttgcaggtctgagaagaatcaatttagatgggctcgatggcgcgtatttgatgctaagggtcaggtgctgggacgattggcttcccaaatagccgttgtgcttcaaggcaaggataaaccgacctatgcgccacatgtggaa

SEQ ID NO: 3066 - DNA, 295 bp, Zea mays
  misc_feature: Incyte ID No: 700610801H1
  unsure 199, 235, 243, 248, 253, 259, 262, 268, 270-271, 275, 291-292: a, t, c, g, or other
gcagattcagttcatcagaaggaaacacattcaggatgtcttcctgttatgtctgatgatgtacatttcatggaagcgccaaaggttgagaactgtgaaactcctccaaggtctcatcagagctccactgtaccagatgcaacgagttcttcaaaaacaaatgatgagttgcgtacttccgctacgtccttagaaaatnacgtggaggagtcagccaaatgaggaacgatactgnggcccgtntgccnggggnagggcnaanagaacncnngggntccggcgggggttttnnaaa

SEQ ID NO: 3067 - DNA, 283 bp, Zea mays
  misc_feature: Incyte ID No: 700610803H1
  unsure 106, 158, 196, 206, 238, 244, 256, 260, 275: a, t, c, g, or other
cctgctgctggagctcgtcacgggccagcgcgcgctccagctcggcaaggcctccggcgccctgcacagccagaagggcgtccatgctggactgggtgaggaaggngcatcaagagaagatgcttgacctgctggtggaccatgacctgggcccacantacgacaggatcgatgttgccgagatggtgcaggtggngctcctctgnacgcattccagccgtcgcaccgccccaagatntccgangtggtccggatnctgnacggcgacggcctanccgagaac

SEQ ID NO: 3068 - DNA, 275 bp, Zea mays
  misc_feature: Incyte ID No: 700610806H1
  unsure 69, 94, 107, 112, 145, 169, 217, 256: a, t, c, g, or other
gtgggacacacgagtacacgaccacgagagactggtcggtctgcgactgtctctgaccgctgaccgcantgtcctctgcttctgtctttctctntctcccctgtccnccttncagatttcctccattcgcggtttgcctctctgncttcctgcctgcttccctccctcngtcagatccccgctcgggatgccatggtggaccagctcaccgacgaanagatcgccgagttcaaggaggcttcaggtcttcgacaangaggcgaggctgcatcatc

SEQ ID NO: 3069 - DNA, 278 bp, Zea mays
  misc_feature: Incyte ID No: 700610808H1
  unsure 262: a, t, c, g, or other
acaaaacaacaatttcatcattccagcagcatcaaacaacaatttcaccaccaaacaacaattttggtattcaagtagcatcaagttattggacgataatacaagcaatatttgtggaatgataatgcacaacattctagcaacaatataatttacccgcgatgagcccaagacttgatcacttgatatgatttctttctatggaagtaaatcgtttgtggcatttgttatatacgcacagatttaccatgttcttgatganaaagccatccattatt

SEQ ID NO: 3070 - DNA, 278 bp, Zea mays
  misc_feature: Incyte ID No: 700610809H1
gataggggaagtaattatatgaagctgctcaaagctttctgtttatattgtttcaagttcaaagacttattgaaccaatcctatcatacttccagcaatacttgcagctcacatgtaaagagtagcctggcaccccatcaaatgagctatgatttgagtttctgaaatatgggatgcctacacctgaatacagaatcagcccctgttgtaagatgtctgaaacatgaaggatgtgaacgttttttcggggctgaaaccttgaataatgtgagtcgcgt

SEQ ID NO: 3071 - DNA, 276 bp, Zea mays
  misc_feature: Incyte ID No: 700610810H1
  unsure 177: a, t, c, g, or other
atcatacatcatattgcatcaatggcacaataaggggatacaatgttgaccttcggagaatgcttcgaaaaagtaaaattgtgctaaggcacaaaataagttttgaagaaatacaactttatcagctctgatgtggagaaaaaaatctattgttgatgaagcattaatgttttggcnacgcttggaggattttttatgaagcactctgatatggaggaaaaaactcattgttgacgaagcataatgttttggcgacgcttggaggattttttacga

SEQ ID NO: 3072 - DNA, 273 bp, Zea mays
  misc_feature: Incyte ID No: 700610811H1
  unsure 64, 112, 114, 206, 210, 230, 243, 245, 259, 266-267: a, t, c, g, or other
tatctagcccggtcgaaggatggtgatgacagattggtcatacagactacagaggtatgcaggntgtttgatcggaacggtttgatcgcttgcgtggttaccacatgagatnanaccgttccgatcaaactctagcccggtcgaaggatggtgatgacagattggtcatacagactacagaggtatgcagggagttgtataatttntttnttgggttggcgaagagatcngccaacatgtaancnaagctccaatcaanggaagtnnaccata

SEQ ID NO: 3073 - DNA, 276 bp, Zea mays
  misc_feature: Incyte ID No: 700610812H1
  unsure 6, 42, 211, 215: a, t, c, g, or other
aacttnatggtactgagagggcacaagaatgctattcttgancttcagtggactactgatgggacccagatcatctctgcaagttcctgacaagactgtgagggtctgggacgttgagactggtaaacaagttaagaagatggctgagcactcatcattcgtcaactcatgctgcccagcacggaagtggccacctcttgtggttagcggntcanatgatggtacagcaaagctgtgggacttgcgtcagagaggtgcaatacaaactcttcccga

SEQ ID NO: 3074 - DNA, 156 bp, Zea mays
  misc_feature: Incyte ID No: 700610814H1
  unsure 11, 19, 22, 38, 97, 100, 104, 110, 115, 132-133, 148: a, t, c, g, or other
gtgatgttgcntatgcggnatngcgatggagcctccangtgttatgggatttgtcaatcttggaaaatgccagatgctggctgcatcaggactgttncangaantctgantggcnagatattcaatgataanncactgtatgtgggangagcacag

SEQ ID NO: 3075 - DNA, 276 bp, Zea mays
  misc_feature: Incyte ID No: 700610815H1
  unsure 2, 7, 16, 18, 22, 26, 29-30, 49-50, 62, 79, 94, 97, 100, 114, 116, 132,: a, t, c, g, or other
cncgaantttacaacncnagantaanggnngaatcccttctggtgtcanncatttctaaggnaagtgctcatcagaganctggtcgtgctggangancanaacccgggaagtgntntaggctatacacgganangagttttaatgaggatttgcaaccanagacatacccagaaattcttcggtcgaacctggnaaatacagttcttaccttgaagaaacttggaattgatgatttagtgcatttgactttatggatcctccagcaccagaaactc

SEQ ID NO: 3076 - DNA, 281 bp, Zea mays
  misc_feature: Incyte ID No: 700610818H1
  unsure 3, 37, 68, 75, 81, 125, 146, 151, 153, 170, 179, 182, 186, 230-231, 234,: a, t, c, g, or other
gtnagcatctgaacaatgagcttcatagtgattctgnaatgctgaaatctgtaatgaagtcctcttcngtgggantcccgnggaagctcagattcagtttctcctctgcccagggagagttggancaacaagtccttcaagggaantgcanangctccccgtagtttaanaatgacaanganactncgtgatttttacaaaaccccaaaggttgatcctgaattgctcannganattgancagtggancgangcacttaannatgatgtgatcnatntngc

SEQ ID NO: 3077 - DNA, 272 bp, Zea mays
  misc_feature: Incyte ID No: 700610823H1
  unsure 263: a, t, c, g, or other
gaaaataatcttatggcttctgaatccttgaaattaattatgaactatgaaccttcatgcattatcaaggctagagaataatatccaagggccagtgaaattttattttcttatctattgtttccatttcagctactaaaaaaattctaatgtgagaggataaggccatctggtaggcagcagaccaattggccgatcagattttaaatggactgtaaacagggatatgttttatacttattgatcaataaaaatgaaatccnccttctgac

SEQ ID NO: 3078 - DNA, 274 bp, Zea mays
  misc_feature: Incyte ID No: 700610824H1
  unsure 153: a, t, c, g, or other
atcgggaggatcaaacaccgcaatcttgttccgctccttggctactgcaagtgtggcgaggagcggctgttggtttatgattacatgaggtttggcagcttggaagacgtgttgcatgaccgaaaaaagatcgggatcaagctaaattgggcngcaaggaaaaagatcgccattggggctgcaaggggattggcatacctccaccacaactgtataccgcacatcatacaccgagacatgaagtcaagcaatgtgcttatcgatgagcattaga

SEQ ID NO: 3079 - DNA, 149 bp, Zea mays
  misc_feature: Incyte ID No: 700610825H1
  unsure 34, 36-37, 127, 142: a, t, c, g, or other
catgctgggacaacatatattcggtgatggaganannctccaagtacacacccgatgtaaataaatgttgtcccagcatgaggaaagaagggagccctttatttacatcgggtgtgtacttggaganctctccatcaccagntatatgt

SEQ ID NO: 3080 - DNA, 276 bp, Zea mays
  misc_feature: Incyte ID No: 700610831H1
  unsure 7: a, t, c, g, or other
ggcaganatttattcatgccaagtatgctgagaaggatttcgtgcggaaacataacatggatgggattcaacttgcagaacagatgtgggacaatgtaagttcgaacaacaagaagggggtgtacagcttgatcgtggggtcaaatgccgacgtaaatttttcctatggtcatacatcattcaattcggctttgactctgggaaaagctctcctcctacaagagcaatcagcctctccatctaacggaagctctagatgttttgaccgcaatccac

SEQ ID NO: 3081 - DNA, 275 bp, Zea mays
  misc_feature: Incyte ID No: 700610835H1
caagagttgaaaaagaatgtctctgcggcaattacaggacagatgagaaaggacaaggaagacatgtatatccattcagaatgttcagtaagttacaatgctcagagaggctgctccttgatggggggtatggatatgcagacggcaagcaatgatttggtctgtactgttcatggggatgccaagttccacaatctgccttggaacagtattggaggtggcattctgttactaagtttggcaacaagtactttgctggggctaattagaagact

SEQ ID NO: 3082 - DNA, 268 bp, Zea mays
  misc_feature: Incyte ID No: 700610838H1
  unsure 23, 145: a, t, c, g, or other
gggcacctcgaagtcaccggtcngcgcacccagctcacgatatgtatccataagctgcgtgcgcgtcccgttcggcctccgcatgcatcgcggcctcggcccccttcgcgcggctctccagggcggtgagccgctcttgcagatnttcggcgagctccttggcaagattgccctccgcccgcgccagttggcctccgcctgcgcacctgctcttggcgacggctcgttggttccctctctccgccgccattggcgccggagtcagcct

SEQ ID NO: 3083 - DNA, 199 bp, Zea mays
  misc_feature: Incyte ID No: 700610840H1
  unsure 6, 86: a, t, c, g, or other
tctcanaatctagtactttcttgaacccgaggctgtgcgctgctcgagcggttcatagcgtcgagaccacgtcagcaataacgcanaattacatagaatctattcccactggggttgtaacattcttcagtgcacctgggtcggccatttccagcttgaaataaacctggttgccctttgaggggttgatgaggatgat

SEQ ID NO: 3084 - DNA, 273 bp, Zea mays
  misc_feature: Incyte ID No: 700610841H1
  unsure 66, 84, 196, 217, 224: a, t, c, g, or other
cttcgcccatttcttcttaggaggctcaagtctgatgtagaaaagggtctacctccgaagaagganaccatacttaaagttggnatgtctcagatgcaaaagcagtactatcgcgctctgcttcagaaggatttggaggttattaatgccggtggtgaacgcaagcgattgcttaacattgccatgcagctgcgcnagtgctgcaaccatccatatntgttccnaggagctgaacctggcccaccctaacacaactggtgaacatctagttgg

SEQ ID NO: 3085 - DNA, 269 bp, Zea mays
  misc_feature: Incyte ID No: 700610843H1
  unsure 2: a, t, c, g, or other
gnaagagcttagatggcatatttcagacattccgctgaaaggtccagccggcaggtcagggcgcggatgcctgttgaccaagactccaaagatggtgagctagaggttgttgggatggtgaagtttgcttaccaaggtccattcacattgtctggcattaaactatgcccagccactgatggcattgcccaatttaatgaagttggccataccttctccagtgggagttacctgtgcatttgataggtaccttcttgtgctgtaggtgc

SEQ ID NO: 3086 - DNA, 268 bp, Zea mays
  misc_feature: Incyte ID No: 700610844H1
  unsure 2, 194-197: a, t, c, g, or other
anccagcgcgctcgttcctcagatgggaggcggaaatgaagagaaggctcgggtggttcagaccatactgttcgttgctggcataaacaccctgttccagacgttattcgggacgcgccttccggtcgtgatgggcggctcgtacgtcttcgtcgggccgaccatctcgatcgtcttggctggacggtacagcnnnnaagcagaccctcacgaggtaccttctgctgaactgctctgtttccttcaataacgatagaacatactggta

SEQ ID NO: 3087 - DNA, 272 bp, Zea mays
  misc_feature: Incyte ID No: 700610851H1
gtagaggcagagacaatggttggagaaatggtgatggaccaaaatgggatggtggagataattggaacgctacaaatccaccaagtaatcagccttggagtagcagtggaggcaccaagtcatatggtcaaaatcagccttccacttggaataattcagaggataacaaaccatctgtaggtgaacaaggtgatccttgggcaagcaaggtgtctctactgaaggtaaaggacaacagaatgattctggtcaagtaagatgactcttgtggg

SEQ ID NO: 3088 - DNA, 270 bp, Zea mays
  misc_feature: Incyte ID No: 700610855H1
  unsure 7-8, 14, 19-20, 36-37, 39, 43, 46-47, 51-52, 67, 105, 134, 139, 142-143,: a, t, c, g, or other
ttctctnntcaggncaggnnaaccgtttgcgccaanngntagnagnnctgnngaaagatacagggtncaaactgcgagttcttgcacaaaattatcctgatacanctggattggctatcagagatttttggcangctgntgnncgtactattgctttngntgctganccaacctttgttgatttaggcgtccctcggactttttggagtcaggnttcagggnnnatgggctctgatctactggaaanaaaagggcnaggacgcctcnatc

SEQ ID NO: 3089 - DNA, 145 bp, Zea mays
  misc_feature: Incyte ID No: 700610857H1
  unsure 2, 27, 48, 73: a, t, c, g, or other
gnaccaccagattgtctagtgtcttcncctgtaataaatttatctgtnccttggtactttgtctatggttccnattcaaccatagacaaagtaccaagaacagataaatttattacagagaagacactagacaatctggtggttc

SEQ ID NO: 3090 - DNA, 267 bp, Zea mays
  misc_feature: Incyte ID No: 700610858H1
gatcaactttgagatacaagagtgtggaacgcattaaggcagttggcaagcatagcatcattggagcaagcggagagttcagtgacttccaggagattttgcgctatttggatgaactaactctgtctgatcatatgtgggatgatggaaactcgctgggccccaaagagatccacagctatttgacaagagtgatgtacaaccggcgcaacaagtttgatcctctctggaactcacttgtacttggtggggtgaaaaagggtccaa

SEQ ID NO: 3091 - DNA, 267 bp, Zea mays
  misc_feature: Incyte ID No: 700610859H1
gatgtgcctcaattcatttgataaagaagcagatcttgatgtcctgaaccatccaatcctgaacttcctctattacctgctggttgagatagtgccttcggctctggtgctcttcattctacggaaactgcctccaaaacgtgggatcacacaatatcacccaatccattagagagcaggccttggtggataggcaaatgttttctggtggattgtcttatatagcgtggtaaatacagaaggcagagtgaaaagtaccacctttgc

SEQ ID NO: 3092 - DNA, 267 bp, Zea mays
  misc_feature: Incyte ID No: 700610860H1
  unsure 103, 137: a, t, c, g, or other
aagaaccaaggcagaggatcctgcagcaaaaagatttatcatttcctttgctgctgaccgtgttgtcagcctggatgggattgattttgtcaggtgtgaagtngttggacagagtttcatgctccatcagatccggnagatgattggtcttgctgtagctgtgatgaggaactgtgcacctgaatcaatttatgatgtcgccttttcgcaaggatgtcaatcttaatgtgcctactgcacctgaggtcggactgtacctagatgaat

SEQ ID NO: 3093 - DNA, 270 bp, Zea mays
  misc_feature: Incyte ID No: 700610862H1
  unsure 2, 23, 95, 116, 118, 185: a, t, c, g, or other
tngatcctcgtgctccctttctngattctttctccgtaggatcctcttgctaggagtagcctgccccgtgtgcgcgctcgcacggacatgcttgnttccgcgtcttgaaaggcgananaaagtggagatgggcgcttgcgcttcggtacacaaggacccggggcaccccaagaagcagtttcttnactctcccaccaaggcgaaggccgccaacgggaagggtggcgggggcggcggtgttgctccggttggtgatggcttcggtgatct

SEQ ID NO: 3094 - DNA, 271 bp, Zea mays
  misc_feature: Incyte ID No: 700610863H1
  unsure 29, 35, 44, 46, 74, 83, 94, 110, 123, 125, 139, 170, 187, 196, 205, 223,: a, t, c, g, or other
cttcaaccacactgcaacaaggtttatanaaggtntgctatgangnaaaacaaatttatgggctcaaacaaagngtgatagtnaaagtcatttngcttccagcttaagantcaagccaagaananagttatcaactgtnacgccacactcaaaagcttgtttggtgatanggataaggttgggatgntggagatcnctaagcttntgagccgtggcttcccgnaaatctccaagcttntgtngtcnatggagccaggganggctctttggt

SEQ ID NO: 3095 - DNA, 199 bp, Zea mays
  misc_feature: Incyte ID No: 700610867H1
  unsure 62, 161, 166, 173: a, t, c, g, or other
cccaatcagatccgatttcgtagagatgaagccggcagtagaggcggaggctgacgagcgancggcggaggagatggcacctaagaaggcagcggctgccaagaaagcggccgaggaagttgaggtggaggaggtggtggacggggacgaggcggtcgatnggganggcgacngtgacgaggacgacgatggggaaggc

SEQ ID NO: 3096 - DNA, 272 bp, Zea mays
  misc_feature: Incyte ID No: 700610869H1
  unsure 50, 56, 72, 77, 99, 119, 124, 140, 174, 176, 185, 187, 217, 239, 259, 265: a, t, c, g, or other
gtctcacaggcgacatttttagatccgcaagatgcgattgcggtgaccancttgcnatggcaattgagatgnttganaaggccggaagaggcgtaatantttatctccgtggacacganggacngggtatcggtctgggncacaaacttcgtgcttataacttgcaggatgatngncgtgatacngnggaagctagtgaagaacttggtcttcctgnggactcacgagaatatgggatngcgcacagatactactgganctaggngtccgtt

SEQ ID NO: 3097 - DNA, 274 bp, Zea mays
  misc_feature: Incyte ID No: 700610872H1
  unsure 2, 85, 200, 231: a, t, c, g, or other
gngcgaggcgacgccgaggcacctcatctccggcgaagggaaatggcgaccgttccaggggatctgatctggcagattgtgaggnagaacaactccttcctggtgaagcagtttggcaacggcaatgccaaggtgcagttcaccaaggagcccaacaacctctacaatttacacttcctacaagtactctgggtttagcnaacaaggaaacctgtaaacgttccagccacngctggaaaggactcggctgtggtcctctctactaccaagacca

SEQ ID NO: 3098 - DNA, 266 bp, Zea mays
  misc_feature: Incyte ID No: 700610875H1
gtgaccctccctcagccgcgtcgcgtcgcatcctacgatccaaagctctctctgctcgcagccatggcgaagaactacccgaccgtgagcgccgagtacagcgaggctgtggagaaggccaggcgcaagtccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcac

SEQ ID NO: 3099 - DNA, 163 bp, Zea mays
  misc_feature: Incyte ID No: 700610878H1
  unsure 31: a, t, c, g, or other
accgagctgcaagcaccgacaagtagctganatgagacagacagacccctcgctgtaatccctgatttcttctgtcctctcctcacatggtatgccaaccagtttatgaactttgctcggctatataaataagtgcttgaagaggggagcagggttttgggcc

SEQ ID NO: 3100 - DNA, 129 bp, Zea mays
  misc_feature: Incyte ID No: 700610879H1
  unsure 5, 8, 16-17, 25, 62, 69, 96, 98, 107, 111-112, 117, 121: a, t, c, g, or other
tcagntcngggggtanncgtcggancccgttgggcaaatgagctgctgagatcaaagatccncgcaagngagtggcacgtcggctcagtaacattnanctctcccgnagannctgtnagancttaacga

SEQ ID NO: 3101 - DNA, 269 bp, Zea mays
  misc_feature: Incyte ID No: 700610880H1
catatacccaatggaggctgagttctacaaacatgcacaatcaacctcaagatggacaattcatccagaagaagaaaatcttaaagcattggcaaagaaggagggcctatggaacttgtttattccgctagacagtgcagcgagagtagaaagctattgtttgaagaccattctcaaatttcccttggaagttcgaataatcttttgctgggcgcgggtcttacaaatcttgaatatggatatttgtgtgagattatgggacgttcagt

SEQ ID NO: 3102 - DNA, 280 bp, Zea mays
  misc_feature: Incyte ID No: 700610881H1
  unsure 134, 175-176, 202, 208-212, 235-237, 263: a, t, c, g, or other
gttgaaactgatgatatgggaatctttagggattgttaaggagaaccaaaatccatcttcaattctcaacagagcctttgtgaagcatttggttctccttaacaatccctaaagattcccaaaggctctgttgngattgaagatgattttgctactcttgctgataagagtattnntcctggggattttctctgggtcagancctctnnnnnatatgaggaaccgtgacattgcnnntgagatttcagaacaaaaggatgatncggctacaggctgagga

SEQ ID NO: 3103 - DNA, 267 bp, Zea mays
  misc_feature: Incyte ID No: 700610883H1
  unsure 28, 31, 59, 83, 143, 235, 244: a, t, c, g, or other
gttctggaacgggtgtattcccttgtgnagnaaatccttagccaacagactggcctttncttcaacaggcacattgaccagancatactatgcagcatatatggagttgccaagatctctcaactggaactttcattcaaggngattattttcggctacaggaaacaacctcagtgcaagccacaagttttccgaagcgtgtatgttcatggcccccaagaagccgtaacggggnaacaggagnagaccagttgacatctcactttc

SEQ ID NO: 3104 - DNA, 269 bp, Zea mays
  misc_feature: Incyte ID No: 700610884H1
  unsure 219: a, t, c, g, or other
gtggaccccatactgaaaattgggcttctgaacatctccgagatccgatttagagtgtcaatggcaatgtccccaagccaaaggccaaggggagtatttgggttctggtcgtcgttgatgactgcattgggaaacatggagcatatgccggtccgtatagctcaaagataccgggaggaattgtgcatgcggcaaagtgcacttatgaactctgctatntctaacattcaaaaggatcttcttagccaacctcttcagctactttccgg

SEQ ID NO: 3105 - DNA, 258 bp, Zea mays
  misc_feature: Incyte ID No: 700610885H1
  unsure 161: a, t, c, g, or other
tgctttgtaaacagatttaccaagcaaatagatagaacatgaaaagtgcataatgctatttgctttgtaaacagatttaccaaaaaaactcagaagataggcatgagagctataaatattcttggaataaaaggtgaggctgcatgcacttgtttggatcncatggtaggaaacgagttgttgctgctaattttccctaaaataggaaaggtagggaaattcttctggataaattatatggtatgtccaatccgttat

SEQ ID NO: 3106 - DNA, 265 bp, Zea mays
  misc_feature: Incyte ID No: 700610887H1
  unsure 47, 109, 121, 138, 169, 184, 188, 220, 237, 252: a, t, c, g, or other
ttcaaccacactgcaacaaggtttataaaaggtttgctatgaggacnaacaaatttatgggctcaaacaaagtgtgatagtgaaagtcattttgcttccagcttaaganccaagccaaganaacagttatcaactgtnacgccacactcaaaagcttgtttggtgaganggataaggttggggntgcnggagatctctaagctttgagcctggctcccgnaaatctccaagctttgnggtccatggagccangggaggctctttg

SEQ ID NO: 3107 - DNA, 263 bp, Zea mays
  misc_feature: Incyte ID No: 700610889H1
  unsure 22, 38, 110-111, 120, 195: a, t, c, g, or other
tcttgcagctcctgcgtttgangcagatcttcaatggngtctttctcaaggttaacaaggcaactattaacatgctacggagggtggagccatatgttgcgtatggatanncgaacctgnagagtgttagggaattgatctacaaaagaggttatgggaagctgaacaagcagaggattccgcttagcaacaacnatgtcatcgaggagggcctgggaagcataatatcatctgcatcgaggaccttgttcacgagatcatga

SEQ ID NO: 3108 - DNA, 123 bp, Zea mays
  misc_feature: Incyte ID No: 700610893H1
  unsure 6, 14, 19, 21, 30-31, 36, 38, 81, 96, 101: a, t, c, g, or other
aaggcnctgaatcnttacngnctccactgnnatttnanaccagaaaggaggagactctagtttcacttgcgtctagtccgngcttcgacttgtaanagcgngcaggttgaagcgctaggctac

SEQ ID NO: 3109 - DNA, 137 bp, Zea mays
  misc_feature: Incyte ID No: 700610894H1
  unsure 4, 9, 15, 57-58, 65-66, 76-77, 82, 89, 103, 116, 118, 134: a, t, c, g, or other
ggcnttctntgatgncctgttcattatccaacactacgtgttgttacctgtcaagtnngtcgtgnncgttaacgcnngcacntgctganagggtacgcccccntatcaggccttcngncaagactgaagcatgnaac

SEQ ID NO: 3110 - DNA, 267 bp, Zea mays
  misc_feature: Incyte ID No: 700610896H1
  unsure 177, 186, 217, 229, 242, 264: a, t, c, g, or other
agaaaatgttcatgaggatcatgttcgagatattgaggaagactggtgtggcagtataggctcggtagaagaaatgaaagctaagacattaaaaaggcaagaggctgctgctaagcgggaaagggcgatggcatatgctttaacccatcagtggcaggcaagttcaaggaaacaganagcagcaancctccaaggccaaggactcgccggggacganaaccagtggggncgaaactggctcnagaggtggatggccgcgcgccntgg

SEQ ID NO: 3111 - DNA, 278 bp, Zea mays
  misc_feature: Incyte ID No: 700610901H1
ggcaagttcgactaccggactgctgccagggacgccattgccaaggctaatccggtggtgaaggcagacaagctcgacaagatctagggggggttccctacggttgggtatcaggaagattgtaaaccgcggtaactcgtcatgcggaactgctgccttgccccccgcgcctttctcttccatgtttgctgctacaatcttgttgttgggcattgcagtgcacggtgcacacttgtgtagcccgcctcgagaatcctgcctctgcatctggtcagttc

SEQ ID NO: 3112 - DNA, 188 bp, Zea mays
  misc_feature: Incyte ID No: 700610902H1
  unsure 7, 62: a, t, c, g, or other
ggctaantgactttgttgtttccagtgatcaggattttcacttgtattagatgaggtttgangtgattgtaacactgatccatcttccaggttgtgccaaggaaaacatatatccgcgattagtggttattactctgttcagacatgcaatgatgtaagttaataaatattccttctggcttccggtc

SEQ ID NO: 3113 - DNA, 217 bp, Zea mays
  misc_feature: Incyte ID No: 700610903H1
tccttccctacgccaggcacgccaagatgaagctcgtcaggttccttatgaagctgaacaatgagacggtcaccatcgagctcaagaacggcacggttgtacacggcaccatcaccggtgttgacataagcatgaacactcatctgaagacagtgaagcttacactgaaagggaagaaccctgtaacacttgaccacctcagcgtgcgaggaaacaa

SEQ ID NO: 3114 - DNA, 257 bp, Zea mays
  misc_feature: Incyte ID No: 700610905H1
  unsure 4: a, t, c, g, or other
gagnagaagaggaattaaatttctttgaggtcattctgcgagctaggcagaggaaagagattgtccattgggtaccgtcttgaggcagctgagcgtgccataatcaatccaatagacaaagtttcaaggcgaaggtggtcacccaaggatgtttttgttgttatatccgagaaagaatgaggtttatcagatcacagttgacacaaaagcaagctcctgaccagtgaccacacctaatgaagaacaggcagctgcgc

SEQ ID NO: 3115 - DNA, 90 bp, Zea mays
  misc_feature: Incyte ID No: 700610907H1
ttgtacttgtggacaagtgctgtattctacacattgtttgcatacagacgatgtgtggttggtgtcataatttaccactaaacctttggt

SEQ ID NO: 3116 - DNA, 275 bp, Zea mays
  misc_feature: Incyte ID No: 700610908H1
  unsure 2: a, t, c, g, or other
gnaacaagcgactaacatcgcacgggggcgtccagttcagtgcagatgctccaggacaaaccactgttccgcttcaccatccccgagggttcttcgctgcttccatttctcaaacgccaagaaggaatgctttgctctggtcttgtttcctgcctgaaaatatattttgttttttttttcttgcgagcacttgatgataagattttgtcagcttaggaacatgcaccatcaatagaaagtttcattctatactttcatagacatttaattttatg

SEQ ID NO: 3117 - DNA, 273 bp, Zea mays
  misc_feature: Incyte ID No: 700610909H1
gtggataagttcgtgaggagcctggatagtgttgtcgaagtaatagaggatatacctgatgaagtgagtgctaagaagccagcagtcatcagagtaccgaaccgtgtgactgaaagcttcatcacaggcaccattcagcccatcttccaaaaaaacaagtacttaagactagcagtcattttctcttccataagtttaaggccaaaggagacaaacaacaagggacatggacacaactgcttgccttgcgatgttcggtggcctcgagctgaa

SEQ ID NO: 3118 - DNA, 111 bp, Zea mays
  misc_feature: Incyte ID No: 700610911H1
  unsure 4, 78, 93: a, t, c, g, or other
gtgngagtggtgtttcactctgcacttgcgagggttacatcggtttgtaacaaaccctgagtacttgtgtaacccccnacttgttcctgaggnatggaatcagattgcgtc

SEQ ID NO: 3119 - DNA, 270 bp, Zea mays
  misc_feature: Incyte ID No: 700610912H1
  unsure 2, 6, 16, 18, 20, 43, 51, 60-62, 82, 88, 133, 149, 237, 254: a, t, c, g, or other
gntcanattccctggngnantgcatgaagcgcctgatactgcnactggagntatcatctnnnttctccagcagaaggagcancccaanttcaagagaccagggcgatgacctcttctacgagcacacactgancttgactgaatctctntgtggcttccagtttgttctgactcacttggataacaggcagctgctgatcaaatcgaaccctggcgaagttgtgaagcctgattctntcagggcaatcaacgangaaggcatgcccatgt

SEQ ID NO: 3120 - DNA, 268 bp, Zea mays
  misc_feature: Incyte ID No: 700610914H1
  unsure 8, 77, 100, 122, 169, 223, 227, 249, 259, 262: a, t, c, g, or other
caggtttntcagttgctgatggcctttctaatctgctaaagtgccgtctttcaaccaccatccgctgcctttctcanccaagcgcgcacgtgcgccgctncagcatgtccgtcctccgtganatcctgaaccacggatccgtgagccccaacaagatcagccgaggggnacagcagcggaatggcatccagagcccatcgtaccggtgcgtggccgcaggatnctcnactggcaagcggacgtggagangtgcatagantgngaagcc

SEQ ID NO: 3121 - DNA, 266 bp, Zea mays
  misc_feature: Incyte ID No: 700610915H1
tttgaaacgctttgctgttcactacgatggttatggccgcccaaatggcactgcagaggtggtgtttacacggaggagcgatgcaattgctgcactgaagcgttataataatgttctacttgatggaaaagctatgaagatagaagtcatcggaaatgacttaggattgcctatgacacctcgtataaatgttgttggggctctaatggcagagctacaagaacagttgttatgacgcctgagtttagtcaacgtggcagaggttc

SEQ ID NO: 3122 - DNA, 177 bp, Zea mays
  misc_feature: Incyte ID No: 700610917H1
gagaagtaccatctcatagactcaaaaaatggtcagatccaaattgagttgcagtggagaacttcctagacagaaagaacacgaatacctgaatgtggtatacatatgaatattcttgtgctgagtttgcggatacctgtaattgagctcatgtagatattccctttgtttcaagac

SEQ ID NO: 3123 - DNA, 267 bp, Zea mays
  misc_feature: Incyte ID No: 700610920H1
  unsure 7, 25, 47, 53, 96, 149, 168, 204: a, t, c, g, or other
tcagatnccctggcgaagtgcgtgnagcgcctgatactgccactggngatatnatctttgttctccagcagaaggagcatcccaagttcaagaganagggcgatgacctcttctacgagcacacactgaccttgactgaatctctgtgnggcttccagtttgttctgnctcacttggataacaggcagctgctgatcaaatcgnaccctggcgaagttgtgaagcctgattcttcaaggcaatcaacgatgaaggcatgcccatgta

SEQ ID NO: 3124 - DNA, 56 bp, Zea mays
  misc_feature: Incyte ID No: 700610922H1
  unsure 15, 28, 40, 43, 47: a, t, c, g, or other
ttcctttggcttcangataggcctaatnagacaacaaatnatnccanttcatatat

SEQ ID NO: 3125 - DNA, 271 bp, Zea mays
  misc_feature: Incyte ID No: 700610923H1
  unsure 2: a, t, c, g, or other
gngctttgccactaaaagaagatcatgaagaatcaatgactgtctatggttgcgtctgcggtttattattatcatcacatccccagatcctccctctggtgcctgacgtcatacatgtctttgcccaagtggtggtatccccagatgagagcgatgaagtgaaaacaaatattggcaaggctatttctcacttgatatctgtctatggccagcaaatgcagccaatactgagtgcccttccaccagcccatgcaaacgcgctggcttcatt

SEQ ID NO: 3126 - DNA, 273 bp, Zea mays
  misc_feature: Incyte ID No: 700610924H1
caaggacgatgatgctttcgttcttcctgagagtagtaaggaggagtacgcatcaacatcaggagacacagctccgtctggcaaaatggacccgaggatggaaaggtctggaagcaatgggacaagcaaggtccctagactgggttccatgcttgggacagccagcatggctggatttggcaaggcagtggagattctagacacgttaggctgcttgatgacgaccttgagctcagatggtggctttgtttccaggaccaagaccaaaggatg

SEQ ID NO: 3127 - DNA, 267 bp, Zea mays
  misc_feature: Incyte ID No: 700610925H1
tgctggtgtgcttcggttggttttccatgatgcagggacttttgaaattggggacggatcaggtggcatgaatggctctataatttttgaagttgacaggcctgaaaacattggcctaaatagatccataaagatactaagaaaagcaaaagaaggaatcgacaacgttcagaaagtgtcgtgggcggatctgattgccgtggctggcgctgaggcagttgcgctctgtggcgggcctgagattccagtaaggctaggaagagtaga

SEQ ID NO: 3128 - DNA, 198 bp, Zea mays
  misc_feature: Incyte ID No: 700610926H1
gggctaactgaaagagctgtctttggttggcttaacttgtagtacgaccgtatttattaattactagaagacgtttatagagcttacgatgtacggcgaggtgatgacatggtggcatagcgtagtgtaatttttttttggcgttcgtctcggccaaaacatagcatacatagtccttgtttgacattgtgaaccatc

SEQ ID NO: 3129 - DNA, 267 bp, Zea mays
  misc_feature: Incyte ID No: 700610929H1
  unsure 22, 43-44, 48, 56, 74-75, 80, 85, 146, 161, 166, 175-176, 181, 207, 216,: a, t, c, g, or other
cgccagagcctcctgttgtganacttgatgatctcttcaggannacanagtcctcnccaaggatctactatacnnccttnattcngaagaggaggtggcagccaagctcgccacacagggcaaaggacaaaaggagtaggaggtgntggcttccattttcngctanctcggagtnngttgnggaacatggcgtgcggtggtcacagnatcagacangtgctactgctgcngaccattgcaatanccggcggccgtgactgccgcggc

SEQ ID NO: 3130 - DNA, 260 bp, Zea mays
  misc_feature: Incyte ID No: 700610931H1
gggggaagagcttcaagattggttcactgcagatgttcatggagaacaatggaagcactgaagatatgggtcctcgaccttttcctgtcaaggaggttcacaaaatagcagtactagatattaggttagctaatgctgatcgtcatgctgggaatattctagtgtgcaaggagggagaaggtggcaactacaagctgattccaattgatcatggttatgctgccagagaagtttgaagatgttacattgagtggctctac

SEQ ID NO: 3131 - DNA, 273 bp, Zea mays
  misc_feature: Incyte ID No: 700610933H1
  unsure 2, 123, 258: a, t, c, g, or other
gnatgctccaaatttctatccatttcttgtgtcactttgggtaaatgattcctttgagagaaaagacatggaaagagagttgttggctaaacttctcgtcagcctttgcagtggtcgacatantttgttgagcaagcaacaactcagtgatggcctttcaaatgttcttgcctcattagaagataatctaagtgatgctccaagagccactgagtaccttggacgacttcttgcaaggtttgtggaggaaagcatatngctcttgcaagaggt

SEQ ID NO: 3132 - DNA, 266 bp, Zea mays
  misc_feature: Incyte ID No: 700610936H1
  unsure 20: a, t, c, g, or other
gatcacattccctggcgaantgatgaagcgcctgatactgccactggagatatcatctttgttctccagcagaaggagcatcccaagttcaagagaaagggcgatgacctcttctacgagcacacactgaccttgactgaatctctgtgtggcttccagtttgttctgactcacttggataacaggcagctgctgatcaaatcgaaccctggcgaattgtgaagcctgattctttcaaggcaatcaacgatgaaggcatgcccatg

SEQ ID NO: 3133 - DNA, 267 bp, Zea mays
  misc_feature: Incyte ID No: 700610937H1
caggcatctccagttgaacaagcagaagactgagggcaaagatgtggattccagaactgtacggcgaaaacaacagagggaaaagatctgctgccagaagtttggatgtcaacaattcagcaaagaaggctaacttgggtacttcatctggatcatcagcctatgaggaaatttctggcttttcacaacacacactgcagtcatttacagtggagagattgcgtgcacttctacgacaaatggtcgatcgaccaaaggcaaaaagga

SEQ ID NO: 3134 - DNA, 220 bp, Zea mays
  misc_feature: Incyte ID No: 700610938H1
  unsure 2, 21, 27, 33, 41-42, 44, 46, 58-59, 76, 102, 201, 205, 217, 219: a, t, c, g, or other
tngggagattccagcaatcgnagagtntgtttncctcaagnntnangcaactaagcgnnaatgtatgtttcaagtngcaagcatgctgtgcaattttgatgnagcttagcaatatagaggacggatggttctccttaaataagcttttaggattatttttgtagtggcgctcttgaatttggtgcaatattgatgccatcnttgnaaaaaaaataanang

SEQ ID NO: 3135 - DNA, 270 bp, Zea mays
  misc_feature: Incyte ID No: 700610940H1
  unsure 2, 58: a, t, c, g, or other
cnaaaccaaaggtgcagcagcagccacaactatcaacagtatccatttcaaagccctncggtgaccctcataagaagcgacgctcggcctccttcagcggcacccaagccgccaagcatcgacgactcttacatggcgttcttggaagatatgaaggagctaggggcacttgatgggtaactcaagtagagcaaatgcctgattgcacttagcagcttaattcatggaaacctgggcatggaacctttttttttgcagcgtgagaatcaa

SEQ ID NO: 3136 - DNA, 269 bp, Zea mays
  misc_feature: Incyte ID No: 700610941H1
  unsure 209, 237, 256: a, t, c, g, or other
atctaatgcaattggctatgggccagatggtgtcatgggaccttacagccctggtgcacctgtgagatcgtctgttttcatgcatgcttcacagcaatatgctataccttctcgccctggagtcccatttgcacatccacaggaatcgatgggaccattcgcacagactcaccaacaacaacctgatgctagtctacgctttgcccggncccggtgaggggcccgggcatgcctgcncctgccagtgtggcaacanacacattatcctt

SEQ ID NO: 3137 - DNA, 238 bp, Zea mays
  misc_feature: Incyte ID No: 700610943H1
  unsure 49, 160, 172, 192, 209, 213: a, t, c, g, or other
ttatggcagagtttgacaagattaacgcaaagcttggcattcggaaagnggatcttcctaagatcgagaaagaacttgaattggagattgccaaaagtgagctgactgaacttaagaaggaatgtgttgaggcaatggagactcaactcaagagggagangtttcggatgtnccagtttcctgacatcaggncatctcctcatcttggnactnctccctcttgagttgagtctccatg

SEQ ID NO: 3138 - DNA, 253 bp, Zea mays
  misc_feature: Incyte ID No: 700610946H1
  unsure 4, 8, 20-21, 34, 53, 62, 69, 135, 212, 233: a, t, c, g, or other
cgcnaggnccttgcggaatnngtgtccgttctgncttcagttcagcctgcctnattcacaangctgganccccatcgaattctgtttctggcgtgatggctgttcaggttcaccgccaccgtaacaaggtccgcnatggccaagctatcaggtgtgcaatggcaactggaaaagagcagggtgcaatttccactgccagtagcggtgatcanaccaagggcggtttgcgtggnaaattaaacaaagttgtttt

SEQ ID NO: 3139 - DNA, 264 bp, Zea mays
  misc_feature: Incyte ID No: 700610952H1
gcctctgagctcgccaccaccgctcccgacgcccctcgcctctactctgttctgctcagcactacctctgaaaccgggcgatgcaaccactctagaagtgctatacatgctcactcactctttagagcccttccccgctgagattagccagtcagagtcccagttggtttactaccgtgacagtgcggtgcttctctcgccctaccatgtcctggagcaggttacctacatcaaaatgccaagcaataggatcgaatccttcac

SEQ ID NO: 3140 - DNA, 266 bp, Zea mays
  misc_feature: Incyte ID No: 700610955H1
  unsure 31: a, t, c, g, or other
gggcgagagaaaaatatctgtactcattggnattacagtaatcttcatgattcatgtgtttggcgtatattggtggtacaggaatgatgatcttctcagacctttgttcatgcttcctccaaaagatataccaccattctggcatgcgatttttgtcatcatggtcaacgatacaatggttcgccaagctgcaatggctgtcaagtgcatgctgcttctgtactacaagaactgcagaggtcgtaactaccgtagacagggccaaa

SEQ ID NO: 3141 - DNA, 266 bp, Zea mays
  misc_feature: Incyte ID No: 700610956H1
  unsure 2, 23: a, t, c, g, or other
gnagtatcgctgaaattggtggngggtgataaagcatcaagaaactggtggcggaagttggagcttgtccgtgtgctcttgtctgaatatgttcaagatcagagtcacttggaggctcttacatattctgctatatatctaaagtggatatatactggtcaaataccatgctttgaggatggtggtcaccatcgacccaataaacatgctgagatatctaggcaaatttttggtgaaattgaaaggatatactatggaaaaaacac

SEQ ID NO: 3142 - DNA, 261 bp, Zea mays
  misc_feature: Incyte ID No: 700610957H1
gcttcgatccggactagctgcccctgccttaaatacaagtatgttgcttagttggatcatcttgatacaagtactgtgtgttgaagggcgggcctggtgcagcggtagagcctaccgtttgtaactggaaggtcccgggttcgagccccagcctctgcatattatgcgggtaaggcttggcgtttaaagatacccttccccagataccgcacagtgcgggaagcctacggcactgggtacgcccttagttagcacaaggta

SEQ ID NO: 3143 - DNA, 263 bp, Zea mays
  misc_feature: Incyte ID No: 700610958H1
  unsure 216, 246: a, t, c, g, or other
cgatttgtccttgttgagaactgaaaccgatgctgtgtgggaaaggttaacgcaggcaaatggtgatggagtttttgttgattgtaactttgtgcctacagattctaagattcaatcagtactgccactgacgaaaactgaaagaaagaaaaggataaaagagaagatggatctgaagaagaaagagaaggatagtaacaaggacaaagatgatgnggataccaaggataaagatgatgggaaagnagaggatagtaacgagg

SEQ ID NO: 3144 - DNA, 261 bp, Zea mays
  misc_feature: Incyte ID No: 700610960H1
  unsure 20-21, 25, 28-29, 52, 56-57, 62, 72, 78, 80, 88, 107, 114, 146, 155,: a, t, c, g, or other
gtctcacaggcgacattttnngatncgnnagatgcgattgcggtgaccagcntgcnntggcnattgagatgnttgagnangccggaanaggcgtaatagtttatctncgtgganacgaaggacggggtatcggtctgggccacaancttcgtgcntataactnncnggatgatnggcgtgatactgtngaagcnantgaagaacttgntcancctgtcnacncacgngaatctctgattggncgcacagatcntacgggac

SEQ ID NO: 3145 - DNA, 260 bp, Zea mays
  misc_feature: Incyte ID No: 700610963H1
  unsure 3, 72, 76-78, 82, 89, 102, 110, 113-114, 119, 123, 128-129, 155, 172, 211,: a, t, c, g, or other
ctnggctaccgccgccgccctacgccaggtgccgaggcctctctgtctcttcgccggcgacgatccaatagncagnnncagnaggaggncaccatgaagctngacgtgantgnncttcnctanctcgnnaaggacgacttccgcgtccttaccgncgtcgagatgggcatgngcaaccacgagattgttccagcagaacttgtcgacaggntcgccacactgaagcatggaggcacatncanagtgctgaggatcttttc

SEQ ID NO: 3146 - DNA, 261 bp, Zea mays
  misc_feature: Incyte ID No: 700610964H1
ggaaccttccgtactcgtcgagtgagatcattagaaggctggagctgcttgacgaagaggatgtggttggctgcggggtcttcggcacggtgtacagaatggtgatggacgatggcacgtcgttcgccgtcaagaggattgatctcagccgccaaagccgcgacaggaccatggagaaggagctcgagttcctgggcagcatcaggcacataaatcttgtcactttgcgaggctactgccggctgctccctgcagcaaagc

SEQ ID NO: 3147 - DNA, 270 bp, Zea mays
  misc_feature: Incyte ID No: 700610965H1
  unsure 2, 4, 156, 179, 195, 201, 206, 220, 238, 244: a, t, c, g, or other
gnanaaccgcatcctctcatcagcttccttccacattcgtctcgagatctcgccccgtacgccatggacgcgatcgacagcgtggtggatcccctccgcgacttcgccaaggacagcgtccgcctcgtcaagcgctgccacaagcccgaccgcaangagttcaccaaggtggcggcgcngacggcgatcgggttntcgtcnagggnttcgtcggttcttncgttaagctcatcttcancccccntcaacaacattcatcgtcgggtccgg

SEQ ID NO: 3148 - DNA, 262 bp, Zea mays
  misc_feature: Incyte ID No: 700610966H1
  unsure 66, 180, 228: a, t, c, g, or other
ccagcacgaacagcattgcttcgatctttgcatggacaagaggacttgcccacagggcaaagctcnacgacaacgctagactactcgacttcgctctcaaactcgaggctgcttgcgttgagaccgtggagtccgggaagatgactaaagatctggcgattcttgtccatggatctccancgtcacgagaagccattacctgaacaccgaggagttcatcgacgcatnccttactgagctccgatcaagactgggagccaat

SEQ ID NO: 3149 - DNA, 261 bp, Zea mays
  misc_feature: Incyte ID No: 700610971H1
tcggaggtgtaggagttggtgaacacccatgatctgtagatgtcgcagttggaagggtccaggaagatttatgcacagggagatgattatcacgagtacttcaagcgctcatttgaggaagacatcgctgcgcaagtgcctcaaggagtggaatggggtacaactattgattgggggaaatcaggcagaggagggcatgttgacggaccaagtggcgaggcaaaattttctaatgattttgaagttcattatattggcagt

SEQ ID NO: 3150 - DNA, 263 bp, Zea mays
  misc_feature: Incyte ID No: 700610972H1
gttattggtaaggagattgagaagtctacctccagcatcttcccacttcaaaacgtcttcatccgcaaggtgaagatactcaaggcccccaagttcgatcttgggaagctcatggaggttcatggcgactacaaagaggatgttggtgtgaagcttgagaggcctgtcgagggagatgaggctgtgcaggaggttgctgctgccgagtagtttgtttgctacttctatatctaggctgagtctggacatgaggttgcttatga

SEQ ID NO: 3151 - DNA, 261 bp, Zea mays
  misc_feature: Incyte ID No: 700610974H1
gtttatggagctgtcagaattacatgatggctttattgttcaggattctcttaccatcaaagcccaagttcaagtcattagggagaagatagaccgtccatttcgttgccttgatggtcagtaccgaagggaactaattagggtgtatctatcaaatgtggaacaaatttatcggtgttttattgatgaaaaagaaggacgttcagcaggctgattgaggataaactcgggtggtccagtttcagtggattctggctagcc

SEQ ID NO: 3152 - DNA, 259 bp, Zea mays
  misc_feature: Incyte ID No: 700610976H1
  unsure 2, 19, 39, 46, 58, 64, 81, 97, 125, 206, 212, 227: a, t, c, g, or other
gnctcggcggcggcggaanaagccgggaacctaccgcanagggcgncaccgatgctanagccanagacgtcgtggacagcntccctccctctccttntcatccgccgctgctcgagaaccgcggncagtccatatcctgccggtgaccggccgctctcctttgtcccggtctgcaagcggcggatgagcaggctggcgcatcccangtttgnccctctccctacggngcaaactgaatcccaaacagatggcggggctg

SEQ ID NO: 3153 - DNA, 258 bp, Zea mays
  misc_feature: Incyte ID No: 700610979H1
gggaggaggtgagccaccggaagcggagacgtgagcactcgaccaaccccgtacgatccggctgcggcgcggcgtgctagatcgctaccgaccatggtggtggaggagatcgccgagggggtgaagaacctaaccgtcaccggagatgcggcggcttcaggcggagaggggcagaggaggggcggcggcggcagcagcaaccgcatccaggtgtccaacaccaagaaacccctcttcttctacgtcaacctcgccaag

SEQ ID NO: 3154 - DNA, 265 bp, Zea mays
  misc_feature: Incyte ID No: 700610981H1
  unsure 140-141, 200, 252, 261, 264: a, t, c, g, or other
ttcgcccatttcttcttaggaggctcaagtctgatgtagaaaagggtctacctccgaagaaggaaaccatacttaaagttggaatgtctcagatgcaaaagcagtactatcgcgctctgcttcagaaggatttggaggtnnttaatgccggtggtgaacgcaagcgattgcttaacattgccatgcagctgcgcaagtgntgccaaccatccatatttgttccaaggagctgaacctggcccaccctacacnatggtgaancanc

SEQ ID NO: 3155 - DNA, 261 bp, Zea mays
  misc_feature: Incyte ID No: 700610983H1
  unsure 10, 56, 249: a, t, c, g, or other
gaagcaaganaactagaaaaggctcctcccgaccgcaacgcccctacatctccctncgaccccgacatccccgacccgatggcgcccaaggcggagaagaagccagcggagaagaagccggcggccgaggagaaggcggagaagacgaccgcaggaagaagcccaaggccgagaagcggctgcccgcgtccaagtcctccggcaaggagggcggcgagaagaaggggaagaagaaggccaagaagagcntggagacctaca

SEQ ID NO: 3156 - DNA, 250 bp, Zea mays
  misc_feature: Incyte ID No: 700610984H1
  unsure 2, 8, 17, 33, 35, 42, 51, 65, 81, 83, 88, 120, 148, 168, 177, 197-200,: a, t, c, g, or other
angcatgncgctcagcnctgcgtgcttgccgangnctgcgancagcctgantatgtcaagctggngaaggctctctgcgcngngcacnatgtccacctggttactgtgcctagcgccaanactcttggagagtgggctgggctttgcnagatcgactctgagggcaangcgaggaangttgtaggctgctcctgtgnnnntgtcaaggactacggcgnngaatctgnaggcnntancanagtgcangcnt

SEQ ID NO: 3157 - DNA, 259 bp, Zea mays
  misc_feature: Incyte ID No: 700610985H1
caaaaatgcaacttggtgtccaagttcttgtaactgatccaagggaacttgagaagattcgtccagagagaatctgacataacaaaggagcgaattgagaaaattctcaaggctggagctaatgttgtgttgaccaccaagggaattgacgatatgtccttgaagtactttgttgaggctggtgcgattgcagtaaggcgtgtgcgcaaggaagattgcgacatgttgccaaagccactggtgcaactatggtgtctac

SEQ ID NO: 3158 - DNA, 261 bp, Zea mays
  misc_feature: Incyte ID No: 700610988H1
gttaaatataggatggtgcccttaaagctattggtatcgacaactcaacaatcaaacatattccaaggtttaacaccacttctgaactctcaggggacgctttaatctgttacaacttgaggacgtcaaacatcctactgacagagagctaccgagccaaagtgtgctgttctgaactgtcaaaaagtggtaatatcgtgctattaaagggaacagggggctacattgatccagagtacttggagacctcagagctcactg

SEQ ID NO: 3159 - DNA, 257 bp, Zea mays
  misc_feature: Incyte ID No: 700610992H1
gctgaaacatatgtttccttacaaatgtacaagcaagctgccttttgttatgaggagctaatattatcccaaccaactattaccactctatcatatagcctatgctgaggttctgtacactatgggtggcttggaaaatcttcagacagctaagaagtactatgcatcaacaatccagttgactggaggcaagaatacaagagccctctttggtgtatgtctgtgtacttcggcaatcaatcagttgaccaaaggaa

SEQ ID NO: 3160 - DNA, 177 bp, Zea mays
  misc_feature: Incyte ID No: 700610993H1
aaaggcacttaatctttaccgtctccactgagatttcagaccagaaaggagtagactctagtttcaattgcgtatagaaagagattcgtcttgtaagagcgagcaggttgaagcgcttaggctacttcagctatatgcttaacacatgcaaatctaacgaatgctacctggacgact

SEQ ID NO: 3161 - DNA, 248 bp, Zea mays
  misc_feature: Incyte ID No: 700610994H1
  unsure 8, 54: a, t, c, g, or other
cgcgaggnccttgcggaattagtgtccgttctgacttcagttcagcctgccttnttcacaaggctggagccccatcgaattctgtttctggcgtgatggctgttcaggttcaccgccaccgtaacaaggtccgcaatggccaagctatcaggtgtgcaatggcaactggaaaagagcagggtgcaatttccactgccagtagcggtgatcaaaccaagggcggtttgcgtggaaaattaaacaaagtt

SEQ ID NO: 3162 - DNA, 260 bp, Zea mays
  misc_feature: Incyte ID No: 700610995H1
  unsure 3, 204, 244: a, t, c, g, or other
ganaatgttcatgaggatcatgttcgagatattgaggaagactggtgtggcagtataggctcggtagaagaaatgaaagctaagacattaaaaaggcaagaggctgctgctaagcgggaaagggcgatggcatatgctttaacccatcagtggcaggcaagtttcaaggaaacagaaagcagcaagcctaccaagggccaaggnactcgccggggacgagaaccagtggggacgaaactggctncgagaggtggatggcc

SEQ ID NO: 3163 - DNA, 255 bp, Zea mays
  misc_feature: Incyte ID No: 700610996H1
ggagcttcggcgcccctggtggtaatcctgggtttggtggtgatgctgaagagagctttggtggccctagtagttctggctttagtggcaccgcctatggtggggcatatgatcctacgctaggtggttatggatctgctagcacacctacatgaataggggaagcttcactggaggatatggacgatatcacccatatggataacaagaagagccctgaaggctaacacttgcatgcacgtttgctgcccgtca

SEQ ID NO: 3164 - DNA, 81 bp, Zea mays
  misc_feature: Incyte ID No: 700611001H1
gcagcagcagcaggtgtattgtgccgggtatgtaatggtattgcaactattattgggtgtaaaacccataaataaatgtgg

SEQ ID NO: 3165 - DNA, 265 bp, Zea mays
  misc_feature: Incyte ID No: 700611002H1
aacagcgacggcaacagcaggatttcattgacaagtacaacttcgatcctgcaaacgactgccctctcccaggcaggtttgagtgggtgaagctagactgatggattcagagggacgagagagcagcaggcatggaatggaactcaccccccgctccctccacaccaccccagcgttgtggcagaggcgcataccgtcgtgttagcttcgtttctgctgtaaaaaaaacccttagtgttttatttagcatgtagccttaatggtc

SEQ ID NO: 3166 - DNA, 264 bp, Zea mays
  misc_feature: Incyte ID No: 700611003H1
aggggcaggaagaaatcgagcctcactcgatccatcgcctcgccgcagcacacacgaggccggcggcgccatggccatgaagctggacatgtccgcgctcgagaccaacttcgccaacctgaccgcctccgccggcgacgacacgtacttctccgccgaggcccccgacgtgccgtccatggtgctccccatctgcgacgacttcgacggcttccaggcggccaccaaggatatggtgaagataagaagggacgaccacgcttg

SEQ ID NO: 3167 - DNA, 283 bp, Zea mays
  misc_feature: Incyte ID No: 700611004H1
gcatttgggaagttgaaacagacaggagaagcatgtaatgtgttccagcatgtattaactcttggtgttaagccaaatgcaacaacatactccctgcttgtcgatgcccatcttgcaaacaaagatccaaaagctgctcttgccataattgatgagatggttgatgctggcttcactccttccaaggataccctcaggaaggttcgaagacggtgctctcgtgagtcagactttgacagtgacgagaaagtccaatccctggctaagcagttcaataccgaat

SEQ ID NO: 3168 - DNA, 285 bp, Zea mays
  misc_feature: Incyte ID No: 700611005H1
  unsure 240: a, t, c, g, or other
agcattagagaagtattatttgttaaataagatactaagatatactaaacaaatgcacactagaatccatagtccgaactggtgagaaagaaacacagggcgacctgaagaacaagaagcatttgttttgtgttgagctaaaacgtacgacaagaacaccatccgacgaaacagagatctcgatgaaacaagaacacattgcccacacatcctatgaatttgcaaagcgaaagtaggaanagcatgctgaaatttgccctggaatttttggagcaaagaagcaga

SEQ ID NO: 3169 - DNA, 284 bp, Zea mays
  misc_feature: Incyte ID No: 700611006H1
cagcatgttttgaggagagacttggaagcatgggaagtagtggcagttggagcattgtctggaggacttgcggcaatagtgaccactccctttgacgtgatgaagactaggatgatgactgcccctccaggcacaccagtgtctatgcagatgataatcttgtccatccttggaaacgagggtccacttgggctctttaagggcgcgatcccccgcttcttctggattgctacctcttggagcaatgaactttgcaggctatgagcttgccaagaaggcaatga

SEQ ID NO: 3170 - DNA, 283 bp, Zea mays
  misc_feature: Incyte ID No: 700611007H1
agacaagtaccacccaactaacctattatctgttatcgaaaggaggaatgaacgttgcaaggttatagcaaaggatttctttcttgatttgcagaatggaactctggacctaggccctggaataactgggggtgcagcaagtaaaccaggtggtagtgatggaaattctgatgatgatacggacaatgacaagagaagaaagcatggcaaagattcctcaaagggaactgattctatttctggtgccctcaaggctcatccagttagttctgaatcacgccga

SEQ ID NO: 3171 - DNA, 81 bp, Zea mays
  misc_feature: Incyte ID No: 700611008H1
aagatctttgattgcttttattgctgcaacatgccaacaaccctctgttggattcgacagaatgtgggtgcctatttctcc

SEQ ID NO: 3172 - DNA, 284 bp, Zea mays
  misc_feature: Incyte ID No: 700611010H1
ggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaagtcaccgt

SEQ ID NO: 3173 - DNA, 282 bp, Zea mays
  misc_feature: Incyte ID No: 700611011H1
ggcagccttcaagtccttagccgtgagcagaatggtactgtaaatactgctgccaaagacatcaccagcaacaatcctgtgagccctgttttgggtcgatcttcttcaatggaacctatgagaaagtctattgtcaacccaaagcttaaggttggtactaatggccgttctttgcatcctctgcaaggttcatttgcagacagaaaagcaagtgcaaaagacaagtacaaattttttgagttgttgcgaagtaagtctgtaaaggttcaagcgctgctatga

SEQ ID NO: 3174 - DNA, 281 bp, Zea mays
  misc_feature: Incyte ID No: 700611015H1
ttagttctggctcaaaaattgcaggcactagccatctcaagcggcacatcacactagggctcctgtcctgttatgaaagaccaagacaggaagctagcattgccacttgcagggggccatgtcactgataatgatggtgagggtactgcagaacgtcctactaagaggcgttacagatacactggttatgcaaatgctacttttgatccacagcggagcacctcttatctgacaaagatgataattttgcatgactacccattcacattgctcaacagtca

SEQ ID NO: 3175 - DNA, 282 bp, Zea mays
  misc_feature: Incyte ID No: 700611018H1
gaaaggttttaataacatttttgcaattggtgacatcacagatattcctgaaatcaaacaagggtacctcgcccagaagcacgcgctgctagtggcgaagaacctgaagctactgaccaagggtctgcctaacagcaaactggcgacttacagcaccggctacccgctggcgctcgtctctcttggaaggaaggaagggctggctcagtttccattgctgacgctcagcgggtgcttgccaggcatgatcaaatccggggatctattcgtcagcaagacgag

SEQ ID NO: 3176 - DNA, 129 bp, Zea mays
  misc_feature: Incyte ID No: 700611027H1
  unsure 26, 49, 52, 63, 90, 98, 102, 116-117, 121: a, t, c, g, or other
cttctcgtaatgcatctgcggctgtnacaaagcctctaataaatccctngantgctgcggcanatgcagctgcagcaagcagttcagganctggtgcnccgncagctataactgcnntgantggtgatg

SEQ ID NO: 3177 - DNA, 278 bp, Zea mays
  misc_feature: Incyte ID No: 700611030H1
  unsure 11: a, t, c, g, or other
gacaagttatngcttgctgcccgtaaggtcagggcgtgccacaaggacttattttgtgatatcactggtctctgatgatttctctcactctagtagcacctacgttggcaaactgaagccaaacttcctcggcacaaagttcacaatcttcgacagccagcctcctcctgacgctgtagtgctaccaaacaataagacaagcaaaaggcagtccaagcaagtatcaccgagactgccgctaggaatttacaatgttgcttacagtcagtacgagctcc

SEQ ID NO: 3178 - DNA, 284 bp, Zea mays
  misc_feature: Incyte ID No: 700611032H1
gctcgtcggcgtggtggtgagaacaaaggccataccaccaggatgtgccatgttaccatccaaaagcaaaaggaaatagccgaagctgcagcacaacaggctcagccgaagcaggtcatgcacactgcttcgtatcattcgccttacatcccagaatatgtaggcaatcaccctgcagtttctgttgcttcggcgagtcaacctcaagcttcctggcaacagcctcctcctccaccaccgctgcaacaaggccagcagccagaagggagccaatatgctccaca

SEQ ID NO: 3179 - DNA, 255 bp, Zea mays
  misc_feature: Incyte ID No: 700611035H1
  unsure 23, 58-59: a, t, c, g, or other
tgaagatgaccattccgataacnctatcttctctgcactgagcacactcttctctgannccgttctcatccgacgatgatgaaagtgttccacactcttacgagaactgaagatagcgtcggacgcaggcttgcaatatggtgaagacgttctgcttctgaggctggcatctttatattgtagcttctgtacatatctctctgaacggtcgccccccataagacaaactatacctctccgttttactgaaaactg

SEQ ID NO: 3180 - DNA, 229 bp, Zea mays
  misc_feature: Incyte ID No: 700611038H1
  unsure 56, 96, 100: a, t, c, g, or other
ctctcttcctagctagacagtatccaccactaagagagtcttgagggattgatggncgcatgcatcttcaattcctgtgtattgtattattacagnttgnacctgtagtaatacaatacacaggaattgaagatgcatgcgtccatcaatccctgtgtattgtattactacaggtacaatctgtaatgttacacactgatgatgaattgatgatggctgatgagcaaac

SEQ ID NO: 3181 - DNA, 214 bp, Zea mays
  misc_feature: Incyte ID No: 700611040H1
  unsure 203-205: a, t, c, g, or other
gccgatcgacccaaccaccgcactccacctacacacaggcacatgttcattgtttttgctgatttcaacatagtactgctcagtggcggatccaggatgagatgcaaggaggggctactagcctactaaaataaagctaaaaatatttagatataactaaatgatctaattaatatagaccaaataagtatgaaaataactannnagttgtgtt

SEQ ID NO: 3182 - DNA, 280 bp, Zea mays
  misc_feature: Incyte ID No: 700611042H1
ggtaaacagtggatagcaggtttatcttaccatgaaggttccaaatttccaaggcgatctcggcagtttgtctggagaggatgtgttggaataagccagacttcatctcaacttgctttacaggttagatatcttgatgcccacatcagatggaaggatttcatccctccagatcatattccctcagatggaaaaagttatgatgctgatttttctgctctcagaaatgctgtagtctgtggataaaaaaataattgataataagataagatacgcactt

SEQ ID NO: 3183 - DNA, 277 bp, Zea mays
  misc_feature: Incyte ID No: 700611043H1
  unsure 4, 7, 19, 35, 43, 53, 65, 91, 146, 153, 168, 191, 207, 219, 233, 254: a, t, c, g, or other
aggnggncatgagcctggntggcgtgaggttccantagaggancctgtggtcnaagatgctgcanaccatgctgtgaaatcgatccaaganaggtccaactccctgtttccctacgaacttctcgagatccttcgtgcccatgcanaggttgnggaagactttgcaanatttgacattctgatgaaactgnagattggcagcaaggnggagaagatcanagcagaggtccatnagagcctggaagggcctttgngctaaaccagcatcagccggcgg

SEQ ID NO: 3184 - DNA, 275 bp, Zea mays
  misc_feature: Incyte ID No: 700611044H1
aattccaggagacgacgaggcgccgatccgtagcggcgccgagggcgatatcgaggagccgctggtctcacgccgcaccgagacaatggcagaccagttagggtcttacacaattagatcccatggaatgatattggcaagattacacatgtatgactggataatacttctcctccttgctgtcatagacgggctgttgaatataattgaaccatttcaccgttttgttggaaaagacatgatgaccgacttgagatatcctatgaagggcaata

SEQ ID NO: 3185 - DNA, 275 bp, Zea mays
  misc_feature: Incyte ID No: 700611045H1
  unsure 19, 21, 35, 39, 43, 49, 56, 70, 84, 92, 94, 96, 122, 141, 184, 198, 214,: a, t, c, g, or other
gatcacattccctggcgancngaatgaagcgcctnatantgcnactggngatatcntcgttgttctccancagaaggagcatcncaagttcnananaaagggcgatgacctcttctacgagnacacactgaccttgactgnatctctgtgtggcttccagtttgttctgactcacttggataanaggcagctgctgancaaatcgaaccctggnganttgtgaagcctgnttctttcaaggcaatcaacgatgnangcagcccatgtatcagagg

SEQ ID NO: 3186 - DNA, 275 bp, Zea mays
  misc_feature: Incyte ID No: 700611047H1
  unsure 7-8, 10-11, 43, 48, 52, 59, 61, 64, 72, 82, 114, 129-130, 173-174, 180,: a, t, c, g, or other
gatgggnngnngcggcgcgaggacaatatggtggagatccgcnagagncgcngtgatgngngcntcctccangaggcgccgngaggggctccaagcccaggtccctgcccctcnctccggggtcgagannaagcttgaaagcctcccagctatggttagtggggtttattcgnntgatantaaccttcagcttgaggcnaccacacagttccgcanattgctctctntngngatgagtctcnccatcgaagaattatcaaaacaggtgtagttcc

SEQ ID NO: 3187 - DNA, 276 bp, Zea mays
  misc_feature: Incyte ID No: 700611048H1
ggaagacgaagaatacctcaaagaggaagaagatgcccttgctggtgcagggggtacacgtttagtttcacagccttcatgcatcaagggaaagatgcgtgattaccagttggctggacttaattggcttatacgattgtatgagaatggtatcaatgggatattagctgatgagatgggtcttgggaaaacacttcaaactatttcatgctgggctatctgcatgagttcagaggtatagctggtcctcacatggttgttgcgccaaagtccatc

SEQ ID NO: 3188 - DNA, 87 bp, Zea mays
  misc_feature: Incyte ID No: 700611049H1
ctatgaacaagctaagctataatagtattttgctatcctatgatccccgggttgttggcttattgttgtcaatatttttttggttgc

SEQ ID NO: 3189 - DNA, 276 bp, Zea mays
  misc_feature: Incyte ID No: 700611050H1
  unsure 42, 66, 69, 85, 88, 105, 235: a, t, c, g, or other
gacaagttcctgacgttcgaattcgaagacgacttccttgtngttacaggtgtccacaagatgagnaangtgatggatattcttnatngtggttccgtttagttncatgacttgtggacacctgtaaagacaagttcctgacgttcgaattcgaagacgacttccttgttgttttgcatcgagaagaagcggatgctgcatcatcggacatctcaaggaacatgccataccgtcnatgacggtcatctgatctatcagaaccatatgcagaagcaa

SEQ ID NO: 3190 - DNA, 277 bp, Zea mays
  misc_feature: Incyte ID No: 700611053H1
  unsure 2, 17, 153, 167, 174, 179, 246: a, t, c, g, or other
cncgcattaagcaaganaaagaacggttgagatctacaaaagttccaggaggtgaatttgctgctgaagttactgcagtatccaaccaacctgtaaaggattcatctacacttgaagccatattaaagaagccacacgtacaatataaactcnttgacgagcatggntgcgganatganaatttatctcgaattgagaaggaatgtgtagagattgatatcaagtatgaaggtttcatcgcacganaacaaagtcaattacatcagatcgtaaacca

SEQ ID NO: 3191 - DNA, 279 bp, Zea mays
  misc_feature: Incyte ID No: 700611056H1
  unsure 223-224: a, t, c, g, or other
gttttgtacaagtggacgctgaggttagagcaatgtcctgtatataaactaaaatccagaagagcgccacagctggttatgctatggccatgcacgctgcactgtcgtgttcattgtttatgtttcgttgttctttcccttgagtatgacgccaccttgatagcccggggtagaattacctgcctatatttatcgtccttgtggtctgcaagaatcatgacgnnattacttaggcacttattcatcttactatctggaagtgatgtgatttgttttggt

SEQ ID NO: 3192 - DNA, 276 bp, Zea mays
  misc_feature: Incyte ID No: 700611057H1
caggtgtctccccattgcagctgaggactgctgccatggctcttctacgtcatggatccactatgccattgaagagatgtgaagagctaatgcagattgtgaagtcatactatggtggtagagatgtgactcctgaagatctcgagatggcattacttgttggtatgagccctcatgagcgaaggcgtcttgaaaagaaaaagggatattcgtttagagctcaggctcaaactattatagaaagagcagcagcaataccatctcagaagacagtgg

SEQ ID NO: 3193 - DNA, 273 bp, Zea mays
  misc_feature: Incyte ID No: 700611058H1
gaagaggcagagacaatggttggagaaatggtgatggaccaaaatgggatggtggagataattggaacgctacaaattccaccaagtaatcagccttggagtagcagtggaggcaccaagtcatatggtcaaaatcagccttccacttggaataattcagaggataacaaaccatctgtaggtgaacaaggtgatcctgggcaagcaaggtgtctctactgaaggtaaaggacaacagaatgattctggtcaataagatgactcttgtggtgc

SEQ ID NO: 3194 - DNA, 134 bp, Zea mays
  misc_feature: Incyte ID No: 700611069H1
tacaatggcgatgatggtatgccctgtaaggctgtaacaccagtagcttggtttgtaattgttcttttcccccggttcgtgttacttcgttgaccttattccggggaaatattttagtgctgtgatgatggtct

SEQ ID NO: 3195 - DNA, 276 bp, Zea mays
  misc_feature: Incyte ID No: 700611071H1
  unsure 7, 9, 17, 25-26, 29, 36, 42, 50-51, 55, 61, 102, 150, 167, 183, 197, 235,: a, t, c, g, or other
ctcgagncnacacgagnaggtgganngtnagaagangagacntaccatannatanattcgnagtcagatactcaatacagtatcctgtaccattaccaccangcgcgcaccaggttaccaaaatctcgtgtggagggaaatggcgcccancagctacgaggtggcgncttccatcctcctctntgccgatgacagcngcattcatcctggacctcgaagcggaggccgatgaggnancgctactggngctgaggnggtgcccgtnggcgnngcagt

SEQ ID NO: 3196 - DNA, 271 bp, Zea mays
  misc_feature: Incyte ID No: 700611078H1
  unsure 8, 11, 17, 31, 35, 38-39, 41, 46, 58, 62, 64, 131, 133, 138, 143, 163, 176,: a, t, c, g, or other
ctgaaatnaanattgtntcatactgcatacnatgncannanacaancaatccttaaanggananatccatccccagtgtgggataagttggtatttaacaaaataaaagctaggcttggtggacgagtgananttatnagttnaggtgcttctccactgtcancagatgtcatggnattcctgnngatatgctttngtggtgaanttctnaaggctatggaatgacggagacatcctgtgatcatatctgcnatggatantggtgacagac

SEQ ID NO: 3197 - DNA, 272 bp, Zea mays
  misc_feature: Incyte ID No: 700611079H1
tattaatgcaggaaacaaggctgttggtatcatgaaagctgggcagacatttacaattgaaccaatgataaatgcaggggtttggaatgatcggctctggcctgatgattggactgcagtcaccacagatggtaaacggagtgctcaatttgaacatacacttttggtgacagacacaggatgcgaagttttgacggcacggttaccctcatcaccagacgtttttccatggttgaaaccgtgatcgggcaccccaacagcaacaagaaagt

SEQ ID NO: 3198 - DNA, 274 bp, Zea mays
  misc_feature: Incyte ID No: 700611080H1
cattagaatatgagaaaagtgaaatcaatgcaggatttttttactcaaacgcagaacaaagagagaaaatggttgctgcagagagacgccaagttgatgaacgtgtcaaacagattattgaattgaaaaataaggtttgtgctggaggcgataaaaactttgtggtgatcaatcagaagggcattgaccctccatctctggacctccttgctagagcggggattattgctcttcgaagagcaaagaggagaatatggagaggcttgtgctaacc

SEQ ID NO: 3199 - DNA, 269 bp, Zea mays
  misc_feature: Incyte ID No: 700611081H1
ggacatgactgcggactcaacctgtttttcattgtcttcacgttgattcttgtttttgggtttgctattgttgctctgcacccaaagatcaatggaagcttgttgcctgcatcagttattggtatgtactgtacatatctgtgctacagtggactctccagtgagccaagggattacgaatgcaatggggcttcacaatcatcaaaagctgtgtcaatggtagccttacattgggactccttaccaggtcctctctgtggtctatctgc

SEQ ID NO: 3200 - DNA, 270 bp, Zea mays
  misc_feature: Incyte ID No: 700611082H1
  unsure 24, 64, 71, 86, 132-133, 207, 263: a, t, c, g, or other
gataacttaattagtgttcatgantatgtcaagccttactttagtggttctaaattgaaaagcnttctagntggtcataatatcancattactgatggtattgacaaaactagtgcaactttgcaatttagnnagttagcagattgcgatttctcaagagaaactttaagcagatgtctaatgttttgtgggtggctcctgaggacnaggcgagtttatggtcacaacttcattatgtttcgtgtaataatctggaaatgcangaagctt

SEQ ID NO: 3201 - DNA, 270 bp, Zea mays
  misc_feature: Incyte ID No: 700611083H1
  unsure 104: a, t, c, g, or other
tgatggccttgttaagggtcttcgtgaggctgccaaagcaattgagaagcatgctgctcagctttgcgtgcttgcggaggactgtgaccagcctgattatgtcnagctggtgaaggctctttgctctgagcacaacgttcacctggttactgtgcctagcgctaaaactcttggtgaatggtctgggctttgcaagattgattctgagggcaaggcgaggaaggttgtgggttgctcctgtgttgtcgtcaaggactatggcgaagaatc

SEQ ID NO: 3202 - DNA, 274 bp, Zea mays
  misc_feature: Incyte ID No: 700611087H1
  unsure 90, 183-184, 188-189, 261-262: a, t, c, g, or other
ctctatttgtttataggaaaaattgagtctgtatatgcatagtcagatgctgccataacatcaggtgtgtaagcatctgactatgcatantcagactctatttgtttataggaaaaattggatatggaactgcaagtgaggctttggcctgcaagctaccattagtgtttgttcgcagagatnnactnncaacgaagagccatttttgcgaaatttgcttgagcactaccaaaacagcattgagatggtcagaagtgattnnccctgctggaca

SEQ ID NO: 3203 - DNA, 272 bp, Zea mays
  misc_feature: Incyte ID No: 700611088H1
  unsure 35: a, t, c, g, or other
aggtgtggagctcctgcattcctgcacgaacaganaagatatctatgttactcaccctgattatattgttgccagagaatgccaaatgagaagctgcgaaacgatttgagcaacattgacatctgggacgaggaccggatagaagcagtgctcgacacattcttggaggacctgaggagcgggcggctggaagaggctgggtggcccgtgatgctaccagcctacagcgtatcgaaaatggtcatcaatctgtacaccaggatcatggcaag

SEQ ID NO: 3204 - DNA, 269 bp, Zea mays
  misc_feature: Incyte ID No: 700611090H1
  unsure 20, 244: a, t, c, g, or other
cccaagccgcgccgcaatanctcgccccctcgttcgccgcctctcctgctcctaccgcagctctccctcaggtttagtgttcgcaatggcggccttcaacaagcttggtggccttctaaggcacagtgctctggtgagcggtatcactggtggctcttctcctgcagtgttcaatgctgcacggctcatgtctaccaagctatttattggtggtcttgactggggtgttgatgacgtgaaatangagaagcattagcagctttggagag

SEQ ID NO: 3205 - DNA, 271 bp, Zea mays
  misc_feature: Incyte ID No: 700611091H1
tgatgggatcaggatggattcgagccttcgggatgttatgcatggcatatgttgttctgaagcaaaatccataatgcaaaatgcttttcttgatgaaatatatggctactactcggtgagaagttccgaatggattaagcactactccttgccagattaccttgctaaggttgaggaaagtatggaaatggaaaccaagaggctggcttactatctggaaatttcaagtggggatagctacccgctctgtttgcaggctgttaatgctcct

SEQ ID NO: 3206 - DNA, 267 bp, Zea mays
  misc_feature: Incyte ID No: 700611092H1
agcattcatggagacaggacacaacaggaaagggagcatgcccttaggtccttcaagagcggagcaactcccatccttgtggcgactgatgttgctgctcgtggtcttgacataccacatgttgcccatgtgattaattttgacctccctaatgatatagatgactatgttcatcggattggaaggactggacgtgctgggaaatctggtcttgcgactgcattcttcaacgagagcaacactacgcttgcaagccgttgagtgatc

SEQ ID NO: 3207 - DNA, 179 bp, Zea mays
  misc_feature: Incyte ID No: 700611093H1
aaaaaaggcacttaatctttaccgtctccactgagatttcagaccagaaaggagtagactctagtttcaattgcgtatagaaagagattcgtcttgtaagagcgagcaggttgaagcgcttaggctacttcagctatatgcttaacacatgcaaatctaacgaatgctcctggacgact

SEQ ID NO: 3208 - DNA, 267 bp, Zea mays
  misc_feature: Incyte ID No: 700611094H1
  unsure 127, 134, 175: a, t, c, g, or other
ccactgcattctcgaattacgattcccaatccagcaaaccctaccagccttttgcaaactcagagagggacccgatggcacccaaggcggagaagaagccggcggcgaagaagcccgcagaggaggngcccgcngccccggcggagaaggcccccgctgggaagaagccgaaggnagaagcggctcccggcgggaaaatccgccggcaaggaaggcggtgttgacaagaagggcggaagaaggccaagaagagcgtggagactacaa

SEQ ID NO: 3209 - DNA, 268 bp, Zea mays
  misc_feature: Incyte ID No: 700611095H1
gcattcatggagacaggacacaacaggaaagggagcatgcccttaggtccttcaagagcggacaactcccatccttgtggcgactgatgttgctgctcgtggtcttgacataccacatgttgcccatgtgattaattttgacctccctaatgatatagatgactatgttcatcggattggaaggactggacgtgctgggaaatctggtcttgcgactgcattcttcaacgagagcaacactacgcttgcaaggccgttgagtgatctc

SEQ ID NO: 3210 - DNA, 267 bp, Zea mays
  misc_feature: Incyte ID No: 700611096H1
gagcttcggcgcccctggtggtaatcctgggtttggtggtgatgctgaagagagctttggtggccctagtagttctggctttagtggcaccgcctatggtggggcatatgatcctacgctaggtggttatggatctgctagcacacctacatgaataggggaagcttcactggaggatatggacgatatcacccatatggataacaagaagagcccttgaaggcttaacattgcagcacgtttgctgccgtcatggagaacacccac

SEQ ID NO: 3211 - DNA, 291 bp, Zea mays
  misc_feature: Incyte ID No: 700611101H1
  unsure 279: a, t, c, g, or other
agtcgactggtaaggggagcaaaaaagattattgtccctaatctcctacctctccttaccagtctcaagccaccagcagagggccataacctcgtggtgaggtctggagcgcgactacgagttacgtagtcgtggtccggcgacgctggggccgagacacttgacaatatataatctgtaattctgtatatcctgctttacttgtgaattcttatatgtggtggcaaggacagatctggtagatctgctactattatctgtgttgactgattgcttggntgcagttgtgtg

SEQ ID NO: 3212 - DNA, 278 bp, Zea mays
  misc_feature: Incyte ID No: 700611105H1
  unsure 153, 165: a, t, c, g, or other
ggtggcgatacacagagaaggagaaagagcttgttctcctgagagctcctgtctgggcaactaaattaaacagggattctattcagtttaaatttaatgctgattttgattcaatttattaacaccaaaataacagctgattctattacaggngagcctcgtggnaaaagaatcagctgttatttttccacgaggctctccttgtaatagaactatagaagtgggctgctgcatctcgttctaatttcgtttctttggaataacaaaaagttcattat

SEQ ID NO: 3213 - DNA, 199 bp, Zea mays
  misc_feature: Incyte ID No: 700611106H1
  unsure 25, 38, 43, 83-84, 175, 183, 197: a, t, c, g, or other
cagcagtatcagtagttgaggctgntgctcacaaaggnctgcnacaatgtattgatactgttatgtctgaggttgaaagattnntgtcttcggaacagaaggctacagattatcgaacaccagatgatggagctgcaccagatcatcgccaactaatgcttgtataagaattgtngcctatcnctctcgtgttcttnag

SEQ ID NO: 3214 - DNA, 287 bp, Zea mays
  misc_feature: Incyte ID No: 700611107H1
  unsure 33, 98, 186: a, t, c, g, or other
caatcaacctcaagatggacaattcatccagangttgattgtgcatgtttgtagaactcagcctccattgggtatatgtgatcttcaaacatgcacangtcaacctcaagatggacaattcatccagaagaagaaaatcttaaagcatggcaaagaaggagggcctatggaacttgtttattcctnctgacagtgcagcgagagctagaaacctattgtttgaagaccattctcaaatttcccttggaagttcgaataatcttttgctgggcgcggtcttacaaatc

SEQ ID NO: 3215 - DNA, 114 bp, Zea mays
  misc_feature: Incyte ID No: 700611108H1
catcatgagattctctatgcaaaggttgttgtttgtttagcaaattggatgccgagtgatttgtgacctgtaccgcatgtttttaagataacaatgttcttcgctcggtggttc

SEQ ID NO: 3216 - DNA, 283 bp, Zea mays
  misc_feature: Incyte ID No: 700611110H1
aaattcagtgcactggagtgagccatgatggcaacattctcatcactggtggtgatgatggagttgttgcagtgtggagatttgtgaaggatggcatccgccgtctcctgagaatggagaaggctttgtgtgctcacacgggcaagtaacttgcgtctctgtcagccaaccttactcattaattgtctcaggctctgatgactgttctgttatcttgtgggacctgacaagcctagtctttgtgaagcagctaccaaggttcccggcatcagtatccgcgcta

SEQ ID NO: 3217 - DNA, 284 bp, Zea mays
  misc_feature: Incyte ID No: 700611111H1
  unsure 12, 114, 180-181, 200-201: a, t, c, g, or other
cattccaggatntgataccccgcgggtcacggttccgcaaagggaaagcctcaaaaggcgacgcgcaagggccgaggagagaaaggaacctgaggaaggcacaccagtttcaancaatccctaggccgtggcgacgtgctgggaaggatcaaatcaggggcgaactaggtgacggcgctnntagtcgcctctagtagctnnccgacgcgggctggcttgtccgatcggtttgcctcggccatgtcgactaagaaagttctttgcaagttcttcatgcatggagc

SEQ ID NO: 3218 - DNA, 160 bp, Zea mays
  misc_feature: Incyte ID No: 700611112H1
  unsure 14, 28, 31, 74, 95, 97, 100, 107, 133, 146, 154, 157: a, t, c, g, or other
caagacattttgcncacccttactagcngcnctaaatgtctttatcttccatcggcagaggtgaaggaagatanagacatttagcgctgctagtnanggntcaaaanaaccttatgcttgcgttgaaatagangctcgggcgatcntgttcatnctntta

SEQ ID NO: 3219 - DNA, 198 bp, Zea mays
  misc_feature: Incyte ID No: 700611113H1
  unsure 34, 45, 73, 149, 162, 196-197: a, t, c, g, or other
gaagcttgttaacaaggataaagacacacttgancacactcaagnagtacacatacgggaagcacatagtagngcgtgtagagaagcttgttgctgctggagagaagcgccttgggcttcaaccagcatgcaccgccgcctgaaggganactctctaagttntacagctaacagttgctaggtttgcctcatgttnnt

SEQ ID NO: 3220 - DNA, 210 bp, Zea mays
  misc_feature: Incyte ID No: 700611115H1
  unsure 2, 6, 19, 32, 35, 37, 39-40, 56, 59, 83-84, 91, 94, 100, 156, 207, 209: a, t, c, g, or other
anagcntctcaagatccgngctgatatagagntgntntnnttccagtttgatggantgntccatattaagcaagctatgaagnnagctgangcngcgggnaatgataactgtcctgtgaagattaagctagttgcaccaccactttagttttgacnacacagacccttgacaaggatcaaggtatttcagttctcactactgcagtnang

SEQ ID NO: 3221 - DNA, 286 bp, Zea mays
  misc_feature: Incyte ID No: 700611117H1
  unsure 230-231: a, t, c, g, or other
atcacttgtcaaaagctgcttccagtcgtcattaattcttcaaaggacagggttcctaacatcaagttcaacgttgcaaaagtactaaagtcacttgtaccgatcctcgatcaatctgtcgtggagaagaccgtgaaaccatgccttgtgagctcagcgaggaccctgacgtcgatgtgaggtactacgcgaaccaggcgctgcaggcgtgcgatcaaatgatggtgtcnngctaactagccgtgtgcccgagtattagagttcgatgcctcatagtccaatttgg

SEQ ID NO: 3222 - DNA, 283 bp, Zea mays
  misc_feature: Incyte ID No: 700611121H1
  unsure 50, 63, 124, 154, 162, 209, 217, 239, 279: a, t, c, g, or other
ttggaagatatccaagcagacagggatgatccaagccagccattggtcantgctccatttggncatgcttcacaggaaattgtgaatttattactctgtggagaggctgttccaaatgtatttnatggcaagatggaccttggtgtggcatgtnccttgaanggcataccaaacaatgttgaagttggttttcttaccctcctggaatnactaaatntctgcaaggttggtcagtactngaagtgcccaaagtggccgatatgggttgtgggaatgaangtca

SEQ ID NO: 3223 - DNA, 286 bp, Zea mays
  misc_feature: Incyte ID No: 700611124H1
  unsure 12, 34, 100, 104, 192-193, 209, 225, 232, 248, 252: a, t, c, g, or other
atcaaggtctgnaaaagaatatctgctgagacanattttcctaacgaggagatcattaaattgtatctaagcgataacaatctggttgaaggtaacaaanagangtatggtccaacacattagagaacaacattatgcttatttaatgcttattgagttgtagtttttttctttggtcaaggttccaaattnngcatttgtttatagtnaaaatctaaatttttnacctgtntgcagaaaagggtgtncccntgcttagttggagtaagcctgatgttgaagcttt

SEQ ID NO: 3224 - DNA, 233 bp, Zea mays
  misc_feature: Incyte ID No: 700611125H1
  unsure 226, 230: a, t, c, g, or other
ggagtgctccggaacccgccgccgcatccgcacgacgccacggctgacgactgggagccccgttcgcctccaccgccacctccccgcgtagaagctttgcagcgagaagccgagaaccctgtcgatctctcctgaagcaatccgctctgtcgtgagctgaaccctacagttcgtatcacctcctctcgcagcagctgcagaaagagcaaggggggatggccaaggncggntgc

SEQ ID NO: 3225 - DNA, 285 bp, Zea mays
  misc_feature: Incyte ID No: 700611130H1
  unsure 31-32, 220-223, 283: a, t, c, g, or other
taaatgacaagattggacttgaaaaagaggnncaactaaagtccagaccagcaaagagtgggaagactatagaacttgatgatgtcacattccaccagtgtgtcaacttaacaagatttaactcagaaaagacagtcagtttcgtgcacctgacggtgaatttgagttgatgaagtatcgaatcacagagggtgtaaaccttccattccgtgttctgccnnnnatcaaggaattgggccgaacacgcatggagatcaacgtgaaagtcaagagtgttttcggngc

SEQ ID NO: 3226 - DNA, 287 bp, Zea mays
  misc_feature: Incyte ID No: 700611134H1
  unsure 7, 14, 24-25, 55, 70, 78, 83, 89, 94, 107, 113, 115-116, 141, 149, 155,: a, t, c, g, or other
agaaganccctgcncaagaaaggnnacaaggaggacgaagcgatgacccccagtncgggcgctccagcangctgaggnatgtnaaaacntcctnaattctaagattnggcgcnanntgggcatctgaactgccttttagantattaganaatgcntntgccactttgtttgctgctagtgaagcatcangtgtctaggcaatcnacaggtttgcatgatgtgataaacagctctctgctgtttttacttcaaaagatgattaggactgtgtgttcagtataatgctt

SEQ ID NO: 3227 - DNA, 241 bp, Zea mays
  misc_feature: Incyte ID No: 700611140H1
  unsure 2, 5, 22, 27, 46, 52, 63, 70, 76, 103, 118, 167, 184, 187, 192, 225: a, t, c, g, or other
anatngaagcagttgggtgaantcgcnatgtccacaggcaagctanagatgncggaggaatgncttcttnaagcgnaggatttaagtggcttgttgctgttgnactcatctcttgganatgctgaaggaattgaaaagcttgctctttggcaaaagaacatggaganaacaatgttgctgcccnctnccttntcatgcttggtaaagtggaagatgcatacagtngctgtagacagtagcc

SEQ ID NO: 3228 - DNA, 251 bp, Zea mays
  misc_feature: Incyte ID No: 700611141H1
ccgagggaattgagtcatgtgaaaactctgagtaggttatgtagtttcctggccataagtatggccccaattgacattggatctgtcttctcatgctcctagagctgtacccttcgaggtgcttgtgcctttgtgagcttgtgtgaaccatgttgtatgactaaatagtccgcaaacgagtcagctggatggctaatctgtaggccaactattgggatattgttggatattatcaacaaccggttcagatt

SEQ ID NO: 3229 - DNA, 236 bp, Zea mays
  misc_feature: Incyte ID No: 700611143H1
  unsure 4, 31-32, 34, 42-43, 54-55, 64, 66, 71-72, 95, 112, 118, 141, 156, 159,: a, t, c, g, or other
aaanaggatcggtcatggtgggggtgatggnngngatgatgnnggtgacgatgnngactacttngntgatnntgatgagggagatgaagaaggtnggctttcaggaggcganttgttngtacaagagctattcaatagggngttcgtagaagctcngtngcaagaatggtacaagacgatgagtgatttgcctaccggtctcgccaagcttgtganatgggtttggtgagttctnc

SEQ ID NO: 3230 - DNA, 279 bp, Zea mays
  misc_feature: Incyte ID No: 700611145H1
  unsure 154, 156, 243: a, t, c, g, or other
cctcaggaaccgttgacgtggcgctcctcctccgacgattcgctccctccctcgagtttcaccactccctcctctcgcggccacgcactcccccgcctccgcaacctctcaccgccggtccccgccctccgaccctccacgcgaaacagcccgntncatccaccaggatccccgatgagctaggagaagtgttgatttggatattcgtggagtgtgcaatggtggatttgttcgacggctcgnctctgccctgctcaagtgctgcgaccttgacatacc

SEQ ID NO: 3231 - DNA, 283 bp, Zea mays
  misc_feature: Incyte ID No: 700611146H1
  unsure 119: a, t, c, g, or other
gggcagcggcgcgggcgaggagcagaccagcacccagcagccctcgtcggggggcggcagtgcagcttcaccagccgccgcctttccccgtctcctctgcctctgcctctccccctaanccccttccatttctccaccccacccgctcccgcttccgcttcctcgccacttagttcgttccgcacccgcagccgcggctgcgttcgcattgggggcacgcaatggagcagtacgagaaggtggagaagatcggggagggcacgtacggggtggtgtacaaggc

SEQ ID NO: 3232 - DNA, 284 bp, Zea mays
  misc_feature: Incyte ID No: 700611147H1
  unsure 163, 180-181, 219, 233: a, t, c, g, or other
ttgtgtggatcaccctgaagaggttagcaagctggccaaagtgaaggcgcaggtttcagaagtcaagggtgttatgatggaaaacattgaaaaggttctggatcgtggagagaagattgagctgcttgtcgacaagaccgagaacttcgctcacaggcacaanatttcagacagcagggnnccaaatgtcaggagaaagatgtggttacagaacatgcncgttcaagctcatncgtcctgggataatcatcgcactcatctgatcatatcctctactgtctgtc

SEQ ID NO: 3233 - DNA, 284 bp, Zea mays
  misc_feature: Incyte ID No: 700611149H1
gcaccagttgtaatatcccaaaggcgccgagtaaccgaagaagagaagtgccttgctctcagaaaggcaatggagttcaagtcgaagcaccctttcaccatgcagataatgatcgagtcttatgtctacgtgggatttttcatgacatcgcctgcgagttcgtcagggagtcgctcccccgcacgagcaagaagatgacgctctgggacccgatggggaagccgtgggacgtcagctacgtctactacggcgaccgcgccgccggctccttcggtggcggctgg

SEQ ID NO: 3234 - DNA, 281 bp, Zea mays
  misc_feature: Incyte ID No: 700611151H1
  unsure 263: a, t, c, g, or other
caaggttctattcataatttagtgaggtctggagttactgttgaagggaaagttaatgtaggggcacaaggagcttttaactctgcctctgcaccacagatggaatttcccacagttcctccatacaacccctcttccttcgggctagctcacagtttctggacaaaggcaaggagttggtttccagcattataagcactgaacctcattcatctaaagttgcatctcagcctgggatttctcatggaagtcccatgcaaganaggcaaggtatgatcagg

SEQ ID NO: 3235 - DNA, 281 bp, Zea mays
  misc_feature: Incyte ID No: 700611152H1
  unsure 122: a, t, c, g, or other
catcatatatatacacacacacctcaaaacatccaaaattacaaatagacttaaccatccaatatcatcatttgcatacaaattccaactgcacaaatcgaaatcaaaccgaaaattttcanaaggaaaacgaaaaaggtcaaaccagataatccgagagccttttgtaacgtgcgtgcgtttaattacaaggaacagtccgtcgctgagaaaacttgctactcatcatcaccggccttcttcgatgacagagcccaggaatgcgacgaggcgtgcgaggc

SEQ ID NO: 3236 - DNA, 193 bp, Zea mays
  misc_feature: Incyte ID No: 700611158H1
  unsure 6, 11, 16: a, t, c, g, or other
gcgtgnttgcngctgnagtcctgcacgtcttgccgctttgattgccttctccttcccgcaactactcatcctttccatcaaaactgagcaaacccctcatcctattcacgcgcccggcgtctcccttctccaacctccgttctaatccgcgctgctaatcccactcccagtcccagctcgtccgctgagatgg

SEQ ID NO: 3237 - DNA, 180 bp, Zea mays
  misc_feature: Incyte ID No: 700611159H1
gcagcttgagacttgagagattggtgatagaggcgtttcattatttgtttctctttggcgaataggagacgcactgtgttgttgcaatcagaattgtgggcttcttggggcacattttgctcttgatttcattagtagtttgtacgatggtgaatggatggcattgtgattttttagacc

SEQ ID NO: 3238 - DNA, 279 bp, Zea mays
  misc_feature: Incyte ID No: 700611160H1
  unsure 176: a, t, c, g, or other
cttaaaccgagttctcatgcttggttcacaagctcaaacagttattgggaggccaatactacctgatgctgctgttcatgctgttgtagaagaacatgtaagatgaacagttggaaactaaattcttgagctcttctttttgttaccacagcattttcactgacgaaatttatganatgattactaaactcaatttgaccgaaacaagtcagtaagtgtatttgctcgattagtggaattttggtttgcaatatatgtgtcagacactttctgtgtatc

SEQ ID NO: 3239 - DNA, 281 bp, Zea mays
  misc_feature: Incyte ID No: 700611165H1
  unsure 20, 29: a, t, c, g, or other
gaagcagatgtgttggtggnatggattgnagagagatgtggctacacgtgtggctatgtgcgaggtgtgtcagaaatgttaaggccgaacaccaaagaccagctggactattatacccattaaagatacccgactggtagtgaaagagattagtatggactttattactggattgcctcgcacctcaaaaggataggattctatatgggttattgtggatagactgaccaaagtggctcatttgattcggtcaagactacttataaaggttctcaattggt

SEQ ID NO: 3240 - DNA, 282 bp, Zea mays
  misc_feature: Incyte ID No: 700611167H1
  unsure 29: a, t, c, g, or other
caggaaaaagaaggattactatgcagttntcggagtagagagaagatgcactgtggaggaaattaggaaggcctacaggaggttatcactgaaggttcatcctgacaagaacaaggttcctggggcagaagatgctttcaagtggtaagcaaggctttcaagtgcctaagcaatgatcagtcgcggaggacttatgatcagtacaggcaccattgaggaccatgattcaatgagcaacatcccaatgtcatgaggcggggagctgctaggcggagaaggcca

SEQ ID NO: 3241 - DNA, 279 bp, Zea mays
  misc_feature: Incyte ID No: 700611168H1
ggtgaataaccaccatctcgatattatcaagtctctcatgtgcagaggtagccaacaacaagatgctcaagcacttcactacaaccatagagtccatgaagtgctgaacacggacgacggtcgccctattgatgtagatttggccctttgtgcagaaatgtgagactcgtgtttgattgtacaaggaagaactgcagggaagtgaaggatggccggtctcgatgccgcggttgcttcttttgtgttgctagatgtgaaattgtggtggctgcatcgacc

SEQ ID NO: 3242 - DNA, 278 bp, Zea mays
  misc_feature: Incyte ID No: 700611169H1
ggaagtgggatggtcaaagaatcagcaggtggctaaatccaaccccacccttgctgcaatgaacaagaagtttgggatgatccacgggctgtcatcactggccaacatcatgtcgtttggtagcttggccatgcactcctgtacctggccagcaagctggagctgtgaagaggagccaagacgtcttccatctccgcgttcttgtgaattttatcactatggtggtaatggtgcacgtcagttgtcagatcgctagactaaactgtacgattgcgcta

SEQ ID NO: 3243 - DNA, 66 bp, Zea mays
  misc_feature: Incyte ID No: 700611173H1
  unsure 3, 27, 38, 41-42, 44, 50: a, t, c, g, or other
aanggggcaaattaagatctgcacccnggacataatcnttnngncaatanttacatcccgttgcga

SEQ ID NO: 3244 - DNA, 276 bp, Zea mays
  misc_feature: Incyte ID No: 700611175H1
gcaaccgtccccacaatcctccgacgatgcctgccgcaccgacgctgttgcccccctgcgacgcggaggagccgctgctggcggagtcctccgaccgcttctccatgttcccgatccgtttcccgcagatctgggagttcacaagaaggcggtggcctccttctggacggcggaggaggttgacctctctgccgacgcccggcactgggacgaggcgctgtcccccgacgagcggcattcatctcccacgtgctcgccttcttcgctgcctccgac

SEQ ID NO: 3245 - DNA, 279 bp, Zea mays
  misc_feature: Incyte ID No: 700611178H1
  unsure 8, 13, 59, 76: a, t, c, g, or other
ggggtatnttganatatccgatgttaactgtgaagcactcccagaagctctctcgcgtngttggaacttgcaggcncttcatgtattagcatgctcaaaacttgcagttgtacctgaaagtatcggcaagcttaagaagctagaactctggaactgaatggtgtttctagtatcaagagttctaccagagtctattggtgattgtgataatcttcgaagattatacctagaaggttgtcgtggaatcgaagatataccacattcctgggaaaattggga

SEQ ID NO: 3246 - DNA, 284 bp, Zea mays
  misc_feature: Incyte ID No: 700611180H1
  unsure 4, 7, 9-10, 20, 76, 83, 97, 118, 129-130, 141, 146-147, 193, 199, 233, 237,: a, t, c, g, or other
ggantcncnnacccttctcntcggtgacaagccggtccaccgtctttggcatcaggaaccctgaggaaatcccgtngggtgangctggcgctgagtntgtcgtggagtccaccggcgncttcactgacnnggacaaggctnctcanntctcaagggtggtgccaagaaggttgttatctctacccccaagcancagatnacacccatgtttgttgttggtgtcaatgaagacnagtncanctcggntgtnaacattgtttccatgctagctgcaccacaaactg

SEQ ID NO: 3247 - DNA, 279 bp, Zea mays
  misc_feature: Incyte ID No: 700611181H1
  unsure 10, 15, 21-22, 50, 52, 68, 71, 171, 174, 178, 196-197, 216, 230, 239, 247,: a, t, c, g, or other
cctcctccgntgcanctgcgnnatccatccagtagtccgaccaatccatngntttcagcgttcgggancgnctccacttgcggcattaaacatgcacctgccggcgttgcgcttgctgcgcccatgaagcacctttccctgtctcgccctcgctggtttcgcttccgcgcnagntgangccgcgaaggaagtacannttcagggtaaacgctgcanaggagctgcattcnacaaggatngctcggcnatcaggaaaatgcnaaatggggtcaacaagct

SEQ ID NO: 3248 - DNA, 279 bp, Zea mays
  misc_feature: Incyte ID No: 700611183H1
  unsure 193: a, t, c, g, or other
gagacgaggaggacgcggcgccgttcgggcttggcagcaaccagcgtctagcgcagtgcccttctgtactcctatctccccggagtccccgctgcccagcccggtctcactttccagtctccgagactccgagtctcgctgcaccccgtcccctgcagcctgtgctctgggttggagggaggtgagctgcganggagcgcggagggggcgaggagatggaggcagattcggcgaggaagagacttgcattgctggccctgcttctcctggcggcgcccg

SEQ ID NO: 3249 - DNA, 273 bp, Zea mays
  misc_feature: Incyte ID No: 700611186H1
  unsure 58, 175, 177-200: a, t, c, g, or other
ccgagcctggtgcgctctcccctgcccagtgccgatcgttggagaagatccttccgcngaaaccagggagccaactgtcggacatggagctggaccagtgcgaggagaccacccttcacgatgtcaacattgaagagggatgaggcgcaggcagcagcagaagaagcaggaagcncnnnnnnnnnnnnnnnnnnnnnnnnctcaaccaagggtgcaatgtgcccagcagtaaatccgtgttcgttggaatgttctccaaaattttcagcagga

SEQ ID NO: 3250 - DNA, 274 bp, Zea mays
  misc_feature: Incyte ID No: 700611189H1
cactcatcgatctacacacatacatagtttcttctactacacgacgacaaacatggggaagcctgcgaagatcggagagtggggtggatacgccggcgatcgtcgggatctgagggctactccggaccggctgatcgagtgaaggtcacggcggacaacagcagctgcatccgctccatctccttcatctacatcggagccgatggcaaaccgtacgaggaggggccatggggtttcggccatgctggcacggagtacaagattgatctgtgca

SEQ ID NO: 3251 - DNA, 276 bp, Zea mays
  misc_feature: Incyte ID No: 700611191H1
caggattcagccgcaactcctgttaccagtgctgaccctgctcgtcctgctgcttcaaatgattctcccagtcaggttgccagtgcagctcctgctgctgtttctgcacctaccgctgctcctgcagaagatgctgcaggcgtgaggcgtcagcatctgtgttctctgcgtctggtttatcctcctgggctaagaacctaaaaattcctcagccttcaccaggtcaagaatcacctacaggaaagaatacctttgcccgtttaacaagtggccttg

SEQ ID NO: 3252 - DNA, 275 bp, Zea mays
  misc_feature: Incyte ID No: 700611192H1
  unsure 120, 124: a, t, c, g, or other
ggttcgctctttacaaattccaattggtttgcatttgacgaggacaaggcactgaatgtggtttggttagctcagaagcatccccatctccaaattcggaaatatccgcactaaaagagnctgncgaacatgatgaatcattcttggcgaaattatagatgaaataaaaggttctgaaccaactctaccagtcttcaacaaagatgcaaacaaagaattctggttccaccggcttggcaaatggtaccgttgacaaattcgaagatgatatcaga

SEQ ID NO: 3253 - DNA, 279 bp, Zea mays
  misc_feature: Incyte ID No: 700611195H1
gggtgcagggcaacaatagcaaacgcaaaaacaagaatcaacggaagcttgttgcctgcatcagttattggtatgtactgtacatatctgtgctacagtggactctccagtgagccaagggattacgaatgcaatgggctcacaatcactcaaaagctgtgtcaactggtagccttacattgggactccttaccacggtcctctctgtggtctattctgctgtccgcgctggctcctctgcaactgtgctctcgccaccagactcaccacgtgggaccg

SEQ ID NO: 3254 - DNA, 268 bp, Zea mays
  misc_feature: Incyte ID No: 700611201H1
gaggatgatgaagtggggacgaggtgggccgtgctcgtcgccggatccttcggttatgggaactaccggcaccaggccgatgtgtgccatgcgtaccagatactgcagaaggaggagtgaagaaggagaacattgtggtgttcatgtatgatgatattgcccacaacattctgaaccctaggcctggagttatcattaaccatcctaaaggagcaaatgtttatgatggtgttccaaaggattacacaggtgatcaggtcatactgaa

SEQ ID NO: 3255 - DNA, 267 bp, Zea mays
  misc_feature: Incyte ID No: 700611202H1
ggggcattgcaagttgcggtatggagatggtggagatgatgaagatgctgacctcgaggaattctatgattacagcagcagttatgttgattcagaaggcaagcagttgatgctgttgatgacttgaacaacaacattgagctgggaatcggtgggtctgagctagtaataacaaacaagagcgagaaaggcactcgggtcagaacccttggctctagggaatttatgcgctactatcgccagaaaccacggccttctgttgcacca

SEQ ID NO: 3256 - DNA, 266 bp, Zea mays
  misc_feature: Incyte ID No: 700611205H1
  unsure 262: a, t, c, g, or other
ggttcgagaagcagacggcaggcacgctcgacatcctgtgccctccttggatggattggttccatggcggcctgcagttccagattgagcaccatctgttcccccgcctgctcggtgccaccttcggaaggttgcgccggcggtgcgtgacctttgcaagaagcatgggctgacctattccgcagcctccttctgggacgcaaatgtgcttacatggaagacactcagggctgccgcattgcaggccaggagcgccacaggngcgg

SEQ ID NO: 3257 - DNA, 89 bp, Zea mays
  misc_feature: Incyte ID No: 700611207H1
  unsure 13, 17, 53, 66, 69, 74-76, 78, 80: a, t, c, g, or other
cagcagtatcagnagtngagcgctgctgctcaccaaaggactgctacaatgtnttgatatctgttntgnactgnnntngnacagatacg

SEQ ID NO: 3258 - DNA, 269 bp, Zea mays
  misc_feature: Incyte ID No: 700611208H1
  unsure 184-185: a, t, c, g, or other
gagcaatatgatccatcttcttatgaggagtatctgcgctggtactcaggagcaacacggcggtaccttgtcccagcaaccagtgacgacggtgaagcgggaccttcagctcaactgacgatttctcagatcttcagtaccaagccaaatctccaataatccgcaaagcagttgataaactggnnaagcatggttaagaaagccaagagagccatgacaaccacagctgatacaaccactcaagccttggttgctgagtttctgcttgg

SEQ ID NO: 3259 - DNA, 268 bp, Zea mays
  misc_feature: Incyte ID No: 700611209H1
  unsure 92: a, t, c, g, or other
cacacacatagctactgttggacgtgctatgtcatcttatgaagatgaagcgtatgagatcatgcagtccacttgatgtgaactatgtgctngttgtatttggaggtgtcactgatattcttcagatgatatcaacaagttcttatggatggtacgtattggtggaggggttttccctgtaatcaaagagccagattaccttgttaacggggagtatcgtattgacaagggggcagcaccaaaaatgctgaactgcctaatgtacaag

SEQ ID NO: 3260 - DNA, 267 bp, Zea mays
  misc_feature: Incyte ID No: 700611210H1
ggcaatgtctttgctttgaaaagaatagtgaaaacaaatgaagggctagatcggttctttgatagagaacttgagatattgggaagtgttaaacatcgctatttggtcaatctcgtggttattgcaactctccttcatcaaaacttttgatatatgattatcttcaaggtggaagcctggatgaagtgcttcatgaaaagtctgaacagttggattgggatgcacgtattaacatcatacttggagctgcaaaaggcttgtcttact

SEQ ID NO: 3261 - DNA, 266 bp, Zea mays
  misc_feature: Incyte ID No: 700611211H1
  unsure 131: a, t, c, g, or other
gactgggcaaccgccaccgccctccctttccctgcgccaggacgactggccgaacgctgcctcgcttcgtcacctcttcgccggcgggacgatcacccaccaggttgatgcgattttttggttgacaattngaagattactaacttctatgatcctgagggcaagaagtaatgatccgcccaggctcaaaggactcgcaaaattatgataacaataatcaaagagtccatcctcaaccaatcgatgagaacatgaatcagaacggg

SEQ ID NO: 3262 - DNA, 258 bp, Zea mays
  misc_feature: Incyte ID No: 700611212H1
  unsure 12, 26, 29, 96, 156: a, t, c, g, or other
agacattttgcncacccttactagcngcnctaaatgtctttatcttccatcggcagaggtgaaggaagataaagacatttagcgctgtagtaaggntgtgaaaaaaccctttgcttgcgttgaaatagaagctcgggcgatccttgttcattcttnaggtctctcacccccaccaccaatctttccatgtctctttattcgtctctgtactgccgtgtagctgctctttggtcgtgtagctgtgatcttgtcccgaaa

SEQ ID NO: 3263 - DNA, 266 bp, Zea mays
  misc_feature: Incyte ID No: 700611213H1
  unsure 251: a, t, c, g, or other
tgttggtgttagcagcctcacactttttgctctgttcacacaaattagccgtgctctgatgatatttccccattattatctattctccagctttcacaaggggcggataagtggttagtgagttctctagtcaacataatcaaggtgcgctaaatgagagctgggttgatgagttctcgaaattaaatgtcactgatgaatgggcagaggaattcagtggaggtggttttggcgaaagctctgctgatctntgggtagatgagttc

SEQ ID NO: 3264 - DNA, 267 bp, Zea mays
  misc_feature: Incyte ID No: 700611215H1
  unsure 13, 16, 32, 41, 43, 45-46, 57, 61, 65, 76, 135, 148-149, 162, 170, 178,: a, t, c, g, or other
gggggccgcgagntgnagctcaaccatcatcnaaaaggcanancnnggtggagatgnttgnaacngctggtcactnataattaccagcatcttatacgtcattgctgttcatgccaacttattcaagtttgaaancagaacactgaanngatggctgagatnagaatatnctaatgcngaganntgagatggggnagttacttggaaaagggagttttgccaaagnnanccatgctcgcaatgttaagattcagaaagcgntgctat

SEQ ID NO: 3265 - DNA, 221 bp, Zea mays
  misc_feature: Incyte ID No: 700611217H1
  unsure 76-77, 135, 141, 172, 220: a, t, c, g, or other
ggagtgctccggaacccgccgccgcatccgcacgacgccacggctgacgactgggagccccgttcgcctccaccgnnacctccccgcgtagaagctttgcagcgagaagccggaaccctgtcgatctctcctgangcaatncgctcctgtcgtgagctgaaccctacagttngtatcacctcctctcgcagcagctgcagaaagagcaaggggggatggnc

SEQ ID NO: 3266 - DNA, 267 bp, Zea mays
  misc_feature: Incyte ID No: 700611219H1
  unsure 35, 48, 84, 86-87, 89, 91-93, 182-183: a, t, c, g, or other
gggaaagaagggtggcaagaaaaagaccgtcgacnctttctctaaganggattggtatgacatcaaggcaccgtcggtgttcancnntncnnnacatcgggaagactctcgttccaggacacagggtaccaggattgcttctgagggtctgaagcacagagtcttcgaggtttgcctagctnntcttcagggcgacgaggatcaagcttacaggaaaatcaggctccgtgctgaagatgtgcaggcaggaatgtgctcacaaacttt

SEQ ID NO: 3267 - DNA, 266 bp, Zea mays
  misc_feature: Incyte ID No: 700611221H1
  unsure 7-8, 49, 54, 81, 83, 101, 167, 204, 213, 242, 245-246, 250: a, t, c, g, or other
gatagannaaagtacaatagagatgacttccctgttcagtacgatgctncaaanttctttgtcattaaatcgtacagcgangntgacatccacaagagcgnaaagtacaattgtgggcaagcacaaccaacggaaacaagaagcttgatgctacccaacaagaagcncagtcaaagggatctacatgccctatattcttgttcntctcagtgnatacaagtgggcagtttgttggtgttgcnganngacnggcgccgttgattttg

SEQ ID NO: 3268 - DNA, 164 bp, Zea mays
  misc_feature: Incyte ID No: 700611222H1
  unsure 13-14, 20, 39, 42, 107, 123, 125, 145-146, 148, 160: a, t, c, g, or other
ggtctgcagcccnnaactanccccagcctcggaaggaanctnccagaagcgcaagactctaaggccgacgccttacccattcttcctcgccgcgggggtcgcctganatcaataaacaatggngnggctgttgctgtgcttggtnncngtgatggtgtcnaggg

SEQ ID NO: 3269 - DNA, 266 bp, Zea mays
  misc_feature: Incyte ID No: 700611226H1
  unsure 3, 25, 35, 106, 131, 182: a, t, c, g, or other
ganagcacgggttcagcgaattttngctgcagganagtcactgcttaactttgttcagattgatcagttgagaatttattttgattcatcatcgaagaagtttgtnatggcaagaaccctcctgtttctanaactaacacccctcttcacgaatctcctgatgcacttaaaacaagtggcantgaaatggattatgaggctgctagaagatttgattcagtttcttctaatatgggcacatgtcagtctaaagtgcagttttgtcc

SEQ ID NO: 3270 - DNA, 264 bp, Zea mays
  misc_feature: Incyte ID No: 700611227H1
  unsure 234: a, t, c, g, or other
gtggcaagagggttttcctgttcccccagtgctacgcagagaagcaggctctgggtgaagtgagccaggagctgctggacactcaggtgaacccagctgtgtgggagatcgtggacacatggtgctgaaacggaggatggactatgaggaggcatctgaaacctccgcgtggaaactcctcgccgaggtctctctctccgaggagcgcttcgaggaagtgaaggcgtacatctncagcgctgctggcctggttcagtatgatga

SEQ ID NO: 3271 - DNA, 267 bp, Zea mays
  misc_feature: Incyte ID No: 700611229H1
  unsure 6, 11, 15, 19, 24, 39, 42, 48, 91, 114, 200, 215, 217, 234, 245, 252: a, t, c, g, or other
ctcttngtcgngccnccgncagcncgactccgactcggncanggtganacccccagctctcctattcccttacgccctcttcggcatcaanctccgccgtcatccgcgcaggtnaggcggtggtcctcttcaacgtctgcgacagctacgtgcggcgaccggaccaggcagaccgtgtcatcggcaccctccttggatcnctcctccccgatggnangtccacgtccgcaactnctacgtggtcncccacangagtcggccgaccag

SEQ ID NO: 3272 - DNA, 260 bp, Zea mays
  misc_feature: Incyte ID No: 700611230H1
  unsure 49, 159: a, t, c, g, or other
taacgtggagtatgagggggatactgtccatgtatccttcgtcgtcatnaaggctgacaccccgtggcattacagcgaagaaggcgttgatcttgtggttaaggacctaatggcgctcaagtccgtgattctcgagataagactagtgataaatttganttcatagttcagaagagaggcgtccatcgcttctgcttcacgaataaatccccgtaccacgaaactatagacttcgacgtgcatgttggccattttcatac

SEQ ID NO: 3273 - DNA, 92 bp, Zea mays
  misc_feature: Incyte ID No: 700611233H1
  unsure 42-43, 54, 60, 66, 71-72, 79, 81, 89-90: a, t, c, g, or other
cttgttctgagtgaagatgagcttgctgattcagaacaagtnnccctgccactntgaatngcctgntccannagacatnancaatcccnnta

SEQ ID NO: 3274 - DNA, 265 bp, Zea mays
  misc_feature: Incyte ID No: 700611234H1
  unsure 110: a, t, c, g, or other
agaaggttaagaagagcaacggccaggtcctggccatcaacgagatctttgagcgtaacccgacgacaatcaagaactacggcatctggctgcgctaccagagcagaacngctaccacaacatgtacaaggagtaccgcgacacaaccctgaatggcgctgtggagcagatgtacaacgagatggcctctcgccaccgcgtgaggtccccctgcatccagatcatcaagactgcgacggtgcattcaagctctgcaagagggaca

SEQ ID NO: 3275 - DNA, 264 bp, Zea mays
  misc_feature: Incyte ID No: 700611235H1
agtagctcctgccggtatcaagattcaagtgattaaaaccgtagatggcgtagtactagtaaaaactagacagctagtcttggcagccagttgtagtgaagtgacatggtgcatacagacatccaaaggaaacggacttggtaggtgccgtggacaaaagccttggccggacagacttggtgctgctgcagctgcagtgctgctgcacaaggaaaagtgatgagaccgagacgagaggggtgtactctgctgggaccagagcat

SEQ ID NO: 3276 - DNA, 266 bp, Zea mays
  misc_feature: Incyte ID No: 700611236H1
  unsure 179: a, t, c, g, or other
tgaagagaaaagcgagatggaggagaagaagggccagtacgccaagttctggaatgagtttggcaaatcaatcaagctgggtatcatcgaagacgcgactaacagaaacgccttgcgaagttgcttagatttgagagtaccaagtcggatggcaaacttgcctcccttgacgagtacanctcacggatgaagtcagggcagaaagacatcttctacatcacgggaagcagcaaagagcagctggagaagtctccattcctcgagag

SEQ ID NO: 3277 - DNA, 263 bp, Zea mays
  misc_feature: Incyte ID No: 700611237H1
  unsure 4, 12, 14, 19, 23, 29, 32, 41, 64, 134, 140, 149, 156, 181, 236: a, t, c, g, or other
tgcnttcagtanangactnaacntaggtncancaagttctngtagtggccgtggggactgtgtntacaccactgttagccacttcaacatcatacactaccaatgccacaggaagctaaacgagctgatgctgnactgangaatcccanaaaggantgggacggtgctaccttgcgaaacnatgagacattgtgcaattgtatctttccattgagggggccatctgttcctcttgngcagtacactaggtgtgttgatcagta

SEQ ID NO: 3278 - DNA, 163 bp, Zea mays
  misc_feature: Incyte ID No: 700611239H1
  unsure 4, 24, 37, 44, 65, 73, 86, 89, 124: a, t, c, g, or other
gcanaagctttggacgagaagcancagctcacgtcanctgccanagctagagtgtcttcctttgncaagagcntaggcctaagtgngangatcagtgttggcacttcagtgtaaatgataaagngaaggaaatggatcagaaataccaagtctctgagaagat

SEQ ID NO: 3279 - DNA, 133 bp, Zea mays
  misc_feature: Incyte ID No: 700611241H1
  unsure 64, 83, 88, 98, 114, 122, 130: a, t, c, g, or other
gtcgaaccagtacgagaccacgtctctcgtgcagatcgagggggtgaacaccaaggaggatgtncgcgtggtacgatttggancctcntgtatccaangatggtgccccggcgnagagcctnaacgagcngtc

SEQ ID NO: 3280 - DNA, 264 bp, Zea mays
  misc_feature: Incyte ID No: 700611242H1
  unsure 55, 58, 92, 189, 197-198, 245, 261: a, t, c, g, or other
gcatttcaccatcctacgaaggatgaggttgttattcatagcatcaggcttccanaanatagcaccattgctgatgtaataaatgacttganaactaaggttgaactgccagtcctaatgctgaactacgtgtactagaagtcttctaccacaagatctataagatctttccactacatgagaagatanagaatatnnacgaccaatattggacactacgtgctgaggagattccagaagagganaaaaatataggcccanatg

SEQ ID NO: 3281 - DNA, 84 bp, Zea mays
  misc_feature: Incyte ID No: 700611247H1
  unsure 5, 19, 37, 39-40, 61-62, 72, 76, 78: a, t, c, g, or other
atcgnccgagcgaattccnccagcagcttactccacncnncgctaaccttgcgatggcacnnaaggcggcanacanangccggt

SEQ ID NO: 3282 - DNA, 264 bp, Zea mays
  misc_feature: Incyte ID No: 700611249H1
  unsure 239: a, t, c, g, or other
gctgtgtctcatcaacgccggcatcaccgcgaggactgggccagctctccctccctttctcctccctccgccttcattgctgacggcgacgactgggcgagctctaccccgctctgcgctaggtgcccaggtcttcctcgggcacttcaccggcgacgagcacccatcaggagcgaaatggacgaggctgttcctgctttggctaccggccaagcttcaaccgacgccgtgacagagcngcctgtgaatgtgtacatatgggac

SEQ ID NO: 3283 - DNA, 260 bp, Zea mays
  misc_feature: Incyte ID No: 700611254H1
  unsure 46, 53, 75, 80, 108, 130, 141, 166, 188, 226, 235, 241, 243, 250: a, t, c, g, or other
caaaagatgctaagaggaagtgggaaacgtttgcagagcaggctgnaaatgantgcaaagctggctccagctttnctgcngctaagcatagccgcatggaaaccatgntcaggagtgcgcatgcactgtngactccgccgntcagcaatggaagaagtcacatgcngctgttaacgatctcagcaganagcaagttgctgaagttgaagcactcgtcaggactgcnattgagaanaacgancnacatganctggaattgc

SEQ ID NO: 3284 - DNA, 265 bp, Zea mays
  misc_feature: Incyte ID No: 700611255H1
  unsure 6, 33, 35, 51, 73, 109, 181: a, t, c, g, or other
aggagnaggaattctcagcacagttagagatgnanattgaagtagagaganctcgttctattgagtctgctanagaatcattagaggaacaactcctgttagtgaactngaagctgcaaaactgcatgacatggtgtctgcgcttgagcacgatgtggaaaaggagaagtttttttctgcncagctaccagatgcagctagaagctctagaggctgtcaaaaaggtgttggagtctgaggcggagtctgcacatcaggatgccat

SEQ ID NO: 3285 - DNA, 261 bp, Zea mays
  misc_feature: Incyte ID No: 700611258H1
tggaaaatattccagatttcattgtaggagtgaagaacaggaagaggaagatgtccggttttgggcaccgtgtgtataaaaactatgaccctcgtgctaaagtcataagaaattggcagatgaggtgttctcaattgttggacgggatccacttattgaggtggccattgccctagaaaaggcagcgctgtcagacgaatattttatcaagaggaagctgtatccaaatgtggattctactctgggctaatttatagggca

SEQ ID NO: 3286 - DNA, 261 bp, Zea mays
  misc_feature: Incyte ID No: 700611260H1
gtggcaagagggttttcctgttcccccagtgctacgcagagaagcaggctctgggtgaagtgagccaggagctgctggacactcaggtgaacccagctgtgtgggagtcagtggacacatggtgctgaaacggaggatggactatgaggaggcatctgaaacctccgcgtggaaactcctcgccgaggtctctctctccgaggagcgcttcgaggaagtgaaggcgtacatcttcagcgctgctggcctggttcagtatga

SEQ ID NO: 3287 - DNA, 91 bp, Zea mays
  misc_feature: Incyte ID No: 700611261H1
  unsure 29, 51: a, t, c, g, or other
cagtactcacctcaaggaagtgaacagtngtaatgctacaagttggtgcanggcaacttgaacacttccaatgatacatgaagctggagaa

SEQ ID NO: 3288 - DNA, 267 bp, Zea mays
  misc_feature: Incyte ID No: 700611263H1
  unsure 110: a, t, c, g, or other
ggaggcgccgacgccgagtcctttctccatcctggcatctgccgctgtttccgacaggatgtttctcacgaggacggagtacgaccgtggggtgaacaccttctctccgnggggcggctgttccaggtcgagtacgccatcgaggccatcaagttgggatccactgcgatcggtttgaagacaaaggatggtgttgtcctcgccgttgagaaacgtgtgacctcaccactgctggaaccaagcagtgtggaaaaaataatggaaatt

SEQ ID NO: 3289 - DNA, 261 bp, Zea mays
  misc_feature: Incyte ID No: 700611265H1
cgcacagttcatcccggccaaggctttcaaggcacgcaaggtttattacaccaacgaggaaaatggattacttcatgttccaaaggaagacgcgcagaaggctcaggagccatgttttctgatccaaacatggccatggacatgatgaagaagaacctatccatgatagttcctcagacacttacatttgcatgggtgaactttttcttttcaggtttcgttgcagcaaaaatcccctttccatgactcagagatcaggga

SEQ ID NO: 3290 - DNA, 263 bp, Zea mays
  misc_feature: Incyte ID No: 700611266H1
  unsure 12, 24, 27, 30, 32-33, 64, 83, 101, 211, 244: a, t, c, g, or other
gttatgccccanatcaatttgacncantanannatggtaaggtggttgttagacataacacaancatgtcacaccatgggatnccaacaaagcagttcacnagcagacttaccactcttttgaagatgctaagtatcacaatgagttttcaggaagctttctgccacccattgagcataatgcttactcttctgctggctttggtaatgtnctggccacctctaactcagcatgtacacatganaattcacaacttggtggag

SEQ ID NO: 3291 - DNA, 262 bp, Zea mays
  misc_feature: Incyte ID No: 700611267H1
  unsure 133: a, t, c, g, or other
gatgattggacagcaaagatatggagtatgaagcaagacaaatgtgtatttgatttcaaggagcataccaaggaaatatacactatttcggtggagcccaacaggccggaacaaacaatcctaatcagcagtngcttttggccagcgcgtcttttgattcaactatcaagctttgggaagtcgagcaaggatgccttctgtacagcttgtctggtcataggcaaccagtgtattctgttgcatttagccccgacggcgaata

SEQ ID NO: 3292 - DNA, 264 bp, Zea mays
  misc_feature: Incyte ID No: 700611268H1
  unsure 107: a, t, c, g, or other
catgcactggatctgttagagaagatgttgactttagatccatcacagaggatatcagcaaaagatgcacttgatgcggaatatttctggactgatcccttaccatngatccaaaaagcttgcccaagtatgaggcatcgcatgaattccagactaagaaaaagcgtcagcaacagaggcaagcagaggaagctgcaaagcgtccaaaaacttaaccatcctccaccacattctcgtttgcctccactccagcagcctggccaa

SEQ ID NO: 3293 - DNA, 262 bp, Zea mays
  misc_feature: Incyte ID No: 700611269H1
  unsure 151, 154: a, t, c, g, or other
ctcatcttcacccgcgccaagcagtacgccgaggagtacgatgcccaggagaaggaactggtacagcttaagcgtgaggcccgtttgaagggtggtttctatgtcagcctgaggcaaagctgctatttgtggtccgcatccgtggtatcancgncatgcaccctaagaccaggaagatattgcagcttctgcgtttgaggcagatcttcaatggagtgttcctgaaatcaacaaagcaaccattaacatgcttcgcagggtt

SEQ ID NO: 3294 - DNA, 262 bp, Zea mays
  misc_feature: Incyte ID No: 700611273H1
cggtacgttatgtctccgtctgtgctcttgctcgtgagcaagcagcacatggctgaccgtgtagcttgcatttccattgcataataggcttatgaagaatgctttggaatatgattttacagtctgacaaggattgtgaagcagaggcagtgtaccatcaagataatacttctggaagcatataaaaaaatttcgtatatttggatttcaaatccagtctgcttcagactggaaattcatattatcttctggaatcgtgctt

SEQ ID NO: 3295 - DNA, 148 bp, Zea mays
  misc_feature: Incyte ID No: 700611274H1
  unsure 12, 97, 118, 129, 145: a, t, c, g, or other
atagtgttcaanttatttaataactaaattgaacactatcatggcttagacagaactgaaacttagttctgaactgaaccatgatagtgttcaatancgttattaataattgtaaaanaaaaaaaaaangggcggccgccgactngtg

SEQ ID NO: 3296 - DNA, 261 bp, Zea mays
  misc_feature: Incyte ID No: 700611275H1
gaggtggccatacgcaacaagcaaagcatacccccaaatccccaatccccaatccccaatccccaaaccctaggttatctcggcgcggcaggatggcggcggcgggtgaggaaggggaatgcgcgcctcccgccggaggtgaaccgggtgctctacgtgcggaacctgccgttcaacatctcgagcgaggagatgtacgacatcttcggcaagtacggcgcgatccggcagatccgtctgggcaacgccaaggacacgcgc

SEQ ID NO: 3297 - DNA, 263 bp, Zea mays
  misc_feature: Incyte ID No: 700611277H1
  unsure 19, 23, 28, 51, 61, 80, 83, 87, 105, 155, 195, 248: a, t, c, g, or other
gtatgccatatcttcagtnctcntatgntgcttcagcgctgcatcttccanttttctcggntaaaaagagatcatagtcnatngtanacctatgtgtgaaagcancagacttatcagttttgtgaacaaccctaacttatgtggtcctggcaccncaaaaccttgtcctaatgctcctcccttttctccacctanttccatacaaccctacaaccccgatgcaatcaccaggaagtagctcttccagncctggagcaattgct

SEQ ID NO: 3298 - DNA, 261 bp, Zea mays
  misc_feature: Incyte ID No: 700611281H1
  unsure 146-166: a, t, c, g, or other
agcgcaatggcaaagcacacgctcagcctgtgcgcttgccatcatgctccaaatagagagagacagccagcccacacacggctgctggttctactcagtattttgctagaaaattgagactatcatgtcacggcccctggtaaatnnnnnnnnnnnnnnnnnnnnntagtttagtaagtcggttgaagaggaaggggattaaggaaggattactgttgggctggcccattagggttccaagccgtgtaatagatccaggcg

SEQ ID NO: 3299 - DNA, 261 bp, Zea mays
  misc_feature: Incyte ID No: 700611282H1
  unsure 51, 102-103, 173, 192-193: a, t, c, g, or other
ttgctgctgtgccccacatgtttatcaatgggtacaagaacgtgcttgctnttgctgtggagactgactactcgtacccacacgccgacaagatcaaggaannctcaaggacccgagcaagtttgctgttgctgctcctgtagctgctgcggactctagtgctgctgctgccnccaaggaggaagagaaggnncaagagcctgccgaggagtcggacgaggaaatgggcttcagcctgttcgacgactaagccgctcttat

SEQ ID NO: 3300 - DNA, 265 bp, Zea mays
  misc_feature: Incyte ID No: 700611283H1
  unsure 78-79, 86-88, 175: a, t, c, g, or other
aaccatcatctaaagttcaacgcccgcaccgcaagcgcaacacgccaacacccgagacccgacgcggccttcgccttnncctccgnnncgagggagattcgaggggaggaggttctcaccttcgcgcctgcggttgcttggcgcagagtcgtcgcagatggaccggtaccagagngggaagaagccgcgggaggagtcccctatcggcgccaacgagatccgcatcacggcgcagggccggccccgcaactacatcacctatgcg

SEQ ID NO: 3301 - DNA, 261 bp, Zea mays
  misc_feature: Incyte ID No: 700611284H1
caagctggcatcgacgacgcagaggagatcgctccacttgccaaggaaaacgtagctactccatgacgcttggtgcctcggaaacacgcgttggtgataggaagcacttctaggatcctcctggccttgtggctggagtgagttgttcagtcagacacagtttcgcctctacaacatcttcctcctcctggtggtggtccgaactccgaagcaaattccagtgataaaggatgaactaagaggtccatgtttcaaaaaaaa

SEQ ID NO: 3302 - DNA, 260 bp, Zea mays
  misc_feature: Incyte ID No: 700611287H1
gtgatgaagctattgagactgccaaggctcttgctctgaaagaagggttgttggttggaatctcttctggtgcagctgcagctgcggcagttaggcttgctaagagccagaaaacgccggaaagctatttgttgtcgtgttcccgagcttcggcgagcgctacctctcatcggtgctgttccagtccatcaagaaggaagcggaaagcatggtggtcgagccctagagcacacagttctgggcttctggcaaactatttc

SEQ ID NO: 3303 - DNA, 259 bp, Zea mays
  misc_feature: Incyte ID No: 700611289H1
ggacctcacatctggagcatgagaagtttgatgcagcaaaatcgcggctaattgagcgaggagaaaaatttggggagatatctttaaaggctcgcaagacaattgaatgcttagtcaggattttatttatgatgggtgtactatacttgtccatgggtattccagagtagtactggaagttctaaagcttgctgcatccaatcgcaagctcttccgggtactatgcacagagggcaggccagacagaatggtttaagga

SEQ ID NO: 3304 - DNA, 261 bp, Zea mays
  misc_feature: Incyte ID No: 700611290H1
aaaattatcattccatgattttatttcaaggcctgttgttgagccttcacccagcctgttaagaggcattcggcaatctttgctctcacacctcacccttgtattggcaatgacgagcttgcagcccagtgcttgctgttgcatcttctatccagacttcgtaatagggtggatgtggtcaccgttggcagactctccttgaatttcactggcttcaacagggaaagtgcttccatatttgggaatcagctgtattctttg

SEQ ID NO: 3305 - DNA, 258 bp, Zea mays
  misc_feature: Incyte ID No: 700611291H1
  unsure 154: a, t, c, g, or other
gctctcaccagtcaccactcagctgacgacgagcgagcgagaggaacggggcgagggaagttaaacgcgcggcgatgccggagccgccgcccttcccgtccttcagttcgggatggctggcgcgatatatatcaaaggcattcctgtgacgaantataagagatccgctgttaattccgaagaggagtggccctccaaacactctaaattctttgctgagcttgatgatggtttggagttctctttcatgataaacgg

SEQ ID NO: 3306 - DNA, 257 bp, Zea mays
  misc_feature: Incyte ID No: 700611292H1
gcaggcctccaaaaccttgagcttgcatcatctgaagacccggaggtagcgcttctctgagcagggaggccagcagtttacatttgcgccgcggggtccaaatatcgttagcaaatttgaacttagcaacgttagatcgttgatggtgatgaatggatgtcaagccttctatgttgctgttttctaaggtgaataccgatgctgttccattactaggatctatacttggtttatctctcgtactgtggccaaaacaa

SEQ ID NO: 3307 - DNA, 201 bp, Zea mays
  misc_feature: Incyte ID No: 700611293H1
  unsure 51: a, t, c, g, or other
cacccaatcagatccgattatcgtagagatgaagccggcagtagaggcggnggctgacgagcgagcggcggaggagatggcacctaagaaggcagcgctgccaagaaagcggccgaggaagttgaggtggaggaggtggtggacggggacgaggcggtcgatggggagggcgacggtgacgaggacgacgatggggaaggc

SEQ ID NO: 3308 - DNA, 264 bp, Zea mays
  misc_feature: Incyte ID No: 700611295H1
ctcatctcctccctcttgggctcttgcagtgcaggcctctcctccgatccctcccacggtcttcaccccaccgcctcgaccacacagctagcttaattagcttgcccccctcacgctctcctcgcccgaatggggttcacggcgagctataggcggagtagctggccaatgtgcggcggcgacagaggaaaggtgcggctgcggctcgatggaaggcagcacacgcacaggtaggagaagggcgggcgtgcgaccgagcgtgca

SEQ ID NO: 3309 - DNA, 263 bp, Zea mays
  misc_feature: Incyte ID No: 700611296H1
actcttgattcactcaaggccgcaggtgtaaacccctatccacataagtttccggttggcatctctgtagtggaatacattgagaagtacaagaccttgaacaatgggagaagcttacagatgcgacagaatgtttagctgggaggatcatgaacaagagaacatcatcatctaagctattcttttatgatctttatggtggcggcatgaaggttcaagtgatggctgatgccaggacctcagagttggatgaagcagaattc

SEQ ID NO: 3310 - DNA, 284 bp, Zea mays
  misc_feature: Incyte ID No: 700611301H1
  unsure 2, 30, 268: a, t, c, g, or other
anaagaggtggagaaagtttttagcgttanaatcctgatccacaggaagtagaaaaggcaaagaaagcactgaaggagcaagaacagtcattgattgacgccatagcaaggcttgctgaggcatcagatggtgaaagtgatgggctcaatcgtgggcgaaggaacttgtatgctggtaaccagcatcaagcaaactatgttgatgacatgcccgttggtgaccaagctgatgccatgtaaacactgcatgaacatgtataccaacatnatataactgtctgttg

SEQ ID NO: 3311 - DNA, 278 bp, Zea mays
  misc_feature: Incyte ID No: 700611303H1
  unsure 183, 206: a, t, c, g, or other
gctgaactcagtaagcagttgcaagccacgaaactagaagctactacggtgcgtgtccagcgtgatctgcaggaaaagcttcagatagtggagaaagaaaacaaagacctcaaggtagaattactcgcactgtccaaggacctgaagatacttgcacgggaaagagacctgagcaaccaagcngcagaaacagcaagcaaacttcncctggaaagtgtgaaaaagataacaagagttgaggcagaatgccttaagtgcgtcatttaacgcggcgtacg

SEQ ID NO: 3312 - DNA, 277 bp, Zea mays
  misc_feature: Incyte ID No: 700611304H1
  unsure 22, 24, 26, 28, 31, 33-34, 37, 45, 47, 65, 74, 95, 130-131, 134, 144, 186,: a, t, c, g, or other
ggccagtcaccaatccccatcnancnanacngnnggngatgacgnancaccgtcgacgtgatgtngcccttgtncctccaatacatagccacccntgccctcctcctgctcgtcatcgcgtacgtcgtcnnccngctcttcctngccgccggaggacggcatccgggtcgtctctgcagagaaggncaatcgacctcacgggtcccatcgtcaaagtcttcctaacattgaaggttgagaatgctcccacggnctctgaagcatcacgagttctcng

SEQ ID NO: 3313 - DNA, 275 bp, Zea mays
  misc_feature: Incyte ID No: 700611306H1
  unsure 35, 37-38, 79: a, t, c, g, or other
cagcagtatcagtagttgaggctgctgctcacagnanngactgctacaatgtattgatactgttatgtctgaggttganagattgttgtcttcggaacagaaggctacagattatcgaacaccagatgatggagctgcaccagatcatcggccaactaatgcttgtataagaattgtagcctatctctctcgtgttcttgaggttgcattcagtgcccttgaaggcctcaacaaacagtcctttttgactgagctgggaaatcgcttgcataagg

SEQ ID NO: 3314 - DNA, 272 bp, Zea mays
  misc_feature: Incyte ID No: 700611308H1
  unsure 227: a, t, c, g, or other
ccagccgccacaaagacagccggccgcctgggaacttttttttcttttcttcttcctggccgaccgcacctcccacttctctctattttttttccttgcaccatggcttggcaaacggatctaggctggcttcctctctttctgttcttctcctgctctgttctttgcttctttcttccccaccgaacagctcaaaccggtgagctagccgctgcctgagcgcgcanccggctcacatatccgaggatgaccggattaatgttcaggggcat

SEQ ID NO: 3315 - DNA, 272 bp, Zea mays
  misc_feature: Incyte ID No: 700611309H1
  unsure 170: a, t, c, g, or other
actaaaaaaggtggtcaggccttgcattcacgttttgaatacgtggagaacgagccatcagctgattcgagaactgggggatctgtatctcgtgtgagtggccatgtagcaccaccaaaatcatcagacttctttcaagagtatgggatgggtaatgggttccagaaganatctagcaatgcctcaaaaactcaggttgaggaaactgatgaagcaaggaagaaattctctaatgccaaggcgatctcgtcatctcagttttttggtactca

SEQ ID NO: 3316 - DNA, 259 bp, Zea mays
  misc_feature: Incyte ID No: 700611312H1
  unsure 254, 257-258: a, t, c, g, or other
taaagaagtacggagaaaaccttgctgtcttgagttcaggcgaataccttctgtctccaaggtttagccttcaacctaagggaatctaaaaggtaaacatgatggactcatcaaggagccacaacacgttcattcttttagaatgttcggttattaggtgaagtatacagagctgtaaactggtgatgcacattcatgcttcatctaaaacaaccgaagttatggcttctgatagcggatagcctactcgaggnagnng

SEQ ID NO: 3317 - DNA, 268 bp, Zea mays
  misc_feature: Incyte ID No: 700611313H1
  unsure 4, 22, 34, 39, 41, 70, 95, 125, 137, 162, 188, 193, 205, 208, 216, 224,: a, t, c, g, or other
gcanaccgcatgattatccgcntgatactgtgantgatngntccttcacctcgtgccaatattctgtgtnccaatgccaagtcacatattctgancagcaactggagatttgctcatgtaccgantcttcaaggtcntaggatcatttcgggtgatgaagantctgaaatacatgtggaggggtactnatatngagatgcatggnctnagtacttnagcggtcnagaacttatggtcacctgatgaaacaaggatggttgtgangana

SEQ ID NO: 3318 - DNA, 278 bp, Zea mays
  misc_feature: Incyte ID No: 700611317H1
  unsure 2, 75, 255: a, t, c, g, or other
tnaccatgacgtctcgtttcgttgcggcggcctcttcctcctcgtcctcgtgccccctcgcctgcctaatctctncgccgcggccttgcggtgccgcagacggccatggacctgcgaaggtgcccttgtggaaagatccgttgagcccgagcaagtggaaggaagagcactttgttctagcaagcctctctatgtggggggctcttttttatggtggtttcaagttttttggtggaaagaaggaagacaagattnaggtggcatcaggacagacatag

SEQ ID NO: 3319 - DNA, 274 bp, Zea mays
  misc_feature: Incyte ID No: 700611319H1
  unsure 4, 10, 15, 21, 165, 206, 246, 256, 258, 266: a, t, c, g, or other
attngtttgnagagnagttanaggaagcccaggaagctttgggaatagatccacatgattttgtcccagtaacttatgttgctgaagtaaattggttccaagaagttatgaggtttgccccaacagcattgattattggtctattatatttcacgggaaaaaggntgcagagtggtttcaatattggaggtggtgctggcaaaggnagaggaggtattttcaacattggaaaagctacagtgatgnagatggacangnactccaanaataaggt

SEQ ID NO: 3320 - DNA, 273 bp, Zea mays
  misc_feature: Incyte ID No: 700611323H1
  unsure 196: a, t, c, g, or other
ggagacgaaaggagggagttttgagaagctcaaatggctcctaaagccgctcctgccaagaagggtgatgccaaggcccaggccttgaaggtggccaaggctgtgaagtctggggcaggcaagaagaagaccaagaagattcgcacatctgtaacatttcaccagcccaagaccctgaagaaggccagggacccgnagtacccaagaatcagcactactggaagaaacaagcttgatcagtaccaaattctcaagtaccccctcaccacagaa

SEQ ID NO: 3321 - DNA, 270 bp, Zea mays
  misc_feature: Incyte ID No: 700611324H1
attagaatggcggtgagatctttgaggaaagaagctaggtcgtggttcaatgagatgagcacaggagaggatggccaagatgccatggaggccaaggcctctgcttggtaccatgttacttatcatcagcagtactggggcagctacaatgaagggtatgatcggccgcatcttattagcttcccatggtgcgtatatgacaagcttgtggccatcaagcaggggaggaatctcctcacgcggatggatcgaaacttgaggttccgttga

SEQ ID NO: 3322 - DNA, 267 bp, Zea mays
  misc_feature: Incyte ID No: 700611325H1
  unsure 4, 9, 27, 29-30, 37, 43, 46, 52-53, 65, 71, 84, 90, 93, 110-112, 120, 143,: a, t, c, g, or other
gganctcanagcctattggtggtggangnntagctgnatcatntanagatannagagaaatgaantcactngttcgtctttttngtggcnatngaatagataaaatggannngatgctangggagcatacgtctgcgctttanactgtatcgattcagcattgaggtcaaatcgtgatgccttagatggcctagctggaactgtaaattccggcgataggtngacagggatgtgaacnngangcnnattantgacctcgaaacactg

SEQ ID NO: 3323 - DNA, 264 bp, Zea mays
  misc_feature: Incyte ID No: 700611331H1
  unsure 57, 102, 129, 176, 210, 244, 249, 258-259: a, t, c, g, or other
ggatttcctggcacacatcgctgaatcttgcaaaatagtttcctcatgcatatggancattccaagaagaaagctagggaacagggttggataatgtcagantctctgctcaaccctggcaaggctcgnttatgtgcagcaaaaccacaatgaatgtactgtttcagtttagtaangatgagatgataccaatctcatgtttgtaagacnacttttctaacgagaaggggatggctaagtctangagcntaactaacnnagttg

SEQ ID NO: 3324 - DNA, 277 bp, Zea mays
  misc_feature: Incyte ID No: 700611333H1
aaattatcttctgcaaagggccctgcaaaagggcatgtcatgagaaatgtttggaacctcccttaaacaaaagcgtacttccaacaagtagccatgggtggctttgcaaattctgtttgtgcaaggtgaggattttagaaactattaatgcacatctagggacgagttttacagtgaagtgccactttgaagatatattcaaggaaactactgaactaatagactctgaggatgcactagatgaagattggctttctgagtattcagtgatgaggac

SEQ ID NO: 3325 - DNA, 278 bp, Zea mays
  misc_feature: Incyte ID No: 700611334H1
  unsure 65, 180: a, t, c, g, or other
cagcgattcctctgattcagacatcgaccctgagctggagaagataattgctcagcgcgaggctnccaggaatggagcaaggtggcccaggaaggaaaagaagtcgtccagccaccaccataggaacagcagcagcaagagaaaatcaaagcacacaaggagtaggagtgatgatagtgncgaggatgaaggcagaagaggccgggacaggaagaagatgtccggcagatcgaagaagcatgaaagatctgatgagctagcagcgatgacactgattc

SEQ ID NO: 3326 - DNA, 275 bp, Zea mays
  misc_feature: Incyte ID No: 700611335H1
tgaagagaaaagcgagatggaggagaagaagggccagtacgccaagttctggaatgagtttggcaaatacaatcaagctgggtatcatcgaagacgcgactaacagaaaccgccttgcgaagttcttagatttgagagtaccaagtcggatggcaaacttgcctcccttgacgagtacatctcacggatgaagtcagggcagaaagacatcttctacatcacgggaagcagcaaagagcagctggagaagtctccattcctcgagaggctaacca

SEQ ID NO: 3327 - DNA, 272 bp, Zea mays
  misc_feature: Incyte ID No: 700611337H1
  unsure 27, 267: a, t, c, g, or other
gaacgaatgaggagtaggtcacgcagncccagtgaggcgccatgaccgtggagggtatcaccgccccagcccaagacgtagccgcagccctgcagaaccgagacacgatgtgaatgattggcctcgatcaggtcatggtggaggcgatcctgaccacagccctcctgccaacaggtccagatcgaagagccgggaccccttgggacccagatctcctgatgctgccccagccaagagggagagctccagatacaaccgcaggcgcanagcag

SEQ ID NO: 3328 - DNA, 269 bp, Zea mays
  misc_feature: Incyte ID No: 700611343H1
  unsure 266: a, t, c, g, or other
cttcgacattgtcagcgatctggtcgtcgccagtagcctcaacggcgttcaaaatgccaagcccgcagccacggaagtggtttcccaccaagacacctgtgaagtgcgagccatctgaatcgtgatctactctgatgctgcatcaccaatccagtgtaacttattataaatggttaggtgtcagatgctctgatttaggagtgtttgaatgcactagagataatagttagttagctaaaaaatgttagtggaattagctagctacnatt

SEQ ID NO: 3329 - DNA, 266 bp, Zea mays
  misc_feature: Incyte ID No: 700611345H1
  unsure 247: a, t, c, g, or other
ctgatttattctgtcaaatctattgttttcgaaggtgtcaactggtcatagtgccttgtgtttcggtaagatggtatttttcatgccaacaaatttggtgcttatattgttgtgctatatagatatcatatcataacatgacaaatgctggtgtagaatgcatcttttgacattgtatgttgtgaaccaatagcccattgctatctgttacttgagaggaatttatggctgtcatctctacatctcngttaaaaatttgtaaaact

SEQ ID NO: 3330 - DNA, 270 bp, Zea mays
  misc_feature: Incyte ID No: 700611348H1
  unsure 6, 15, 23-24, 27, 31, 46, 50, 58, 88, 168, 171, 182, 212, 225, 244, 248,: a, t, c, g, or other
gtggangtgcaaggnctctggcnnctnttanagctctcttccctantctncacacaanagaaacaatatctagcaaagaggagctggntccattctctaaatattcttctcgcatggctgcacttgatttcattgtctgtgatgaaagtgatgctttgtggctaacancancggcaacatgnataaaatttggctggacgaaggagatactngggcacaagagancgatccgaccaaatgccanaagntcatccnttattttngacagag

SEQ ID NO: 3331 - DNA, 268 bp, Zea mays
  misc_feature: Incyte ID No: 700611351H1
ggcgatgagtctgtatttgtcaactccaattcaaacagctcgatggtgcctcctgtcctggagaacaatgctgttgatctcactgatgggctgacagatttggaatcctatatgaggtttcttatggatggcggtgcaagtgattcaattgatagccttctgaaccttgatggatcacaggatcttggtagcaatatggacctctggaccttcgatgacatgcccatcgctggcgatttcttctgagaatttgaagcttggccatagg

SEQ ID NO: 3332 - DNA, 268 bp, Zea mays
  misc_feature: Incyte ID No: 700611356H1
  unsure 20-21: a, t, c, g, or other
tcgattggttgttgttgatnnccactgcattgcaggttgagggcaccagcagatacgactgcttcgagcctgggacggtcggccggatggagctcctcgtcctgatggcgctcaactggcggctccgctcggttactcccttcaccttcgtcgacttcttcgcgtgcaaggtcgacccaggagggaggcacaccaggtgcctcattgcccgggccacgcaagtcattctggctgcgatgcatgacgtcgagttcttggaccactgccc

SEQ ID NO: 3333 - DNA, 212 bp, Zea mays
  misc_feature: Incyte ID No: 700611357H1
caccgagagatgtaatcctcgctcgtctttactagcctctcctttttagttgccagaccttctgttcatctacactggctgcagtaactgtacattgaaataatccagtgcgccagcctatgcaggggaggaaaaaaaagaggtgagcttgattaaaaatgtacatgagcagtgacaagaaaaaaaacgctggctgcagtaactgtgcattg

SEQ ID NO: 3334 - DNA, 267 bp, Zea mays
  misc_feature: Incyte ID No: 700611359H1
  unsure 4, 29-30, 197-198, 254: a, t, c, g, or other
acancgtcgcgacgtcctcgtgggctatnncccctccatcacttcttcccgtcgagatgcacaacaccgcgagatccatccaccttctccagcacccccacccccgctcaaatggtgtcgcgatgtccgccaccaacagcgccccttcccccctctcaaacaacgtcgcgacgtctgcgagttctgtaaggaatgannaataactcccagtcgtgattattcttcttcagccttctatccttccgagttctttntggtgcaggtgca

SEQ ID NO: 3335 - DNA, 274 bp, Zea mays
  misc_feature: Incyte ID No: 700611360H1
  unsure 8: a, t, c, g, or other
tgttgatntcgccaagtttgatgacaagtactttgccagggagaagaagcagaaggtgaagaagaccgagggcgagctttttgagacagaaaaggaggcatccaagtcactgcctgacttcaagaaggatgaccagaaggctgtggattctgctctgatcaaggctatcgaggctgtcccggagctgaaaacctatcttggcgcccggttctctctcagggatggtgacaagccccatgagatggtcttctaagcttctagttttggagttcgt

SEQ ID NO: 3336 - DNA, 266 bp, Zea mays
  misc_feature: Incyte ID No: 700611361H1
ggtcatcttaagttggcaattgacgacgataaaaggagcattgtggccctggattgtagaggaacatttgaagagatgcacgtgcctcacgaaactgccttacttcatttcttctagaggatttatgaagaccaattcgttattccatgcatttaatgctgccgctgagggttcagcattctctacgcgtggactcagcagagggtgataaaaagttgcagagatgttggacatgcggattttaacaagccattctgatccatcta

SEQ ID NO: 3337 - DNA, 278 bp, Zea mays
  misc_feature: Incyte ID No: 700611364H1
  unsure 3, 17, 22: a, t, c, g, or other
acnttccaacagatgtngatancaaaggaggagtacgatgagtctggcccggcaattgttcacaggaagtgcttcctaggtttctgccaagttcgtcaagtgcttttagggttcgccaagttcatcatcgctacctagtcttaagttatgcccccttcatttcctgagatatgtgtggcagatttgcatcgttttggtatttcgtggctccatgtgtgagcatgctgtgtcctataacctggtttatgagatgagttgttaaacttgcttggtttgat

SEQ ID NO: 3338 - DNA, 274 bp, Zea mays
  misc_feature: Incyte ID No: 700611366H1
  unsure 65: a, t, c, g, or other
gtttactactgaagcacgcaccgcagcgtctccaccttctgctcaacctccgcttccgtaggtgnccggcgctaagcgaggatccctccgttcatcggtcccgacggcacctcgactcgtttcgtcggtcgctgtggcgacgggtgattgactgcgatatgaggcaatggttatgttgtaactgccactttgatgacgaggaagatggccatgacaaggaacaggccaaagctcagagcaataagatagacccaagcagaagtcttcaaaacct

SEQ ID NO: 3339 - DNA, 265 bp, Zea mays
  misc_feature: Incyte ID No: 700611374H1
  unsure 2, 4, 10-12, 17-18, 21-22, 25-26, 28-29, 45, 49, 57, 61-62, 66, 187, 259: a, t, c, g, or other
gntncctctnnnctcgnntcnncgnntnnccctaggggatcgtcngagnggaatcgnaacnngggncgtctcatccgacttaaggaagccatggagcacaaggaagctgggtgccaggcccccgagggacccatcctctgcatcaataactgtggcttcttcggcagcgcggcgaccatgaacatgngctccaagtgccacaaggagatgataacgaagcaggatcaggccaagctggctgcctcctctatcgacagcntcgtgt

SEQ ID NO: 3340 - DNA, 265 bp, Zea mays
  misc_feature: Incyte ID No: 700611377H1
ggggtatcttgaaatatccgatgttaactgtgaagcactcccagaagctctctcgcgttgttggaacttgcaggcccttcatgtattagcatgctcaaaacttgcagttgtacctgaaagtatcggcaagcttaagaagcttagaactctggaactgaatggtgtttctagtatcaagagtttaccagagtctattggtgattgtgataatcttcgaagattatacctagaaggttgtcgtggaatcgaagatataccaaattcc

SEQ ID NO: 3341 - DNA, 144 bp, Zea mays
  misc_feature: Incyte ID No: 700611378H1
  unsure 2, 58, 70, 85, 90, 96, 109, 111-112, 119, 122, 132, 136, 138-140: a, t, c, g, or other
ancaaatcagatgtgggaagatcgtcaaaaccactatgcttcctaatttgttattgtntttcttgctgtnatttttatttatggncattnatatanggacttaattaangnntccacanatngggtgggtantccngnnnaagg

SEQ ID NO: 3342 - DNA, 272 bp, Zea mays
  misc_feature: Incyte ID No: 700611381H1
  unsure 2, 7, 50, 98, 173: a, t, c, g, or other
tngctgntgtgccccacatgtttatcaatgggtacaagaacgtgcttgcngttgctgtggagactgactactcgtacccacacgccgacaagatcaancagtacctcaaggacccgagcaagtttgctgttgctgctcctgtagctgctgcggactctagtgctgctgctgcncccaaggaggaagagaaggctgtcaagcctgccgaggagtcggacgaggaaatgggcttcagcctgttcgacgactaagccgctcttatcgtccatccg

SEQ ID NO: 3343 - DNA, 299 bp, Zea mays
  misc_feature: Incyte ID No: 700611383H1
  unsure 4, 6, 16, 19, 22, 33, 63-64, 81, 125-126, 130-131, 185, 187, 196, 208, 217,: a, t, c, g, or other
cagnanagcaatagcnaanagntcccacagcancatcagcttcaggaacctgctgtctctagnnagcaatctcaaagttcnaaatacaacatgcttcaacaagaaaagccaggaattggaagtanngccnngctgatgggggcataccaaatttcatttgggggagctgtaacagatcagacaancngatagaganagaagctcaggntacatcctntggtaggagctaatnagttncagnggaanagccnagattactgnctgggtgcctctacccaaagttctggcnacccatccgg

SEQ ID NO: 3344 - DNA, 265 bp, Zea mays
  misc_feature: Incyte ID No: 700611386H1
  unsure 28, 234: a, t, c, g, or other
tgaaggtaaaaggaatatatgccatttncttcatatcttcatccaaagggatatatgccatttccttgcatgggtcaaataaactgtactttgcactcttgctaggaaatggcatatatccctttggatgaagatatgaaggtaaaaggaaaggcagccattgatgttgtttgcaacccactgggcaagtcgggcggcgcacttatccaacagttcatgatcctgacgttcggncccctggcaaattcgactccataccttgggg

SEQ ID NO: 3345 - DNA, 264 bp, Zea mays
  misc_feature: Incyte ID No: 700611389H1
  unsure 153, 197: a, t, c, g, or other
aagtacctctcgtgacatatacattgatagtcggtcacattctgggactatgaattccaattggagactctctggtactaacgccctcagcgtcaaccttgctgcatttgagaagcgactgcagaaactcacctttaatgatcttattgtggncaccaatggcttccacaatgatagcctagttgggtctggtggtnttggtgatgtctataacgcccagctcaaggatggaaaggttgttgcaatcaagaagcttatacatgt

SEQ ID NO: 3346 - DNA, 181 bp, Zea mays
  misc_feature: Incyte ID No: 700611390H1
  unsure 3, 7, 29, 35, 49-50, 61, 70, 75, 83, 96, 103, 133, 137, 145-146, 156, 158,: a, t, c, g, or other
gtncgcngtggcgcctgctgggaaggctncccagnctgcggcgagccannaagttcccgancaagcccgntcctncctcgcanacggttcgggatncagactnggtggctcatcagctcgtggaggctttggncgtngtgaacgnngccgtggcanangtgaacggggatatngccanaac

SEQ ID NO: 3347 - DNA, 262 bp, Zea mays
  misc_feature: Incyte ID No: 700611392H1
atacaatgatgatactatgattttattctggatatgatgatgtacttgtggcatttaggggactcgagcagtttctcgagtacctctccgtaaggacctgttcgttgagagaccacccgggataacagtgcaaccatgagggtgaaatgagatgcccttagctaattaattagaggaactagaggtgtagttgcttcgccgttgtgccgtcaatggggtccaggcacagtgcttgctctgccgaggctgagtgccgaggttc

SEQ ID NO: 3348 - DNA, 94 bp, Zea mays
  misc_feature: Incyte ID No: 700611395H1
atcggcctgtgcaagggaacatatatcctgttgcatccgagtgtccaatgtattggaagttttttatcccttaatatattccatgctccgatag

SEQ ID NO: 3349 - DNA, 266 bp, Zea mays
  misc_feature: Incyte ID No: 700611396H1
  unsure 171, 191, 248: a, t, c, g, or other
aagagatcagtgaagcccagcccttgccttgaagacggcgctcctttcccccaccagcaccagacactgaagggggtaatgatgaagtatcagttcaagagatcagtgaagcccagcccttgccttgaagacggcgctcctttcccttcaagctcggtttcttctcccggnactggcgatcttccagatgntgttgttgcacagcaggtccggatgagtattcctattgggtatattttagtgcatanatatcgcaagcggactac

SEQ ID NO: 3350 - DNA, 277 bp, Zea mays
  misc_feature: Incyte ID No: 700611401H1
gaggataaatgctggcaaaaaaggaggatcaaaagctgcacccaagaaaccacgtaaaaaggctgcatctaaaaagctggatagcgatacagaagatgatgattttgaaccagcggttgcaaagcgtggagctcaaccgaagaaaacatccagcaaggcaaatgattctgcgtctgaagatggagattatgtggctgctgaaaatcaaaagaaacaatccaagaaagcaagtgcccatgtggacgaagaagttgacatgccttcgttaaaagaccgc

SEQ ID NO: 3351 - DNA, 271 bp, Zea mays
  misc_feature: Incyte ID No: 700611402H1
caaaaaactccaacagagagctccaaaatcactaagaaggtgggagcggtgtgggcaagttaaagtggttgtgaaaatagaaagcgaggaagacatgctagttttacaagggagagcaaagtctttaaatctgccaactcacataaccatagacgctggaagaacacagattgctccaaattcaaggacagtcatggctattctggggccagctgatatggttgatgatgttactggcggtctgaagcttttgtagaaaaccaccttgtca

SEQ ID NO: 3352 - DNA, 268 bp, Zea mays
  misc_feature: Incyte ID No: 700611403H1
agattctattggcacggtgctcaagtgtatgcagaagggtgcggtggacttccttgtgaaaccagtaagaaagaatgagctgggtaacctgtggcaacatgtgtggaggaggcatgcaatgaattgccagacaaatggatcagaaaataatgcagccagcaatcatgtaagtaccaatgttgctaatgggtcaaagacaggagaaaacaatgatgaggaaagtgatgcccaagtgctccaagtgaaagtgagaagaatgtgcgttcca

SEQ ID NO: 3353 - DNA, 266 bp, Zea mays
  misc_feature: Incyte ID No: 700611404H1
  unsure 139, 183: a, t, c, g, or other
ccccaccagcaggcggccccctcttactccacgaccgccaccgtcttctggccgtacgcgactcgccgcagaaagagagccgaggacggcagcgacctctcgctggcgtcggatatggatctcgacgccgacgcgcagncgccgcagataagctgaaagcagtgtcagaggaacttggacatnagatccgggtttttttcaagtgagaactttgctctacaaccgagcaagctgcctagtgcagatcatgaggaaggtgacgactt

SEQ ID NO: 3354 - DNA, 264 bp, Zea mays
  misc_feature: Incyte ID No: 700611405H1
  unsure 58, 70, 98, 123-124, 127, 143, 173, 191, 251: a, t, c, g, or other
cagcagtatcagtagttgaggctgctgctcacaaaggactgctacaatgtattgatantgttatgtctgnggttgaaagattgttgtcttcggaacanaaggctacagattatcgaacaccanntgntggagctgcaccagancatcggccaactaatgcttgtataagaatngtagcctatctctctcgngttcttgaggttgcattcagtgcccttgaaggcctcaacaaacagtccttattgactganctgggaaatcgct

SEQ ID NO: 3355 - DNA, 263 bp, Zea mays
  misc_feature: Incyte ID No: 700611406H1
cattcggttcaaactgaggtcgacatatatgctggataaagacaactttgccttgtactatgtggtattgccctgtgctgtgctagcgctacttgttcatccttcaacatcgcacaacattgtgaacagaatctgctgggccttctgtgtttatttggaagcagtttcagtgttgccccagttgcgcttgatgcaaaataccaagattgtggagccgttcacagctcattatgtgtttgcgctgggtgttgcaaggtttctta

SEQ ID NO: 3356 - DNA, 266 bp, Zea mays
  misc_feature: Incyte ID No: 700611408H1
  unsure 69, 129: a, t, c, g, or other
gcaggcgctggtggactgggtcgacagggtgggcggggcggcgtcgcggccaccgtcttcgacttcacnaccaagggcatcctcaacgccgccgtcgaaggcgagctatggcggctcatcgacccgcanggaagtgcgccgggagtcatcggctggtggcctgccaaggccgtgcacctttgtcgacaaccacgacaccggctccacgcaggccatgtggccgtgtcccctccgacaaggtcatgcagggctacgcctacatcctc

SEQ ID NO: 3357 - DNA, 264 bp, Zea mays
  misc_feature: Incyte ID No: 700611411H1
ggattattctgatctgactaaaatgatcagccgctgtgtgaaactccagcgtctttgggtactggactgcatttcagacaagggtttgcaggtggtggcctctagttgcaaggatctacaagaactcagggtgtttccatcagaatttaatgttgctggtgcttttacggtgacagaggagggacttgttgcaatatcatcaggctgcccaaaactgagctctttgctgtatttttgtcaccagatgaccaatgaagcactaac

SEQ ID NO: 3358 - DNA, 146 bp, Zea mays
  misc_feature: Incyte ID No: 700611412H1
  unsure 13, 21, 32, 49, 66, 68-69, 72-73, 79-80, 90, 104, 115, 127, 139, 144: a, t, c, g, or other
gatccaagaggtnccagcaangaaggttactnccctgaggttcaccganacggcaagggccaggantnncanngctggnngggagtgccncacattcgaccagnttgctctccgngctccactacgnaaggaacacagncctcntg

SEQ ID NO: 3359 - DNA, 145 bp, Zea mays
  misc_feature: Incyte ID No: 700611414H1
  unsure 4, 32, 44, 52, 54-55, 70, 75, 122, 128-129: a, t, c, g, or other
aatngtagaggataatggcgatgaagataacncccgtggatganatagcttngnntttaggctctgcggnattcngtgaatcatataattgtagaggataatttttcgtgctacaagtgctngcatannactatgtttctgtttt

SEQ ID NO: 3360 - DNA, 272 bp, Zea mays
  misc_feature: Incyte ID No: 700611415H1
  unsure 35, 37, 151, 156, 180, 262: a, t, c, g, or other
cacagcctctcaagatccgtgctgatatagagatncnatgcttccagtttgatggagtgctccatattaagcaagctatgaagaaagctgaagctgcgggcaatgataactgtcctgtgaagattaagctagttgctcctccactttatgntttgnccacacagacccttgacaaggatnaatccatttcagttctcactactgcagtcaaggcttgtacagcagagattgaaaagtacaaaggaaagttagtagtgaaggnaccaccaaga

SEQ ID NO: 3361 - DNA, 69 bp, Zea mays
  misc_feature: Incyte ID No: 700611417H1
  unsure 2, 4, 7, 26, 35, 40, 43, 47: a, t, c, g, or other
cntnacncgcatgttatgttattgcnacagatctngtatnaanggcnagctcatggctgagatgccaat

SEQ ID NO: 3362 - DNA, 264 bp, Zea mays
  misc_feature: Incyte ID No: 700611422H1
  unsure 33, 35, 126, 134: a, t, c, g, or other
caccgagttcaatagaagacttgacgagtgggnanccgcttgagcagcttgatcttgctactgtcgagaccgatgttgatgagaaagtcgaagataaggcaacaagcttaaagatgacacggcacnagaagcgnacaattgatgaaacacatgtggagcaaggacatgaggagcttgatgcagccagcttgcgggaacatgaagaattcacaaaagtgaaaaatattgcaaagattgaacttgggagatatgagatagatacat

SEQ ID NO: 3363 - DNA, 267 bp, Zea mays
  misc_feature: Incyte ID No: 700611425H1
  unsure 16, 18, 26, 36, 43, 150, 157, 186, 243, 264: a, t, c, g, or other
tgtcctcatcaccgananccaattgnagaaaatgcncaagcgnaagactgacagagcacatgttttagacaaggctaagcatctttcaaggctaaatgttaaggaggcaggaaaagtaatgttgaaacgtggtgaaggaaagcttgcaangcaattncgcatgagctgtgtgggatgtgacctttntgtctgttaccgatcagactgaggatctggaggttgcccctttcatatacgttattnacggagcactgagttcagttnctg

SEQ ID NO: 3364 - DNA, 128 bp, Zea mays
  misc_feature: Incyte ID No: 700611427H1
  unsure 11, 19, 22, 24, 26-27, 31, 35, 78, 88, 92, 112, 116, 126: a, t, c, g, or other
gcatcaaggtnatcctacnaantncnntcancaanaaatgttcaaagatgcacttccagatgtcggaaattcaagaantggatccgantaanaatgccttctttgggatcangcantgatggtccntg

SEQ ID NO: 3365 - DNA, 265 bp, Zea mays
  misc_feature: Incyte ID No: 700611429H1
  unsure 231: a, t, c, g, or other
ggaatggccgaagcaccatttagggccatggatgagtttgatgtattcatggatgcggtgagccgcaaaataagcttagacaccctagtagattttgctgtcgcacaagggtctcaatggatatttataacccctcatgatatcagcatggtgaaggctggggataggatcaagaagcagcaaatggctgctcctcgcggttgacagtgttgagacccctgacccttgtanatgaagcctgagagccttgggcatgggagtgaat

SEQ ID NO: 3366 - DNA, 279 bp, Zea mays
  misc_feature: Incyte ID No: 700611432H1
  unsure 28, 60, 65, 98, 105, 146, 148, 158-159, 179, 256, 260, 264, 271, 275: a, t, c, g, or other
catatggttctacgacctacacgtactngctgctactactgcgtgctaactttaatctgntggcngtccacagctagctagcacatgcacctcctgtncgtaatntgcttatctatatgtgcaccgaccggaaccggaggcgtgcntncgctgatctnncacgaagcctactagtagtnaaatgtaacgtaacctgcaggcaattaagcagggcgctgctagatatagcgtaattaattgtgcgtatgggtatggnggtncgantatcggntgtntaat

SEQ ID NO: 3367 - DNA, 273 bp, Zea mays
  misc_feature: Incyte ID No: 700611433H1
gatcatagttgtgtgatagaaagtatgtaccttgcggtatacacgaattgtccaaatcagattcagacctgattttcaagattttctctatctcttctgctaaattttcagcatttttagtagaaataaagtatgcttcatcggactgtgatgctcgaacagctattctgttgaaaattctgcatagagtggaatagcgatttgatatcttgactttaggatcctcatgtatattgcacatgctgcttatatgtaggacttttgcatcaacag

SEQ ID NO: 3368 - DNA, 267 bp, Zea mays
  misc_feature: Incyte ID No: 700611434H1
  unsure 115, 151, 200, 207, 212, 250: a, t, c, g, or other
cagctcagactgcgtgtagagatcacgcaacttctcaaggaggccagtgctttgtcaacgccctcgacgtttgcgcaagccgcaaaactgaagcggttggctggtgctaaagagnaggagctggcaaaaagtaagcgttgaattcctcagncattgcgtgggttcttgctgttcttgtttgggccgattcgggttgctgnactcttnctttngtccattttatagtgcaagatgtggacattagaggganacagtctttatatgaaa

SEQ ID NO: 3369 - DNA, 264 bp, Zea mays
  misc_feature: Incyte ID No: 700611442H1
ggagatctttgggaatcattcagggaatggagtgcttatggggccggtgttccacttgtgctaaatggcagtgactctgtgattcagtattatgtgccatatctttctgctatccaactatttgcagatccatcaagacctgcttcaagaaacagtgagagcagcattgagaatgacgttgagcggctaagagtctcatcatcactggaaggtaaacatcgactggaaaatggtggcatacgaagtgatgatggtgaaggcgat

SEQ ID NO: 3370 - DNA, 266 bp, Zea mays
  misc_feature: Incyte ID No: 700611444H1
  unsure 126, 129: a, t, c, g, or other
cccatgggtgtttttgaatatgacaagttcgctataggaactgaggctgtggcaaagaagttggcagaacttagccgcaagggtgtgacaactatcatcggaggtggagactctgtcgccgccgtngancaggtcggagttgctgacgttatgagccacatttccaccggaggtgttgccagcttggaattgttggaaggaaaggagcttccaggagttactgcattggatgaagcagccactgtgactgtatgaagcaagttttc

SEQ ID NO: 3371 - DNA, 269 bp, Zea mays
  misc_feature: Incyte ID No: 700611449H1
agaggaatcaccaaaatggacatgacagcagtaacatgttgtgaggagaacaacattcctgtcgtcatctttaacatgttggagcctggtaacatctcaagagcaatttgtggagatcaaataggcaccttagttgaccagtcaggaaggatcacataaaactaggaggatgaatggtagcagagctccaggacatgccgatactctgggtgggacatcactctggggggacatcctgaattctttgctcgtggatcttttccgtatag

SEQ ID NO: 3372 - DNA, 265 bp, Zea mays
  misc_feature: Incyte ID No: 700611451H1
ggtaaaaactagactcaaaggacatcaaaggaggataactgggttggcattctccaccaaccttggcatacttgtttcttcaggcgctgatgcacagctctgtgtgtggaccaatgacacctgggaaaaaaagagaacagtctcgatacaaatgccagctggaaaaactccttcaggagatacacgggtccagtttagttctgatcaaagtcacttgctagtagtacatgagactcaactagccatatatgacgcatcaaaaatg

SEQ ID NO: 3373 - DNA, 263 bp, Zea mays
  misc_feature: Incyte ID No: 700611452H1
catcatatatatacacacacacctcaaaacatccaaaattacaaatagacttaaccatccaatatcatcatttgcatacaaattccaactgcacaaatcgaaatcaaaccgaaaattttcaaaaggaaaacgaaaaaggtcaaaaccagataatccgagagccttttgtaacgtgcgtgcgtttaattacaaggaacagtccgtcgcttgagaaaacttgctactcatcatcaccggccttcttcgatgacagagcccaggaa

SEQ ID NO: 3374 - DNA, 258 bp, Zea mays
  misc_feature: Incyte ID No: 700611454H1
  unsure 2, 4, 21, 23, 25, 42, 55, 162, 197, 209, 221, 247-248: a, t, c, g, or other
tnanatgatctgtagaagttncngnagtgcacccaaagttantgagttgtgaatnggatcgtcgacatgcatgttgaagagtggggacgcatctgaacctgtccgtgctgatatctgccgctgtgcatctgtaacagactgaacgttttgctggttccagcnttcctgcgtgttggtaactagactagatatatggncctttggtgggncccaaactgttnagctggagaaatgaagtgattattcnngcatgatttg

SEQ ID NO: 3375 - DNA, 262 bp, Zea mays
  misc_feature: Incyte ID No: 700611455H1
  unsure 2-3, 6, 21, 24, 31, 50, 54, 58, 79-80, 87, 110, 116, 123, 137, 145, 156,: a, t, c, g, or other
gnnctncgtaaatgttggtcntgnaaaagcnccatacaaccagaagattntggncagntggaggaatgctggatctctnnatgcaanccctcctggctccaatgacgatnggtatnggctgtntgcagctgtcagtngccgatcnttgcttgttananntgatgagatgcgagaccacttgtnccaactgcttggcactagttttttccctaggtggaaagnnaaacatcaggtcagactaactttctccgggcatggccct

SEQ ID NO: 3376 - DNA, 263 bp, Zea mays
  misc_feature: Incyte ID No: 700611456H1
atggaggtgcaaggactctggcacctcttaaagctctcttccctaatctccacacaaaagaaacaatatctagcaaagaggagctggctccattctctaaatattcttctcgcatggctgcacttgatttcattgtctgtgatgaaagtgatgcttttgtggctaacaacaacggcaacatggctaaaattttggctggacgaaggagatactttgggcacaagagaacgatccgaccaaatgccaaaaggctctatccctta

SEQ ID NO: 3377 - DNA, 265 bp, Zea mays
  misc_feature: Incyte ID No: 700611458H1
  unsure 35: a, t, c, g, or other
catgcgctcgcggtgacggcgaacagcagagacgnctgccactctcccctccaacctagaggctagagcactggacttcggcactcccgaatcctcgaagaagagagagagggccttggcgttgttccaggaggaggccctcggtgccaggaaaagcccggacccggaagctcagatgaccagcccatcttctgttctgagcccaccgccgtcgttgaaacggagaacgattcgggactacttcgctgccagtaccgtgtcttga

SEQ ID NO: 3378 - DNA, 263 bp, Zea mays
  misc_feature: Incyte ID No: 700611461H1
gaaatggtatgacccgtccatccaaatattttgaacagtgcagagaaaactgttgaggccttttattctcttcatagctgagatttgcattatgtgggtagccacctttatcttctctagttcctttttttaacttgatgttgtgttatcacttaagtatatttatgtgtattcaggaatcatgagtattactatagtcatgaaccaacctttaaaatacctatgtgggtgcagtaatctggcaatattattatgaccgatgt

SEQ ID NO: 3379 - DNA, 77 bp, Zea mays
  misc_feature: Incyte ID No: 700611463H1
  unsure 2, 6, 17, 23, 32, 37, 60, 62, 70: a, t, c, g, or other
cnccanaatatatcgangcttcnaggaccttncgggnataacacagtgcgctggtgggcnantagaaatntcattgt

SEQ ID NO: 3380 - DNA, 276 bp, Zea mays
  misc_feature: Incyte ID No: 700611464H1
  unsure 12-13, 17, 36, 40-41, 52, 66, 89, 122, 126, 132, 143, 148, 165, 169, 185,: a, t, c, g, or other
gcccaagagggnntatntactgtcatagaaagatanatanncattccggtangcacatggctgcanttgcactttacgacctgctcttntcatcaaatctgctttccagcctggcagctgancagnaattcnatccacaatangctgnacctgatccttggtganattnttcagggacagaggcngccccaggnntttacacgganaggtcgagatgccacaagggagnagatcttgcttgaagtatatncacggataggtcgcgnttncacaagg

SEQ ID NO: 3381 - DNA, 212 bp, Zea mays; identical to SEQ ID NO: 3333
  misc_feature: Incyte ID No: 700611465H1

SEQ ID NO: 3382 - DNA, 266 bp, Zea mays
  misc_feature: Incyte ID No: 700611466H1
  unsure 180: a, t, c, g, or other
gagtacgatgcaaatgcaaaagctagcagtattgggaaaggaattgtatttggccatttgtttgatgatgttgccagagagaaatttcaaagccattctatctttcagaatagtagggttcaacacatagctgccgaagcagctggactcttatccaaggaagccaatgactcgaagaancactatgcatcaatcggtccattagatctcagtgataaggagcaggattcttcacttgaatctgaagacgactatgatgatgaaga

SEQ ID NO: 3383 - DNA, 261 bp, Zea mays
  misc_feature: Incyte ID No: 700611472H1
  unsure 4, 6, 14, 33, 44, 71, 76, 113, 118, 122, 134, 138, 161, 184, 232, 235, 253: a, t, c, g, or other
agananggttatcnaggggattagggatgggtncgaacaatcanattgtgctctcctaggaggggagacancatanatgcctggtttctatgcagagggtgaatatgatctangtggntttnctgtgggtgttntgangaagaataaagtcattgatgganaaagcattgttaagggagatgtncttataggtcttccttccagtggtgttcattctaacgggttctctctngtnagaagagtactggagaanagtggact

SEQ ID NO: 3384 - DNA, 260 bp, Zea mays
  misc_feature: Incyte ID No: 700611473H1
  unsure 5, 8, 72, 87, 94, 96, 159, 167, 169, 202, 225: a, t, c, g, or other
cgacngantggtggtggagaacttcaagtcgtacaagggtgagcagacgattgggcctttcgtcgacttcanagccatcatcggccntaacggngncggcaagtccaacctgatggacgccatcagcttcgtgctgggcgtgcgctcaacgcaccttcnaggcgcgnantcaaggacctcatttacgccctcgacgaccgcnacaaggaggccaagggccgcaancttccgtccgcctcttctactgccaacccaaccag

SEQ ID NO: 3385 - DNA, 145 bp, Zea mays
  misc_feature: Incyte ID No: 700611476H1
  unsure 8, 41-42, 45, 58, 88, 102, 109: a, t, c, g, or other
gttgattnctggttatctggctgaagttgcaccagacatgnnctntcaagttgccaangtttcagtctttggctgctgctataccggnttatgctcgtccantagatgntgggctttatcgtgctattgacatatatctcaaggg

SEQ ID NO: 3386 - DNA, 270 bp, Zea mays
  misc_feature: Incyte ID No: 700611479H1
  unsure 182, 196, 204, 208, 235, 254, 267: a, t, c, g, or other
agggatccaaataagcaaatttgccctccctacgcacccactgaaatcccttcaccaagttgaggacctcctgccgaatccgagggttcaagcgaccgacggcgaacatggcggcggacggcggcccagcgacgtcggcgctggcaagaggccctcaagcccttccaggaaagagcctccgncgctgagatacgcntagcgaantggnaagccttgctgtacaacaaagatggtncgagcggtggatccgaggnaattcctctgccntga

SEQ ID NO: 3387 - DNA, 264 bp, Zea mays
  misc_feature: Incyte ID No: 700611482H1
  unsure 178: a, t, c, g, or other
atttcaaatctgataaggaatggactgtttggtgttgaggaggctctgagatgttgccatgactgtttatctgctctcgccgccgccgcagcagcaggaatccgccatggtgatatccggccagagaatgtgatccgtgtcaataacggctcaaggcatccatatttcgtgcttattngatggggccatgctatcccagaagatagagaccggcctgtgatgaatctattcttctcatccacgtttgcgctccaggaaggaaaa

SEQ ID NO: 3388 - DNA, 260 bp, Zea mays
  misc_feature: Incyte ID No: 700611484H1
  unsure 4, 9, 14, 42, 47, 91, 109, 131, 135, 154, 179-180, 196, 214, 235, 250, 254,: a, t, c, g, or other
caanctggnatcgncgacgcagaggagatcgctccacttgcnaaggnaaacgtagctactccatgacgcttggtgcctcggaaacacgcgntggtgataggaagcatcntctaggatcctcctggccttgnggcnggagtgagttgttcagtcnacacagtttcgcctctacaacatcnncctcctcctggtggtngtccgaactccgaagcanattccagtgataaaggatganctaagaggtccatgnttcnananaa

SEQ ID NO: 3389 - DNA, 260 bp, Zea mays
  misc_feature: Incyte ID No: 700611492H1
aggaggcctgttgtttcgagtagccgtgatatggtggccactgacagttccgagccttcacgagcacgtgcaaccgacgcaagcccaggggcgttccgcagagcctcaggtcctcagagaagctcacctgtccattccgcagaacagaagcgctcatcctcaggccggcatccgtctaacgtgaagaactacgattctgctctcaaaggcattgaaggtcttcattttgatggcgacgagaggttcagtactagagccgc

SEQ ID NO: 3390 - DNA, 272 bp, Zea mays
  misc_feature: Incyte ID No: 700611495H1
  unsure 227: a, t, c, g, or other
gcactcactggtgacaaaaaagaggaactcagatccttgggtgctcaaatagcttatagagctccagatcccagtcatggctttaagtatgtccgttacgttgttcagcagcacccatattctcttgccgcatggaattcctactataaggtggtatcaagaatagaggacaggtttccacatcatttcaaatatctccttcggacaagagaagcgaatcctgactngtgtgcctccaataatcatatccgggcatcgatttactgctataa

SEQ ID NO: 3391 - DNA, 273 bp, Zea mays
  misc_feature: Incyte ID No: 700611496H1
agagatcagtgaagcccagcccttgccttgaagacggcgctcctttcccccaccagcaccagacactgaagggggtaatgatgaagtatcagttcaagagatcagtgaagcccagcccttgccttgaagacggcgctcctttcccttcaagctccgctttcttctcccgcacctggcgatcttcacgatgttgttgttgcacagcaggtccggactgagtatttcctatttggttatatttttagtgcactataatatcgcaagcgaatacaa

SEQ ID NO: 3392 - DNA, 285 bp, Zea mays
  misc_feature: Incyte ID No: 700611501H1
  unsure 6, 8-9, 11, 15, 21-24, 29-30, 33, 35, 191, 232: a, t, c, g, or other
agatcnanncncatncataannnntgctnntanangacgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcgnagccgatggcaaaccgtacgaggaggggccatggggtttcngccatgctggcacggagtacaagattgatctgtgcaggttcgacgagagcttg

SEQ ID NO: 3393 - DNA, 279 bp, Zea mays
  misc_feature: Incyte ID No: 700611503H1
  unsure 94, 105, 110, 114, 151, 229: a, t, c, g, or other
gaaacaaatcttggtctggcccttcgcagcgtgtctgaatcagggctgaaggtggtggaaccatactaaatcgaatcggccatagttagctganattcatatcanctgtnagtngcacagtaaggcattcccgccaagctgtaaaattatngccccgacgagaatgtgtagcatgaatttgaatttcttttctgctattgctgtgtactgttgcagggtagtgccttantgtagtatatgtataggtgcctgagttttatgtatcatcgtgtatgtacc

SEQ ID NO: 3394 - DNA, 284 bp, Zea mays
  misc_feature: Incyte ID No: 700611505H1
  unsure 7: a, t, c, g, or other
gagaagnaccacaggaggagggttatcagcatgcagctgttagacgagtatgcttacgtgatggaagtgggaggaatcatatataccatcactgatgtcgaggagctcggagagtggatgcggtcgtgtctagagaaacacccgttattcgaaaccgttcctgaggaagagattaaggctgaccctgttttcaaattactgtctactgccactgaagaaagccagaaggtggcaagaaatggaggacagactttctatgccatcttcaagcggatctccttaca

SEQ ID NO: 3395 - DNA, 280 bp, Zea mays
  misc_feature: Incyte ID No: 700611506H1
  unsure 209: a, t, c, g, or other
gtgaagcaacggctggcactctaccagggggtcatccctattcacatgcagttctctgacgacgcagaagaaactttctccagagcaattagcagcttgctggtaaggccatgtgctgtgaagtttcactgctgatcttttgcagtcagttcatcagataaacacatctcggctttacttcatcttttttttttgttcttccgtttttnattttgactgattattcatggattgaatgctgaacagaaagcacaatatgtgaagaagggagactacgtca

SEQ ID NO: 3396 - DNA, 281 bp, Zea mays
  misc_feature: Incyte ID No: 700611508H1
  unsure 32, 64, 87, 93, 118, 133, 135, 142-143, 152, 179, 189-190, 195, 210, 234,: a, t, c, g, or other
atacaccgagaagggcttgtgcacatcaggcnagactaggataggcgctgtagtcaacttctcnttcagcgcttcaaaggcctcttngcattnctgggtccacttgaactcaaccttnttgcctagcaatgcngncattggnntcgcaatcntcgaaaacccttcaatgaatcgccganaatatccggnnattcnaatgaagctcttgantcctctagcatctgttggcgcttnccagtncaaaatgtctgccactttcttcggatccacagccaatcctt

SEQ ID NO: 3397 - DNA, 281 bp, Zea mays
  misc_feature: Incyte ID No: 700611509H1
cagagagagcgtgtggatttgggggagcttcttcactggagagtggagagctccggtagcgaggcgaaggaaggaagagggaggaggggaatcagagaggtctccccgatggcggactggggccccgtgatcgtagcgacggtgctgttcgtggtcctcacgccggggctgctctgcacgctgccgggccggggccgcgtcgcagagttcggcagcatgcacaccagcggcctggccatcctcgtccacgccgtcctctacttcgcgctcatcaccatctt

SEQ ID NO: 3398 - DNA, 279 bp, Zea mays
  misc_feature: Incyte ID No: 700611511H1
gaatatagaaggcaactcattgaccaagtggtttcgactgcgttgcctgagagcaagagccctgagcaagtgtctgctgctgttaaggctttcatgactgctgacctgcctcatgaactgattgagcttcttgaaaagattgttcttcagaattccgctttcagtggaaatttcaatctgcagaacctgctcatcttgactgctataaaggcagatccatccagagtcatggactatgtcaacagacttgataactttgatgggcctgctgttggagaa

SEQ ID NO: 3399 - DNA, 282 bp, Zea mays
  misc_feature: Incyte ID No: 700611516H1
  unsure 40: a, t, c, g, or other
attacttttcgacaaaagtgctaatgatgagcatgagagnagtattctgacaaagctcaagcaacagtgcggggggcagtttacttccaaaatggagggcatggttacggaccttactgtcgctagagatcaccaaactaagtttgaagagtttgtagctgggcatccagagttgaatcctggcatagatttggctgttactgttttgacaacgggattctggccaagctacaaaacttttgacataaaccttcctgcggagatggtgaaatgtgtagaggt

SEQ ID NO: 3400 - DNA, 283 bp, Zea mays
  misc_feature: Incyte ID No: 700611517H1
  unsure 157: a, t, c, g, or other
caaacctttgggcactcatcatggacgcaggaactggtttctgttctcaggtttatgagctctcaccagttttcctccacaaggactggataatggagcagtgggagaaaagctactacataacagcaattgctggatcatccaacgggagctcatnggttgtcatgtccaaaggaactccttacacccaacaatcatacaaggttagcgagtcgttcccttacaagtggatcaataagaagtggaaagaagggttccatgtgacatccatggccaccgctgg

SEQ ID NO: 3401 - DNA, 282 bp, Zea mays
  misc_feature: Incyte ID No: 700611518H1
  unsure 36, 116, 142, 144, 154, 166, 179, 206, 212-213, 217, 229, 253, 278-280: a, t, c, g, or other
gaggaaaatgatgatcctgaagttgaaaatgaatcntcagacagatgctggtgatgaagatacacagtggagtagcagaaacagtttctgcagaagagaacggtgatgaatctggngacgaaagtgatattgaacccttggntncaattgattntgtcattgagantaacgatgactangcttctcatccatctgctgaagcttgngaacgnntgcnagctagattagnaaaaagagaccgcttctcgttttncttctatactgaagaatatagtacnnnac

SEQ ID NO: 3402 - DNA, 279 bp, Zea mays
  misc_feature: Incyte ID No: 700611522H1
ggtagctcaatagatctactgctgtcaggggagttaatgcaaagctgagttgctgcacgttggttttcttcagagatggcttcagctggtgtagccccatctgggtacaaaaacagcagcagcactagcattggtgccgagaagttgcaagatcagatgaacgagctaaagattagagatgataaggaagttgaagcaaccataattaatgggaaagggactgaaactgggcacataattgtcaccactactggtggcaagaatggtcaaccaaaacag

SEQ ID NO: 3403 - DNA, 279 bp, Zea mays
  misc_feature: Incyte ID No: 700611523H1
cgtgagtcaccgaggaggtatgcaacgagctagcaagagaggtgggggaagacaaagctgagattgaggccttgaaacgtgactccctgaggttgcgagaggaggtagacgaggaacggaagatgctccagatggctgaggtgtggcgtgaagaacgggtgcagatgaagctcgtcgatgcaaaacttactcttgacgccaaatacacacagctgagcagactgcaacaggatgttgaggcgtttattgccgcacgcagtactgcaaacggagacaaaa

SEQ ID NO: 3404 - DNA, 268 bp, Zea mays
  misc_feature: Incyte ID No: 700611524H1
cgcttttgatcgaatcagaaaattccccaccaaaatctcctccccctgaagtcccgaagctcgcggaagcgccgagatgtaccatcccacgagaggcggcgtccgcggcggcaggcatcaattcaaatgggacgatgtgaaggttgacaagcatcgggagaattaccttggtcatagtgttaaggctccggttggtagatggcagaaaggaaaggatctttactggtatactcgggataagaaatccgacacggaagatgctcttaag

SEQ ID NO: 3405 - DNA, 282 bp, Zea mays
  misc_feature: Incyte ID No: 700611525H1
  unsure 233-237, 239-240: a, t, c, g, or other
ccaacagcctgcttgccgcgcttgcattgaggggagttcggggagcggccggtgcggaaggaaatcgacacggagttcagttcacatggctgctgaatcagagaacggcaactgcaaagcttgggcagcgagagatccttctggagttctctcaccacacagttttaaccgcagagcagtgcaaagcggcgatgtttcgctgaagatcatatactgtggagtctgttatgcannnnngnngcttggacacggaataagctcaatgattcaaaatatcctttg

SEQ ID NO: 3406 - DNA, 283 bp, Zea mays
  misc_feature: Incyte ID No: 700611531H1
  unsure 6, 31, 37, 39, 78, 154, 194, 243, 270: a, t, c, g, or other
ctctcnccctttattcctatcggcgctcggncacctncncgcaccaacccaccagcccccgcattcccgggtgcctcncttcgctttgcgcgcgattccgatccaggctttggttggaggcatggcctcgtcgcccgcgagcagctacgactgntccttcaaggtcctgcttatcggggattcggccgtcggcnagagcagcctcctcgtcagcttcgtctccgccgctacacatcgacgacnacatcgacgccaaccataggggtggantttaaaatcaaat

SEQ ID NO: 3407 - DNA, 280 bp, Zea mays
  misc_feature: Incyte ID No: 700611533H1
caatggggaatatgatggatgaaaatcttatccctcttgaactatagcagtagccggtctttgtctttggctctatgctacctgcttgtttaattgcaacaaagatgaacggtctctcatttaagctgaacctctacctgtattgatatccctggattttttctgagccaccacctgttgtgatttgtgaacgttgtaagaataggtttctttgcttgggttcgcttgttgctgtcgaaaatatgtaacgaatgttattaataaagaatttcttgtatga

SEQ ID NO: 3408 - DNA, 277 bp, Zea mays
  misc_feature: Incyte ID No: 700611534H1
  unsure 3, 6-9, 11, 13-14, 16, 21, 221, 230, 233-235, 238-241: a, t, c, g, or other
tancannnncnannancagcntgccgttggattctctggtgttctgattgccatgaaggttgtgctgaaacgcctggtcagacgatttcgtgtatctgcacgggatggttattccagcgaaatacgctgcctgggcggagttgatcctcatccaggtttttattcctgggacatcctttcttggccatcttggtgggatacttgctggactggtttacctntggctgaangcnnnacnnnntcaaaccagatccgatcactctttgatctcaagcgt

SEQ ID NO: 3409 - DNA, 279 bp, Zea mays
  misc_feature: Incyte ID No: 700611535H1
  unsure 17, 78-101, 164-193: a, t, c, g, or other
gaagaatctagctaggngcaggccgcctacgccatcggccgtccacagcaacatgtgctccggctcctggttctggannnnnnnnnnnnnnnnnnnnnnnnagaagcgcccgtctcttgtcgtcgtcaacctcgagcggcagctaaagaagacgctggccgtcnnnnnnnnnnnnnnnnnnnnnnnnnnnnnnaggttgcgagccggaggagcagaggccatggagatggtgaacctgaagctgtacctggagaaccggtgcatcatcgcggagaacga

SEQ ID NO: 3410 - DNA, 234 bp, Zea mays
  misc_feature: Incyte ID No: 700611537H1
  unsure 146, 168, 192, 224, 228, 233: a, t, c, g, or other
gggccgtcaccaagttcacctcctcctaggcttgcacgctcgccctttgtaggcttctcttgtgttgatgttcgccttgtgttgtagttagatgttgctggtttctctgtcggcgctgctctgcttctgtaggaactgcgtcatgnaacctagcaaggacttgtttanttgtgaatcatcaacacttgttgntgatcacttatgttccaaattctgagtttganaaanaaaanc

SEQ ID NO: 3411 - DNA, 279 bp, Zea mays
  misc_feature: Incyte ID No: 700611538H1
  unsure 24, 89, 93, 96-98, 150-152: a, t, c, g, or other
ctccttcacctttatcattcaganggtaaaggagttgttattgctccacatgtggagcaataacaactccttcacctgtggctgggcanagcnttnnngggggacagtgtggaagattacaaaagatggggaggatgttgtgtatgctgnnnacttcaaccatcggaaagagaggcatttgaatggcaccgttcttggatctttcgtgcggccagctgttctgataactgatgcttacaatgctttgaacaaccaaggctatagaaaaaagcaggatca

SEQ ID NO: 3412 - DNA, 278 bp, Zea mays
  misc_feature: Incyte ID No: 700611540H1
  unsure 60: a, t, c, g, or other
gcccttgtggcaatgcgcacagagaaggcacaacttgtgcttcttcgtgagattgcgcanagcttgccaaagatggagttccagttgggccgggagctggggcggggccaggtgtacaccatttacctagaaaacacacagttgggattgtagaaaggagattcacagaggacaagaaggcgatacttgtgaagacattttccatggctgccttgtttaagtggatcctcgctttattgggcaagaaaaagaagctatctcaaagcaggtatactttt

SEQ ID NO: 3413 - DNA, 279 bp, Zea mays
  misc_feature: Incyte ID No: 700611541H1
  unsure 198: a, t, c, g, or other
agctattaaaacaacagataatgccgcgaagataaaaaaggtgctaaacagagtgcggcttgctttagttgtcattgcagctgtgatgcttcttctggcatttgttggcttcttgttatccatctttggtctggaattccttgtctctgtcttggttattattggatggatattggttactggaacgtttatcctgtncggtgtatttcttcttctgcacaatgttgtttcagatacttgcgttgcaatggaagagtgggttgctcatccgacagaaca

SEQ ID NO: 3414 - DNA, 277 bp, Zea mays
  misc_feature: Incyte ID No: 700611544H1
  unsure 2, 15, 25, 28, 31, 36, 41, 55, 65, 82, 110, 122, 147-148, 153, 188, 190,: a, t, c, g, or other
cncaaaacaacaatntcatcattcnaanagngtcanacaanaatttcaccaccangacaacaatnttggtattcaagtagcntcaagttattggacgataatacaagcantatttgtggaangataatgcacaacattctagcaacnntatantttacccgcgatgagcccaagacttgatcacttgntntgatntcntnctanggncgtaaancgtttgtggcatnttgttatanacgcacagattnaccatgtncttgatgaacaagccatccnt

SEQ ID NO: 3415 - DNA, 288 bp, Zea mays
  misc_feature: Incyte ID No: 700611546H1
  unsure 3, 10, 15, 20-22, 36, 67, 74, 82, 87, 93, 96, 103, 119, 145, 171, 195, 211,: a, t, c, g, or other
gancagagantgctngaacnnncatcaataacctanggctcactatgctcagcaagcattgttaagntcaacangcaagttncgcantgttcnagngacttcntacagttcgagatgcnaaggtacctgttcactcttcggagcnacctatacaattgtgcaaatcctaancaaggcctggctggtagtttggangttcctatggagttgncattgcccaagctggacccattngtcagtatngaggatcctgcnnaagagtcattgcccatgncagacccacnggtc

SEQ ID NO: 3416 - DNA, 276 bp, Zea mays
  misc_feature: Incyte ID No: 700611547H1
  unsure 125, 128, 210-211, 216: a, t, c, g, or other
tccttctaagactgtgaagccacttgatggtcctcagtcagattctattacagagaataatcagccttctccagaagctacccttaatatccagaacaaagtgcaaagtagttccaccagaaggncangaaggttcataagcaaggtagtgccctcggcaggtcgattgatctaacaaagttcgcttgctatgatgagctgattgctgannagganagatgtttgacttcgatggtgagctgaagagtccatgcaaaagttggttagttgtctaca

SEQ ID NO: 3417 - DNA, 245 bp, Zea mays
  misc_feature: Incyte ID No: 700611548H1
  unsure 5, 7, 9, 15, 20, 27, 36, 39, 42, 44, 46, 60, 71, 79, 85, 95, 99, 107, 149,: a, t, c, g, or other
ggagncnanggcgcnagagnagcagcngcacgcggngcngangnancggctctaccaccncgagcttgccnccatggcnagaggnttgaagaagnattngaagaggntcaatgcgcccaagcattggcatgctggacaagcttggcggngttttcactcncaagccatcttcnggacctcacaagtctagggagngccagcnactgatcntcatcatnaggaanaggntcaagnatgctcttaca

SEQ ID NO: 3418 - DNA, 279 bp, Zea mays
  misc_feature: Incyte ID No: 700611549H1
cattattctgagcggtcatctcaccaagaagagcatgcaaacttctcaggaaacaaacgccgacttgaagaagataagtttcaggaaatgcttgcagagttagctaattctgagcttcggatgtctgtatggacggatgatgtctacagctttatgcgctcgcaaaagaggcgtcgaattcaaagttctgacatttctcaagattttgatgcaatgagaaagcagctagtatcagatgctgcaagagtatgtaggtcaaaagttccggagtcgctgatg

SEQ ID NO: 3419 - DNA, 277 bp, Zea mays
  misc_feature: Incyte ID No: 700611551H1
  unsure 15, 70, 185, 191, 227, 245, 248, 275: a, t, c, g, or other
gagaggcgttccgtnccatccaagctgatggcaacgagttctccagggcggcggcgcacgggcacctacntgcctaccagaaggcctccgcaccgagctcttctcatcgccaccaacaccagaaggcttccgcccctctctccagtgtctctttctctctccatcgcatggctctcgcgtgcgcnactcangcgcgccgcttcctcctcgctggcccggcgagatcnttccacgcccagccctancangccaaggtcggcgtagtggagttcttnaa

SEQ ID NO: 3420 - DNA, 277 bp, Zea mays
  misc_feature: Incyte ID No: 700611552H1
gcagaagaaaaaggttctgctgatgagaaagatgaagatgaaggtgaccagaagatggaagagaataaggaggagactccgaagaataagaaagcaaggagtgccagggatagaagccagggaaatgataataaacatgatggatcaaaatctagggaagccaaaagtttgctgaacaccccaagcccatatggtaccgatcgtcctcaacgtgagaggaaaatagtggagaggttggttgaggtgattgagaaagagccaaacaggaatttcgtgg

SEQ ID NO: 3421 - DNA, 276 bp, Zea mays
  misc_feature: Incyte ID No: 700611553H1
  unsure 20-21, 31-33, 41, 186, 197, 208, 265: a, t, c, g, or other
gccaaggatttgcatggcannaaatggaggnnncgtcatanctatagaggtcaacctcgaaggcatcttctgacaactggatggagttcatttatcaataagaagaaactagtctcaggggatgcagtcttgtttcttagaggtaatgatggtgagctaagattgggtgtgaggagagcagttcanctgaaaaatgnagctctacttnaagctgtcaactgtactgattcgaagctacttatgctgtctgctgtcgccaattctntggacaacagg

SEQ ID NO: 3422 - DNA, 278 bp, Zea mays
  misc_feature: Incyte ID No: 700611554H1
acagcaacagcaaacaactgaccatcagctgcagactttgggcaagcgtcttcaagggatggagtcacggcagcaacagatgatgtctttcctggctaaagcaatgcaaagtcctggtttcctagcgcagtttgtacagcaaaatgagaagagcagaagaagaatagtagcggcgaacaagaaaaggcggctgcccaggcaagatggtggcctagactccgaaagtgctgctgcttcgttggacggtcaaatcatcaagtatcagcctctgatcaacg

SEQ ID NO: 3423 - DNA, 278 bp, Zea mays
  misc_feature: Incyte ID No: 700611557H1
  unsure 191: a, t, c, g, or other
gtgactacctgatgatcaagggatgctgtgtgggtccaaagaagagggtggtgaccctccgccagtccctcctgaagcagacttcccggctggcgctggaggagatcaagctcaagttcattgacacatcgtccaaatttgggcacggtcgcttccagactaccgatgagaagcagaggttctttggtaanctcaaggcgtaaggtgctgcggtgcagcgaaagtcccatttgtcaaaatcatcaaactgtgaaacctttgtttgttaccttgctgta

SEQ ID NO: 3424 - DNA, 276 bp, Zea mays
  misc_feature: Incyte ID No: 700611560H1
aggatgcgagtacaaacctcgctggaagtgctgatgatctacctggtaatatccatgatgatgagcaaaagaacatccctgaacatggtgctgaaatgacttctccagaagccaaatctgttctgaggttgcggaagacttctgaggaaggcaacaaggatgtcaagcaggagagttgtctcgagccacacgtgagagcaccaatgcagaagggaggcttccaatcatacatcatctggctggttcttccggtggctctgctcctgcttctctgtg

SEQ ID NO: 3425 - DNA, 277 bp, Zea mays
  misc_feature: Incyte ID No: 700611563H1
  unsure 135, 142-143: a, t, c, g, or other
ccaattgaggcacggtacaaggagtcgacagaaaggggttcctctgtagatcaactggtctactgcatcaactgggtcaccaatcttcttaaggtcttccagtttagaagattggtgacccaattgaggcacggnacaaggnntcgacagaaaggggttcctctgtagatcaactggtctactgcatcaacagtttcagagaggctgctttgtccagtgaccaaaagtttggccatatcgacatatctgagaaacagaaggtcatcaatgagtgctc

SEQ ID NO: 3426 - DNA, 279 bp, Zea mays
  misc_feature: Incyte ID No: 700611564H1
  unsure 33-34, 196: a, t, c, g, or other
gtgaccatcttgccactggggataaaggagganntgtggttttatttgaaaggacagatgttcgggataatgccagccagagagaactggagagacaagatgttccagttactagacacccagagttccgctacaaaactgaatttcagagtcatgaacctgagtttgactacctcaaaagtttggaaatagaggnaaaggtcaacaggatcaagtggtgccagacagccaacaatgctctctcccttttgtctacaaatgataaaacaataaaatact

SEQ ID NO: 3427 - DNA, 276 bp, Zea mays
  misc_feature: Incyte ID No: 700611566H1
cgcggtctgctcgttcgatctgtgcagcagatctgaggtcccgggcgaccgtgaagcagcttcaatcgtcggcatggcgctcgtattgcatagtggggctggaaacaagaatgccttcaaagcacttattgctgcagaatacagtgggatcaaggttgagttgaccaaggattttgagatgggtgtctccaacaagacccctgagtttcttaagatgaacccccttgggaaggttcctgttctggagactcctgatggccctgtttttgagagtaa

SEQ ID NO: 3428 - DNA, 259 bp, Zea mays
  misc_feature: Incyte ID No: 700611572H1
  unsure 48: a, t, c, g, or other
cgatagtgtaataactttttattgattcatgtgatcatgcattgatgnatcacttacatttgccctacttcttgcagccacttgtatctggtgcggcattaggcttagaagggcagttgactgtttatcatcataatggaagcccatgctatcggtgcctctttccaactccaccacctgtggcagcctgccagagatgctcagacagtggtgtccttggggttgttccgggagtgattggttgcttacaagctctgga

SEQ ID NO: 3429 - DNA, 160 bp, Zea mays
  misc_feature: Incyte ID No: 700611573H1
  unsure 2, 5, 9, 18, 21, 25, 51, 127: a, t, c, g, or other
tnagnatgnagatgacantantgangaaagttcggatgatgagccaacaanaagttgaagaaaagaaggctccaaaagtatcagaaaacagtggatcggagcctgaatcttctgaagacgagagtgntaaagacagtgaagagcctgctaatactccaaa

SEQ ID NO: 3430 - DNA, 277 bp, Zea mays
  misc_feature: Incyte ID No: 700611574H1
  unsure 55: a, t, c, g, or other
caatctccttaatgacaggctcctcacttggacgcagctcttcaaagagattganctattcgtgtagcatggctcaatctccttaatgacaggctcctcacttggagattgagccatgctacacgaatagctctgccaaatgtgaatcggaaattcaacaggttagcccaatgaccgatatattcctcgaaacgaaagccaaagtttactcaaacaaaagccctaaagatgaaagcgacgccgaagatggcagcagctgggagacaataagccatga

SEQ ID NO: 3431 - DNA, 275 bp, Zea mays
  misc_feature: Incyte ID No: 700611577H1
  unsure 2-3, 11, 17-18, 20, 24, 27, 34-35, 54, 63, 67, 82-83, 96, 123, 130, 137,: a, t, c, g, or other
tnnataactcnatgatnncnaatnatnggcattnnctgctgcggttcgactganacttgatgngcanatccttatgtgcagnnaaagaaattcgcnggcagcaggatgttacatgctccggangcaagtnactacgntanaggtccaaaggnanattcaatttataacaagcanaaganagtacaacaatcaacaagaatggatgacaaagggaaggccacacaaatgtcaccttgggatgctccttccatctaaggattctctagcagctgang

SEQ ID NO: 3432 - DNA, 161 bp, Zea mays
  misc_feature: Incyte ID No: 700611578H1
  unsure 8, 12, 14, 19, 31, 35, 41, 43, 46, 54, 59, 62, 73, 90, 127, 133, 146: a, t, c, g, or other
acagagtnctgncntgccngggataggatcnctcnctcagntncanatgtacgnaaganatntaagcatcacnaggagaagcataggtcnctagaatcacgtggcggagactttgatgctgagcggnggctgnactctcatgcgtncaagaagtcctcgtc

SEQ ID NO: 3433 - DNA, 277 bp, Zea mays
  misc_feature: Incyte ID No: 700611581H1
cagacgccgccgccgcccaaagaaagacgtcaactccaggagacaagatagtgagaactgaagagaaggatgggcttcgagaagcagatcctgagatccggcaccggccccaagccgataaagggccagaaggtcaccgttcactgcaccggctacgggaaggatcgtgatctgtccaagaaattttggagcaccaaggaccctgggcagcagccattcagtttcagcattggtcagggttcagtgatcaaaggatgggacgagggagttatgacca

SEQ ID NO: 3434 - DNA, 277 bp, Zea mays
  misc_feature: Incyte ID No: 700611582H1
  unsure 2, 4, 6, 15, 17, 22, 26-27, 35, 39, 47, 53, 62, 86, 94, 97, 106, 128-129,: a, t, c, g, or other
angntntgcagtcanangtcantgannttgttctngganaagaaaancctgtngaggaatcnactcctgaatatgagaagcttaanaattacanatntgagctagnaaatcatttagcagaggcccannaacaagcataccgtcttatgaaaagacacagagaacttggtcaatctttggcggactttggaaaggcgattnagcatttangtgcttgtganggagatttganggaaaaggtgtttnctgaagttngtncgcagtcagagatgtnntc

SEQ ID NO: 3435 - DNA, 274 bp, Zea mays
  misc_feature: Incyte ID No: 700611583H1
  unsure 222, 252: a, t, c, g, or other
tgggtttcattctggagctgggcctgatgaaggctgtttttagttttattacaatagcagctccagttctgttcggtgtttttcaccttttcgcttggaacaaggacacattactttggtagaacaatccttcatggcggtgcaaagtatcgtgctactggaagaggttttgttgttcggcacataaagtttgctgaaaattataggctctattctcgaagncactttgtcaaagcgcttgaggttgctctnctcctgatcgtttacattgcat

SEQ ID NO: 3436 - DNA, 276 bp, Zea mays
  misc_feature: Incyte ID No: 700611584H1
  unsure 40, 42: a, t, c, g, or other
cgtaaaaagaaagaggaagaagagagaagaatggaaagananagggagaaggaaagaatacgaattggaaaagaagattaaagcacaggagctaagggatcgtgctcgtaaaaagaaagaggaagaagagagaagaatggaaagagaaagggagaaggaaagaatacgaattggaaaagaacttctggaagccaaaagaattgaggagcaaaatgaaaggaaacgcatgatagaactgcgaaaacttgagaaagaggaggagaaaagagctagaga

SEQ ID NO: 3437 - DNA, 276 bp, Zea mays
  misc_feature: Incyte ID No: 700611585H1
ccataccccaaccctctgacgatgccttctacgccgacgctggtccctccgtgcgacgcggtggagccactgctggcggagtcctccgaccgcttctccatgttcccgatccgcttcccgcagatctgggagttctacaagaaggcggtggcgtccttctggacggccgaggaggttgacctctctgccgacgcccggcactgggacgaggcgctgtcccccgacgagcgccacttcatctctcacgtgctcgccttcttcgccgcctccgacggt

SEQ ID NO: 3438 - DNA, 276 bp, Zea mays
  misc_feature: Incyte ID No: 700611586H1
cagctgactcagtacctgaaagctcatcctggaggccctgcatcttcagagtttgattggggaaccagtgatactcccagacgctcagcacgcttgagcgagaaggtcaaggcaactgagagcccagagggtgagaagacccctaaacgggcaagatcaagctctaagaggggcaaaaaggaggaaaaagtggatgcagaggatgcaaatgaggctggagaagatggtgcttcggcggaaggtaaaggtaccgatgtggagatgaaagatgctgaa

SEQ ID NO: 3439 - DNA, 277 bp, Zea mays
  misc_feature: Incyte ID No: 700611587H1
  unsure 15, 35, 37, 42, 55, 61, 77, 85, 96-97, 101, 105, 123, 151, 179-180, 182,: a, t, c, g, or other
ccgcagtctgctcgntcgatctgtgcagcagatcngnggtcncgggcgaccgtgnagcagnttcaatcggcggcatngcgctcgnattgcatagtnnggcngganacaagaatgccttcaaancacttattgctgcagaatacagtgggancaaggttgagttgaccaaggattttganntnggtgtctccaanaagacncctgagtntctnaagatgancncccttnggaaggttcctgntctggagacncctgntggacctgtnnttgagantac

SEQ ID NO: 3440 - DNA, 277 bp, Zea mays
  misc_feature: Incyte ID No: 700611588H1
  unsure 123: a, t, c, g, or other
agtcattccctagggatgaccccaagaagccttgccatctcactgccttccttggctacaaggctggcatgactcacattgtccgtgaggttgagaagccaggatccaaactccataagaagnaaacttgtgaggctgttaccatcattgaaacccctcctcttgtcattgttgggctcgtggcatatgtgaagactcctcgtggcctccgcacactcaactctgtttgggcccaacatcttagtgaagaagtgaggagaaggttctacaagaactg

SEQ ID NO: 3441 - DNA, 274 bp, Zea mays
  misc_feature: Incyte ID No: 700611589H1
ggcggctctggacgaaggcaaggtggaagagtgcgtcgacgagaggctctgcggcaagtttccgctggaggaggccgttccgatcatgaagctcggtctggtctgcacttcccaggttccgtctaacaggccagacatgggtgaggtggtgaacatactggagctgatcagatgcccccaggacagcccggagactgaactgggttaacctcctctactacctacactggatcccggcctgtttgttggtttcacttttgagatccttctctgc

SEQ ID NO: 3442 - DNA, 274 bp, Zea mays
  misc_feature: Incyte ID No: 700611592H1
cagaacagcatccagttgattcagtaaaagtacataacaatgcatctgttgtgctgaccaaaaaaatatctgatttatctcttgagtggcgatcagatttatcgaaaactgatgtctggtatgccagttttggatcaaacatgtggagaccaagatttctatgctatattcaaggagggaaggctgagggtatgaatataccatgctgcggatcacgtgacacaagctcaccaaagggaaccgtgtggaagactgtacctcacaggttgctttt

SEQ ID NO: 3443 - DNA, 274 bp, Zea mays
  misc_feature: Incyte ID No: 700611594H1
  unsure 92, 202: a, t, c, g, or other
agattttcaaagattcctggacaacgtgcaatacaaaacaagtgggatattacgttacgagcgtgtctttggtgaaggttttgtgagcactngtggaatcgagacaacaaaggaatttgtgggcatgctcgatcttaaaccgggccagaaagtacttgatgtcggatgtggaattggaggcggcgacttttacatggctgcnaactatgatgtcccatgttcttggtattgatctatcggtgaacatggtttcatttgcaatgaacgtgccatg

SEQ ID NO: 3444 - DNA, 150 bp, Zea mays
  misc_feature: Incyte ID No: 700611601H1
  unsure 75, 130: a, t, c, g, or other
gatgttggaacagtggaatccaggagagggaacggaggagggtcgacagcgtgcgaggtgctcttgttccaccancgaggacatgggcatcccgtacgagatcgcaaagctcggtatccggcaagggatntggggatgcgtgaagagatt

SEQ ID NO: 3445 - DNA, 276 bp, Zea mays
  misc_feature: Incyte ID No: 700611602H1
  unsure 69, 111, 134, 140, 143, 146, 170, 203, 206, 229, 242, 246, 250, 257, 261,: a, t, c, g, or other
cttggacaactgtcacttttagaagcaaataattatggtgctgtaattcctcacgtactatgtttagtnctgataattttggaaattgcagtgttgtgcagcaatccacgnaactgaggaagtgctgtctacantctacnatncangtcatgttggtccatccagaccanacatgctactgtcacatctagtagtcatcagtntgncgccgcgtgcttctatagatccnaatcggagtgcanccangtgngtttggncgtnatcncgcccccnaat

SEQ ID NO: 3446 - DNA, 271 bp, Zea mays
  misc_feature: Incyte ID No: 700611603H1
  unsure 162, 169, 178, 211, 222-223, 225-226, 228, 240-241, 254: a, t, c, g, or other
gttcgcaagcaagaaagagatcattcttttgacaagacaaaatttaacaatgtctttgtgaaaaatttgtctgagtctaccacaaaggaagatttactcaaaatctttggtgaatatggggatattacaagtgctgttgtgatgattggtatggatggtacntcaaggngtttggttncatcaattttgagaatccagatgcggcttcccnaggcctgttcnngnncntaattggtaggnngataaatgacaangagtggtatgttggaag

SEQ ID NO: 3447 - DNA, 267 bp, Zea mays
  misc_feature: Incyte ID No: 700611604H1
  unsure 9, 26, 183, 195, 258: a, t, c, g, or other
ccgtctcgngttacttcatttaagancagcattgatgatttcaatccattcaagctgctggaccacctatttgccgaatgcaggaaccagggggaggatttggttaacagaggagtgataacaatgaaggacattgaagaaacgaagtctggcaaagttggcagcggtgttcttaatgttggnctaccagcgtancttattcttaatgcactccttcggtctgcgaaagctgattctgtcgggctaatcttaagtgangctctgaga

SEQ ID NO: 3448 - DNA, 266 bp, Zea mays
  misc_feature: Incyte ID No: 700611605H1
  unsure 23, 36, 102, 202, 250-251, 265: a, t, c, g, or other
aacaccaaacttcgacgactgcnccggccgtcggcntccgctgccgccctattttgaccccatccgccggcgacgataatcgccagtttgtggataagggtnttttaagtcttcatatgaaactatccttttgatatacagctgaaggacaataactatcatggatgctactgcaaattcagatgtgcaaagggctgaggantttaaacttaaggcgaatgatgccttcaaggcaaaacaagttctcgcnngctatagagctttnc

SEQ ID NO: 3449 - DNA, 274 bp, Zea mays
  misc_feature: Incyte ID No: 700611608H1
  unsure 32, 103, 115, 117, 133, 139, 141, 147-148, 152, 185-186, 196, 198, 210,: a, t, c, g, or other
gtgaccctccctcagccgcgtcgcgtcgcatnctacgatccaaagctctctctgctcgcagccatggcgaagaactacccgaccgtgagcgccgagtacagtngaggctgtggananggccaggcgcaagtcncgagcncntcatcnncganaagagctgcgcccccgctaatgctccggctggnnatggcactcngnggggacttccancgtgtcatcaaaggacgggagttcattngggnnaattgagccattcangggtantcgccccgnc

SEQ ID NO: 3450 - DNA, 94 bp, Zea mays
  misc_feature: Incyte ID No: 700611610H1
  unsure 3, 9, 18, 31-32, 40, 47, 52, 68: a, t, c, g, or other
acnttttgnagggattcntctatggttagcnnggagcganattcatnagttnattcatcgctgaaatncttcttgcattcgaaggaggccacca

SEQ ID NO: 3451 - DNA, 271 bp, Zea mays
  misc_feature: Incyte ID No: 700611611H1
  unsure 43, 227, 255: a, t, c, g, or other
acttctttttgagctgctggtcattgtacccatgagggtgccnattgatgagagccctgtcttcttattgtaccaggattgggcactggggttaatattcttgaaaatatggactagactggttatgttggatcagatggcacctttggttgatgaaagctggaggtcaaagtttgagagagttagagacgatggcttctcccgtttaaggggtctgtgggtcctcnatgaaattatatgccgattctcaccaanctccttaccggctttt

SEQ ID NO: 3452 - DNA, 201 bp, Zea mays
  misc_feature: Incyte ID No: 700611612H1
  unsure 50, 68, 108-109, 112, 119, 124, 141, 150, 152-153, 156, 159, 163, 165,: a, t, c, g, or other
gtacaatgggaagaatctggtgagcatatcattgctggagctggtgagcnttcatcttgaagatttgncctgaaaggatctgcaaggaggacttcaatgggtggtgcnnganaattatngttcncccaacccggtaggtcntccttcccnannaanggnttcntnaaaaannccccnggncggaanctgataagggtnnna

SEQ ID NO: 3453 - DNA, 209 bp, Zea mays
  misc_feature: Incyte ID No: 700611617H1
  unsure 10, 17-18, 23, 54-55, 59, 63, 69-70, 72, 78, 86, 114, 117, 122, 133, 138,: a, t, c, g, or other
ccgccctccnagccgannaggcnacgcttgaggtctctaatgacgctgatgacnncgancggnttcttnnangtgtancagaagcnaaatctccgggactctgatgccgcccgngcncgatntccaagattcncgccnggctggngttcgnttcaggccatgcatgccacatcccacaaagtccttcngtgggtggttgcnnantcngg

SEQ ID NO: 3454 - DNA, 263 bp, Zea mays
  misc_feature: Incyte ID No: 700611620H1
  unsure 78, 109, 128, 172, 183, 192, 201, 207, 214, 217, 219, 246: a, t, c, g, or other
ggcacacagagctcatgcttcaaccgaaggagttaccaagtatttgaagcctgctgttgctggcttcctcatgcaganggaacttgactaccttgttggagctgttgcnaacccaaagaacccatttnccgctattgttggtggatccaaggtctcaagtaaaattggtgcnattgagtcgtngctggaganggtcgatancctcanccttggnggngnaaggatctacaattttacagggcacanggaaatcctgtgggaaa

SEQ ID NO: 3455 - DNA, 214 bp, Zea mays
  misc_feature: Incyte ID No: 700611622H1
  unsure 4, 9, 11, 13, 56, 60, 65, 73, 81, 91, 120, 127, 157-159, 186, 191, 194-196,: a, t, c, g, or other
gtanaccanangnaccaaagtgtgggttcagtgggaagttggtccacatcacttangcangagantattcctntgctgcangttttgacancctttcagatgatgagggttaggacaggnggctganaggtgctctcaaactggccccagttgcccnnnaattgtacataaaaggtgagctaggtngggcngcnnngacatnntnatgcnnttg

SEQ ID NO: 3456 - DNA, 272 bp, Zea mays
  misc_feature: Incyte ID No: 700611623H1
  unsure 19, 41, 80, 157, 163, 185, 190, 201, 207, 216, 218, 220, 223, 225, 233,: a, t, c, g, or other
gagaaggacattaagaaancacttttgaggagcgacaagangaacatggccaccctcttggcagagtttgacaagattancaaaaagcttgggctttcggaaggaggatcttcccaagatcgaggaagagcttgaattggaaattgccaaaaagtgngctgancgaattaagaaggaatgcgtcnaaacnaatgggagccncccacncaggagggngntnttncnaagatggnggncacccnngnacccggnatttggancnacnnactcnc

SEQ ID NO: 3457 - DNA, 273 bp, Zea mays
  misc_feature: Incyte ID No: 700611628H1
  unsure 146, 164-165, 176, 201, 203, 205-206, 210-213, 217, 222, 226-227, 231-232,: a, t, c, g, or other
gtcgggctgacaactactctgatactcttctgcagccatttcccatcagatcgatggagatctcgccgttggaaagatgtctcctctggtaagaatcggcactaaagcaggatcgcggatagtgtcgattgggattgtcatgctanacattctcttggctagtnngggaaccatgnggattctctcccgcaatcttgcatngncnngggnnnncttnactcncccnngggnnaaaacggttcntggantagtgcnaaaacntcaggngnanaa

SEQ ID NO: 3458 - DNA, 276 bp, Zea mays
  misc_feature: Incyte ID No: 700611632H1
  unsure 18, 40, 42, 45, 60, 62, 64, 75, 103, 109, 112-113, 116, 149, 151, 154, 168,: a, t, c, g, or other
ggaccttgtggcaatgcntcaccaggagaaggcacaactngngcntattcgtgagattgngnanaagcttgccanagatggagttccagttgggccgggagcnggggcnggnncangtgtacaccatcttaccttagacaacacacaantnggnttgtagaaaggagnttcacagnggacnagaaggcgatacttgngaagacatttncatggcngccttntttagtggatccncgcnttattggcanaggnanagcagccttcnaaagcnggcnt

SEQ ID NO: 3459 - DNA, 260 bp, Zea mays
  misc_feature: Incyte ID No: 700611633H1
  unsure 34, 50, 218, 235, 244, 250: a, t, c, g, or other
tgtcaaggatgacttcattggacgtgttatattngatttgaatgaggtcncaaagagagtgccacctgatagcccattggctccacaatggtatcggttggaagaccgcaatgggcacaaggtgaagggggagttgatgctggctgtttggatgggtactcaagctgatgaagcattccctgaagcatggcattctgatgcagcctccgtccctggtnatggcttgcaagccatnaggtccaantgtttnaaacccccaa

SEQ ID NO: 3460 - DNA, 262 bp, Zea mays
  misc_feature: Incyte ID No: 700611637H1
  unsure 241, 259: a, t, c, g, or other
agcagtgtactccaagctcttatactccacagacatttgtaggcagcagtaatggagcattgcaaaaacccttccatgctgggagacaagtggcatcattatcaagtgtacagaaacaatttatgaatctaccatatccaaaagaagaaacactagctagacactccatattaggacctaatggtcttaatggccggtggaatgggcctgttactggaatcaaggttcaatatccaagcanttttgaattaacacaaantgg

SEQ ID NO: 3461 - DNA, 261 bp, Zea mays
  misc_feature: Incyte ID No: 700611638H1
  unsure 98, 157, 167: a, t, c, g, or other
gctggttctggttaccaaggtggacatccaggctcaaatagaggaccttggggcagtcaagctccatctgcatatggaactggagggtatggtggcantgctgggtatagtgcttggaacaactcttctggtggtggcaatgctctgaatagtcaancccctggtgnacctgcaggctatggaagccagggctatgggtatggtggatatggaggggatccatcatacgctagtcacggaggatatggggcttatggagca

SEQ ID NO: 3462 - DNA, 248 bp, Zea mays
  misc_feature: Incyte ID No: 700611641H1
agaagatcaacaggcgtaaggatttccttcactggtggaccaagtgaagcatgcttctgctgttgctcgcttgctacgtttctttgcactcgacctacctgtcttatctgaaataaggacggactttgcacggattcacaaatttgttgtgcctggaaggatgtatgcccaggttgtgacgaacatataacttgtgtacttggagtcattcgctgtaatggacaccagacctgctgtgaatctgtttt

SEQ ID NO: 3463 - DNA, 109 bp, Zea mays
  misc_feature: Incyte ID No: 700611643H1
  unsure 41, 43, 45, 51, 61, 64, 73, 77, 93-94, 96, 98, 101: a, t, c, g, or other
acctgggagaaagtttatgggcttccctccaggtactcaancncnccatgntccccttgcnacngttgaatangttncggttgcagtatctgnntncnagntaatgggc

SEQ ID NO: 3464 - DNA, 263 bp, Zea mays
  misc_feature: Incyte ID No: 700611644H1
  unsure 203, 209, 214, 217-218, 226, 238, 243, 249-252, 254-255, 258-260: a, t, c, g, or other
gaacctgctcctgccccattgaaggaaggaggtcctcctggaaggaaaattgttgtgtccaccaacattgctgaaacatccttaactatagatggcatagtttatgtgatagacccggggttttccaaacagaaagtttacaacccaagaataagggtggaatcccttctggtgtcacccatttctaaggcaagtgctcatcngagaantggtngtnntgaagaanaaacccgggganttttngccacnnnngnnaannnttt

SEQ ID NO: 3465 - DNA, 265 bp, Zea mays
  misc_feature: Incyte ID No: 700611645H1
  unsure 2, 48, 56, 60, 85, 88, 94, 113, 118, 178, 192, 199, 203-204, 221, 228, 233,: a, t, c, g, or other
gnttgctactagtgttgctgctagaggattagatgttaaagaacttgnactggttntcanttatgatgtccctaaccattatgangantatgtncatcgtgttggtagaacangtcgngctggtacaaagggctttgccgctacttttatttctgatgaggatgagcgctatgcaacngaccttgttaaagntcctggncccnnctagcaggccggtccanagggacntaaangccntggcngtnagnttanggccnaggttaaa

SEQ ID NO: 3466 - DNA, 266 bp, Zea mays
  misc_feature: Incyte ID No: 700611648H1
  unsure 124, 140, 160, 238, 246, 249: a, t, c, g, or other
gtagacaccacggagctcctcgccgagttctcgtccacccctcctccggacgacctgctggcagtggcagtattcggcggcgacgagcagccgtgacgcaagggacgccatgcgtggccgctgncaaggtttccggtgcntcaccccatctacagcagancggcgatggtacctccgccgccaagcaccaccaagctagctcaactgcatctggacttaaagcgcaccgttcaagganattatgangcngcatggagatgttttgt

SEQ ID NO: 3467 - DNA, 269 bp, Zea mays
  misc_feature: Incyte ID No: 700611649H1
  unsure 24, 27, 33, 56, 66, 73, 76, 94-95, 124, 135, 148, 159, 173, 216, 218, 227,: a, t, c, g, or other
cattattctgagcggtcatctcancangaagancatgcaaacttctcaggagacanacgccgactnggagaanatnagtttacaggaaatggcnngcagagttaggtaattctgagcttcggangtctgtatggncggatgatgtctncagctttatgncgctcgcaaaacangcgtcgaattcaaagttctgacatttctcaagattttgatgcnangagaagcanctagtatcagatgctgcaagagtatgaaggtcnaaantnccg

SEQ ID NO: 3468 - DNA, 265 bp, Zea mays
  misc_feature: Incyte ID No: 700611651H1
  unsure 29, 37, 41, 51, 82, 90, 94, 106, 158, 164, 166, 169, 183, 190, 192, 199,: a, t, c, g, or other
ggagaggcgttccgttccatcaaagctgntggcaacnagtnctccagggcngcggtgcacgggcacctgcctgactaccagnaggcctcngcancgaactcttctnatcgccaccatcaccagaaggcttccgcccctctctccagtgtctctttctntctccntngcntggctctcgcgtgngccactnangcgcgcngcttcctnctcgctggnccggcgagatctttccacgcccagccctancaggccaaggtcggcgtgg

SEQ ID NO: 3469 - DNA, 266 bp, Zea mays
  misc_feature: Incyte ID No: 700611652H1
  unsure 6, 14, 21, 57, 71, 77, 85, 118, 134, 161-162, 169, 176, 200, 206, 220, 222,: a, t, c, g, or other
agcagnagaaaaangttctgnctgatgagaaagatgaagatgaaggtgaccagaagntggaagagaataangagganactccgangactagagaggctggagtgccagggatagaacncagggaaatggtagtngacatgatggatcaaaattctagggannccaaaantttgctnaacacccccaagcccatatggtancgatcnttctcaaagtgaananggnaattantgnccnaggtggttggggtatnggaaannancnna

SEQ ID NO: 3470 - DNA, 264 bp, Zea mays
  misc_feature: Incyte ID No: 700611653H1
  unsure 33: a, t, c, g, or other
ggagtacacagaggttctgaagctccgcgggcntccctactctggccaccactgaggacatcatcaagttcttccctggagtaacgagctggcagaggagaacgtgcatatcgcctaccgctccgatgggaaggccacgggtgaagccttcgttgagtttccgacagctgaagtcgcgaagacggccatgtggcaaggataagatgactattgggacgaggtactggagctgttcccgtcgaccccagaggaggccagcagggc

SEQ ID NO: 3471 - DNA, 100 bp, Zea mays
  misc_feature: Incyte ID No: 700611658H1
  unsure 65, 99: a, t, c, g, or other
ggaatgttactggatactggatagttagttcggcctgtaggcgtatcctcctgaacttacctctncattggctaattagttttggcaccaagtttgtcnc

SEQ ID NO: 3472 - DNA, 262 bp, Zea mays
  misc_feature: Incyte ID No: 700611660H1
  unsure 61, 86, 88, 150, 163, 165, 169, 193, 209, 215, 222, 237-238, 246, 254, 260: a, t, c, g, or other
ggacatgactgcggactcaacctgtttttcattgtcttcacgttgattcttgtttttgggnttgctattgttgctctgcacccaangntcaatggaagcttgttgcctgcatcagttattggtatgtactgtacatatctgtgctacagnggactctccagtnanccangggattacgaatgcaatgggcttnacaatcactcaaaagntggggncactggnaccataacatgggcnnccataacnacggcccnttcggngg

SEQ ID NO: 3473 - DNA, 266 bp, Zea mays
  misc_feature: Incyte ID No: 700611665H1
  unsure 90, 129, 169, 202, 224, 242, 247, 251, 258: a, t, c, g, or other
gtgaagaacaggcaggtcaaagccaagcaggttactttccacaggaagaagaatctgcagtactatgaaatttctggcaagagcaactanaaactttgagaaacctttcctgtaccttgcaaggaagcnggctggtggatccgaaccttcactttgttgaagtgttgcntcttaagcctccggaagttaccatggacaatgnctatgcagcagcagcatgaagntgagcttgctgcagcagntgaanaacntcttccngaggagga

SEQ ID NO: 3474 - DNA, 260 bp, Zea mays
  misc_feature: Incyte ID No: 700611666H1
  unsure 67, 96, 106, 115-116, 126, 131, 138, 144, 147-148, 152, 157, 159-160, 163,: a, t, c, g, or other
gttatcctcgcatcaaaccgtggcactgtgatggagttgggtattactccaattgtgacctcctggnatggtaatgcaacttcttgtcggatcgangatcattgangttgacacnngtttaaaaanggtcntgccccngctgantgnngcanaaaantnnctnggnancttgaccgcnatgggggaacngtggcaatgtctgtctggaatgtanggcnanttaacccaacttggaccggggaatannntccccannannt

SEQ ID NO: 3475 - DNA, 164 bp, Zea mays
  misc_feature: Incyte ID No: 700611667H1
  unsure 2, 7, 20-21, 23, 32, 34, 38, 100, 114, 117, 143, 151-152, 159-160, 162-163: a, t, c, g, or other
anacganccacacagaaatnnantatagatcngncaanccagccagacataaatcatatacgcacagatcaggaattcactgggaatcagttcccctcgngcctaccagttgancantgttatttcattaggggatactgaanaacttcanngcgggtnncnna

SEQ ID NO: 3476 - DNA, 96 bp, Zea mays
  misc_feature: Incyte ID No: 700611673H1
attatataagagtgggatatgtaagattaagatctgttcagctgttctgcggttactgtttgtacaattgttctttttcctgatgtttttataaaa

SEQ ID NO: 3477 - DNA, 269 bp, Zea mays
  misc_feature: Incyte ID No: 700611674H1
  unsure 99, 122, 223, 229, 235, 239, 252, 259, 265, 267: a, t, c, g, or other
agctaattgttgcacttaccagtttcatgcgtcacgtccgaagcgtgtagagtagctcggtttttctctcccatatgtcgtctaagcaatcaaggagtnaccaggctgcgagaaaacatctnagtctaagcatggcatgaagttacatagatgtagcactcatggtatcacttcgctagctgaactgaggatgattgattgacccgagttataaaaagtgaanccatcnaatttnaaanttggggtgggggncccaatncccccnantt

SEQ ID NO: 3478 - DNA, 281 bp, Zea mays
  misc_feature: Incyte ID No: 700611677H1
  unsure 11, 20, 35, 41, 62, 92, 101-102, 154, 159, 169, 179, 208, 213, 223, 244,: a, t, c, g, or other
attacgattcncaatccagncaaaccctaccagcnttttgnaaacttcatagagggacccgntggcacccaaggccggagaagaagccggcngcgataganncccgcagaggaggagcccgcggccccggcggagaaaggcccccgctgggaanaaagnccgaaggcangtaagcggcntcccgtcggaaaaattccgcccgccaagnaagtncggttttaanaagaaagggccggaaaaaggncaataanggcttgnagacngtaccaaagatnttcntt

SEQ ID NO: 3479 - DNA, 266 bp, Zea mays
  misc_feature: Incyte ID No: 700611691H1
  unsure 124, 143, 152, 156, 168-169, 175, 190, 196, 198, 218, 227, 234, 245, 251,: a, t, c, g, or other
cttcacagacggtagacagtgaagatgtgataagccgtttacgactcaaaggctgtaacacatcttcacagacggtagacagtgcctcgcagggtgaggctaatgatgtcaatcctccatctangaagcccaaggaggaagantctttcacngggncctagtgaactnnaaatgnggtcaaccacctctnggggantntagcggcacaggttaatgtncttccagcnactgatnacctagatggnacaacngcctacggnnttttt

SEQ ID NO: 3480 - DNA, 255 bp, Zea mays
  misc_feature: Incyte ID No: 700611693H1
  unsure 69, 71, 130, 172, 206, 209-210, 234, 246, 248, 253: a, t, c, g, or other
aagacccgtaaatgtgggaaatctgcatcaaggccatctgcgatgtctagtgatgacagcttccttcananagactgcaccgctgaaacaagccgtctctaagcagcttgacagtcagcaggtagcgaanttgagtctagggctgcccttgaaggtgaacttgctgaacttngcattccctcagagatatactcaacttctctgtntgnntaccttcctcatgacaagcagagnagttagttatcntnaggantc

SEQ ID NO: 3481 - DNA, 270 bp, Zea mays
  misc_feature: Incyte ID No: 700611696H1
  unsure 2, 15, 25, 29, 36, 42, 51, 59, 67, 99, 105, 107, 120, 146, 158, 177, 184,: a, t, c, g, or other
cnacaatcctccgangatgccctgncganccgacgntgttgncccccttgngacgcggnggagcccnatgctggcaggagttccctcagagcgcttctncatgtntnccgatccgtttcncgcagatctgggagttctacaagaantgcggtggcctncttctggacggcagaagangttgacntctctgccgacgcccggcactgggacgaggcgatgtcccccgacgagtggcacttcatctcccacgtgctngcttttggctgcctc

SEQ ID NO: 3482 - DNA, 297 bp, Zea mays
  misc_feature: Incyte ID No: 700611702H1
  unsure 73, 173, 231, 247, 270, 280, 288: a, t, c, g, or other
gagttgatcctcaggcgaaggtgtcacagaaggaaatgggatctgctgtttgcctgccacaaactccacatcntcctgttttgcagaaacccaaggacttgcctgttcctaaacagcgggagcctatcaactctttgccaaaagaagagccttgtttctctggaaggactgtngaagcagatcaagggaaggaagcttctctcccgttcagatcggaagaaaatccacaanactgagaagaacaatnagaagttcagagatctgtttgtnactggaatcngcgttganggagaatga

SEQ ID NO: 3483 - DNA, 295 bp, Zea mays
  misc_feature: Incyte ID No: 700611704H1
  unsure 287: a, t, c, g, or other
aactggaagctgttggactccgtcttaacaaaaggcctccccagatatacttcaagaggaagaagacgggtgggatttctttcaataccactgttcctttgactcatattgatgagaagctgtgctatcagattctgcacgagtacaaaattcacaatgctgaggtgttattccgtgaagatgctactgtggatgctcatgacgttatcgaagggaaccggaagtacataaagtgcgtctacgtatataaccaagatcgatgttgttggtatcgatgacgttgatancttgcgcg

SEQ ID NO: 3484 - DNA, 300 bp, Zea mays
  misc_feature: Incyte ID No: 700611705H1
  unsure 59, 62, 103, 212, 221, 233, 242, 245, 270, 278, 285-286: a, t, c, g, or other
gaagagaaggatgggcttcgagaagcagatcctgagatccggcaccggccccaagccgntanagggccagaaggttcaccgttgcactgcaccggctacgggnaggatcgtgatctgtccaagaaattttggagcaccacaggaccctgggcagcagccattcagtttcagcattggtcagggttcagtgatcaaaggaggacgagggagtnatgaccatncaagtgggtgangttgctcgnatncagtgcacgcctgattatgcttatngagccggngggttcnnaggctagggattca

SEQ ID NO: 3485 - DNA, 301 bp, Zea mays
  misc_feature: Incyte ID No: 700611708H1
  unsure 27, 30: a, t, c, g, or other
gcgactaacagaaaccgccttgcgaanttncttagatttgagagtaccaagtcggatgggcaaacttgcctcccttgacgagtacatctcacggatgaagtcagggcagaaagacatcttctacatcacgggaagcagcaaagagcagctggagaagtctccattcctcgagaggctaaccaagaagaactacgaggtccttcttcaccgaccccgtggacgagtacctgatgcagtaccttatggactacgaggacaagaagttccagaacgtgtccaaggagggatgaagctgggcaag

SEQ ID NO: 3486 - DNA, 303 bp, Zea mays
  misc_feature: Incyte ID No: 700611709H1
  unsure 10, 14, 37, 74, 76, 85, 88, 90, 103, 109, 128, 144, 152, 157-158, 178-179,: a, t, c, g, or other
cgggtctatnttcncccctcctctgcccccatctcgnttctcgcacacggcagccggattcacgaagcgcgcgncnctcggcacnagncnaaaagcatcgcantttctnatgctttggagagcacacnagaatgtcgttcgtgnagctctcnggtgnnagagtcgctgcagtggcctnnangancaagagcctagtctctggcacgnagcgctacgggttctgctcgtcgaagcgctcgataccgtagcctggtcnttaangctgcaactgtcgtcaccccaaagtacacttcactgaagcnt

SEQ ID NO: 3487 - DNA, 295 bp, Zea mays
  misc_feature: Incyte ID No: 700611710H1
acttctttttgagctgctggtcattgtacccatgagggtgcctattgatgagagccctgtcttcttattgtaccaggattgggcactggggttaatattcttgaaaatatggactagactggttatgttggatcagatggcacctttggttgatgaaagctggaggtcaaagtttgagagagttagagacgatggtctcccgtttaaggggtctgtgggtcctccatgaaatataatgccgattctcaccaaactccttaccgctctctgtgtcccatacgtccttgcaaggggc

SEQ ID NO: 3488 - DNA, 300 bp, Zea mays
  misc_feature: Incyte ID No: 700611712H1
  unsure 20, 46-47, 50, 56, 79, 83, 90, 106, 108, 118, 137, 139, 153, 259, 282: a, t, c, g, or other
gcaacggccgagggaagccncactcaagggcactgactttagggcnnttnccatgntctacaagcccggtgaaaaaatnctcngagtcgntggaagtccatactangntgcaccagangtgcttcagaaatgctatngnccagaagctgatgngtggagcgcacgagtaattctgtacattttgctttgtggtgtgccccgtttgggcagaaactgaggctggaatcttcaggcagatctgcgaggcaaacttgatttngaatctgaaccctggcctagtanttctgatagtgctaagga

SEQ ID NO: 3489 - DNA, 289 bp, Zea mays
  misc_feature: Incyte ID No: 700611716H1
  unsure 35, 63, 144, 156, 167, 171, 177, 185, 187-188, 192, 196, 201, 206, 215,: a, t, c, g, or other
cctcagcatgacatggtgaggtcttccttctgtantgcagacggcaaggtcgagctcagcctnccattggcctccattatagcggcggcggcaaatggtggtggaacatatataacagttgcattggcttttgtttcagccttngcttctgctacngaagcattccnattnaggcgntggaagcnanntccngtangcccntaacnagaattggngttganaggntccnaccnattantaagntgcnagtgnggcaaancnggcnncnaaanggnnntgccaaggttct

SEQ ID NO: 3490 - DNA, 297 bp, Zea mays
  misc_feature: Incyte ID No: 700611717H1
  unsure 158-159, 192, 234, 243, 250, 254, 273, 286: a, t, c, g, or other
aggactttatggccctcctggcttatgaagagccggagaagtcacctatgtttcatctactaagcccagagcacaggcagaatgttgcagagggcttgaatcgggctgtccttgcacatgctaatcttccagcatattcatcgttggagagggtggtnnagcaagcgactgtggttagacaatacctacagnaggattggcaaggattcttacccaccattttctttgaaggcntttctgagnaagtatntgcnaaatggtcacttcttcagnacagggtaaccanctctccaggcc

SEQ ID NO: 3491 - DNA, 292 bp, Zea mays
  misc_feature: Incyte ID No: 700611720H1
gagatccggagctctctcgaacaacattttagtgattgtggtgagatgacaagggtctctatcccgactgatcatgaatctggtgcaataaaaggaatggcttacatagacttcaaggatcaggactctgtgtctaaagcccttgagctcagtggctctgacattggtggtggctatgagctttatgttgatagccaaaccaagaggcgatggccagcgtggtggtggtagatctggtggccgttctggtgggagatttggtgaccgttctggtggccggcgtggtggtggt

SEQ ID NO: 3492 - DNA, 296 bp, Zea mays
  misc_feature: Incyte ID No: 700611721H1
  unsure 281: a, t, c, g, or other
agaacagataaagtatattctgggagtatcatcccatgggtatgacaggtcaaacatggatgatgatgagtcggagaggatgaagaaggacattgaagctagccaggacaatgctctgaatctttgcaccgagaaagtcttactggcacgccaagcttatgacctgatagagagccatataaaacgccttgatgagacttgggccagtttgcagaagatttaaagcatgaagggaagatacctccagatgaacctacagtccttcctccagttccggtggntagcaggatgagaaa

SEQ ID NO: 3493 - DNA, 295 bp, Zea mays
  misc_feature: Incyte ID No: 700611724H1
  unsure 224: a, t, c, g, or other
atcacgaaaggaccggatcttggtgagctcgagggtacatgacgcggttcttcctatcgcggcaggtgaccaggacctctatcccctccttgatggaggtcggggactgggatggaggccagggactcgacggcggtgggcctggaggtggcggcaaaggcctcggcgtcgacggccgcggcggtgcgcatttcggctcgttcattcttgtgccctccttcgantacttcatttcgtcgcgtcccaaatcggtcgatggaaaatggaatctcgatggcttttgttaaatctggat

SEQ ID NO: 3494 - DNA, 298 bp, Zea mays
  misc_feature: Incyte ID No: 700611725H1
  unsure 37: a, t, c, g, or other
ggagcaattacaaaagtgcatcgtcaagagggagagntcaatctcatggttgagtgaaggcaccacatagctaccttttgtgggatacctctcgttgtacatagctgcagccttctagtacggaagcaggataggattggagtaggaagtcttcattggagcacaaggattcggatgtattataaactagcttaaggattctgttaaccttttcttttacttgcctgaatcagacttttccgtgttgtagaatagtcataatatcgtagaaacctccttttagtatgtgtgggtacac

SEQ ID NO: 3495 - DNA, 304 bp, Zea mays
  misc_feature: Incyte ID No: 700611727H1
  unsure 2, 7, 17-18, 32, 41, 45, 65, 69-70, 78, 94, 97, 99, 102, 114, 139, 142,: a, t, c, g, or other
gnagatnctagctaggnngcaggccgtctacnccatcggcngtcnatcagcaaacatgtggctcngggnncctagttntggagcagcggcggcngcngnggnaccatgaagcgnccgtctcttgtcgtcgtcaacctcnagnggcagntanagaagacgctggccgtcangaganggaggagnnggttgaggctgaggagttncgagccggaggagcagangccatggagatngtgaactgaagctgtacctnnagaaccggtgcatcatcgcgggagaacgacaggcttccggggagangccc

SEQ ID NO: 3496 - DNA, 288 bp, Zea mays
  misc_feature: Incyte ID No: 700611728H1
  unsure 2, 14, 32, 52, 57, 65, 78, 84, 87, 107, 162-163, 165, 169, 190, 287: a, t, c, g, or other
gnaaatctcgcgtncacctcctctccagtctntccgcctcccgcttacttcnctgantctgtccnctttggttacttncctgtnggngacggctggggtgctgcgcngctctcaccttcaccgccgacgagcattcacaagtagtggtctcttactggtggnngngtanaggtgacgaaaaaaccttganatgagcagcataggcacaggttatgatctgtctgtcaccaccttctctcccgatggccgcgtcttcgaggtcgagtatgccacgaagctgtcgacana

SEQ ID NO: 3497 - DNA, 291 bp, Zea mays
  misc_feature: Incyte ID No: 700611729H1
  unsure 55, 105: a, t, c, g, or other
aagcaaccaccgcctccccgatctcgtcgagaggaagcccaatcccgaaaccgtncgccgtattccaatggcgcccaaggccgagaagaagcccgccgccaagangcctgcggaggaggagccggcggcggagaaggccacggcggggaagaagcccaaggccgagaagcggctccccgcgggcaagtccgagcaaggagggtggcgagaagaaggggaagaagaaggcaaagaatcggtggagacgtacaagatcttacatctttaagtgctgaagcaggtgcacccgga

SEQ ID NO: 3498 - DNA, 292 bp, Zea mays
  misc_feature: Incyte ID No: 700611730H1
  unsure 193, 218, 263, 266, 291: a, t, c, g, or other
acacagaatgctcatttgctatgcagttgcagagaaatattcgagttactgggcaatgaagagcttgaaatgcatcccatttctgcttggaaagaagcaaagctacagttttatggtgggcctgatggtgctgccatgcagagaaggccattaatccatgttaaggattccgatagtttgggcggatgtggcngactataatcagaaatgaaatatcnttcagttcctatcttaagtggcatgccagattcatcaggagtgcnttncttaatcttgcaaacctccaggggnt

SEQ ID NO: 3499 - DNA, 294 bp, Zea mays
  misc_feature: Incyte ID No: 700611731H1
  unsure 6, 21, 154, 172, 193-194, 203, 284: a, t, c, g, or other
aacagnttcaggtggacagangtgtgcctctaggtgaagccttactcatgccacgataaatgggctagaggacaagggcatcaagaacacaaactttgctattgtgacctggtctaactgggactgccgtataatgctggagtcggaatgcagntttaagagaatcaggaancccccttattttaacaggtgnncaacttganggtaccgttccaggaagtgtacggggacgtccgctgcaacctgaaaggaggcagtccagctggccgggctcacatgggagnggcgcgctca

SEQ ID NO: 3500 - DNA, 295 bp, Zea mays
  misc_feature: Incyte ID No: 700611734H1
  unsure 7, 13, 16, 37, 79, 90, 101, 123, 138, 141, 151, 166, 192, 196, 203, 208,: a, t, c, g, or other
gaacgcngcgcanggncggcgggcgatagggagagangagagagtctgcaggatccagcaaggccgagggaggagtcancggccgggccngagaatatgancggcaacggcgcgaagaaggtngtcgatgcggcggtnaangccggcaggncgatcatcggctggnacggcatagccaagttgctcgtcacngacngctcgcnagganttcnccgccctncgtcgcgctttcnntgacgtaaannacnactccagaccangttctcccaagnaccccagccgttgntnggatata

SEQ ID NO: 3501 - DNA, 291 bp, Zea mays
  misc_feature: Incyte ID No: 700611736H1
  unsure 8, 16, 119, 124, 191, 194, 207, 238, 253, 275-276, 284: a, t, c, g, or other
gcataggntctctggntttcctgttattgatgatgactggaatttggttggcgttgtgtgcagattatgatttattggcactggatacaatatcaggagctggaccggctgaagcaganatatntcctgaggtggatagcacttggaagacatttcatgagatacagaagcttttgagcaaaaccaacggnagntattgctgatgtnatgaccccagcgcctcacgtggtgcgtgaancaactaaccttgaanatgctgcaaggttactccgtgnnataagttnccgcagc

SEQ ID NO: 3502 - DNA, 294 bp, Zea mays
  misc_feature: Incyte ID No: 700611737H1
  unsure 34, 50, 68, 76, 79, 81, 107, 111, 136, 157-158, 168, 179, 221, 248-249, 278: a, t, c, g, or other
gagttgatcctcaggcgaaggtgtcacagaaggnaatggcgatctgctgnttgcctgccacaagctancacatccnccngntttgcagaaacccaaggagttgcctnttcntaaacagcgggagcctatcaactcnttgccaaaagaagagccttgnntctctggaangactgtggaancagatcaagggaagagctaagctctcccgttcagatcggagnagatccacaaaactgagaagaaaaatnngaagttcagagatctgtttgttacctggnatccgctattgatgga

SEQ ID NO: 3503 - DNA, 293 bp, Zea mays
  misc_feature: Incyte ID No: 700611741H1
  unsure 23, 37, 80, 222, 260, 267, 281, 289, 292: a, t, c, g, or other
aaggaatcaacatttgatatgtngagtactgttggtntatccttctacaaggtgaaaatgactcttccaggacacttctncgtacatcaataagagactaaaattgaagttcaccaaagcatggctgtctttgctcaagttaccactaccacttgatgtgtacaaggaggtcctgcttcaattcatcaaaatgtatcctgcaatgtcaaacccttccatctnatgtgatttcttgactagatcatagatattggtggtgntaccagngtgatggcctcaanggctttcnttnt

SEQ ID NO: 3504 - DNA, 285 bp, Zea mays
  misc_feature: Incyte ID No: 700611744H1
gattgctactagtgttgctgctagaggattagatgttaaagaacttgaactggttgtcaattatgatgtccctaaccattatgaggactatgttcatcgtgttggtagaacaggtcgtgctggtagaaagggctttgccgttacttttatttctgatgaggatgagcgctatgcaacagaccttgttagctctggagctctctgagcaggctgttccacaggacctaaaagccctggctgatagattatggctaaggtgaaacagggactgagcaggcccatggc

SEQ ID NO: 3505 - DNA, 285 bp, Zea mays
  misc_feature: Incyte ID No: 700611745H1
ctctgatggtgataggtacattcaagtcgggaacgcagtggctgtccctgttgcccgggcactgggctactgtctggggcaagcctacctgggtgaatctgaggggagtgaccctctgtaccagctgcctccaagtttcacctctgttggaggacgcactgcggggcaggcgagggcctctcctgtagcacccctgcaggggaggtagttgagcagtaaaaggatgacagatctgagctgagctgggcaacatccagcggcaggagcattctggttcggttcgat

SEQ ID NO: 3506 - DNA, 288 bp, Zea mays
  misc_feature: Incyte ID No: 700611747H1
  unsure 21-22, 31, 43, 47, 56, 80, 110, 120, 188, 203, 222, 245-246: a, t, c, g, or other
aacacccagagatccctggtnncatgagtanacctggaggggnatcnagtgtagcnactggaactaccggattaggaagnatgtcggctaggacagggctgttgcacttntctttaaggntctgccgtcttcaccctcagatgatcagcctggaaaattcagtttgaacaaaattttggaagggaaanaggaaacaggctgcnaggatgttctctgaggacnacggttctgaagagttataattnnattgatgtgcaacaagaggatccatatggagccattgagatt

SEQ ID NO: 3507 - DNA, 288 bp, Zea mays
  misc_feature: Incyte ID No: 700611748H1
  unsure 59, 78, 125, 287: a, t, c, g, or other
ggaaagaagtgctccggggaagcaccgtgacacccttgctcgcccgcatctctctaacncgccggcgccggcgccggngccggtcatcgttcacatggctgcgatgccaccggccttcacgggcnccctgaagaaagcacttgcaggtctgagaagaatcaatttagatgggcttcgatggcgcgtattatgctaagggtcaggtgctgggacgatgggcttcccaaatagccgttgtgcttcaaggcaaggataaaccgacctatgcgccacatgtggaaaatggng

SEQ ID NO: 3508 - DNA, 294 bp, Zea mays
  misc_feature: Incyte ID No: 700611749H1
  unsure 47, 101, 135, 188-190, 258: a, t, c, g, or other
gcttcagatgttggtgagagctcccgttcagtgctctatccagttgntacgactactgtgaactcagtgtcatccacgtctacagtggctggtaccccaanttgaactttctgggtatcaggagggtgctccagnggtatgttcttcatgtttaacagctgatgttcagaacaatgtgacatctgatnnncagtgcttcggataacgaggtgcttcctccagaacctgctgactctttttgcagtctgaaagaatcangcaccagctgtatgtggttcagtgcaaccaattggg

SEQ ID NO: 3509 - DNA, 295 bp, Zea mays
  misc_feature: Incyte ID No: 700611753H1
  unsure 20, 25, 27, 33, 36, 47, 64, 66, 68, 70, 86, 108, 112, 118, 128, 132, 134,: a, t, c, g, or other
cgaccagtgaggtgcggttngccancnagcggnganccaaaccgagngtacgccatggatcgcnantngngctccaagcccggcancggcggtgccgcctccgcccanaatnaggctnttgaccggcnggancntctccgncgcctggncntcgagaccatcgacctcnncaaggatccctntntcatgcgcccacctcggcagctatgagtgcaagctgtgcctnacgctgnacaacancgaggggnatcagctagnccacangcaacggtagaggcaccagancaagcttngc

SEQ ID NO: 3510 - DNA, 291 bp, Zea mays
  misc_feature: Incyte ID No: 700611757H1
  unsure 181, 188, 198, 231, 240, 252, 258, 265, 274, 279, 285-287: a, t, c, g, or other
gaaagagacttactactctgttgccatgatggagaggttacttcttcgctttccggagttgtattttgagcaaaacatggaggacatatggataatattatgcaagttgttgatccatcctcattcgatgttgcgtagtatttcaagctctctggtagcatcatattttgctacagcgganaagaggncagaacaganattggatgccccatcatggttgcttgttcaacngagcaggcnattcataatagntggttncctggtngaggcattngaggnttgacnnngttg

SEQ ID NO: 3511 - DNA, 259 bp, Zea mays
  misc_feature: Incyte ID No: 700611758H1
aagaagaccgccttcgaactcgaggcatttgagactagcttcgatgcagttgcacagcgactgggagcagcaggagagaagctcaagcaaaggcaggaggggtttcctcaggtcgctgctcacgaggcgccggtggaggaacgacgagtcgtccttgtacagttacttggatgagtactgattgctggagttggaactgaaaaaagtctggtgttaactgaatcttctatagatggatgcgatgctctctgctttgcca

SEQ ID NO: 3512 - DNA, 251 bp, Zea mays
  misc_feature: Incyte ID No: 700611759H1
  unsure 4, 31, 60: a, t, c, g, or other
gaanccaagccaaactgagtaagcagctatngagggatccgccgccgctccgctccgcangcgcatctgcatcatcgggagcggtcccgctgcgcacacggcagccatctacgcggcccgcgcggagtcaagcctgtgctcttcgagggctgtggccaacgacatcgccgcgggcgggcagctcaccaccaccaccgacgtcgagaattcccgggcttccccaacggcatcatgggcgccgacctcatggg

SEQ ID NO: 3513 - DNA, 286 bp, Zea mays
  misc_feature: Incyte ID No: 700611764H1
  unsure 5, 14, 17, 32, 138-139, 189, 199, 202, 213, 240, 253, 263, 267, 278: a, t, c, g, or other
tccantcgatcatnggnatggacgcggatgtnattcaccattgagaactcgcggtccgacgagaagctgctctccgtgttccgcgagggcgtcaagtacggcgcgggcatcggccccggtgtctacgacatccactcnnccaggatcccgtcggctgaggagatcgccgaccgcatcgacaagatgtgnggtgctgganacnaacatcctctnggtgaaccccgactgcggcctcaaganccgcaagtacacngaggtcaaancggnctgaccaacangtctccgt

SEQ ID NO: 3514 - DNA, 293 bp, Zea mays
  misc_feature: Incyte ID No: 700611766H1
  unsure 67, 200, 217, 223, 241, 264: a, t, c, g, or other
ccgaactcgcacctcgcacctcgcatcgtcttgtcgacacacctccagctccgaaaccctactccgncggcgatgtcgtcatccggcgccccggccccggcggcggcaatggccgttgacgacgcggaggacgaccagctcgcctccatgtccacggaggatatcatcgggccttcccgccttcttgacagagatctgtntctaaaaggacgagttngcaagnggacgaacctggagttgnaagtcgttcaaggagaagattanggaaaaccaagagaaattaagctcaacaa

SEQ ID NO: 3515 - DNA, 289 bp, Zea mays
  misc_feature: Incyte ID No: 700611768H1
  unsure 55, 202: a, t, c, g, or other
cgtcgaacaggagtcaaagtcagaagttcttcgcagccagttgcaagtcgctcgntcagaggctgaacatgccattcaacttaggcaacgatttgatggtgccgttgtctcaaatggcacaggatctaattctagcctgctaatgattaccccaacagaacacacagctgctatgatacagggttctgataaggctgacgtntcctcagttgcaatcactgaatccagcaacctcgcttgccccttacagtcagtggcatgggagatgagccgaagagacggcagcagc

SEQ ID NO: 3516 - DNA, 288 bp, Zea mays
  misc_feature: Incyte ID No: 700611770H1
  unsure 33, 35, 41, 181, 201: a, t, c, g, or other
ctgccgaaacaatctggagtaatatattaattntncagcgngccaatctaatatgagttatgttctttttggtgttcctttcaagggaaacgctcggcggcgaagtaaagcagagcttgcgctacacgcgctgcgagcagtttctgtctaaagggcaaggtctgatctcatatttgagctncccgtggatgctcgcccggncagccaccatcccggtcttgcgctcggcggcgtgcatggtgtgctcgtccctgacagtggctagcttctgtgttcttattgaggcta

SEQ ID NO: 3517 - DNA, 291 bp, Zea mays
  misc_feature: Incyte ID No: 700611773H1
tgtgcagtctatgagtaatcgagagaaccaattagctggcggttccagtgagctagccgcaaagcagcatcttgtaactgctgatctcactagcattataatccagctcatatctactgctggttccctgctcccttcaatgaagaatccacttcttagcagcaatccagcagttaggcagcttggcaactcttggttctcctatgggccttggcatgaatgctaatcagagaccaagtgtagacagcaagactggatattctgacacaggaaaaacttctggatatgatg

SEQ ID NO: 3518 - DNA, 287 bp, Zea mays
  misc_feature: Incyte ID No: 700611774H1
  unsure 61, 263: a, t, c, g, or other
tctccccgtcaaggccttttgagagtccgtgagtttactttagcggaaattgagcactttntggacccagaggacaaatcccatccaaagtttggtgatgtttctgatctagagttctggatgtttccgagagaggatcaaatggcaggaaggtcagccacaagacttaaactcggaaattctatattgaggtattatctcctgatatttctctgttatatatttttgacaatatgatatctgagctcttcttttgctactantgataccatctataaacttgtaat

SEQ ID NO: 3519 - DNA, 63 bp, Zea mays
  misc_feature: Incyte ID No: 700611775H1
  unsure 31, 37, 42-43, 53, 60: a, t, c, g, or other
agacaatcctcagccttagatttctcaagantacgtnctctnnagggctgganatgcgcntgc

SEQ ID NO: 3520 - DNA, 291 bp, Zea mays
  misc_feature: Incyte ID No: 700611781H1
  unsure 260: a, t, c, g, or other
gacttaggaaaactgacaacaacaggattgctaaagcttgtggagcagttatagtgaaacaggcctgaggagctccaagaatctgatgttggaacaagagctggcctgttcgaggttaagaagataggtgatgagttcttttcctttattgttgactgtaaagatcccaaggcatgtactgttctgtttgggagcaagcaaggatgtattgaatgaagttgagagaaagctgcaggatgccatgtccgttgcaaggaaantttggaaaaatccaaaactccttcctggagg

SEQ ID NO: 3521 - DNA, 286 bp, Zea mays
  misc_feature: Incyte ID No: 700611783H1
  unsure 23, 79, 123, 155, 205, 272-273, 277, 279: a, t, c, g, or other
aacttgacagtccagtgctaganaacggggataactggagcgtgggacagcggcaactttattgcactgggtagggcgntgctcaagcaggcaaaaattttggtactcgatgaggcgacagcntctgtcgacacagcaacagacaatcttatccnaaagatcatccgcagtgaattcaaggactgtagtctgtaccattgctcancgtattcccaccgttattgacagtgaccttgttctggtcctagtgatggtaaaatcgcagagttcgnnacgncncagacgg

SEQ ID NO: 3522 - DNA, 288 bp, Zea mays
  misc_feature: Incyte ID No: 700611784H1
  unsure 10, 22, 30, 38, 45-46, 50, 52, 67, 69, 76, 81, 89-91, 118, 147, 162, 213,: a, t, c, g, or other
tcaaatctantctagaagggtnaagttggnggaggagnaacaggnncttnanagacaactccaattnanacatcanagggnacttgagnnnatgaagattgatgaagattgggatcanagccatcaatccaaagagcaaattgaggncaacctaatgatganacaggaagctgcactcaggcgggtagagcacttgcatatgcattttctcancagtggaggnantctggtcgaacnntaacccctanttttacggaaccnggganncccaatggggctggagctnna

SEQ ID NO: 3523 - DNA, 287 bp, Zea mays
  misc_feature: Incyte ID No: 700611786H1
  unsure 2, 4, 14, 45, 64, 79, 102, 128, 146, 176, 191, 286: a, t, c, g, or other
ananatccccaaancctacacctgcccgccggcgcactcggggancgtcgaatcgagcaggttnacggaggagagggancctcgaagatgttccggaaccantacgacaccgacgtgacgacatggancccccaggggcggctgtnccaggtggagtacgccatggaggccgtcangcagggctccgcgcntcgggctccggtcgagcacccacgccgtcttagccgccgtcaacaagcccgcctccgagctctcctcctaccatcggaaggtgttccggtcgctna

SEQ ID NO: 3524 - DNA, 291 bp, Zea mays
  misc_feature: Incyte ID No: 700611788H1
gttgatcgaggcaaacaaagtttggagactatatgccttcttcttgcttacaaaatccaagtaccctgagaacttttttcttctgaggggcaatcatgaatgcgcctcaataaacagaatatatggattctatgatgaatgcaagcgtcgatttaatgtgcggctatggaaggtcttcacagaatgtttaacactctacctgtggctgctcttatcgatgataaaatattatgtatgcacggcggactctctcctggatctagcacacttggatgagataaagaacttgcc

SEQ ID NO: 3525 - DNA, 285 bp, Zea mays
  misc_feature: Incyte ID No: 700611789H1
gatagataacatgtcatttctccatccatccacgagtggcttttgcttgctttggtggggggctaccagcagccgcagctagagcctctctctcgtccctctgtttgcaacctttttttttacttgcaaaagaagcttgccgtgggctccatgaataagggcgtttgctttgttgtcctagagtatatcaaaggaattgtttgtgtttcgcctgtaccagtgctagctagtagtaacagtgtccccctgtttcgctagtagtaatggtgtttattagtcaagtgg

SEQ ID NO: 3526 - DNA, 280 bp, Zea mays
  misc_feature: Incyte ID No: 700611792H1
ggccaaggaagtccttacaaggttcccagatatatcgtcagtccagcttagaatgccgaaccttcactttctgcctgtcaacttggggagcaaagaagctccgctggtgaagtttgctgatgatgtgtacctgccgacggatgaaccacacgggacgattgaagcaaccttaataagccgtcctgtcaaagctgtaaaaaaaatgtagtcgtcaggctggtattagatcctgcttcgtctccccagcatccccagcttaaaatggacagtaagctgtaag

SEQ ID NO: 3527 - DNA, 282 bp, Zea mays
  misc_feature: Incyte ID No: 700611794H1
  unsure 18, 39, 63, 84, 204, 220, 247: a, t, c, g, or other
ctttcaggacgatgggantgaagtcagtattgcggcatntgaattggtgagcgacatcactgntcgtatagggactacaaagtnttacctcacaagtttccgctcctctccaagtgtgctcgctttcagaagttgattccaaccactggtgatgaaaatattgagatccacatccatgatatcctggtggcgcaaaggcttttngggtctgtgccaagtnttgctacggcatgatgtgcacactcantgcctacaatgtgattgcagcccgctgtgctgcag

SEQ ID NO: 3528 - DNA, 283 bp, Zea mays
  misc_feature: Incyte ID No: 700611795H1
  unsure 2, 6, 9, 21, 25, 31, 35, 67, 79, 96, 121, 126, 251: a, t, c, g, or other
gntaantanccccgcgctggntcgncaccgncgcngcagcagggcgtggggaatctgggcagcggcncgcggagaagangaggcagcgcgctctcngtccgccatggcgggctcttccgancccgncaagctcatgagcaaagccgacaaactaacaaaattgagttttacaagatggaatgctatggaaaagcgctacctccttgtatgagcaagctgcaattgcgtattaggttcagaaaggacaatgngaaagcaaaagatgcttttgagaggctcaaaa

SEQ ID NO: 3529 - DNA, 284 bp, Zea mays
  misc_feature: Incyte ID No: 700611796H1
  unsure 61, 66, 164: a, t, c, g, or other
gaaagaagtgctccggggaagcaccgtgacacccttgctcgcccgcatctctctaaccgcncggcnccggcgccgggccggccatcgttcacatggctgcgatgccaccggccttcacgggcaacctgaagaaagcacttgcaggtctgagaagaatcaatttngatgggcttcgatggcgcgtttgatgctaagggtcaggtgctgggacgatggcttcccaaatagccgttgtgcttcaaggcaaggataaaccggacctatgcgccacatgtggaaaatgg

SEQ ID NO: 3530 - DNA, 139 bp, Zea mays
  misc_feature: Incyte ID No: 700611801H1
  unsure 106, 113, 118, 121, 123, 126, 128, 133, 135, 137: a, t, c, g, or other
attcagatgaagctggtgacaaacaggaagatggcaatgcaaaggcagaagaagttgaggatgtcaagatgactgaggctgacacgggaagtacagaggtcaaagntaaagangaganggnanttnanttttngncncc

SEQ ID NO: 3531 - DNA, 127 bp, Zea mays
  misc_feature: Incyte ID No: 700611805H1
  unsure 2, 48, 59, 69: a, t, c, g, or other
anaaggaagaaggtcatgtcgtcggcggcgcagcagtcagcagaaagncggcggcagcngaagcaggangaggtggagcacgggccatttccccattcgagcagctccaggctttctggaatagctg

SEQ ID NO: 3532 - DNA, 285 bp, Zea mays
  misc_feature: Incyte ID No: 700611806H1
  unsure 145: a, t, c, g, or other
atttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgantgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcat

SEQ ID NO: 3533 - DNA, 288 bp, Zea mays
  misc_feature: Incyte ID No: 700611807H1
ggctaaaattattaaacaattgatttcttgtctcctatcattggcttgaggctaaaattatccatccattctggacacatggaagcactctgctgaaagcacacactggcccaaaacaatgtcgaaagaaaactgttcagggagcgagactaagcggtgctctgaaggcgaaggccagagaagagtcactgtcgacagcgctccccaaatcctttccacaaacaagtagaagagcagaaccaagtgttggtaaaccacaggatcttgcctgggatcgcgcctgtacat

SEQ ID NO: 3534 - DNA, 283 bp, Zea mays
  misc_feature: Incyte ID No: 700611809H1
gtggacactcgcgcacgggtgattgctgccctctggcagtatattaaagcaaagaagcttcagaacccaaatgatccttccttcttcatgtgtgaccctcaattgaagaaggtgtttggggaggacaagctcaagtttgcaatgctgtcacagaggatatctcagcatctgtctgccccgccacccatcaatttggagcacaagattaagctgtcggggaatgaagcgcatagcagtgcttgctatgatgtgctggtggatgttcccttcccgctgcagaaag

SEQ ID NO: 3535 - DNA, 274 bp, Zea mays
  misc_feature: Incyte ID No: 700611810H1
  unsure 245, 252, 260, 268, 272-273: a, t, c, g, or other
cgattgatgatctaggtcttgaatctagtaaggatgtggaatcaagcaatgctttgctaagcagggcctggtctcctggctggcgcaatgcagagaacatgcttgaggaatttgtgtcttatggtcttccagaatattcagaacatggtatgaaggttgggggaagtactacgtcattattcagaacatggtatgaaggttgggggaatactacgtcattattgtcaccgtatctccattcgggnttaggtnaagggganttccaccntttnna

SEQ ID NO: 3536 - DNA, 102 bp, Zea mays
  misc_feature: Incyte ID No: 700611815H1
  unsure 17, 20-21, 37, 59, 75, 89, 93-95: a, t, c, g, or other
ccctagtgccagatagnatnnaccgccatgagaggtnaaattcaatccaggtccgtaantgttatggattgatancattgataaggttncttnnnagaggtg

SEQ ID NO: 3537 - DNA, 284 bp, Zea mays
  misc_feature: Incyte ID No: 700611816H1
  unsure 271, 278, 283: a, t, c, g, or other
atggactacagactatggttgttcagataaggaagaagagttccagtggctcattaaatattctccccttcataatgtacggagaccttgggagcaaagctctggtaataactgccagtatccagcaaccatgttgttgacagctgatcatgacgatcgtgttgtgccattgcattcactgaagttattagcaactttgcagcatgtcctgtgtaccagcactgaggacagcccgcagacgaatccaataattggtcgcattgatcggagncagggcntgaanc

SEQ ID NO: 3538 - DNA, 284 bp, Zea mays
  misc_feature: Incyte ID No: 700611833H1
  unsure 174: a, t, c, g, or other
ccttccctggcggcaacgcctgggcggacgagcgccgtcgccctgccagttcttcgtctgtcccttcgcctgtgattggcgccgcgaccttctttggatttcggccctttcgcgccggggactagcgcccaccaggagcaagattgatgccttgaagggctatatagggttggncacggttgacctgatcgactgaaactgaaatggcattggtggtgaagcggtaccgatgtacgcactccgtgagctgtgcttgcctcaagggcatgtcaggaggatgcaat

SEQ ID NO: 3539 - DNA, 170 bp, Zea mays
  misc_feature: Incyte ID No: 700611836H1
attgaaacaatctggggcagaattgggcacttcaatccttttctttggatgcaggaaccgtaatatggactacatatatgaagatgagttgcaaactttccttgaggagggggcgctttctgagctaattgttgcattctctcgggaagggccaacgaaagaatatgtgc

SEQ ID NO: 3540 - DNA, 97 bp, Zea mays
  misc_feature: Incyte ID No: 700611838H1
  unsure 3, 12, 26, 36, 53, 60, 63, 95: a, t, c, g, or other
agnggctatgangtgctgttcatggnggatgccatngaacgagtattctattngacagcnganggagtttcagggcaagaagctcgtactcagcnac

SEQ ID NO: 3541 - DNA, 96 bp, Zea mays
  misc_feature: Incyte ID No: 700611841H1
  unsure 53: a, t, c, g, or other
aacaaagcaggagagatgacttagagtctcttggttatgtgctgatgtacttncttaagaggaagccttccttggcaaggcctgaaagctggaacg

SEQ ID NO: 3542 - DNA, 274 bp, Zea mays
  misc_feature: Incyte ID No: 700611842H1
  unsure 44, 234, 255: a, t, c, g, or other
gtttagcattggtgctggcataaatgcatatagcaatctaggantattggctgtggttacatggcaagttctgttcgtctctgtgccaatgattgttttggcaatcaggttgcagaggtattatttagcctcatctaaggaattgatgaggatcaatggcactaccaaatctgctctcgctaatcacttgggcgagtcgattgcaggggctataacaataagggcttttcaggnagaagatcgtttctttgaganaaacttggaacttgttgac

SEQ ID NO: 3543 - DNA, 189 bp, Zea mays
  misc_feature: Incyte ID No: 700611844H1
  unsure 172, 174, 180, 185, 188: a, t, c, g, or other
cacaaaacaacaatttcatcattccagcagcatcaaacaacaatttcaccaccaaacaacaattttggtattcaagtagcatcaagttattggacgataatacaagcaatatttgtggaatgataatgcacaacattctagcaacaatataatttacccgcgatgagcccangncttgancactngana

SEQ ID NO: 3544 - DNA, 281 bp, Zea mays
  misc_feature: Incyte ID No: 700611849H1
caaatgtgcttgcagctgccgatcttatcctatggaggaacaggaagatctctggcggggtacttgctggtgccacggccatctggctcctattcgaggtcatggagtaccatctcctcaccttggtgtgccactgtctcatcctctcgctggccatcctcttcctgtggtccaatgcctccactttcatcaacaagtccccaccgaacattcctgaggtcaaaatccctgaggatgtggctgttaatgttgccctgtcactgagatatgagatcaacagg

SEQ ID NO: 3545 - DNA, 278 bp, Zea mays
  misc_feature: Incyte ID No: 700611851H1
aatggagccagctggtctcaactactggaaactcttccccttcctaatataaaatggatatgccccactgcaccttcaagacccgtgtcagtgtttggcgggttcccctccacagcatggtttgatgttgctgatctttctgaggatgctcctgatgacattgagggaatcgatgcctcagcagcacatgttgcgaatttgttgtcaactgaacctgctgacatcaaacttggtgttggcggctttagtatgggtgctgctactgctctgtactctgc

SEQ ID NO: 3546 - DNA, 272 bp, Zea mays
  misc_feature: Incyte ID No: 700611857H1
  unsure 22-23, 31, 68, 82, 93, 96, 146, 183, 186, 189-190, 198, 230, 254, 261: a, t, c, g, or other
aagagacttactactctgttgnnatgatggngaggttacttcttcgctttccggagttgtattttgancaaaacatggaggncatatggatantantatgcaagttgttgatccatcctcattcgatgttgcgtagtatttcaagntctctggtagcatcatattttgctacagcggagaagnggnaanntgaacagntattgggtgcccatcatggttgcttgttcaancggaccagggcaatcctaatagcngtttccntgttgaagcca

SEQ ID NO: 3547 - DNA, 276 bp, Zea mays
  misc_feature: Incyte ID No: 700611858H1
  unsure 37, 51, 66, 106, 180, 199, 209, 245, 252, 255-256, 263, 266, 269: a, t, c, g, or other
tgttctttcaatgtgattgcctacaaggataaaccangtttgcgaacaggngctggagatgctganaacgacacaagagatagaaaggcgtctagaagaggtttcnttgcccttgatcattttgcacggtgaggctgatatggttactgacccggcggttagtaaggctctgtatgaganagccaagagccaagacaanaagctgttcntctacaaaggtgcgtatcacgctatcttggaaggtnaaccggnccnngagtatnttnccnattttcg

SEQ ID NO: 3548 - DNA, 272 bp, Zea mays
  misc_feature: Incyte ID No: 700611860H1
  unsure 181, 184-185, 260, 268: a, t, c, g, or other
aggatgcgagtacaaacctcgctggaagtgctgatgatctacctggtaatatccatgatgatgagcaaaagaacatccctgaacatggtgctgaaatgacttctccagaagccaaatctgttctgaggttgcggaagacttctgaggaaggcaacaaggatgtcaagcaggagattggtcncanncaaacggtgagagcaccaatgcagaagggaggcttccaatcatacatcatctggctggttcttccggtggtctgnccctgctnctcc

SEQ ID NO: 3549 - DNA, 303 bp, Zea mays
  misc_feature: Incyte ID No: 700611864H1
  unsure 40, 43, 73, 111, 117, 145, 158, 162, 181, 189, 206, 261, 280, 288, 290-291,: a, t, c, g, or other
cgagcagaagccacaaggttgggtcctcatttccactttncanttgcggcttccggtggcccatacgccgtcnccgaacggcagcgcagggactgaaggatgagtgaagangataangttgctgcttctgctgaggaagctaagnagggcccctaagnctcnatgaaaaggatcctcttcntctctgtncaggaagtccgtagctngttcatccatggaatgaatctcgaagatcggtcctggggctcctgctgtaattcnaaggttgttggtgagatcncaaagggnannaaantccaaatt

SEQ ID NO: 3550 - DNA, 279 bp, Zea mays
  misc_feature: Incyte ID No: 700611867H1
  unsure 277: a, t, c, g, or other
atctactgaaggaatatgatgagaacgatcctgtaaatagaaacacacatattgccaatctgttgcaggatataatggaaatcatcacacaggatattatgaaaaatggaaaaggtatcttgaaggacgagggccaaaaacaacaactgtttgcaaaattaaatctggattcattgaagcatgttgcttggagggagaagtgcattaggcttcaattgttgttgacaacaaaggaatctgccatatatgtaccaacgaacttggaagctcggcgtangg

SEQ ID NO: 3551 - DNA, 278 bp, Zea mays
  misc_feature: Incyte ID No: 700611868H1
  unsure 133, 136, 146, 208, 269: a, t, c, g, or other
gtctgctcgcatttcctcccaatccatcccgcctccaaacccgaactccaagtcgccccgcatcgatggcgcccaaggccgagaagaagcccgcggcgaagaagccggcggaggaggagcccgctgcggaaangcngcgggcgggnagaagcccaaggcggagaagcgtgtcccagcaggcaagtccgccggcaaggagggcggcganggaaagaggggccggaagaaaggcaagaagagcgtggagaccttacaagatctacatttcnaagtgttga

SEQ ID NO: 3552 - DNA, 265 bp, Zea mays
  misc_feature: Incyte ID No: 700611874H1
  unsure 15, 21, 30, 46, 49, 69, 74, 80-81, 166, 170, 203, 239: a, t, c, g, or other
tgttggtgaagctgnagctgnaacacaatntatccattctcctttnggngaaactgaagctgcaacaanagganaatggnnatattgtgttggtgaagacatgaacatgtattgctttagctaccaatctggtaaactggagcatctgatgatggtgcatgagaangatntcataggcattacgcaccatcctcacaggaacntagtagccaccattgctgaggatgtatgatgacgtntggaagcttgactttttctttttaaa

SEQ ID NO: 3553 - DNA, 270 bp, Zea mays
  misc_feature: Incyte ID No: 700611877H1
  unsure 185, 218: a, t, c, g, or other
aaaggggaaaatgatttcttaaaaaagaggagtgacccggtctaccggagcgtacggtgccgatcccgtcgccgccgctacccctcaatcgcgagcaacttcttccggattcgcaccaagctctccacaattctatcgctatgctgcggaaggccgtcgtcgccttcatcgcctgcaccgccttnttcctcgccttctctgcctactcccgtcggcanggcgttggagaggttcaattaccagcagttactcacagggtctacctagatg

SEQ ID NO: 3554 - DNA, 271 bp, Zea mays
  misc_feature: Incyte ID No: 700611878H1
  unsure 220, 249, 262, 270: a, t, c, g, or other
cgatttgctgaatcaaaaaaggagctggacgctctcctgtcagatgattccttggcaaatgttccatttctcatccttggcaacaagattgatatcccgtatgctgcctctgaagaggagctgcggtatcacctaggccttagcaacttcacaaccgggaagggcaaggtcaaccttgggcgactccaatgtccggccacttgaggtttcatgtgcatgntgttcgcaagatggggctaggcgatggtntcaagtggggctnccaatacnt

SEQ ID NO: 3555 - DNA, 276 bp, Zea mays
  misc_feature: Incyte ID No: 700611879H1
  unsure 3, 13-14, 18, 39, 47-48, 52, 69, 83, 91, 100, 104, 115, 118, 138, 144-145,: a, t, c, g, or other
tcnaccaaattcnnagtnacagcggcgaaactctcgganatgtctgnncgcngcaaggggcggaaaagntctgggcaatggtngcgtcaancgccatccncaantgctgcgtganaanatccaaggcatcaccaagcnggcganncncagttggcgangaggancggcgtnaagcgcattcttccggctcatctacgangaagaccgngggctgctcaatatcnttnctcgagnacgtcattcngcgaagcngtcaccttacaccgagctagccng

SEQ ID NO: 3556 - DNA, 275 bp, Zea mays
  misc_feature: Incyte ID No: 700611881H1
ccagttcggctgtcgaaccggaactgaagcaacatttgttctgtggaaattgggatggctctggctagggtttcaccgtcttccttagcgaaccttataccgcccctgctccaatccttcttccgccctttctcctcggactttcccatccgcaattcccgccgaagaagctcccccgttgctgccgccttctctcttacttcacaatctgcccacgctgcgagggaggggctggtcatggaggcgcccaggccgagctccaggtatccttggaa

SEQ ID NO: 3557 - DNA, 110 bp, Zea mays
  misc_feature: Incyte ID No: 700611885H1
  unsure 22, 44, 47, 87, 101, 105: a, t, c, g, or other
tcaaactgttcctgggcaagangaacagtttgagatgacttcangcncaagatgttttaatgtttcgaattggttctccaaacctgntccctgggcaagancgcnggcag

SEQ ID NO: 3558 - DNA, 262 bp, Zea mays
  misc_feature: Incyte ID No: 700611890H1
  unsure 7, 20, 28, 32, 38, 42-43, 47, 56, 60, 68, 71, 83, 95, 102, 107, 112, 114,: a, t, c, g, or other
ggttgancggtgctcgggangaagatgnttancgggangcannagangtgcaaggngtgnaccaaganggngtacccgatggnccagctctccancgacggngtcgncttcnancgcncctgcttnaagtnncancactgggagtctaccctctcactgagcaactattcctcgttacgaaggagtgccgtatgcaaganccattcgngcagctnttcnaggagacngggagtaacacagagcttccaatcaaantnactga

SEQ ID NO: 3559 - DNA, 267 bp, Zea mays
  misc_feature: Incyte ID No: 700611892H1
  unsure 182: a, t, c, g, or other
atatttttatttaaatattaattttttgtggtgttacacgcgagctgaaaagagtattttcttaaatatcttattgcgatatcctaatttgtatcgacttttcctaaaggatgtcacgtacaaataaaccaaccaaatatacctcgatacattatattagctttaattttgtttctcatttnttctttctattttaaatttaaaattcaagtctaatttagagctaagttcaaatttctatttcgagcataaattgcaacaaaaaat

SEQ ID NO: 3560 - DNA, 267 bp, Zea mays
  misc_feature: Incyte ID No: 700611894H1
atacaatgatgatactatgattttattctggatatgatgatgtacttgtggcatttaggggactcgagcagtttctcgagtacctctccgtaaggacctgttcgttgagagaccacccgggataacagtgcaaccatgagggtgaaatgagatgcccagagctaattaattagaggaactagaggtgtagttgcttcgccgttgtgccgtcaatggggtccaggcacagtgcttgctctgccgaggctgagtgccgaggtttttttt

SEQ ID NO: 3561 - DNA, 269 bp, Zea mays
  misc_feature: Incyte ID No: 700611895H1
  unsure 8, 96, 209: a, t, c, g, or other
agggtttntgattttagccgccgccgctgctcatctcacatccctcgagaagacgcctgctcctcgccgatcgatacgatggccgtcttctccganctccacaccgccgacggcctcaagtccctcgaggctcacctcgccggcaaaacctatgtgtctggtgactccattactaaggatgacattaaggtcttcgccgcggtgccgtngaagcctgggcgctgagtttctaatgccgccgtggtacgagaacgtctctgcggctgtag

SEQ ID NO: 3562 - DNA, 278 bp, Zea mays
  misc_feature: Incyte ID No: 700611902H1
gaaaaggaaggagaatcaaagttgagtggaccaaggaggatcgcactgctgatcgaagaggcaactcaaggaggtctccaaccaatgcaaaaccgaccaaaaccttgttcgtgatcaactttgacccgatcaacacgagaattcgagatctggagaggcactttgataaatatggcagggtcgcgaatgtaaggatcaaaaagaacttcgcctttatacagtttgaggcgcaggaggatgctactagagcattggagggtgctaatgggagccatttc

SEQ ID NO: 3563 - DNA, 92 bp, Zea mays
  misc_feature: Incyte ID No: 700611903H1
  unsure 11, 18, 33, 38, 49, 51-52, 65-68: a, t, c, g, or other
gttgctacggntatactnctagcgtagtaacgncaagnccaacgtccangnntttggttcagatnnnnagaagagtgtagtaggtcttctaa

SEQ ID NO: 3564 - DNA, 275 bp, Zea mays
  misc_feature: Incyte ID No: 700611904H1
  unsure 47, 62, 201: a, t, c, g, or other
aacgccttcaagcccatctcggtagccggagaacgagcagcagcggnaggcgatggcgtccncggatcccggccacacgccggcgcaaggcgaggaatctgcctccccctcctcgtggcctccccgaaagctccagagtttcacaccagggctgtggtcacaatacaaagcttatgaggatgcagttgtggagaacattanaggaactattgcggatgctctggttcttgtgagagagcatcaggcggaggcaattggatgtgccactgttgcag

SEQ ID NO: 3565 - DNA, 274 bp, Zea mays
  misc_feature: Incyte ID No: 700611905H1
acgccttcaagcccatctcggtagccggagaacgagcagcagcggaggcgatggcgtccggggatcccggccacacgccggcgcaaggcgaggaatctgcctccccctcctcgtggcctccccgaaagctccagagtttcacaccagggctgtggtcacaatacaaagcttatgaggatgcagttgtggagaacattaaaggaactattgcggatgctctggttcttgtgagagagcatcaggcggaggcaattggatgtgccactgttgcagg

SEQ ID NO: 3566 - DNA, 273 bp, Zea mays
  misc_feature: Incyte ID No: 700611907H1
gccgcaaagagggctgaaggagaagcgaggaaaggtgaggccgatagatagaggagctgcggcgccgccggcgagcgaagagtggaggatccgatccgaagcgagaggactgaatcctgcggccgggagggacgcgggaccacgacgagcgtcgtcgtcggtgccaagcaacggcagttgtccctgtccagagcacaggcaagatggttaacgcgatcaaggggctgttcatctcctgcgacgtacctatggcacagttcatcgtcaacctga

SEQ ID NO: 3567 - DNA, 273 bp, Zea mays
  misc_feature: Incyte ID No: 700611908H1
  unsure 33, 44, 46-47, 57, 61-62, 64-65, 83, 85, 87, 117-118, 134, 171-172, 210,: a, t, c, g, or other
taagcaggttaaaatgtggcccctgcttatcanagcctcctganannacagtcaacncatnntnnttccaagccgagcacagnancngttgatcgtgcgaaatggagggttgactgnnttctcaggaggctgtnataagcaggttaaaatgtggcccctgctctcaggtgnncagcccacggttttctcaggccatgaggcacctattanagaactacgcttgggtgccacngatgaatcttcttgtcagtggganctgggacaagactttga

SEQ ID NO: 3568 - DNA, 276 bp, Zea mays
  misc_feature: Incyte ID No: 700611909H1
gaagcatggtgcacgtataccgacccggcaggaagtgctggacaagaaagaagccatccaggaggcctataattttgtgtattcagctgcaactgtacagcagatgctgcgagagaaatcagctgtgagacgccctatcaatattgctgctgagaaggatcggttgaggagtgagttggagatggccctgagccgtaggaatgaagctgaagcagagaggattcgtgtgaagctgaaaaatctgcaaagcaggccacaaccggtgtcaaaggataa

SEQ ID NO: 3569 - DNA, 272 bp, Zea mays
  misc_feature: Incyte ID No: 700611910H1
  unsure 27, 33, 46, 61, 96-97, 109-110, 116-117, 124, 128, 134-135, 143, 145, 147,: a, t, c, g, or other
cagattaaaaatctcattgagggcacnagaacnaggattttgaaanggaaagcttccatgngggggtagcaaagcttgctggtggtgttgccgtcnntccaggggggannccaacnngaactgnactnaaagannaggagttnananttgangatgccctaaattgcnacccaggcngcngttgangaangtattgttgttggtggaagatgcacctttgcggctgcannaaagncgatgccntcnagggttacanggagaacgtgancnga

SEQ ID NO: 3570 - DNA, 276 bp, Zea mays
  misc_feature: Incyte ID No: 700611913H1
  unsure 18-19, 48, 54, 121, 190, 206, 244: a, t, c, g, or other
gtcaacaataagcctatnntgcattatcatgcaaggggagcgacgctnttgaanactctcccgtgaggacactaagggccaccttggacacaaggagagccaaaaccaagggggttacatncaattaataactaattatcttattcaaatcgcacccatatggattactcaacgaaaagacgtggttttnaagagaatttgacttntcaaactagccctaattaatggtaattgatatcatcancgataccagcgaagatgcacctatggagaatc

SEQ ID NO: 3571 - DNA, 277 bp, Zea mays
  misc_feature: Incyte ID No: 700611914H1
atcttggattaattgaggagtccaaggtttcaaggccattaccttggaggccagcgactaatgttttccgtgttaaagaggatgttcgacctatattctgggccaacagaccaaagagctatcttaaaaggacattaggttgggatcagtatccccatggacggtggggtgattctcggaacccatcatatggagcacttactgaccaccagttcacaagaccacgaggccgtggtaagaagctccaagaggaatgggctgttccactgaaatctgt

SEQ ID NO: 3572 - DNA, 278 bp, Zea mays
  misc_feature: Incyte ID No: 700611915H1
atcagttgcctgtgatacatctcgggaagttgccaaactaaagtcacgtctggtattgttggaaaggaaaaatgctgaattcaagaagcagatcaatgaattgtcaatgaagcttcaattggccggacaagggaaaaatgaggccctgtataaggctggtccatttggtacagtgaaagctctgagaacaaatccaacagttactcctgatttatccatcaatcccagattggccaacatattggaacaggttgctgtgaagaaagaactgatagttg

SEQ ID NO: 3573 - DNA, 162 bp, Zea mays
  misc_feature: Incyte ID No: 700611916H1
  unsure 76: a, t, c, g, or other
gtccaatctacagttggaatgcgaatccagacgttttgctttagcctatcttattttgctttgtgcaacatgaatnttaagtgtatggggtattacagtgccttgtcttgtgtgaacctgcttatctcgtgctgaacatcgttatgcatggaagtacttatc

SEQ ID NO: 3574 - DNA, 275 bp, Zea mays
  misc_feature: Incyte ID No: 700611917H1
  unsure 6-7, 58, 75, 218, 242: a, t, c, g, or other
gcagannagagcagtagctgctttgaacaaatttggtgagaacgcaaagatgatgtcngatcctatgtggattcngaggctccaacctactcctgagccaactgtgatggttgccgagaagccaactttggcaagtatttggtctgctaaaggcggtactgggcgctgtttgttttaggggaggttgttcacatattcaggccacttgtatatgtacntctgatcagaaagtttggaataanatcgtggaccccgtggctagtgtcgctagctgt

SEQ ID NO: 3575 - DNA, 272 bp, Zea mays
  misc_feature: Incyte ID No: 700611919H1
  unsure 58: a, t, c, g, or other
aagctgctctcgtccctagaaataaagcagctcctccgcggggcggcgaactactacncatcgccaaaaccctagccccgatccggtcgaggagcactacttcttggcatggcgggcacccctagccaggcaagcctcctgctccagaagcagctcaaggatcttgcgaagaaccccgtggatgggttctccgcagggcttgtagacgatagcaacgtcttcgagtggcaggtcaccatcatcggcccgcccgacaccctatatgatggagg

SEQ ID NO: 3576 - DNA, 271 bp, Zea mays
  misc_feature: Incyte ID No: 700611920H1
ccctagcttatcatgtatagcatcatcctggtctcttatcctttcttatatggccacaaatctaactcaacatacacgtttccgcatatctgagaagttctgaactcgatccgttctgtcttgtctgaaaagttccatatctgcaacttgaatccaaattaatggtaaacaaagttgatacattgattccaaatggtttacttttagatttaaaattcaactttaagtttaaaggggaaactacatctatgagaaatgagcttacaccacc

SEQ ID NO: 3577 - DNA, 269 bp, Zea mays
  misc_feature: Incyte ID No: 700611923H1
  unsure 177, 181: a, t, c, g, or other
ccgcctccccctccgctccttccagctcgctctgtaatctgcatcagcctcgcccggggccgtcgccgccatggggaggggaaagttcaaggggaagcccacaggccgccgcaacttctccacacccgaggagatcgctgctggtacttcaggtcggccacgcacctttaagaaganggangaagaggaagatgaggaagaggtagaaagagaagagtctgaggaagaatctgaagaggattctgatgaaaagactaaacataaaggca

SEQ ID NO: 3578 - DNA, 270 bp, Zea mays
  misc_feature: Incyte ID No: 700611926H1
  unsure 4, 10-11, 56-57, 59-61, 63, 68, 84-85, 88, 113, 174-175, 197, 226, 230,: a, t, c, g, or other
gttntctcgnngaaggcagcctcttcctacgtcgccggcgacgtcaccctccgcgnngnnnanggatnccggtcagggtggtanntancgccacgccttcctctcaaccctcnccagggcaagcagcaaatactggacacccatctcctcctagctgttcactcttaagtgctnnaagatctttgctgggactcaanatgtttcaagcctgcagaaggatgtcgcntggnaantgnatgtacgcatccaggttgtgntcttgaacagggt

SEQ ID NO: 3579 - DNA, 246 bp, Zea mays
  misc_feature: Incyte ID No: 700611928H1
gcgtttaacttatgagacgagataggagcctgtgttcttgtcccagtataagatctgcgatggcacgatgcttgtaccatctgtttactatttttatcatgcagtgcatgtgacttgaaactgtgatggacttgtattgctttctgccttatggcacctgtagtagtgaactgatgaaggaagttcatgcggactctgaagctttgttggctagaatggtaattttgctgtattctatttcacagg

SEQ ID NO: 3580 - DNA, 223 bp, Zea mays
  misc_feature: Incyte ID No: 700611929H1
tgctcttggcaccctgatgactgaaggcgcggtggttatccatggagacaacgtgaggagagtttgatgtcttgacggccatctgcggtgatgcttctataaggctccaacccgccacttccttgaacagacaaggttccgaagataactgtagcacttagccgtaacttgtggtccgaggtctaaactggtccagatttgtagcagtattgctagttgtaga

SEQ ID NO: 3581 - DNA, 277 bp, Zea mays
  misc_feature: Incyte ID No: 700611930H1
  unsure 63, 65, 78, 84, 89, 114, 118, 127, 131, 135, 154, 157, 167, 203, 209, 266,: a, t, c, g, or other
ccacctccttctgatgatctccgttatttgaaatcatcagccctggatatttggttacttggntntgaatttccaganacaatnattgntttcatgcacaagcaaatacatgtnttangcagtcagnaganaggnaatcttattgggaccctcnagnaggctgcaancgaggctgttggtgttgacattgtgttgcatgtganaaccangaatagtgatggtgctgcacttgatggatgacatagtgcatgctgctcgtaatccanccaanatcant

SEQ ID NO: 3582 - DNA, 276 bp, Zea mays
  misc_feature: Incyte ID No: 700611931H1
  unsure 215: a, t, c, g, or other
gacagtcttcccagagcttcgccagctaatagaagacatacatgagaaaggccgcaaagagcaagcctcattcacataccaactctgacccaagagaaaacatgctaattcagagaggagtcgcaacaattttgaacgcacttgcattgctccacggtgagttactgaaacacaaagcctttgcaattatattttgatggtgcataagttggatngaggaagtgctggtgcttaagaatgatctgtacagatgtatatcagaggttatgtaaatat

SEQ ID NO: 3583 - DNA, 271 bp, Zea mays
  misc_feature: Incyte ID No: 700611933H1
  unsure 244, 259: a, t, c, g, or other
ctaaccatatcgttcctgattaggatggccgatataccattgtaactgacaggtggcaaaagttcagtgatgtgtttgtggatgaaccaacattagaatatctcgctgcctttgcagatgagtttttggttcatggtgttgatgtggagggcaaaaggtgcagctatgttccttgttatcaagtactacatctgttctcgaatatttgccgcccgctagttcatttcaaactaaaccgcgacanataaaaaagaatggngggattatttct

SEQ ID NO: 3584 - DNA, 268 bp, Zea mays
  misc_feature: Incyte ID No: 700611934H1
gtttctgcatggtctcggtctaatccactgtgatttaaagccagaaaacatattggtaaagagctacagcagatgtgaaataaaagtaattgatcttgggagcagctgctttgagacagatcatctatgttcatatgtgcaatcacgatcttaccgtgcacctgaagttatactgggctgcctatgacaaaaagatagatgtatggtcacttggttgtatattagcagagctttgcaccggaaatgtactttccaaaatgatctcctg

SEQ ID NO: 3585 - DNA, 271 bp, Zea mays
  misc_feature: Incyte ID No: 700611935H1
  unsure 166-184: a, t, c, g, or other
gtgacgacactttgaatctgtcccccgaggatctggtcccgcaaggagaacccagccagcagggagaaccagtcgaggacaagaacaaggaataaacacatgcccagcatagctactgtactgtaccccttttcatacacaagatgccattttccgccgtcgcacnnnnnnnnnnnnnnnnnnngccttggtaataagcgtgttgattcggttccggcccaacggtcccggtgaggctgaggttgagacacgtgcagcttgaactgcatgt

SEQ ID NO: 3586 - DNA, 268 bp, Zea mays
  misc_feature: Incyte ID No: 700611936H1
  unsure 14, 54-55, 57-58, 105, 195-196, 232: a, t, c, g, or other
gggaaagtagcagnagctggtagcgttctcaaatgttacaggtgcatgctaccnngnnacatttcatgcattgaggctactggttcacccatttcaactggaaantggtgttgtaaaaactgcagcgctggcactaaggaaccagttgaaggagacatggtcttagcccatggcaatccaaattgcttgcatganngctgtgtcgtctgcgacagacttgcggcctgcaggnctccaaaatgtgataactcaagagcattggttattt

SEQ ID NO: 3587 - DNA, 181 bp, Zea mays
  misc_feature: Incyte ID No: 700611937H1
  unsure 45-46, 80, 86: a, t, c, g, or other
tcccatcccatatgatgtggtcaatgatctcaagggtggatactnngttgtttgggggatctacctgcagtacccagtancctaanttctgtgttactctagtgcgtgcaactttgctcactctgagcagtagtatgaacctgttgtctgttcctgttgaaagatttcccattttaggtgc

SEQ ID NO: 3588 - DNA, 268 bp, Zea mays
  misc_feature: Incyte ID No: 700611938H1
  unsure 88-89: a, t, c, g, or other
gctactcctcgccgctggggcgagcggggagaggcgggcgctgccgaacgcgcgggtcatgatccaccagccctccggtggcgcgtcnnggcaggcgtcagacatcgccatccacgccaaggagatccttaaggtgcgggaccggctcaacaaaatctatgccaagcacacgggccaggccatcgaccgcatcgagcagtgtatggagagggacatgttcatggacccggaggaggcacatgattgggggcttatcgacgaggtcatc

SEQ ID NO: 3589 - DNA, 266 bp, Zea mays
  misc_feature: Incyte ID No: 700611939H1
  unsure 57: a, t, c, g, or other
gtttcagaagatggtccagcagggtgtacggccaaatgttgtaacattttctgcgancctgaatgcttgcagtcgctgtaatagttttgaagatgcagcccttttactggaacagcttcgcttatttgataactctgtctatggggttgcgtatgggcttttgatgggccatcgagaagcttggtctcaagcacggtccctctttaatcagctgggccgcatggattctccaacatcttctgccttttacaatgctcttaccgatg

SEQ ID NO: 3590 - DNA, 268 bp, Zea mays
  misc_feature: Incyte ID No: 700611940H1
  unsure 161: a, t, c, g, or other
aagaagaaggcccgacgctctcaccgctgccaccaaaatcgcacgcgagccccaagagatccccaaaccctacacctgcccgccggcgcactcggggaccgtcgaatcgagcaggttgacggaggagagggagcctcgaagatgttccggaaccagtacgncaccgacgtgacgacatggagcccccaggggcggctgttccaggtggagtacgccatggaggccgtcaagcagggtccgcctgcgtcgggctccggtcgagcaccca

SEQ ID NO: 3591 - DNA, 269 bp, Zea mays
  misc_feature: Incyte ID No: 700611944H1
  unsure 54-55, 58, 228: a, t, c, g, or other
gcagctcaactccattaccaacaccgggccaaccatgggagctttcatctcttnnggngcagctgcagataaaactggagtcgtcgatatgtccgacgatgaacaagaagaaggcagcggcatggaggcagaagtagccctgggcatcgatccttgctccgatgacaaggagctcaagaagcagctcctcaggaaatacagcgggtgtttgggcaacctgagaaaggngctgtgcaagaagaggaagaaagacaagctccccaaggagg

SEQ ID NO: 3592 - DNA, 272 bp, Zea mays
  misc_feature: Incyte ID No: 700611947H1
  unsure 202-203: a, t, c, g, or other
atcttggcattaattgaggagtccaaggtttcaaggccattaccttggaggccagcgactaatgttttccgtgttaaagaggatgttcgacctatattctgggccaacagaaccaaagagctatcttaaaaggacattaggttgggatcagtatccccatggacggtggggtgattctcggaacccatcatatggagcactnnctgaccaccagttcacaagaccacgaggccgtggtaagaagctccaagaggatgggctgttccatgaaa

SEQ ID NO: 3593 - DNA, 274 bp, Zea mays
  misc_feature: Incyte ID No: 700611948H1
  unsure 10, 14: a, t, c, g, or other
gcacgcgaantggnaggaaattgacatgcttcatgaggtcacgaagcaaatcgaagggcatactatctgtgcgcttggggatgctgcggcatggcctgtgcaggggcttatcaggcacttcaggccagagttggagcggaggatccgcgagcgagctgaaagggagctgttggcggcttctgcataatgtgtcagccatgttgcccctgtactagtttcctgattcttcctaccgaaataatacaaatgatggagctccttctgtgtaaggaaa

SEQ ID NO: 3594 - DNA, 246 bp, Zea mays
  misc_feature: Incyte ID No: 700611950H1
  unsure 229, 240, 242-243: a, t, c, g, or other
ccaaacgcatctactgagtgaggagtattcgtttgattcattcatttatcaggtgcaatcaatgtggcagcgctgctcaaggcagcactgtagcaaagccactcattgcatttttttttgcagtggagccgcgatcgacgtttggaacgttcatcctgtaccgtagcaaaaaaggaattttgttgtatagaaactagaaggaatggatgcatcggcgattgatagacanaaaaaaaaaancnnccc

SEQ ID NO: 3595 - DNA, 266 bp, Zea mays
  misc_feature: Incyte ID No: 700611951H1
  unsure 23-24, 55, 127, 162, 180, 251: a, t, c, g, or other
tgcactgctactaacaaagttgnnaggatttgctcaaggaaggatagtgatggcncttgaaggaggttataaccttaggtccatagcgaactcagtttgtgcttgtgcaaaagttctcttgggaganaaattcacattcaacactccagagatgcaaccatntgaatctacatggagagnaatacaagcggtacgcaatgaattgaagacatgctggcctgttctgagtagcaagttgccagaaaatgtancttgaggataagcct

SEQ ID NO: 3596 - DNA, 265 bp, Zea mays
  misc_feature: Incyte ID No: 700611952H1
  unsure 183-204: a, t, c, g, or other
gctttgccatctcttctaaagccacatcagcaggaccactggtttcttcgaattgcaagagggttgttgtgagggcaatgtcgcagagaggtgcccaaggacttcccattgatctcacaggtaaaagagcatttatagctggagttgctgatgataatggttatggttgggcaattgctaagnnnnnnnnnnnnnnnnnnnnnnagattcttgttggtacatgggtgcctgcgttgaacatatttgagacaagctgagacgtgga

SEQ ID NO: 3597 - DNA, 268 bp, Zea mays
  misc_feature: Incyte ID No: 700611953H1
  unsure 43, 53, 58: a, t, c, g, or other
tgatgaaaatatgaaacttggtgaagcttacactgaactgcanctggcacctnggggnggtgaggaggccatgacatgtatgtgtagtgagctgcccagccaggaggtggaggctccaagcagtgaccctttggagaataatgaagaaacgaaaaatgaagctgctgctcaaggatcagtaaatgaggattctgctcctcgtgctgaaaatgcaaagattgatgaagctgacacagaacaggaactgcttccatctggtgaggccacg

SEQ ID NO: 3598 - DNA, 264 bp, Zea mays
  misc_feature: Incyte ID No: 700611955H1
  unsure 55: a, t, c, g, or other
ggccattgggaagaagctagaccgctacaagaacccatggttagagttgaaaatncagtacggccaaaataaagggaagttctataacgaggaatgtgaccgctttatgctttgcatggtgcacaaacttggatatggaaactgggatgaactgaaagctgccttccgtatgtctcccttgtttcgatttgattggtttgtgaagtccagaactacccaagagttggctaggcggtgtgatacccttatccgactggttgagaa

SEQ ID NO: 3599 - DNA, 268 bp, Zea mays
  misc_feature: Incyte ID No: 700611956H1
taccgcatttcccaagggaaccataccagagcggcagagccttcccctccgctccccagtcccacccgcaccctagccctcagcaaaccctaaccgctcgtcgccatgaaggacacctcgttcaaggccaccggcgccaagcgcaagaaggtcggcggcgccaagcgcgggctcacccccttcttcgcgtttttggctgagtttaggccgcatacctggagaagcaccctgagctcaagggcgtaaaggaggtgagcaaggcggctgg

SEQ ID NO: 3600 - DNA, 197 bp, Zea mays
  misc_feature: Incyte ID No: 700611957H1
  unsure 46, 113, 139, 195: a, t, c, g, or other
atcttttacacgacttcttgagtataaaaaatactctttgaatgangagacggcctcctgagtatgttactgacacgtcctcaggaggccgtctcttcattcaaagagtatcntttacacgacttcttgagtataaaanactcatttgtacaatcctacctgtctattgaattgtctttagaaaaaaaaaaaatncg

SEQ ID NO: 3601 - DNA, 263 bp, Zea mays
  misc_feature: Incyte ID No: 700611958H1
  unsure 54-55: a, t, c, g, or other
cagctcactcatttatctgcaatttgagaggttatttcaattcaaccggaaagnngacgaattgacttacactattgctgctgaggagataccgtttcagctgggattatcaaaaactgacctaaggagggtactgaaatccagcttatctgggattgataagtcgattagcgccatgtacaggaggttgcagaagacactacctccgatgagttgtttcctcgctgtgggacaagtgcaagaaggagtttttggacaaatac

SEQ ID NO: 3602 - DNA, 266 bp, Zea mays
  misc_feature: Incyte ID No: 700611959H1
  unsure 52-54: a, t, c, g, or other
gcagctcaactccattaccaacaccgggccaaccatgggagctttcatctcnnnagctgcagctgcagataaaactggagtcgtcgatatgtccgacgatgaacaagaagaaggcagcggcatggaggcagaagtagccctgggcatcgatccttgctccgatgacaaggagctcaagaagcagctcctcaggaaatacagcgggtgtttgggcaacctgagaaaggagctgtgcaagaagaggaagaaagacaagctccccaagg

SEQ ID NO: 3603 - DNA, 280 bp, Zea mays
  misc_feature: Incyte ID No: 700611964H1
  unsure 2-3, 6, 18, 22, 29, 34, 46, 48, 52, 79, 111, 192, 222, 272: a, t, c, g, or other
gnntangccacgggaatnagangatgcangcganaaagctgtaggntnggcnaatctaaagcccaattgaaggcatganggcgtcgattaaatcgtccccccgacgccgancgcggaggaggatcgggacaaggcagccttctctcggagagatcattaacatcaagttggtagagactggggagaaggagnagctaatggagctactccgcgagcggatcntgagtgcggctggagggatgagatgaaggcatctgcaggctatgcaaggnagaaagga

SEQ ID NO: 3604 - DNA, 267 bp, Zea mays
  misc_feature: Incyte ID No: 700611965H1
  unsure 50: a, t, c, g, or other
attttccgtgcaaaagaagcaaggatatgagttgcaacaactgaagtacntgaatgagcttggtggcagtttaagcgtacaaaatcttgagaatgtcatcggaaaggatgaagccttagagtcgaagctatatctgaaaagtcgccttaaagtttgacacttgtgtggagttctgataatggcatggatgcaatggatattctgcatttggatattctagaaggtctgagaccgccaccccaattgagtaaactcacaatcgaaggc

SEQ ID NO: 3605 - DNA, 270 bp, Zea mays
  misc_feature: Incyte ID No: 700611966H1
  unsure 13, 66, 72, 261: a, t, c, g, or other
aagagaaactacntctgagtctgactactttaagcaagcacttcgccaaggtgcaccagcaaagcntagggnaccaaggattccaagaatgccgcacttacatgatttccagtttttcaataaccaaaggctaaatgaattgtatgaaaaggaagtgcggtaccttatgcaagcgaaccagaagaaagataccattgatggtgaagacgaagatcagttggagccttgacagcagcaggacgggggaagagaagggaacantattagagg

SEQ ID NO: 3606 - DNA, 264 bp, Zea mays
  misc_feature: Incyte ID No: 700611970H1
  unsure 22, 31, 142, 201, 228-229: a, t, c, g, or other
ttctctctccaaaccttaatanccttgatcnctcttacaactcctttacaggacaaatcccatcaggtttgcagaatcttaccaaattgtctgtcttgaatttagcagaaaattccctgtccgggccgattccggatctcanacttcctagcttaagacagctagaatctgagcaacaatgaactgaatggttcgattccnccctttttccaaatcttctcaaatagnnccttcctagggaatctggcattgtgtggaccgccg

SEQ ID NO: 3607 - DNA, 245 bp, Zea mays
  misc_feature: Incyte ID No: 700611971H1
  unsure 8, 32-35: a, t, c, g, or other
gtaatggnggccgcgcctaccaccatcaccgnnnnggtcaagttcgccgggcggacgatccccgtggaggtcccggcagcggcttccggcgcggagtgaagcgcctcctccagccgctgaccaatgtcctcccgcgcggccagaggctcatctgcaaaggcaaagtgctccaggatgccgcaagcctgagctcgatgcaagtagtggacggatccaaggtgatgctcatcgcgtcgcaggggctc

SEQ ID NO: 3608 - DNA, 262 bp, Zea mays
  misc_feature: Incyte ID No: 700611972H1
  unsure 50: a, t, c, g, or other
tgagtccaaaatgtcagttcttcacttcagcataaagaaacacgactctnacgaagctcctatcaaatctaaggagcctttgattttcaatgttggattccgacaatttacggcaaggccactgttttcatccgacaacatcaactgcaataaacacaagatggagagatttctgcaccatggccgattttcggttgcatctgtatacgctccaatttccttccctccacttcctctaatagttttgaagaacagagatggc

SEQ ID NO: 3609 - DNA, 252 bp, Zea mays
  misc_feature: Incyte ID No: 700611974H1
  unsure 50-52, 79, 125: a, t, c, g, or other
gggaaggggaagcctgctcctcatgtaaaaccagtttgagtgattggatnnnatatgccagagtatctctctttttttntttcccatccatttgtaggtgtaggtaatatagtagggttcttagngggatttgtaaagaggcaggcagagttctggatgttttctgtctattatgtagttttttttacatcttcaagtctctgtaaagtacgctatgtaaatacataatgacatccagttcggagtgcgatg

SEQ ID NO: 3610 - DNA, 262 bp, Zea mays
  misc_feature: Incyte ID No: 700611975H1
  unsure 50-51: a, t, c, g, or other
cagctcactcatttatctgcaatttgagaggttatttcaattcaaccggnnagttgacgaattgacttacactattgctgctgaggagataccgtttcagctgggattatcaaaaactgacctaaggagggtactgaaatccagcttatctgggattgataagtcgattagcgccatgtacaggaggttgcagaagacacttacctccgatgagttgtttccttcgctgtgggacaagtgcaagaaggagtttttggacaaa

SEQ ID NO: 3611 - DNA, 260 bp, Zea mays
  misc_feature: Incyte ID No: 700611977H1
  unsure 34, 50, 94, 130, 213: a, t, c, g, or other
attttaactgtagtatggttcatgctcaaatatntggcagcagagttccnactgaagtatatgacagtcccatagcaaggtttaccctcttttnatacctaggaaaaatgtttgcacaggtggtgaaganaccccattgacagaaagtggttcgagttacttggagctgactctgtggattctgtcaagaaacagtctttggttccaagagangcaatagttctagtttctcggtgcatctctcactccaggagaggcat

SEQ ID NO: 3612 - DNA, 271 bp, Zea mays
  misc_feature: Incyte ID No: 700611980H1
gtttgttgtgttagggtttcgtctcgtgtataaggcgttcggagctcgcaaatcctttcctctctcgcgttcgaggctaggtagccgtcaccatgagccgctcggggcagcctccggatctcaagaagtacatggacaagaagcttcagattaagatgaatgcaaaccgtgttgttatcggcacacttcgtgggttcgaccagttcatgaatctggtggtggacaacactgtggaggtcaatggaaatgacaaaacagatattggaatggt

SEQ ID NO: 3613 - DNA, 264 bp, Zea mays
  misc_feature: Incyte ID No: 700611983H1
  unsure 257, 262: a, t, c, g, or other
atcccacggcagcagcagcacgccaacgcagggaacttcccttccttctcgccagcgcagggagcagctagcagccatggcgctcggcacccttgtagcagggacaacgcccttccttcctccctgtttctgtccatggcgagcaggagtttttccctcccatggccgacggcttccatctccatcagccgccatggccgagctcccttggagcaggcgctccccaccgtggcgccctcctccctggcgcttgctcnctcgngc

SEQ ID NO: 3614 - DNA, 262 bp, Zea mays
  misc_feature: Incyte ID No: 700611985H1
  unsure 49, 51: a, t, c, g, or other
aaaatacaaaggaaagttagtagtgaaggaaccaccaagagctgttagngngcgggaagacaagctattcctcgaccagattgattccctaatggaacaaaacgcagaggtcgatggtgacgtggacagtgaagaggaggaagatacaggaatgggcaacgttgatcttacaaattctggcgtcactgcttactaaggcaacactggttgatttgaatgagatttgctgtatagcaccagctatgatctaaaccgttctgtt

SEQ ID NO: 3615 - DNA, 258 bp, Zea mays
  misc_feature: Incyte ID No: 700611991H1
  unsure 48-49: a, t, c, g, or other
aactgaatcgtcctcgtcgtccaaccctgcgattgcctctggtccggnnaaggtctggcaaccgggtgtagatacactggaagatggggaggagctgcagtttgatcctcaggcttacaattatctccgaggttttggcattggctggtcttgcttgagttttgatgttgtgcgtgatcaacttggactcgtccgttcagagttccctcatacattctatggtgttgctggaacgcaggctgagaaagcttcatggaa

SEQ ID NO: 3616 - DNA, 267 bp, Zea mays
  misc_feature: Incyte ID No: 700611993H1
  unsure 65, 99: a, t, c, g, or other
actagttctaggaccgcaagctacttcctccgcctcgacaggcgtcggcgagatggtgaagagangcaagaagagcaagagcaagcgcgtacacgctgncggcagaagcacaaggtgctgcgcaaggtgaaggagcaccaccgcaagaagcgcaaggaggccaagaaggagggcaaggccggccagcggaagaaggtcgagaaggaccccgggatccccaacgagtggcccttcaaggagcaggagctcaaggcgctcgaggcccga

SEQ ID NO: 3617 - DNA, 272 bp, Zea mays
  misc_feature: Incyte ID No: 700611995H1
  unsure 8-9, 11, 22-23, 30-32, 43, 53, 57, 59, 80-81, 102, 134, 137, 139, 142, 191,: a, t, c, g, or other
gttgggcnntnttgtatgtatnncgagctnnntgcattgctcngcgtcagagnggancncaggcaggagacaacatattnnccaaacgttagctgaacagtngtaatatacaaagacgatagatgcggtgctcnttngnaancattaaagcttccggagatggtggagaatcagagatgggatgaaggagnctgcacgncatncacnnncaaatcacgaggtccatcnncgttactgaacntcntanggtaggaanataagtaagtactccc

SEQ ID NO: 3618 - DNA, 269 bp, Zea mays
  misc_feature: Incyte ID No: 700611996H1
  unsure 18: a, t, c, g, or other
taggtttttttgattttngccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagacgtctctgcggctg

SEQ ID NO: 3619 - DNA, 284 bp, Zea mays
  misc_feature: Incyte ID No: 700612001H1
  unsure 187-188: a, t, c, g, or other
caaataacgatggtatggctagttttcgtgcaagaagggcaatttcgtctcttcgtactagaacctatgaagaaggcactttggctgtggaggatatggattgggatgcactgacagtcaaaggaacatgtcaggaaattgagaaacgctatctacgacttacagaagcacctgatcctgccatgcnncaggccagaagatgttctggagaaggcccttgcaatggttgaaacatcagaaaagaattacctttacaagtgtgatcaactaaaatctatccgggc

SEQ ID NO: 3620 - DNA, 271 bp, Zea mays
  misc_feature: Incyte ID No: 700612004H1
  unsure 83, 129: a, t, c, g, or other
ggatagcttgttttacccttgctatcctacccgcattgcaaccttggtaggatagcgggtaagggtgtggtgttttgctctancggagaatcagttcagaaatgcaattatagtcaattactaccaganaatggctagtgtccctagccagaagcttcattttttcaagtttgaattggttcatgctcaaacacgtgtttgatggatatttactccttctcccaccagtttttggatgccccctactgcaacaccaactgatgagcatgtg

SEQ ID NO: 3621 - DNA, 271 bp, Zea mays
  misc_feature: Incyte ID No: 700612006H1
  unsure 157, 160: a, t, c, g, or other
ccagaaccctctccgcaatctccccgcctcgctcccgcctccacccaatggcgtctctccctaacggtggcggcgccgccgcttctggctcatgcggcgcgcgccctgtggacaaggaggtggacttcgccaactacttctgcacgtacgcctaccnttnccaccagaaggagatgctctgcgaccgcgtccgcatggacggtaaccactccgccgtcttccgcaacgcgccccacttccagggcaaggtggtccttgacgtgggcaccgg

SEQ ID NO: 3622 - DNA, 272 bp, Zea mays
  misc_feature: Incyte ID No: 700612007H1
ggacaaaatttataagagctaagtatgagacacaagattttttgaagccaagtttgcgcatttccatcaagatccatcttttaaatctaccacttctgtgaagagtgtagatagcaatttctctagcacttcaaggaaggatgtctttgaagatacaagagaatttgttggagagttgaatatcacactggtcaaaggcaccaacttggccgttagagacatgctaacaagtgatccatatgttgttttaacgctcggagggcagaaagttc

SEQ ID NO: 3623 - DNA, 249 bp, Zea mays
  misc_feature: Incyte ID No: 700612008H1
  unsure 21, 37, 57: a, t, c, g, or other
gatgctgaagccaacaaagantgctaagcagctcaangggcacaaaattatctgatngaggaacaaaaaaggaaccaaagaaacaatctggtggttcaaaatcgaagacaggtgaggctgatactacggttgcaaaattggatattagagtgggccttatcagaaaagcagagaagcatccagatgctgattccctttacgtggaggagattgatgttggagaggacacaccaagaacagtggtcagtg

SEQ ID NO: 3624 - DNA, 265 bp, Zea mays
  misc_feature: Incyte ID No: 700612009H1
gagccaaacaggaatttcgtggttgagaagggacgagggactcctctgaaggatataccaagtgtggcacacagaatatcaaggaagaaaccttctgatcttaaatttcttcacagtattctttttgggaggaaaggcaaggctgtcgattttaaaggacatatactccagttctctggatttgtttggcatgaaagtgatgaaaagcacagagtcaaggcaaaagaaaagctgacaagtgtgtaaaagaaacgctgttggacct

SEQ ID NO: 3625 - DNA, 263 bp, Zea mays
  misc_feature: Incyte ID No: 700612012H1
  unsure 190: a, t, c, g, or other
gtgatggcacttgctccacaggagaaggaacgaattgttgatatgggcggctgctccaggtggtaagactacttacattggcgctcttatgaagaataccggaatcatctatgcaaatgagttcaatgagaaaaggttgcatggacttttgggaaatatccatcgcatgggtgtgacaaataccatagtntgtaactatgatggtaaagagctacccaaagttcttgggatgaattcggttgacagagtattgcttgatgctc

SEQ ID NO: 3626 - DNA, 267 bp, Zea mays
  misc_feature: Incyte ID No: 700612014H1
ccgacgtaggcgcccgccgctaggacttttctgaggaatagagaagttgcagaattcgtgagtggagcattggctggtgcaatgactaaggctgttcttgctcccttagaaactatcaggacaagaatggttgtaggggtaggatcaaaacatatttttggtagctttgtggagattgttgaacataatggctggcaaggactctgggcaggtaatacaataaatatgctccggattatcccaactcaagcaattgagctcgggaca

SEQ ID NO: 3627 - DNA, 269 bp, Zea mays
  misc_feature: Incyte ID No: 700612015H1
gttgccaggatcctgcaaggtagaggcaccacagttagcatgagacccactgaacggatagcacggattttaatctgtgacagttcaaactaatgagtttgtagggcctgtcggtaaggggttctatctagcttcaagaaactgttgttttcagatttttctaccaagtagttttttttcccgaaaccgtgtctcactaaacactattttttattcagctcatctcacgacaaaaagcctttccctgctatcttctctgagaagacaaa

SEQ ID NO: 3628 - DNA, 279 bp, Zea mays
  misc_feature: Incyte ID No: 700612017H1
  unsure 185: a, t, c, g, or other
gttgccaggatcctgcaaggtagaggcaccacagttagcatgagacccactgaacggatagcacggattttaatctgtgacagttcaaactaatgagtttgtagggcctgtcggtaaggggttctatctagcttcaagaaactgttgttttcagatttttctaccaagtagttttttttcccgancaccgtgtctcactaaacactattttttattcagctcatctcacgacaaaaagccttttccctgctatcttctctgagaagacaaacagttctc

SEQ ID NO: 3629 - DNA, 274 bp, Zea mays
  misc_feature: Incyte ID No: 700612018H1
agcgtctagaggctaagctgcttcgtacctgggcaactcgtaggcatggatgcctgggaggacacaactcctaaattgttcttaggtagtcatgaaacatcgtggctcacacttccatggtccaactagcgggccctaaggcctagatatgcacccactgatcagagagtccatccattctaccagtgcactgtagtagtgtagtagatcacgaaccgtgagggaagagacgcaacacaaaataaccggctgagttacattccaggagaccgcg

SEQ ID NO: 3630 - DNA, 272 bp, Zea mays
  misc_feature: Incyte ID No: 700612019H1
aacattgcggtgatcaagtactgggggaagcgggacgaggcgctcatcctccccatcaacgacagcatcagcgtaacgctcgaccctgaccatctctccgccaccaccactgtcgccgtcagcccctcattcccttccgaccgcatgtggctcaatggcaaggagatctcgctattaggaggaaggtttcagagctgcctcagagaaatcagaaagcgtgctcgtgactttgaggacaaggagaagggcgtcaagatcaagaaagaggactg

SEQ ID NO: 3631 - DNA, 270 bp, Zea mays
  misc_feature: Incyte ID No: 700612020H1
  unsure 20, 22, 33, 130, 132-133, 161, 163, 190, 193: a, t, c, g, or other
ggccgaccataaggaggagnantctgtgatggncaagatctccgagaagttccacggcggggactcctcgtgcgtcgtctgactcggacgacgagaagaagaaggggtcttcctcggcgtcggcgacggngnnccatgaaagccaagatctaccgcctctncngccgcgagaggcccgtccactctgtanctncgcggcggcaagcccgccgatcttgtcctatggaggaacaagaagatctcaggcggggtactcgctggtgccacggc

SEQ ID NO: 3632 - DNA, 270 bp, Zea mays
  misc_feature: Incyte ID No: 700612021H1
  unsure 150-183: a, t, c, g, or other
agaaactttgcaaagatgagaccttctactggagctagacttgctaatatcgatggtgtcaaccagcattttatttccacgtttcagtaacattttcatccaaaatattgcggaattgtcgaaggagttaaacctcccgttggataattnnnnnnnnnnnnnnnnnnnnnnnnnnnnnnnnnntgcagaaaatattgctggtataccaaaacctgtacaaaacaatcttcctgggatcttgggtgatgcaaagctgactgcatgggattg

SEQ ID NO: 3633 - DNA, 266 bp, Zea mays
  misc_feature: Incyte ID No: 700612023H1
  unsure 211-212: a, t, c, g, or other
gcgcatcgtcccgcgccacgtgctgctggcgatccgcaacgacgaggagctcgggaagctgctgaccggcgtgaccatcgcccacggcgcgtgttgcccaacatcaacccggtcctgctgcccaagaagacggcggagaaggcgtccagcggcgggagcaaggaggccaagtcgcccaagaaggccgccaagtcccccaagaaggcatagnntttggaggcggatccgatgttgtcatgtgtaggttgtaagcgggcatgtgattg

SEQ ID NO: 3634 - DNA, 264 bp, Zea mays
  misc_feature: Incyte ID No: 700612024H1
ccatcccatatccatggctggtctttggtgagaaggtgaaggtgaatgctgtcttcatccgtgattcaaccggagtatcagactccatattgattttgtttggcggtgctgtagcaaaaggaggcatggccgggcacttgaagatgctcgatggctacattgatttcttcatggaccccagcctgtctgaatgctacctgcaacttaaagaagaactcgataaactatacagcagaagcttgaagacccaaacttcgacatcca

SEQ ID NO: 3635 - DNA, 261 bp, Zea mays
  misc_feature: Incyte ID No: 700612025H1
cccatgtctaactttaatcagcagcagcagatgttcaaagctgcggctcctgagactgatattcagggtgcagatcccagtaataacacactctttggaataaacggtgatggtcagctgggctttcccatgggagcagatgatttcttatcaaatggaattgatgcttccaagtatcagggtcatatttcaacagatattgatggtaactacaggatcccaaaggatggccagcaagaaatatcgtcatccatggtttca

SEQ ID NO: 3636 - DNA, 261 bp, Zea mays
  misc_feature: Incyte ID No: 700612028H1
  unsure 30-31, 38, 43, 46, 51, 53, 58-59, 61, 70, 82, 152, 179, 187: a, t, c, g, or other
gggtaaagttcttcaatttcacccttctgnngagcatngatgnggntctgncntcaannanctgatgatngcatgcatcctngaaacgagcagtggctgtggccattgactggtcaggtgttctggcctggtattgctgatcgggaaagggnggagaaatacattaaaaagctggatantaagctcncgaacaaggtcaagttacttgaaaggcagaagtctggtagcaagcagaagcccctgggacaatgaccatgactg

SEQ ID NO: 3637 - DNA, 263 bp, Zea mays
  misc_feature: Incyte ID No: 700612029H1
  unsure 133: a, t, c, g, or other
aagccgaggcgaagaagtccgccgtggcgcctgctgggaaggctgcccagcctgcggcgacccaccaagttcccgaccaagcccgctcctccctcgcagacggttcgggatgcacgcggcggtggctcatcanctcgtggaggctttggccgtggtgaacgtggccgtggcagaggtggacggggatatggccagaaccgtggcttcagtggtgacaatggcaatgagttccagggaggttatggtggcggaggctatgggga

SEQ ID NO: 3638 - DNA, 157 bp, Zea mays
  misc_feature: Incyte ID No: 700612030H1
  unsure 11, 17, 20, 27-28, 34, 74, 88, 112-113, 115, 122-123, 127, 130, 141, 144,: a, t, c, g, or other
gacataccatncacaanacngtctttnnatcttntggttgtattatgtctgctacatgtgcaatgactgtacgnatgtccttaggtgnttacaatattggcactcagtcatnncntgtgccnntatnccntcatgttcccntgnttatcaatnagag

SEQ ID NO: 3639 - DNA, 269 bp, Zea mays
  misc_feature: Incyte ID No: 700612031H1
caatgttactagggcagattacttgagtggtcgaacagcactgcattttgctgcacatgatggatttgttcggtgtattagacttttagttgcagactttgtcccgagtgtggccttggaggatattgcttcttctgtggtggatggtggtgattgccagacaaacagtgggagcagtcctaattcatcgtcggggcagaagtttaatgaatcggcccgtgtgaggtacatcaacaaacctgcagatggtggtgttacagcacttcaca

SEQ ID NO: 3640 - DNA, 269 bp, Zea mays
  misc_feature: Incyte ID No: 700612035H1
ctcttgataatgatgtatttgtggagccaattcatgaagaagaatgccaaccatcaacctctgagaaagaagacgacaataatacacattctgcgtctgcaatttcagctaaaaaatgccgagcaaatgaagaaaaaagaatatcaaagaaattgcctggagttcagggaacttcctcgatattgaagtttctttcacggggccaatctaccttacatgagaaaagaaaatctgatggactatttgcagtcatcaaggtaccgggagtt

SEQ ID NO: 3641 - DNA, 266 bp, Zea mays
  misc_feature: Incyte ID No: 700612036H1
  unsure 128: a, t, c, g, or other
aatttggcgtgttttggtccttgcctactagtttggaaaggatgataaagtttaaggaggcctgtgtgctagattctgatattggaccatttaatgtcatacaggaagctttaagggattggaatctngatcagaagcatttcagcttgacatctggcagtgaaattagaaacgacgagagaacctcaaagctgatggactgctcatccaaaggaaatgccttcctataagaggtgagctatacaatatcgattgtgtgaatgatg

SEQ ID NO: 3642 - DNA, 267 bp, Zea mays
  misc_feature: Incyte ID No: 700612038H1
tacgacatctcgctgaacgactacctcgctgtgaacgcgacgaagcacgcgatgtacctgccgcacaccgcggggcgttactccaagaagcggttccgcaaggcgcagtgcccgatcgtcgagcgcctcacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaac

SEQ ID NO: 3643 - DNA, 262 bp, Zea mays
  misc_feature: Incyte ID No: 700612039H1
attgatgctgatcacatgatgttccctctagcatttggtgttgttgattctgagagtgatgataactggaattggtttatatcggaattgaggaagatgcttggagttaacacagataagatgccggtcttgactatactttctgagagaaagcggcaagtggttaaagcagttggatctaatttccccactgcttttcatggtttttgcctgagatacgtgagcgagagtttcctgacgagttcaagaatactaaactgct

SEQ ID NO: 3644 - DNA, 263 bp, Zea mays
  misc_feature: Incyte ID No: 700612040H1
caactgggactgttgtcgcatacgcacttgagtacaatgatgagaagggaatatgtttcttcactgactttcttgtcgttggggagaaccaacaaacatttgatcttgaaggggacagtggaagcctcataatcttaacaggacaagacggtgagaagccgcaacctataggaattatatggggtggtacagctaaccggggaaggttgaaacttaaaagtggccagggtccggagaactggacaagtggagttgatcttggc

SEQ ID NO: 3645 - DNA, 260 bp, Zea mays
  misc_feature: Incyte ID No: 700612042H1
  unsure 123: a, t, c, g, or other
cgatagccggggaggatggtgcttgtgcttgcgctgggggatctgcacatcccgcaccgggcgcccgacctccccgccaaattcaagtccatgctcgtgcccggcaagatccaacacatcatntgcactggcaatctctgcatcaaggaagtccatgactacctgaaaagcctttgccctgatctccatattaccagaggtgaacatgatgaggatgctcgatacctagagactaagacacttacaattggtcagtttaa

SEQ ID NO: 3646 - DNA, 257 bp, Zea mays
  misc_feature: Incyte ID No: 700612044H1
  unsure 186: a, t, c, g, or other
attgagaaaacaacaaaaagtgttacacaacttgatttgatgcctgattcgctaagccaggcagatctaacagttctgcaggaattacctgaggatgtgaaggctgatttgtttagtgcacttccactgcatagatcaggagatcctgcatgcagcacttccaatgtatctgaaagtaaatcaccnaatgtggttagagctgaaaatagatcttctaatgatggtggaatgatgatctgaaaaccccaaggtctttc

SEQ ID NO: 3647 - DNA, 261 bp, Zea mays
  misc_feature: Incyte ID No: 700612045H1
  unsure 44: a, t, c, g, or other
gggaagagctttgcacttcgtcctggtgaaaaatattatttggntccttcatcttggttgtccagagtggagagcttatattacaacgacgggaaaaaatatttcttcactaccagaacctcagagtcttgaagctgttgtcagttcacttatatgtgaaaagcattcgagattgctgcaaaagcctttggatcttgtttgtaagcgcggaagcatcactcagaaaacatcaaataacgatggtttaacaatcatcccaga

SEQ ID NO: 3648 - DNA, 271 bp, Zea mays
  misc_feature: Incyte ID No: 700612048H1
cgaaccaaaccaccgcctcctcccccgaccggagaggagcctcaccgccggcgcccatggcgacacgctacttgatcgtgtcgctgcccgtgcagtcgcccggcgccaccgccagctccctgtggtcgcgcctccaggactccatctcccgccactccttcgacaccccgctctaccgcttcaacgtcccggatctccgcgtcggcaccctcgactcgctcctcgcgctcatgacgacctcgtcaagtccaatgtcttcgtggagggcgtg

SEQ ID NO: 3649 - DNA, 274 bp, Zea mays
  misc_feature: Incyte ID No: 700612049H1
  unsure 82-102: a, t, c, g, or other
caccattttcattgtgtttgcatcgataaatggctgcacatcaatgccacgtgccccctatgcaagtacaatgttcggaaannnnnnnnnnnnnnnnnnnnngaagaagtataaatctctatatgagaatattgagaattcatacccaacagttctggcttctcgcagcaaattttttatcccataatcccatgagttcgcattcgtatctgtggcagtgtgatgaagaaaatgatccatgtaaattctcttgttcgtaatacggctatagcaa

SEQ ID NO: 3650 - DNA, 267 bp, Zea mays
  misc_feature: Incyte ID No: 700612050H1
cgaaaacttaaaacatctggctatgatggagagggttcttggacctttgccataccatatgttcaagagggcagagtacgtttcatgccattgtctcatatcgtatgcttaagagggcagggttctctgaacatcagtgctgtgggatctggtcgatgtcttgtgcttattaatccttgtttgtagtcggcactctgacaaatacatcagaaaaggacgcctgaattggcctgagggttgcacttcgcgtgaaagcatgaaagctgt

SEQ ID NO: 3651 - DNA, 236 bp, Zea mays
  misc_feature: Incyte ID No: 700612052H1
  unsure 12-13: a, t, c, g, or other
acccgcgttcanngaggccagtttcaacttgcccatgttccaggagggaaagggccctttcttggcatttgggttaacaacggggtgaaggggcatgggatggaggatgggagtttcactggaggggcagagagttaaaccatggaaatggaacctgggtggggcccgagttaacccaggcagttaacccaaggacggccaacagctggagggatgagggagttacgagggaggaa

SEQ ID NO: 3652 - DNA, 270 bp, Zea mays
  misc_feature: Incyte ID No: 700612053H1
  unsure 116, 122, 145, 217, 220, 265, 267: a, t, c, g, or other
atggatcaagttgtgtacactggaacacatgataacgatacagttcttggctggtggcaaaatttaccagaggaagaaaagaaaattgtgatcaagtatctaccagaagccgagantattgncataacatggacactgattacgngctgcccttcttctccgtcgcgaggacttccgtggtaaccatgcagggacattcttggcctttgacagttcngcnaagattgaatactccagctacccagaaagggaacttgaggttggngnttc

SEQ ID NO: 3653 - DNA, 262 bp, Zea mays
  misc_feature: Incyte ID No: 700612054H1
  unsure 144: a, t, c, g, or other
ggaagctgctgttgcccctgagtttgccgcaatcactgattaccaaggagctgatcagtggggtggtgaccagtggacctctgatgtgactgcgccgcctgttgctcctactggtgctgattggggtgctgctccagctccggntcctaccggtgatggctgggatcaagctggggcccctgcacctgtggtggacggcactgtacctcctctggttgctcctactggttgggaccaagcagccccgccaccgactgcccaa

SEQ ID NO: 3654 - DNA, 262 bp, Zea mays
  misc_feature: Incyte ID No: 700612056H1
  unsure 75: a, t, c, g, or other
ctaaatattgatggtgcatctggtgggataatgcttcttggaatagtcggattttgtatattattgcctttgatnatagctgttatttatttgtcaagatcatcaaaatatactggaaactatgtcatgcatcaaactttgtccacttactactactttatgaagccatctcttgctccaagcaaagttatagatgtcttcatcaaggctggcagaatatatggagatgccagttcgacgcagtgatgatgaacccctgcaa

SEQ ID NO: 3655 - DNA, 257 bp, Zea mays
  misc_feature: Incyte ID No: 700612057H1
  unsure 191, 194: a, t, c, g, or other
ggatgaaggtagcagcatccacagtccatactgggtagcttggcagtatacataatgttgcagacgtcaactgcttttgtttctcgtaattagaatggattttctttctgaaacatggaaagggagaaatgctgttcttaatttggtagggccattcggtaaccaaaatgtctggtttagcccaacgcagnggncattgactgtcctgttgtcttattgctgtattacttgagatgcttatgcatgctaattgtgta

SEQ ID NO: 3656 - DNA, 264 bp, Zea mays
  misc_feature: Incyte ID No: 700612058H1
ataaataagctgtcctttggggaagagttcccaggtgtagtcaatcctcttgatggagttgagtggatacaggataactccaatggattaacggggatgtaccagtattttgtaaaggttgttccaacaatctacacagatatcagggggcgcaagattcactcaaatcagttttctgtgacagagcacttcagagaggcaattggctatcctaggcctccacctggtgtatatttcttctacgaattttcaccaatcaaggtt

SEQ ID NO: 3657 - DNA, 258 bp, Zea mays
  misc_feature: Incyte ID No: 700612059H1
gacacaggaaatattggtttgtcggaaagttgcgctactgccctaccactgccccatgaaatgatgggtcatgcagcttggaaagaatgttctgctagtctcacacagggctctgcagttgttgatgctctttcacaaaaagaaagtattgtagactcaccatctaagaaaactccaagttatggttctaacgattatagcaagatgactgtttttgaagttacaggttttcctcaaccatttcaaggtcttcagaaa

SEQ ID NO: 3658 - DNA, 260 bp, Zea mays
  misc_feature: Incyte ID No: 700612061H1
agaaggaggaagttgtggataacaaagtcaggtgcatagacaacatcaatgataccttaactcatcaagagtctttgcttaaagaaagattaagtgggctggaggaaacaaacaaatccctgctggtacagtctggcaggtgaaggtgttggaggaagcttcaaacaatacttctgaggaaaatcagatgttggtaaaaaaaatatatgaacttgattcaagactacaagcacttgaagcaaaggctgctcctagtgaag

SEQ ID NO: 3659 - DNA, 272 bp, Zea mays
  misc_feature: Incyte ID No: 700612065H1
  unsure 179-180: a, t, c, g, or other
agaaactggagattgcagaggcaaactcgaaaatactgaaagaaaacgctgagatgattaatgagtacttctctattcacgttgatcacgatgggaacttgaccaggcttccagttgtacttgatcagtacacccctgatatggaccgtctcccaaattttgttttgactatggggccnnatgttacctgggatgatgagaaagagtgcttcagaacggcagcagctgctattgggaacttctacgcactccatcctcccatccttccaaat

SEQ ID NO: 3660 - DNA, 265 bp, Zea mays
  misc_feature: Incyte ID No: 700612067H1
gatgattttaggagggaaagtttaagttgttttcttacaataaaagactcctggaaagaattagatgaccaagcaaacgagcaagatggtcttctgaaactaagtaaaaccttccacctttgccagaccctgaaaacaagtggagacctttcagattggttgagctcagcgtacagttatctggccatggtggattacccacttccatcagaatttctcatgccttgccagccaatcctattaaagaagtatgcagaaatatcga

SEQ ID NO: 3661 - DNA, 261 bp, Zea mays
  misc_feature: Incyte ID No: 700612069H1
  unsure 8, 10, 13, 18, 28, 39, 61, 64, 71, 83, 104, 112, 118, 149, 158, 161, 173,: a, t, c, g, or other
gagtggancncgntctgntgcttgagancagggggccantgtcattgcagaatgttgaaangancaggganagtgcttgtcangaggtattctttgaggaaagnaacctcanggatanatgtgaaccttctgtgtcaaagaatggggantctatgtgntanacattgtagatntcgacanaganaatggnaatcctcaaatgtgtgnttcctacgttgnggngagtactcaaacctaatngcttcagagcttgtgngaaga

SEQ ID NO: 3662 - DNA, 265 bp, Zea mays
  misc_feature: Incyte ID No: 700612070H1
  unsure 221, 264: a, t, c, g, or other
agctgtttcagcaatagtgtcgtacttattggggcctgatagagctgataagattaccatatttgctggagatgtggttcctcacaaaaaacctgacccagcaatctacatattagcagcaactacacttggagttgatccgcaaagctgtgttgttattgaagacagtactatagggctcgcagcggcaaaagctgccggcatgaagtgtaatcgtaacnaaaaagcggctacactgccagaagaggacttcgagacagcagnt

SEQ ID NO: 3663 - DNA, 257 bp, Zea mays
  misc_feature: Incyte ID No: 700612073H1
gaataaccgaataaggtctaacagcctacaatagcttatgtggtcaaaaactaaaaataagccaacacaaaggggccttaatcaactccactccatctgtcggtgccgtgagccactgtttcccactggaacgccgctggttcgagaaaacgcggccacgcatgcaaattgacttccccagtctggaaccatgtgcatgccaaatggaagccagtctcgtctcgcgcggcaaccccgatcgagattatggatgaaaa

SEQ ID NO: 3664 - DNA, 258 bp, Zea mays
  misc_feature: Incyte ID No: 700612074H1
cgggagcagtcaagaagcagcagggcaaaggagaagacacctaacagtagcagcaagagtaacaagcctagttcaaaagtgcagtcaagagcagagtctcgatcgaaggctaaggtccccaaagacgaagaagagagcggtgacgacgacggggacgaggaggcggaggagcacgacaacaccctgtgtggaacctggcgggaccaacgacggcaaggaccagttctggatctgctgcgataatgcgagaatggtacc

SEQ ID NO: 3665 - DNA, 256 bp, Zea mays
  misc_feature: Incyte ID No: 700612075H1
gctaaaagccccggcgggcggtcatggccaccgcagaccagagccgtattttcatgaaggacgtcaaacgcgtcatcatcaaggtgggcactgcagttgtcacgaggcatgatgggcgagtatccacaggcaattttggtgttctttgtgaacaggtgaaagagataaatgctctaggatacgaggtgatcattgtgtcctcaggtgctgttggtgtggggaagcagaggctcaattacaggaagcttgtcaatag

SEQ ID NO: 3666 - DNA, 92 bp, Zea mays
  misc_feature: Incyte ID No: 700612077H1
  unsure 17-18, 27, 32, 35, 37, 48, 54, 79, 83, 90: a, t, c, g, or other
gaaacgtctagatcgcnncgttccggngtggnctncnggaacgacttncacatntcacttactttcaggcggcaccacngtcnacgaganac

SEQ ID NO: 3667 - DNA, 260 bp, Zea mays
  misc_feature: Incyte ID No: 700612078H1
ggataatggtggtggcattcttgtgcttggtgaaattgtggagccaggattagtgtatactccacttgttccatcacagcctcattacaacttaaatctggaaagcattgctgtcaatggtcaaaagctgcccattgattcctccttgtttacaacatcaaatacacaaggaacaatcgtggattcaggaacaacattggcataccttgcagatggagcctacgatccatttgttagtgcgatagtgctgcagtctctcc

SEQ ID NO: 3668 - DNA, 264 bp, Zea mays
  misc_feature: Incyte ID No: 700612079H1
  unsure 8, 20-21, 42, 85, 135, 144, 155-156, 183, 202, 207, 209, 217, 238, 242,: a, t, c, g, or other
gataatanatctttattatnntcgcactctcatgagcattanatggcattcattcttatttatacctatatggttatatttaganaatgaagaagagatcgaagggaccgaagagaagacaccaccaccttcggnatctcaggncggaaattgtnnctacttcgatatctgcgggtccgagcntgactcacctactaacganggcangncccggtgnatttgccaccttccttgatgngttnaaaatcgatctcacttgnntgc

SEQ ID NO: 3669 - DNA, 265 bp, Zea mays
  misc_feature: Incyte ID No: 700612080H1
caaagacgggatagtagtttatgatggaaaggggctgttcagtgctgctcgtgtttggtggatgttccgtgtatttggacatgataaagtttgggtgttggatggaggtttgccccaatggcgcgcttctgggtatgatgttgaatcaagtgcctctagtgatgccatcctaaaggccagtgcagctggtgaagcaattgagaaagtttaccagggtcaatggttggtccaaccacatttgaagcaaagttgcagcctcatcttc

SEQ ID NO: 3670 - DNA, 259 bp, Zea mays
  misc_feature: Incyte ID No: 700612082H1
agcagaagaagcgaagtcgtcgccggagcaggaggaagagcgagcagcaagatgtcgtggcaggcgtacgtcgatgaccacctgctgtgcgacatcgaaggccagcacctcagcgccgccgccatcgtcggccacgaggcagcgtctgggcacagtccgagaacttccccgagttaaagcctgaggaggttgctgggatgataaaggatttgatgaacctggaatcttgcaccaatggtctttttgttggagtacgaat

SEQ ID NO: 3671 - DNA, 262 bp, Zea mays
  misc_feature: Incyte ID No: 700612083H1
  unsure 14, 37, 67, 148, 150: a, t, c, g, or other
atgaccctgaagtnacagctaatttcattgccacttncgttgggcccgctcagtccaaatgaagtanccatgaaattagctgtgagatcagatgaccctgaagtcagtgataagattcatgagattgtcgccagcggataaagtgcananccatacaaatcttctgccaaaagtgtagagcgggtagatagcctttatacttcgatgcttacagcctgtctcttcgtggacatctcagatatcagttagcatatctataaat

SEQ ID NO: 3672 - DNA, 259 bp, Zea mays
  misc_feature: Incyte ID No: 700612085H1
  unsure 44: a, t, c, g, or other
cttttcccaggacgggaccgttcctaccaggaaggcaacctcantggctggggtggcaaggcagcgtgagttagccataccgtcgagagtgagggggacagtaagatgaagaggcaggtgtccagtacgaaatccaaggagctcagtggtcacgacatctttgccgatcacgaagatcccaagcccaacaggtcaaggagatcagactatggcagctctgctgctcagtcaccagtgaaaaatgcaatgtgagctcctt

SEQ ID NO: 3673 - DNA, 259 bp, Zea mays
  misc_feature: Incyte ID No: 700612086H1
gcaaacgtcactcgacaggacaatgcttcaactgagactacaaaatcgacagtgttaaatgactcttgctgtgctgaaaaatataaggctgatgcctgctcaagatctgtatgcgacacatctacagatccatctgtttcgggagttaatagttccatgcctgatttttccatattaagaggagaagtctgtttggatgatcttactattagagaacttcaggaggcgtttagagccacgtttggccggcagactaatg

SEQ ID NO: 3674 - DNA, 260 bp, Zea mays
  misc_feature: Incyte ID No: 700612088H1
  unsure 8, 13, 19, 28, 44, 46, 50-51, 57, 67, 88, 107, 111, 140, 167, 178, 186,: a, t, c, g, or other
ctccggancggcngaccgnggtgaaggncacggcggaacaacancngctnnatccgntccattctgncttacataccacatcggagcngatggcaagaccgtaacgnggangggccatggggtttcggccatgctggcanggagtaacaatattgatctgtgcaggntcgacgagagnttgacggngatctcngggacnacngncncagcctacaanattgacaatcnggtcnagtctctnaantnngtcancaacanac

SEQ ID NO: 3675 - DNA, 254 bp, Zea mays
  misc_feature: Incyte ID No: 700612089H1
  unsure 186: a, t, c, g, or other
gaatctgaaatctttattgtcgaaggtgattctgcgggcggtagtgcaaagcaaggacgggatagaagattccaggctattttgcctctacgaggtaaaattctcaacattgaaagaagggatgaagcagccatgtacaaaaatgaagagatccaaaaccttattcttgcacttggattaggagtnaccggtgaggattttaagaaggaggctctccggtatcataagatagttatacttactgacgctgatgt

SEQ ID NO: 3676 - DNA, 257 bp, Zea mays
  misc_feature: Incyte ID No: 700612090H1
ctaccaagcagaaacgtgagaaggaggtgcatgctctcctgggataaactccctccggagaccattatgctgaacccgaacacgatagccactgtacgagctccgaagaagaaagagaagaagaccaaggaggagattgaggaagagatggcagatgccgtggaggcggccaagaacactgagcgcaagaagaagaccaagggcaggagcaaaccgagcaagcgagccaagaagaaagaggaagacgttttcaaggc

SEQ ID NO: 3677 - DNA, 155 bp, Zea mays
  misc_feature: Incyte ID No: 700612091H1
gtttcttcattcgttttgtttttgtcagtctcagggtaggggatggagatcataccatgatctttgtagggttgagagaggagtccacgcttgaatattgttgtcatgtatgttattcttggttaataataaagttcgtcagctcatttcttagc

SEQ ID NO: 3678 - DNA, 258 bp, Zea mays
  misc_feature: Incyte ID No: 700612093H1
caaccaccgcctccccgatctcgtcgagaggaagcccaatcccgaaaccgtcgccgtatttccaatggcgcccaaggccgagaagaagcccgccgccaagaagcctgcggaggaggagccggcggcggagagggccacggcggggaagaagcccaaggccgagaagcggctccccgcgggcaagtccgcaggcaaggagggtggcgagaagaaggggaagaagaaggcaaagaatcggtggagactacaagatctaca

SEQ ID NO: 3679 - DNA, 261 bp, Zea mays
  misc_feature: Incyte ID No: 700612095H1
  unsure 119: a, t, c, g, or other
atggataacaaccccaatggatattgctaaggagatatcaagtggatttgcagctagttgtttgatagctcaagtggacgaaacactctgggatatggggaggccactggaaggtgacnccaaattgcaaatgttcaagtttgataccaatgaaggccgtgacacctctggcactcaagtgctcatattcttggagaatctcttgagagagcatatggctgcaagctgtgtattgggccttgcaccacaagaggggagggt

SEQ ID NO: 3680 - DNA, 270 bp, Zea mays
  misc_feature: Incyte ID No: 700612096H1
taggtttttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctg

SEQ ID NO: 3681 - DNA, 156 bp, Zea mays
  misc_feature: Incyte ID No: 700612101H1
  unsure 123, 138, 140, 147, 150, 153-154: a, t, c, g, or other
cgaagaagctgctcaaggagggcgagggctgggagactcccgaggtcggcgacgaggttgaagtgcattacacgggcacgctccttgatgggacaaaattcgactcaagccgtgatcgtgganaacccttcaagttcnancttgganaangtnnag

SEQ ID NO: 3682 - DNA, 275 bp, Zea mays
  misc_feature: Incyte ID No: 700612102H1
cagtcatgtgccaaatatcaggaatggattttgctcttgagcctgtgctgcctccagtgactgcaaggccagaacatgttgagagagcgttaaaggcacgttatcaagatgcaatgaacatactgaggccacagggaagggaacttgatctgctgatcgtaatactgcctgacaacaatggttctctttatggggatctcaaaaggatctgtgagactgaactcggattggtctcccagtgttgtctgactaaacatgtttttaagatgagcaag

SEQ ID NO: 3683 - DNA, 273 bp, Zea mays
  misc_feature: Incyte ID No: 700612103H1
aaggtgattctggcacttctccaccaaggcaatctcatgttgactctactaacaggacggtatatgttggtgggcttgaccccaatgttagcgaagatgaactgaggaaagcatttgcaaaatatggtgatcttgcctctgtcaaaattccttttgggaaacaatgtgggtttgttcaatttgtaaacagagttgatgctgaagaagcactgcatgggttgaatggatcaactattgggaagcaggcagttcgactttcctggggccgcagcc

SEQ ID NO: 3684 - DNA, 272 bp, Zea mays
  misc_feature: Incyte ID No: 700612104H1
cttccctttcttgtcgtcgtccctatcactgtcacttgtatatggacatttagcgataaagtgaccggacttaccacacctgtagcaaaccctcttaaagcgggcttcccctttctttgcttgaggatttaccagaagatcttgatgataagagtcatttcctcattatcaagcttggaggggttgattgggagtctacttggtgtagactcttccttcttctcttctgttgctttgaatgcaacgggttgcacctcaggtgtgaaggtggc

SEQ ID NO: 3685 - DNA, 272 bp, Zea mays
  misc_feature: Incyte ID No: 700612105H1
gaaggattttgcttggcatcaaggaacagtgcaaactagaagaaacccccgtcatcagcgacctctccccaacggcgccgacgatggcgcaacagcagacgcagctaaccactggctcgggcatcctggatgccgtcccgctcttcgtcgtcatcctcctcgcggcccacgtcctggccctcgtgttctggatgtacaagctggcttccgagaagcaaccaccccggaggaagacacagtgacggcgccgatctacgccatcgggatccttc

SEQ ID NO: 3686 - DNA, 90 bp, Zea mays
  misc_feature: Incyte ID No: 700612107H1
  unsure 6, 16, 46, 48, 56-57, 59, 68, 80: a, t, c, g, or other
tcgacnttgagaggcnccaactactgccaacttgaatacgccttgngnctgcaggnntngctcatcgntgactgcttctntgaggttgcg

SEQ ID NO: 3687 - DNA, 275 bp, Zea mays
  misc_feature: Incyte ID No: 700612108H1
gaagagagaaactctgccattcagcagaacaataagcttcgagaggaactggaccttacgaggagggaagccaacaagcagaatggtggattctcctttgtggtcgtggtggccattgctctcctgggaatgctactgggatatatcatgaagagatagatgggctcataatgactcggcctcatgttagaccgttttcctcacagtattgaatattgtctaatgcacttatcacatgcacactgctactccatagcatattcatctggtgtctt

SEQ ID NO: 3688 - DNA, 277 bp, Zea mays
  misc_feature: Incyte ID No: 700612109H1
gaaccacttgcatcaagatgtgcaaagtttaggttcaagcctctttcagaagaagtgatgagcagtcgcattatgcatatatgcaatgaagaaggcctcaatcttaatgctcaggcgatgtccacactgagtgtcatttctcaaggtgatcttcgtcgtgctataacctaccttcagagtgcagctcgcttatttggatcttctatctcttccagtgacctgatcagtgtttcaggggttatccctgaagatgttgtcaagtcactgcttgcagcct

SEQ ID NO: 3689 - DNA, 155 bp, Zea mays
  misc_feature: Incyte ID No: 700612110H1
  unsure 87-88: a, t, c, g, or other
ccgcctgggcgcggcgggccctgaccaggcggtgcagctcctgcagctgcacctggctgctgctcctcgtacctaagttctggaaanngtttcggggcttagttttgtgaaacattacctgttttgagaaaccattgttactgtatccccttgat

SEQ ID NO: 3690 - DNA, 275 bp, Zea mays
  misc_feature: Incyte ID No: 700612111H1
  unsure 17, 27: a, t, c, g, or other
acttggtgtctgagggncgcatcaagnccattgtgtgaccttcttgtctgccctgatccgagaattgtaacagtttgtctggagggtcttgagaatattcttaaagtagggcagcatgacaagaccatgggtgcaacaggtgacactaacgtcttagctcagatgatcgatgaagcggaaggcctggaaaagatcgagaacctacagagccacgataacaatgaaatctatgaaaaggctgtgaagcttcttgagacatactggatggaggagga

SEQ ID NO: 3691 - DNA, 273 bp, Zea mays
  misc_feature: Incyte ID No: 700612112H1
gtagttttgattttgcaacagtagagaatgttgttatctgtggaagtatggagtctgccttagaactgctagcatcaactccatattgcttatcaattgagaaagtgtttgttataggaggcgggcaggtactgagagaatatcttaaaggacctgcatgtgaggctatccatctaactgacattcagtcgagcattgagtgtgacactttcatccctccggttgacttctcagtgttccagccatggtattcatctttcccggtgatagaga

SEQ ID NO: 3692 - DNA, 273 bp, Zea mays
  misc_feature: Incyte ID No: 700612113H1
  unsure 41, 48: a, t, c, g, or other
gacattggacttatactcgtcttctccaatgggaaacttgnaataagntccctgccagacttgtccttgttgaaggatgcctttttacgaggttttgtgtactcaagaaacttgaattcaagtagttccataacatgttcatctgatggagaagccatcttgattaatggagaagagacctattttttctctacgctctgccaggatgagatatacaggcacgtagacagcatagtacagtgtacagaaaagagaactcaaccagggaagact

SEQ ID NO: 3693 - DNA, 100 bp, Zea mays
  misc_feature: Incyte ID No: 700612114H1
  unsure 40, 70, 73, 87, 89, 93, 98: a, t, c, g, or other
agaacacatgctcctgcggcatttcttgcccatgccgatnccccccttgcggcaaccaaaaccccaactncgnccccgcatgcgatngnaccnccaangg

SEQ ID NO: 3694 - DNA, 276 bp, Zea mays
  misc_feature: Incyte ID No: 700612115H1
aaccgcctccccctccgctccttccagctcgctctgtaatctgcatcagcctccgcccgccgccgtcgccgccatggggaggggaaagttcaaggggaagcccacaggccgccgcaacttctccacacccgaggagatcgctgctggtacttcaggtcggccacgcacctttaagaagaaggaggaagaggaagatgaggaagaggtagaaagagaagagtctgaggaagaatctgaagaggattctgatgaaaagactaaacataaaggcatgag

SEQ ID NO: 3695 - DNA, 278 bp, Zea mays
  misc_feature: Incyte ID No: 700612116H1
ggtacagattatgattttgaatcttgtgaaccacataaagcccgagaggaacttgaaaatccttcaagctcaacaatccagtcttgagaagagggtcaataagaaagtaatggcaatgtttgagaaggcggaggatgagtacaatgatttgatgtcaaagaaaaacatcatcgagaatgacaaggcaaaaatcaagaaagtgatagaggagttggatgagaagaagaaggaaacttgaaggtcacttggctcaaagtaaacaaggtttcgggtctata

SEQ ID NO: 3696 - DNA, 274 bp, Zea mays
  misc_feature: Incyte ID No: 700612118H1
caatatcatgcaataaatctctgtgcgagtttacggaccagacccggaccatgagaggagggatatcgtttttcctctttagtgtgcagcagtgccatccctgacaacagattcggagaagaagggcccagtgataatggaaattccactggaccaaatccggaggccactgatgcgaacgcgggccaatgatccagtcaaggtgcaagaactcatggacagtatccgtgtcatcggcctccaagtacctattgatgtgttggaggtcgatggg

SEQ ID NO: 3697 - DNA, 272 bp, Zea mays
  misc_feature: Incyte ID No: 700612119H1
  unsure 16, 121, 128, 132, 257, 264: a, t, c, g, or other
ctatgagagactccgngaatcagttgacatgcatgacaacattgaccagatatgtcttgcccagaagcttgagaagcatgaattgctggagatgaggaggattgccgcctacatttacaanaaggctngcangtggaagcaatcgatagctctatcgaagaaagacaacatgtacaaggattgcatggagacatgctcacaatctggtgaccgcgaattgtcagaggacttgctgtctatttcattgagcagggtangaaagantgcttcgc

SEQ ID NO: 3698 - DNA, 273 bp, Zea mays
  misc_feature: Incyte ID No: 700612120H1
  unsure 226, 228: a, t, c, g, or other
acgctcctgtgaagaataatcccgaagacgcagctaaagttccaaagggcaacccttatcatagtgcaacattccggagagatggcaatttacagggcgaacagccttattttgagaaaggtccggtgctcagatagctgatcctgttgttcacaccttcaacggacaagaggtagaggtttggccacgcgtaacctggagcccacggtggggttcaaccttcaanantgtcaaggagaaagtgcacgggaatcttcagtttctcagaggtca

SEQ ID NO: 3699 - DNA, 274 bp, Zea mays
  misc_feature: Incyte ID No: 700612123H1
  unsure 79, 99: a, t, c, g, or other
ccatcccatatccatggctggtctttggtgagaaggtgaaggtgaatgctgtcttcatccgtgattcaaccggagtatncagactccatattgattttntttggcggtgctgtagcaaaaggaggcatggccgggcacttgaagatgctcgatggctacattgatttcttcatggaccccagcctgtctgaatgctacctgcaacttaaagaagaactcgataaacttatacagcagaagcttgaagacccaaacttcgacatccacaaggaag

SEQ ID NO: 3700 - DNA, 275 bp, Zea mays
  misc_feature: Incyte ID No: 700612124H1
tgaaatgagttgatcagtgcaattctttgacatctaactatttatttttatatgagatgggaggaactgatggagaataaatgctgctgtagatttgtagaagttcaaaaaaattgggtacccctgacaagtttgtagccaagggggtacatcatacagtttgagatgaggacactatgtatactatttgagacgaggacattatgtatactactctagaaggctaccgaaaccaaattttgcatctgtttattaaaagcttgtacttttatcaa

SEQ ID NO: 3701 - DNA, 273 bp, Zea mays
  misc_feature: Incyte ID No: 700612126H1
aggtttagtagggctactagaaagaggagcttgggacagagctagcaagatatgaaccacgagcagaggttgtcccttgaaagaagcaccgaccgaacaggtatcgagatatgcatctggataggttgttttagctagctaggcatttgcttgtgattaatacttcttttcttaaggttaaggtagttagctaagcaagtatgtattcacggagaagcaatggtataggttgaggtttagaaagctaagtaaagtatttcaagtatgcatgcg

SEQ ID NO: 3702 - DNA, 270 bp, Zea mays
  misc_feature: Incyte ID No: 700612127H1
cggtgaagtacaaggaggataagggtgcagaacgggtggaagagaaggtggtacctgctgggagggatgattacagcgagtatcgtggcgactattgaaccgaagtttgtgtgactgtggaactaagaaagcgctgtgagtcgattcttcttccatgcctatgtgggaataattccagtgttagtgctatggcttccccatgtatgtgtatatatttgtgatgttgtgtatattctgatacctataaactactctctccgttctttttta

SEQ ID NO: 3703 - DNA, 272 bp, Zea mays
  misc_feature: Incyte ID No: 700612129H1
gaaataacatacacaaaacaatctttgaatcttgtggttgtattatttctgctcatgtcaatgactgtacaatgtccttaggtgcttacaatattgtcactcagtcattttttgtgccactattccatcattttcccttgcttatcaatgagagtctttatatgaaactaatgcttgatgaattgctttcttttccacaactcaatgttttcctggtaggactgatgttcaatttttgcataggtggcaaaaggttttggtgtattagatgc

SEQ ID NO: 3704 - DNA, 273 bp, Zea mays
  misc_feature: Incyte ID No: 700612130H1
aacaagcacagccaaagaaggccgaaagtacttcgaagatattactgaacataaaaaagattttctctgggtagatgaccaagatggcaatcatattgaattagcattcagcaagaaacggattgctgataggaaacagtggcttacaaattttcagcctgggacatacattgaccaacgtgacaaacatgtcaagtatagcgatttcatcaacaaagagctgatactcttctcaatggcagacctgcagcgatcaataccttcaatggttga

SEQ ID NO: 3705 - DNA, 200 bp, Zea mays
  misc_feature: Incyte ID No: 700612132H1
gagattagttctgttgatcctgtacgtccatgagcatcagaaaccaaatgtcggtccaacggttgaaaatgtatcagttctttcgttgttcatgaaaaggatagctcatggctgggctggtatcgttccggcttttgcgttcttacaagaagcagtggggaacaataagattcttgtaagtgcaacttgaggtcttgtct

SEQ ID NO: 3706 - DNA, 275 bp, Zea mays
  misc_feature: Incyte ID No: 700612133H1
cttgaaactcttggtgttgagacagacaaggctggcaggatccttgttgataagcgcttcatgaccaatgtgaagggagtctatgcaatcggggatgccatccctggtcccatgcttgcccataaagctgaagaggatggtgtcgcatgcgtagaattcattgctggaaaagaaggccatgttgactatggcacagttcctggtgtggtctatacacatccagaagttgcatctgttggcaagactgaggagcaggtgaaggctctaggaattgc

SEQ ID NO: 3707 - DNA, 271 bp, Zea mays
  misc_feature: Incyte ID No: 700612135H1
  unsure 14, 121: a, t, c, g, or other
agtaaacaaaaatnaagtggtcaatgcccccttgtcttcatcagataatatgaatgttcttatatgtgctgtgcagactgcctctgtatccaatcatggagagttgaaggaagatgacganaatgttgataaagatgatattgacactgctaatatgatcttatggttggaatcatttgaaaatcaggagtggttatcatggataggaggcacaagccaggatgcagtggcgtcaaatatcatagttgcagctgcttggtcgtttggtatc

SEQ ID NO: 3708 - DNA, 272 bp, Zea mays
  misc_feature: Incyte ID No: 700612136H1
gagaaaaacatcctaagccaatagctgcatcccctcaagattcacgcttgctctctgaaatacaagagcagcagaatttgttgaagacctacgaggtcatggtaaagaagttccagtcccagatccagactagagacactgagataacccatttacagcagcaaattgatgaagctaaacttcggaaatcaaagctagagaagaaactgaaacagaggggcctacttaacagggagtcagaggaatctgacgaagaagagaactacttttcc

SEQ ID NO: 3709 - DNA, 272 bp, Zea mays
  misc_feature: Incyte ID No: 700612138H1
  unsure 158: a, t, c, g, or other
cgactactacgaggccacaggcaaggacgtggattgtgtaaagggtagtaagctgaaggagcttactactaaagtgcagaaagtctgaaaaaaaagcaactttgttttgtgttgaagaggtgtagcttgtagcgtatgtctggagaagcatgttccantagttacattttggtgggggccttcttgaaaagtggccatctctgcttcgccaggcagttggacaactggaggccgcggttgaatcaaaggagcggccgttgtttcgttccggt

SEQ ID NO: 3710 - DNA, 273 bp, Zea mays
  misc_feature: Incyte ID No: 700612139H1
caactgggactgttgtcgcatacgcacttgagtacaatgatgagaagggaatatgtttcttcactgactttacttgtcgttggggagaaccaacaaacatttgatcttgaaggggacagtggaagcctcataatcttaacaggacaagacggtgagaagccgcaacctataggaattatatggggtggtacagctaaccggggaaggttgaaacttaaaagtggccagggtccggagaactggacaagtggagttgatcttggccgccttctt

SEQ ID NO: 3711 - DNA, 276 bp, Zea mays
  misc_feature: Incyte ID No: 700612140H1
gtttaccagtagcaggcaggtaacatgagcacaaagatgttactgtgacactgtccttgatgtactctacaatgacaggccccccaacccaccccacccccactaggtttattatactaaatgcgaggttaatccacgattctggtaccaggcacatgtcacatgtaaagagcagtacagctacagcctgctgcgagattcatgcagatattgtatactactaggccactagggaggcccagtgactgtagaagtgcacatgaccatggcagttgt

SEQ ID NO: 3712 - DNA, 273 bp, Zea mays
  misc_feature: Incyte ID No: 700612141H1
gcgagaacagggctctcaagataatttccggtcttcagaactttgacaggagcagtgttgcatctgttgtcacagctgcagataagatgagactagcagagctactcgaagaggaaggagctgatataatccaaactgagggtgggaaatgttctagcccgacaaaacctggagtgcttggattgattgaaaaggcaacaccaacactcgccgcagcatactccatctctcgggctgttagtattccagtgatgtgctcgtcaggttaagctc

SEQ ID NO: 3713 - DNA, 273 bp, Zea mays
  misc_feature: Incyte ID No: 700612142H1
tcctgcattcagccctcctgtgtagctccaaccacttgctttggcccccggttcttctccaaatccaagtccaagtctaagtccaagtccaagaaggagaagtcgaagcctgatggtccaaaccaagagaacctcttcccggagctgattgctgagccaactgatgctcgctcgatgtcctttgttggcactcatgagtacttggccccagaaataataaaaggggagggccatggaagtgctgtggattggtggacctttggcatattcttg

SEQ ID NO: 3714 - DNA, 273 bp, Zea mays
  misc_feature: Incyte ID No: 700612145H1
gaaactcactggctccctctcctttccccagtccgcggcgctcgctccgttcacctcggccgcggcgaccttcgaggcgacgagacgatgctgcggctctcccgcttcctcccctccgcctgcaggaggggttttgatctgaaagaatctctttggagtggttcattgacattccaacaagctgtttccactgcagcaacaaatcttgatggtgaagcttttgtctctgttcttgttattaaccagccttctgcatgtttagtgctaacctca

SEQ ID NO: 3715 - DNA, 276 bp, Zea mays
  misc_feature: Incyte ID No: 700612148H1
cttagatcaatagtcttattggaaccaaggtggagtgggtttatcatatgttacaagcattcaacacgggcaaccttgctttctaccaagaactttgcagggttcacaatgctgctcttactgcacaaccagctttggtgcaggatgagaggaagctgcttgagaaaatcaatattctttgtctgatggagataatctttagtcggccatctgaagatagaactattccattaagtgttattgctgagcagactaagctttcaatcagtgatgtgg

SEQ ID NO: 3716 - DNA, 154 bp, Zea mays
  misc_feature: Incyte ID No: 700612149H1
  unsure 120-121, 130: a, t, c, g, or other
ggcactgtgtagggtcaagggggtcacaagccgctggatcttaggtgccttgtgacccccttgaccctccagaggaagcgtgctagaattgctgacaagaagaagaggatcgctaagaannaagtctgangctgctgagtaccagaagcttctt

SEQ ID NO: 3717 - DNA, 84 bp, Zea mays
  misc_feature: Incyte ID No: 700612151H1
  unsure 7, 13, 34, 39-40, 54-55, 66: a, t, c, g, or other
gccattnaggcanttctattaattgcagatgaanatggnnattacttgcaaganngccatgggagncatatattgacatgtgtt

SEQ ID NO: 3718 - DNA, 220 bp, Zea mays
  misc_feature: Incyte ID No: 700612154H1
gctttcctgggttctggatcctaaattaatgggctggtgcattgcataatgtgatgggaagtgttgctgggacgggcgaggattcaggtaataatccccctcaaaagactcatgcgcggactgtccggatacgtacccggaccgttcgtgattatatgcggaccgtccgtcgttgtatgcggaccgtccgactggatagtttaaatttggtgccctatgt

SEQ ID NO: 3719 - DNA, 273 bp, Zea mays
  misc_feature: Incyte ID No: 700612155H1
aaaatggacttggtgacaagatgcatcgatttatctgagaatcgattatgcattatgccaaaacgagaaaacacaattacacctgaacgtctccgatcattcttttctcgcttttcagcgtcctgggtctattcgaaaatactcacattaggtgtctctgtttatgaaagagaccgcaggtaagttgcaataactgctataattacggatcagatcaaacactctcattagatgcatggttttcgtgtttcatagaattttggttgaaagtgg

SEQ ID NO: 3720 - DNA, 270 bp, Zea mays
  misc_feature: Incyte ID No: 700612157H1
  unsure 216-218: a, t, c, g, or other
agttgatcttgggcctttcaaacatgttgtagatgatggtcttgaactcaggaaagctgcctttgaatgtgtggatactttattggacagttgtcttgatcaagtgaatccatcgtccttcattgtacctttcctcttgtctggtttaggtgaccattacgacgtgaaaatgccttgccatttgattctatcaaagctagcagacaagtgccctcnnncgtccttgctgtcctggactccatagttgaaccaatcgagaaaactataagc

SEQ ID NO: 3721 - DNA, 271 bp, Zea mays
  misc_feature: Incyte ID No: 700612158H1
catccatcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggccgcgagggcgccagtagatatattcatcttcatctcggcttgcgatatttttgaattttctattccgtattgaaggcgtcgatggccttgtccgccctaatcagcaccctcctcgccg

SEQ ID NO: 3722 - DNA, 273 bp, Zea mays
  misc_feature: Incyte ID No: 700612159H1
  unsure 257: a, t, c, g, or other
gtggaaagaggcctgacgtcattgctgttgctacagagaacaccacagcaggtttctgcagaacacctgcgacactaaagcatctggaaattttggaccgtcctcagctactagccacctgagcaggagtccagctacgagtcttgaaggcagttataaaacacacccagacaacccagaggtggatgctgaagaaatccttcccgagactgtgagaacaacacccgacgatgcaaccacaagctccaatggcgaanattattctcttcagat

SEQ ID NO: 3723 - DNA, 271 bp, Zea mays
  misc_feature: Incyte ID No: 700612162H1
atagaccacagccagtcagccacatcactagctatctgtgcagaggcaatggcgtccaaggttgagctggtggtggaggtcaagtccccggctgacaagctgtgggcggcgctgcgtgactcgacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgagacgg

SEQ ID NO: 3724 - DNA, 274 bp, Zea mays
  misc_feature: Incyte ID No: 700612163H1
atcttgtgctgctgctgttggacaagatatgataaattcactggctgctgatgatgataaggaaaagtatgggcgatatcttcgcagatcttacattgaggataatagaaagacaaaatggtgtcctgcgcctggatgtgaatacgcagtggaattcgtcatgggcagtggcagctatgatgttaattgcaactgttcatatgggttttgttggaattgcaccgaggaagctcatcgtccagtagactgtgccactgtttcgaagtggatcctc

SEQ ID NO: 3725 - DNA, 273 bp, Zea mays
  misc_feature: Incyte ID No: 700612165H1
aacaatcaagaggtgccacaagtagaacaacatgttggcatcagcaactcttattcagagccgttggaccttgcaaagtacagttcatctgcagaattggaggtgcttggtctggagaagctaaaaatagagctgcaatctcgcggattaaaatgtggtggaactttacaggagcgtgctgcccgactcttccttctgaagacaactccattggacaagttaccaaagaagctgcttgcaaagactaatgggcggaagtgagaagttgtacca

SEQ ID NO: 3726 - DNA, 270 bp, Zea mays
  misc_feature: Incyte ID No: 700612166H1
cactgggttcatcgtgcaggtcctcgtaaggagatatattacgaacctgaagaagtaaaggctgccattgttacctgtggagggctctgtcctggtctaaatgatgtcattagacagatagtatttactctggagacttatggggtgaagaatattgtcggaatcccatttggttatcgtggtttttttgagaaaggcttaaaagaaatgccgctctcgcgtgacgtggtggaaaacataaatcttctggaggaagtttcctaggagtct

SEQ ID NO: 3727 - DNA, 272 bp, Zea mays
  misc_feature: Incyte ID No: 700612167H1
  unsure 126: a, t, c, g, or other
ttggaacaatgccgccccataagattgagactgggcatcaagatgtggtccatgatattgccatggattactacgggaagcgcctagctacagcctcctctgataacacaataaagatcattggcntaagtggaacctcacaccagcagcttgcaaccttgagtggacaccagggcccagtatggcaagtgcgcatgggctcatcccaagtttggttcaatggcttgcatcctgcagctacgacggccgggtgatcatctggaaggaaggaa

SEQ ID NO: 3728 - DNA, 271 bp, Zea mays
  misc_feature: Incyte ID No: 700612168H1
  unsure 10, 18, 25, 32, 39, 62, 72, 74, 98, 119-120, 126, 210, 269: a, t, c, g, or other
gagtggaacncgttctgntgcttgngaacagngggccantgtccattgcagaatgttgaaangaacaggganantgcttgtcatgaggtattctttgnggaaagaaacctcagggatanntgtgancccttctgtgtcaaagaatggggactcttatgtgttagacattgtagatatcgacaaagataatggcaatcctcaaatgtgtgnttcctacgttgtggagatatactcaaacctaatggcttcagagcttatgagaagaccangt

SEQ ID NO: 3729 - DNA, 272 bp, Zea mays
  misc_feature: Incyte ID No: 700612169H1
  unsure 4, 168, 173, 177, 180, 201-202, 210, 215, 236: a, t, c, g, or other
agtncagtcaacatcatcttggacttggaggtatacaagtaataactgcaagtacgtggaagcttcagtgaggaagctaagaacaagatattatcagcgaatgcagcaggaatatgaagaggaacaagagagagttcaaagaataaggcatatgcagagtgtcttcancaganagangtntacatttggacgaggttatgnnagctgganggagnatggccctcctcgtggctacnattacatccctcgggatgattggtattggcagaccg

SEQ ID NO: 3730 - DNA, 270 bp, Zea mays
  misc_feature: Incyte ID No: 700612170H1
gactagttctagatcgccagggcgtcggagcgagctcattctcaactcgactcaagagctctgcctcctccatcttcccttctctggcctccggagccacgctgatcagagatggaggcgaatccgaagaacaccttcacgatcaaagtggaggacgggaagcccgggaaggacggccggctggcggtcggaccggtgttccggagcgttctggccaaggatgggttcccgcagcttgagcctgacatgaagacatcatgggacgtgttc

SEQ ID NO: 3731 - DNA, 272 bp, Zea mays
  misc_feature: Incyte ID No: 700612172H1
atgcagtccattgaaaacaaaagcgataggaggctctgtctcaccatttgcgttggttataagaggcggttgccatttcgatgacaaagttagaaatgcacagaatgctggattcaaggctgctgtagtatatgatactgaagacaacggtgtccttgtttcaatggctggaagctcgtctggagtccacatatatgcagtgtttgtctctaaagcgtcaggggaggagctgaagaaatattcaggccaaactgacgcagagttgtggataa

SEQ ID NO: 3732 - DNA, 271 bp, Zea mays
  misc_feature: Incyte ID No: 700612174H1
  unsure 153: a, t, c, g, or other
gagcatttcagaaagcaatatgctatggtgcttgtgcagctaagagattctaatgatcaagtggctgcagctttgctttcgcttcgccaacgcaatacatatcatgggaattcagggcagtctaaatctatggaaaatggcatagcccttgcnggagcaccagatccgtataaccttttcagttatattaatccagagtctggttctcaagtgatcgaagttatcgagacttcaaagtccagggcaaaaatgatggttgatgttgctatcc

SEQ ID NO: 3733 - DNA, 271 bp, Zea mays
  misc_feature: Incyte ID No: 700612176H1
  unsure 45, 47, 79, 195: a, t, c, g, or other
ggaagagagcaaaagatctcttgtacaaggactacaactttgatnanaagttttttttgtcgacatgttctaactctgntttgaatctcacagccactggtgtgaagatcaatgaagacttcattggtgatatacggacacagcataaaagcagcagaaccactgttgatgtcataatcgatagtgattctaaancgtcaaccacagtcactgttgatgaagcactaactggtttgaagacttcatttgccttcaaggttccagatcacaa

SEQ ID NO: 3734 - DNA, 270 bp, Zea mays
  misc_feature: Incyte ID No: 700612178H1
  unsure 11-12, 28, 150, 188, 233, 266: a, t, c, g, or other
aggaaggaganngatgactcaaaagcangaaaagaacctaaacctaaccaaagtttcagtattgtagatgctgcttctgcttctgttcatggcaggagtgcagcagcagcaaaagcaacttctgctgaaaaaaccgtgtctagaatcganctgcatatggcaggggaacgagctcctgtaaatgctanactggtcaaaagtcgttacactactggagcagcgtcgcgttcttncacatcgacttcttatgatcctgttaccaaaantgaa

SEQ ID NO: 3735 - DNA, 277 bp, Zea mays
  misc_feature: Incyte ID No: 700612180H1
gccgcaaagagggctgaaggagaagcgaggaaaggtgaggccgatagatagaggagctgcggcgccgccggcgagccgaagagtggaggatccgatccgaagcgagaggactgaatcctgcggccgggagggacgcgggaccacgacgagcgtcgtcgtcggtgccaagcaacggcagttgtccctgtccagagcacaggcaagatggttaacgcgatcaaggggctgttcatctcctgcgacgtacctatggcacagttcatcgtcaacctgaacg

SEQ ID NO: 3736 - DNA, 270 bp, Zea mays
  misc_feature: Incyte ID No: 700612182H1
cctcaagaacctgatcagcttggatctgtatgccaacaagctcacgggaggaatccccaagtcactctccaagctcgactcactcagattcatgcgcttgaacaacaacaagcttacaggatcaattccaagggagtttgccaagctctccaacctgaaagtcatcgatttgtctaacaatgatctctgtggaactatccctgttgatgggcctttctcaacctttcctctccgaagctttgagaacaacagcaggctcaacggtccaga

SEQ ID NO: 3737 - DNA, 266 bp, Zea mays
  misc_feature: Incyte ID No: 700612184H1
tatgaatgggatccttcaacagataagtacaccagcgtgaaatatgatgcaacaacggtaactgaagcaaaggctctcaataaagagaggttgcaagctgaagttggattgcctgtggactcgagcatccctgttatagtttttgtcgggcgtcttgaagaacagaaagggtctgacatactcattgcagccattccagagttcgtgggcgagaatgttcagataatcgttcttggcacgggaaagaagaaaatggaggaggatta

SEQ ID NO: 3738 - DNA, 267 bp, Zea mays
  misc_feature: Incyte ID No: 700612185H1
tggacagtttggtgaacaggccatttgcagttatactaagcaaatacttttgggcctagcttatttgcacgcaaagaatacagtacacagagacatcaaaggcgcaaacatattggtagaccctaatggccgcgtgaagctcgctgactttgggatggcaaaacatatcaatgggcagcagtgccctttctcatttaagggtagcccgtactggatggctcctgaggttataaaaaatgctagcggatgtaaccttgcattgatata

SEQ ID NO: 3739 - DNA, 272 bp, Zea mays
  misc_feature: Incyte ID No: 700612186H1
  unsure 29, 33, 61, 184, 206: a, t, c, g, or other
catgtgcgtcgagcacagggctttcccgntaanaatcgtgcaggtccgtcgggtacttgtncggacaggtcctggaagatgaggcgcgcttcttggatcttggaaccaccctgaaaaacatgacaagtcatggtgtacagtactacttgaacaacaccaaaggttcttcggaaattcaagtgcntggactgaaggaaactctagantttatagccaaggttgccactcatgccatttcttccagcagagatgtatgtgtgtgcctaccagca

SEQ ID NO: 3740 - DNA, 267 bp, Zea mays
  misc_feature: Incyte ID No: 700612187H1
ctagaactagtcctaactgttttcactgattatatccaagcatgtgtcagatctgggaggttggacgttgacatcaattatacagaaatgcaagacagctgataagatcaaagttttgtgtccacaatgggcctggtgcattgacatatcagaagctgcatttgaagctaacaatagcaaattagctcttttgctctggaatttcttgcaagatggatgttcgtggtgagaagttaaacctcctgttcagctgtcagttaatgaagg

SEQ ID NO: 3741 - DNA, 269 bp, Zea mays
  misc_feature: Incyte ID No: 700612191H1
gactagttctagatcgtgatctcgcggccaggggaggaggttcagacgcctgatgcaatgggtggctccccggcgtgctccacgcaggccggtgacggcaaggctacagccacctcggtttcgttgaccgcttcggcggctgccaaggaggccgagttggcaaggtccgacagcttcgacgactacgagcaatgcagagtttgtcaacagaagacagaagaacctctggtcgaccttggatgtagatgtcgtggtgatcttgcaaaagc

SEQ ID NO: 3742 - DNA, 271 bp, Zea mays
  misc_feature: Incyte ID No: 700612193H1
catccatcctggcgtcggtgtcttgccctgccccagcgccgccgcttccttcccccaccccgaagcgccgccttcttctgcctccgtcgacggtggtggtgctcctgatccccgccgttgaactggccataggagagcaaagaggaaggggaggccgcgagggcgccagtagatatattcatcttcatctcggcttgcgatatttttgaattttctattccgtattgaaggcgtcgatggccttgtccgccctaatcagcaccctcctcgc

SEQ ID NO: 3743 - DNA, 269 bp, Zea mays
  misc_feature: Incyte ID No: 700612194H1
actgggagcactcaaaaaaattgaccactctagagctgtgccaggttgcaggggatgacttgttgatgtctgatcctgaacgcattaagcgggcagttaatgagtacacttgcaacgctcttgttctcaaggcaaatcaagtgggcactgtcactgaggccatagaggttgtgaagcaggcaaaggatgctcattggggtgtgatggtgtcacataggtcgggagacactgaagattctttcattgctgacctggctgttggtgcttca

SEQ ID NO: 3744 - DNA, 271 bp, Zea mays
  misc_feature: Incyte ID No: 700612195H1
caaatggcaaaaatttgcctgaagtgccgaccttgatgtttgaattcatagggacagaagcatatgctctggaacaaactctcttggttcaaaaaattgccactgaacaccatggatcagattttgtttttgtcgaggagccagatgctaaagcggaactatggaagatcaggaaggaggcactttgggctggttttgctatgaaacctgatcatgaagctatgataacggatgtttgtgtccctctatccagacttgctgaatgcatatc

SEQ ID NO: 3745 - DNA, 273 bp, Zea mays
  misc_feature: Incyte ID No: 700612196H1
atcatcaaaagacagtggcttctggatgcattagacattggctgtgttacagctcacccctcaacggtgctgtgttttgttggcttgctttgtggtagctgctgcatctatatgccgcttcttcttgttaattcgataaatgtactgagcgacttgccggtcaccctgcctgcctttctctccaccatcgtttctgatgatttcaggaactctgtggcagacaggctatggctgttgactactgacatctatacttgggctgaacaatagctc

SEQ ID NO: 3746 - DNA, 293 bp, Zea mays
  misc_feature: Incyte ID No: 700612201H1
  unsure 189: a, t, c, g, or other
tgcagttgatggtcttgttacaagtttggagaagtatccagaggaagaggatatatacggtattatgttttccattggtaagaaccatgggagcttttcagctaacatagctaaacatttggccaaagagattactatggcatctgacggagagcttatcttggacaaaccaagggtcaaagcattgtnaatagtgtctatttcagcacctttttctaatgataagcacaagcagctgggtatacctcgattatcttcttgtatgcaattcccctactggagaagactcgtgc

SEQ ID NO: 3747 - DNA, 293 bp, Zea mays
  misc_feature: Incyte ID No: 700612202H1
cgcgcttcgcccccgacgagctcacgctctgctagcaagacgctcaatgacgcctgcccctactccaagttcgcgcacctacaccgccaaccaggccatcctggaggctacgggcgcggcgaccaagattcacatcgttgacttcgggatcgtgcagggtatccaatgggcggcgctgctgcaggcactcgccactcgcccgggggagaagccatcccgggtacgtatctccggcgtgccttcgccgtacctggggccaaagcctgcggcgtccctcgccgcaaccagtgccc

SEQ ID NO: 3748 - DNA, 289 bp, Zea mays
  misc_feature: Incyte ID No: 700612203H1
  unsure 77, 115, 122, 269, 277-280: a, t, c, g, or other
acaataatgatggagaccttcgagttaaagacgacgaactacaccaattattgcaggatattccgtgcacgcgattnctaccatacaatgaaattgcggataaattacaggagantgcagangcagctgaaacagctgcttctgcagcacgttcaattgatgaagagagaagattttttacgttagaacttgaacggctgaaacaagaccacgagaaacaagttgaagcatctttgcttaggttaagggaatcggaggagaaagcaaancttcttgnnnnagagagaga

SEQ ID NO: 3749 - DNA, 282 bp, Zea mays
  misc_feature: Incyte ID No: 700612204H1
aagcagaattagctgtaaaagactgtatggaaaagaaatggttaccgaaattatgtttgatctgagagctagtggccaaagttcttcggagtccgaagccggctggtttgatcttttcagcaagcgttactggaaagttgtgagtgtgggggcagcactgtttttgttccagcagcttgcggtataaacgctgttgtatattactctacatcggtgttccgtagtgcaggcattgcatctgatgttgctgctagtgctcttgttggagcagccaatgttttt

SEQ ID NO: 3750 - DNA, 282 bp, Zea mays
  misc_feature: Incyte ID No: 700612205H1
  unsure 138: a, t, c, g, or other
gactagttctagtattcttctcaatccactcccgagcctgaacaggcaaagggcattgacgaggtatccttgcagcaagatgttcagactgaggattctgaggatcatgctgatggcaaggaggatcagccagcgcanatggtcaaaagttgggatcagatatgtggtcaagttacttggacaaagtatcggatcctgctgccattggtgctgctcttgctgccattattgttgcagctgttgtggcattcctttacatgaggcagaagcaaactcgtgttg

SEQ ID NO: 3751 - DNA, 285 bp, Zea mays
  misc_feature: Incyte ID No: 700612206H1
  unsure 224, 247: a, t, c, g, or other
attgatgctgatcacatgatgttccctgctagcatttggtgttgttgattctgagagtgatgataactggaattggtttatatcggaattgaggaagatgcttggagttaacacagataagatgccggtcttgactatactttctgagagaaagcggcaagtggttaaagcagttggatctaatttccccactgcttttcatggtttttgcctgagatacgtgnagcgagagtttccttgacgagtncaagaatactaaactgcttaaccttttctggagtgctg

SEQ ID NO: 3752 - DNA, 283 bp, Zea mays
  misc_feature: Incyte ID No: 700612208H1
acgactgcatctctggtctcccacgcctataatcccattcccctccttcaaagccctgcggcgatttcgattcttcccttctatctccaggtatacccatcggagcagcactgacaaaaattctccagatatggcaagcaaaaggattcagaaggaactcatggatctccaaaaggacccaccgacatcatgcagtgcagggcctgctggagaggatctattccactggcaggccacaatcatgggtctagtgacagcccctatgcaggcggggttttcttta

SEQ ID NO: 3753 - DNA, 285 bp, Zea mays
  misc_feature: Incyte ID No: 700612209H1
  unsure 29, 90: a, t, c, g, or other
tacggaacttccggtgcggcggcgaccancttgtggcgatccatccctcaccatgtcgtcggaaaaggaggcggcgctcgcgcgtgcctncgatgacagcccaaccatatttgacaagatcatcaaaaaggaaataccttctactgtggtttacgaggacgagaaggtactggctttcagggacatcaaccctcaagctccaacacacattctcatcatccccaaagtcaaggatggactaactggcctggcaaaggctgaagagaggcacatagagatattggc

SEQ ID NO: 3754 - DNA, 280 bp, Zea mays
  misc_feature: Incyte ID No: 700612210H1
aagcagaattagctgtcaaaagactgtatggaaaagaaatggttaccgaaattatgtttgatctgagagctagtggccaaagttcttcggagtccgaagccggctggtttgatcttttcagcaagcgttactggaaagttgtgagtgtgggggcagcactgtttttgttccagcagcttgctggtataaacgctgttgtatattactctacatcggtgttccgtagtgcaggcatgcatctgatgttgctgctagtgctcttgttggagcagccaatgtt

SEQ ID NO: 3755 - DNA, 279 bp, Zea mays
  misc_feature: Incyte ID No: 700612212H1
tattgataagacgggaaataccctaggctctcgccagtctccggtgcggctcaacaccgaccgaacccgtgaaaaattcgttctcctttcgatccgtttggcggggggctcggccggatccgaccggaggggcgccgccgatccatccggtcgcagccgcgtctgatttggtgcggatttggcgagataccccgctcctagctccgctgtttcaaggataacaaagatggcgtcgccgcggggcgggttcgatgagcaagatcgccggacggagaaggg

SEQ ID NO: 3756 - DNA, 281 bp, Zea mays
  misc_feature: Incyte ID No: 700612213H1
  unsure 22, 27, 34, 39-40, 43, 45, 48-49, 221: a, t, c, g, or other
gacattggacttatactcgtcntctcnaatgggnaactnnccnancanntccctgccagacttgtccttgttgaaggatgcctttttacgaggttttgtgtactcaagaaacttgaattcaagtagttccataacatgttcatctgatggagaagccatcttgattaatggagaagagactattttttctctacgctctgccaggatgagatatacaggtncgtagacagcatagtacagtgtacagaaaagagaatcaaccagggaagactcttcttttg

SEQ ID NO: 3757 - DNA, 286 bp, Zea mays
  misc_feature: Incyte ID No: 700612214H1
  unsure 183-184: a, t, c, g, or other
cgtgacttcccctcccctccgcccctctccactccatcgtcaaggaaggaacacggccctaactaaaccctagctaagggaagggaaacaagaccatggatgcctccaagctccgcgagcttcgcgacttcgtcgaggcgtgcaagaagaatccttcgctcctcgccgaccccaacctctccnncttccgggattacctccagagtttgggtgccaaaattcccgccgccgccccctctttcgaaagtcccaagagatcttccatggacgacattgatgacgaggt

SEQ ID NO: 3758 - DNA, 289 bp, Zea mays
  misc_feature: Incyte ID No: 700612215H1
ggaacggctgatgtatactataaacagattatgtccctttgtatgaagggttatcgagtaatatctattgacgttcctacaagtttggaatcaccatgaatggattcattcatttgaaaaatttttggactccatgaatatccatcatgttcacatttatggtacatctcttggtggattcctggcacaaatatttgctgaacaccgtccaaggagagtaaagtcattggtcctatcaaatacttttcttgagacgcacaagtttgctgctgccatgccttggtctcca

SEQ ID NO: 3759 - DNA, 287 bp, Zea mays
  misc_feature: Incyte ID No: 700612216H1
ggatgaaggtagcagcatccacagtccatactgggtagcttggcagtatacataatgttgcagacgtcaactgcttttgtttctcgtaattagaatggattttctttctgaaacatggaaagggagaaatgctgttcttaatttggtagggccattcggtaaccaaaatgtctggtttagcccaacgcatgccattgactgtcctgttgtcttattgctgtatacttgagatgcttatgcatgctaatgtgtacctgtgcttactaagagaagtatgtttatataca

SEQ ID NO: 3760 - DNA, 287 bp, Zea mays
  misc_feature: Incyte ID No: 700612217H1
  unsure 140: a, t, c, g, or other
agcggctgcagcttctgtcaagggagcactccatggacaaatgctgcgaggcctggcactccgtcttggaaatcatggggagcttactagattgtcgggtctggtaagcaatttgattacagctggccatggacgcgaanagcatttgctgccgcagttctgggagataatgccctaatggagaagcatggcaggacacaggaatgttagctgaggctgttttacatgctcaggcccatggtcgtccatcataaggaattggttataacatggaacaagatgctaca

SEQ ID NO: 3761 - DNA, 286 bp, Zea mays
  misc_feature: Incyte ID No: 700612218H1
  unsure 18: a, t, c, g, or other
catatgaaaagcaagctngaatgctcgagcaagaaaaaaaccatcttcaagagaagttcttatctgaatgtaagaaatatgatgaggcagaacaaagatacaagtctgcagaaagggatgcgaagaaagctgttgagttggctgatgcagctcgaacagaggctattgcataccagaaagagaggacaaggcacagcagttatctattgaaaaggtagcagttatagagagggttcaaagacaggtagacagactagagcaggaaaaggttaatctattgggcgaa

SEQ ID NO: 3762 - DNA, 284 bp, Zea mays
  misc_feature: Incyte ID No: 700612219H1
  unsure 81, 158, 224, 235: a, t, c, g, or other
ggagcaatccctgcccgttctgctgtccggccaggattgcattctccacgcgcaggctccgggaagacgctggcctacctncttgtccatcttctccaccatcgacttcagcaggtcctcggtgcaagcgctggttgtcgtccccacgagggagctcntcatgcaggttaccaaggtcgctagactactcgcagccaaggcgtgcaccgtcatggctttgcttnatggcggtacntcaagaggcaaaagagctgggtcaaggcagagccccccgcgataattgt

SEQ ID NO: 3763 - DNA, 281 bp, Zea mays
  misc_feature: Incyte ID No: 700612222H1
  unsure 85, 253: a, t, c, g, or other
aacttggttcccccacggagttgcagagaaaagagcttgccatatctgagaaaataactggacttgagaaaaagttgcactactncgaatgttgaacagaataaccttagagggaaactagctaaattagcatctgagaggagtaatattgaggcagagattgatcgtctgaagcctggagaggaggagctcgagacccgtattggtaaaagggaagcagaagcaagaaaacttgagaaaaaaattaatgacntgtggacaaggtgtacagagattttagc

SEQ ID NO: 3764 - DNA, 282 bp, Zea mays
  misc_feature: Incyte ID No: 700612223H1
gaatctgcacttaatgaacaagctgggaagatgttacttgaaaattatgaggaatatgcacgacatgcaaggttatacactggcatccatgcccttaaacctaagaatacgtccaagaccggagctatatctgagtcaaccacagctctgaatgtcgacaagtcaagtactgccttctagcaagaacacaccatcgatgccaccggcggtatctacctccagtgcatccagagcatttggtacgagtttgcaggatcagaaccccatgtttctgatcctgct

SEQ ID NO: 3765 - DNA, 283 bp, Zea mays
  misc_feature: Incyte ID No: 700612224H1
ggtttcatcgcggcaccatcagtcgttagtcataataccattaccaaacgcaaccaacgataaatccacgtgacataaatagatggagcccatgagagtatggctaaaaaaataagaatgtgatcggagttgaagcagagattgctggcagaagagcatcacatgagaattttcttcaactcagagaattattttatgattaacatggagattatcaggtcagagatttatacgagagtggatatgaggggaaccaaccatgagatcaagtttggcaacttgc

SEQ ID NO: 3766 - DNA, 280 bp, Zea mays
  misc_feature: Incyte ID No: 700612227H1
gtgttcaacatgattgtaaacgaatacaattctgttgctaactgtgtaatgatgagaaggataattgaataatctttgtgaagtattactgtctgaactgtacgcaaatgctacattcattctttgtgttcgtgtaaatatcattatacataaaaatgctgcattgcattcccgtcgtccgttctaaatcagaactgacgattgctctggtggctgaagctcctgaaagaaaaggaaaaggccgaaaagaagaaagagaaaaggagtgacaggaaagctc

SEQ ID NO: 3767 - DNA, 280 bp, Zea mays
  misc_feature: Incyte ID No: 700612229H1
  unsure 17: a, t, c, g, or other
gaaataacatacacaanacaatctttgaatcttgtggttgtattatttctgctcatgtcaatgactgtacaatgtccttaggtgcttacaatattgtcactcagtcattttttgtgccactattccatcattttcccttgcttatcaatgagagtctttatatgaaactaatgcttgatgaattgctttcttttccacaactcaatgttttcctggtaggactgatgttcaattttgcataggtggcaaaaggttttggtgtatagatgctgggaaagct

SEQ ID NO: 3768 - DNA, 288 bp, Zea mays
  misc_feature: Incyte ID No: 700612230H1
  unsure 63, 220: a, t, c, g, or other
cagctgcccatgaacgtgggcgacgcgcactacgacccgctcttcccgttcggcttcggactncaccaccaagggcacgaagtgagtgagtgtgaggcgctctgatgggatgtggcctgtgagtgagctgtgtattcgtgggcgggcgtgaggctctttggctttcgaattggttgggggtgacgggcggcgagtcgtgtacgccgcacacattgcgcangtaacgttgggttgggatgtttgcgtctgggtaataacagtgatgcatcttgagatggttgctgttat

SEQ ID NO: 3769 - DNA, 288 bp, Zea mays
  misc_feature: Incyte ID No: 700612231H1
  unsure 171: a, t, c, g, or other
atgatgtttcatgcaattgcatgttcagcttttgttggaattgcactgaggaagctcatcgaccagtgaactgtgagactgtttctaagtggatattaaaaaacagtgcagaatctgaaaacatgaactggatactggctaattctaagccctgtccaaagtgcaaacggnccaatagagaaaaaccagggatgcatgcatatgacatgcacccctccttgtaaattcgattttgctggttatgtctgggtgcatggtcagatcatggagagagaacaggtggctttt

SEQ ID NO: 3770 - DNA, 289 bp, Zea mays
  misc_feature: Incyte ID No: 700612232H1
atgatctcaaaggtgatgaacaagaacaaattgatagattggctgaggatggtgatatctacagtaagttggcaaggtccttggcacctgaaatatttggccatgaagacgtcaaaaaagcactgctgttactacttgttggtgcaccccataggaagctcgcagatggcatgaagatcagaggcgacctgcatatatgcatgatgggagatcctggtgttgcaaagagtcaattctgaagcatattatcatgttgcaccaagaggagtgtacaccatggacgtgggag

SEQ ID NO: 3771 - DNA, 284 bp, Zea mays
  misc_feature: Incyte ID No: 700612236H1
  unsure 11, 14, 40, 82, 181, 192, 196, 270: a, t, c, g, or other
gcagcagacanctncgccacctccaccctcgaatcgttcnccaccatggcgtcgcagggatcctccgtattgcgccgcactncgagcaggccccggaggaccccatcctcggagtgaccgttgcctacaacaaggatcccagccccgtgaaggtcaacctcggggtctgcgcctaccggancgaggaagggnagcncctagtgctgaacgtggtcaggcgcgccgagcaaatgttgatcaataatccgtcacgtgtcaaggagtacctancaatcaccggtctg

SEQ ID NO: 3772 - DNA, 140 bp, Zea mays
  misc_feature: Incyte ID No: 700612237H1
  unsure 54-56, 122, 134: a, t, c, g, or other
cccttgcagcgtgctgttaaattgattagattgatttcatcactgcggtggatnnngtggtagattgattagattgatttcatcactgcggtggatgcagtcaatctaatcaatctaccacncccttcagcgtncgtgtt

SEQ ID NO: 3773 - DNA, 146 bp, Zea mays
  misc_feature: Incyte ID No: 700612238H1
  unsure 13, 39, 72, 91-94, 97, 104, 108, 131-132, 140: a, t, c, g, or other
tctagctctacgncgacagcctacttcgtctaatctgcnatttgggctggtgagccttcagtctgcactatntgaagctatatcttgcctnnnncangagccangcangattgcagcaatggcggctttgnnagattacnatatag

SEQ ID NO: 3774 - DNA, 160 bp, Zea mays
  misc_feature: Incyte ID No: 700612240H1
  unsure 8, 38, 59, 80, 87-88, 94, 97, 114, 119: a, t, c, g, or other
ctcccatncagccgccaccaggtgcagagtctttcgtncatctcttctccggcgaagancccccagtcgcccaccagatncacttgnnaaactntgntgaggggtgatggcggnttctntcgcaaactcaactccgaggccagggcttgaaaagcttgat

SEQ ID NO: 3775 - DNA, 277 bp, Zea mays
  misc_feature: Incyte ID No: 700612241H1
  unsure 64, 128-129, 231, 245, 268, 270: a, t, c, g, or other
tcctttccctcgcgccgccgccaacgcaacccttgcagccccaatccctcacagcaaccatggntggcgcgcaggagtccctctctctggtgggcacgatgcgcggccacaacggcgaggtgacggcnnccgcgaccccgatcgacaactcgccgttcatcgtctcctcctcccgcgacaagtccctgctggtgtgggacctgaccaacccggtccactccaccccggaanccggcgccacggcngactacgggtcccttcggccgcnanacggcca

SEQ ID NO: 3776 - DNA, 199 bp, Zea mays
  misc_feature: Incyte ID No: 700612242H1
gactgcgttgctgctgcaaagcacttttacatcatatgccaaggatggtctggtgcaaaggtttgatcaaggggggagaatggcgcagaatatgttctgcagaagttttacctttcgctaggccagatttgtcgattcatggtcatctgtattgactgtattcaattgaaatgaaagtatccgttgaacattcactttc

SEQ ID NO: 3777 - DNA, 279 bp, Zea mays
  misc_feature: Incyte ID No: 700612243H1
  unsure 15, 218-219: a, t, c, g, or other
ctcttgataatgtgnatttgtggagccaattcatgaagaagaatgccaaccatcaacctctgagaaagaagacgacaataatacacattctgcgtctgcaatttcagctaaaaaatgccgagcaaatgaagaaaaaagaatatcaaagaaattgcctggagttcagggaacttcctcgatattgaagtttctttcacggggccaatctaccttacatnngaaaagaaaatctgatggactaatttgcagtcatcaaggtaccgggagttcttcggaagc

SEQ ID NO: 3778 - DNA, 278 bp, Zea mays
  misc_feature: Incyte ID No: 700612244H1
  unsure 177: a, t, c, g, or other
gtggtgaacaaacagttgttgggaggcccttgcaggaaatggaacctaaggctggtgcaggggaaaatacttctgttgtctctgctgttgctaatgatgccgctacattgtccaaggcagacaaactaacttctcagcctcaaacagctccatcttccaagccaactgccaatgtanaggacacagctactgagtttgctacactgtctttatcaaagaaggattctgttgtttcaaatggtgctgtgcttagcattggatgtctcacatccggtgag

SEQ ID NO: 3779 - DNA, 281 bp, Zea mays
  misc_feature: Incyte ID No: 700612246H1
  unsure 53-54, 209-211, 213: a, t, c, g, or other
ctcgagcggatggtgcatgggtttcagttatttgacatctggcagcagcatcnnatggaaagtggtgcagacttccttgatttacagaaatcttataagcaagcagcaggatctttttctgaatggaggggcaagcttactatgaactttggttttgtcattgatttgataagcttgttgatgtcacttggtcattactcgatgatatnnncntctcgtggtatggcgtttcatctggttgatgcagttctcttattgaactcgcgtgctcttatagtttc

SEQ ID NO: 3780 - DNA, 287 bp, Zea mays
  misc_feature: Incyte ID No: 700612247H1
ggatgaaaggcttaatgcatctaaacaatcacgtgcagatgctgacgagataatttcaagccagaaaggaatgatatgtgagcttgagggacagctaaatgaggagcgaaatttaagaagagaagagcgtgataaggctgcacatgacatgaaatctgcattgcataaagtgcaagtcgaggctcaagaagaaattaagaaacaggcggagtcttaccttaggcaacaaagggagcagaaagaagttattagcaagcttcaggaatcagaaaaagaaacccgtttgt

SEQ ID NO: 3781 - DNA, 285 bp, Zea mays
  misc_feature: Incyte ID No: 700612249H1
  unsure 11, 17, 26, 31, 38-39, 56, 61, 64-65, 75, 136, 141, 170, 175, 245, 272: a, t, c, g, or other
gcttgttgagntaggangcgcggatnacaanttaaacnncagcaatgtggaaactncagantanntcatgttgcnacctgacagagaactgtcggctaatgattacatggaactaaacgatctccttgctcctganccaancttccccagtgaattttctgctcaggacnctcantatatgcagcatctcttgctcagtacaatggacattatgatctgtcaggtccttcggagccaacaatgcntagcattttcgatgggttgcctcccantaatggagtcctc

SEQ ID NO: 3782 - DNA, 282 bp, Zea mays
  misc_feature: Incyte ID No: 700612250H1
  unsure 4, 6, 9-10, 23, 36, 43, 47, 51, 60, 68, 75, 100, 123, 146, 150, 161, 163,: a, t, c, g, or other
gtgnanganngatcttcccatancaatcatcttccncgcccantgcnatgnatccatccncgattganctagggnttcgcttcgctattgcctctcctgncttgtgtagtgccctctggggantgctctagttccccagatcttanccanatcagtcaagntnaangctaaggattgngggtgnncagtggncttatgtgcattcggaanaaccaacctatactaacatgtaagancgaaggacagactcctttccgaatggtntatggggcagaagcnata

SEQ ID NO: 3783 - DNA, 260 bp, Zea mays
  misc_feature: Incyte ID No: 700612251H1
  unsure 20-21, 33-34, 53, 175, 237: a, t, c, g, or other
accaccgcaccggcaccaannccaaccgagcgnntccaggctcctgctcaagnaggggagaagaggcgagccttccttgggaagtcgcaggaggagagaaggggaacaaagatggggcgcggcaagatcgagatcaagcggatcgagaactccaccaaccgccagtgaccttctnccaagcgccgcaacgggatcctcaagaaggcgcgggagatcagcgtgctctgcgacgccgangtcggcgtcgttcgtcttctcca

SEQ ID NO: 3784 - DNA, 278 bp, Zea mays
  misc_feature: Incyte ID No: 700612253H1
ggagggatgctgctcgaatatgcaggaacggccttgcaaatgaaccgaactgattctatgtagtatttctgtgtgctctcgttggcattttgcttggaggggcatcttgctgggatgcagcgagacacgctttagttgtagcctccgtactgtcagtattattccctagatgcaatgttgttgcagtgctgctgctgaccttctgctccatccagaacactggtagcagtctgtatgcgcgcccacgctacagaactctagattatcttgtgaaatgt

SEQ ID NO: 3785 - DNA, 274 bp, Zea mays
  misc_feature: Incyte ID No: 700612254H1
catttgggacaggagattgaagtagctgaggggcatgctaagaagcctcttgaggaggtgattcaggctgcaacgaaagcccctccttcaagagacttctatggcgctttagaagctgcctacaagcgtaatggggtgcctgcattgattgctgaggtcaagaaagcatccccgagtaggggtgtgctcagggagaactttaatcctgttgaaattgctcaagcttatgaaaagatggagctgcatgtttgagcatttgacagatgagaagtac

SEQ ID NO: 3786 - DNA, 275 bp, Zea mays
  misc_feature: Incyte ID No: 700612255H1
  unsure 2, 124, 194: a, t, c, g, or other
gntggactacattgggtcctagttctttgcaagtagaatcactggatgctttggatagcgatatactgtatgttaacacaggagttctcgagcagcatcataaagagggttactatgaacccantgtctaccaaatcacttcaggcatttgcacaatgtctgaagctgaaccattcgaagttttagaaactggnaaagatgtaaaaacgccatctaagctagatgagcaacttaatcctgggttggaggagatgaagctgagaaacacagcttag

SEQ ID NO: 3787 - DNA, 279 bp, Zea mays
  misc_feature: Incyte ID No: 700612256H1
  unsure 277: a, t, c, g, or other
gtgttccatctgatctggcagaggagtaatgatgcaaatgtttctagtcaagatgtggttctagataactctggccaagcttgtgctcatgcagtggacggcatgacaagggaatttaatcattttgttcatagagacgctaatctttttgggagtactgaggtccctgcttctgagattactggggtggaatataatcaagatgcctctggttttcctcgacaaacagaggatgacaacacggtggagtataatcaagatgcctctggttttcctnga

SEQ ID NO: 3788 - DNA, 271 bp, Zea mays
  misc_feature: Incyte ID No: 700612257H1
  unsure 41, 43, 49, 219, 251: a, t, c, g, or other
agccatggttcacttgggaataatggctatcaatattacanancctgcnatattgatagccatggttcacttgggaataatggctatcaatatcgcagggtctgtaataggattatataatcgtcgaacattagagtgtgggttcttgagaacgctactctaggttgtgcgtcgtataattatatctggctacagtaaagcctgagtccaatcatgtgnaaggccgtaaggattcctgggtggtttgtttnttaagttcctcgggaaggtc

SEQ ID NO: 3789 - DNA, 274 bp, Zea mays
  misc_feature: Incyte ID No: 700612258H1
  unsure 270: a, t, c, g, or other
aatcatcagaaggcacaggtgatggtttctagttggcctctaaactattggagaacagcacccgtcttcagaacacctctcataaaccagcatgcaagcatgcaagaggcaaaggtgaatgatgctggaccttcatcaaacttaaacatgcctgctatgtatggacacaccgaagatagtttgctttctgctgatcttgaaagggattggattatagaagagaatccaagaatgaaactacattgtttggagatagttcatcggaaatcntgat

SEQ ID NO: 3790 - DNA, 279 bp, Zea mays
  misc_feature: Incyte ID No: 700612261H1
  unsure 3, 5, 10-11, 18-19, 23, 31, 34-35, 41, 43-44, 46, 55-56, 60, 63, 71, 73,: a, t, c, g, or other
gcngnaaatnntcccggnnatcnctcctacnagnntcttangnngntattttcanntgtnggnagtttgantncaatccgaacttgctatcctcanactcnaaatggcantggncctgcaantaatagnncttccaagttagatatgctttttgctaanaagctgcatgctttcgtggagtnngaaactcctgaggatgctgcgaangctattttggagctcaatgatgagaaaaactggagaaatgggcttagagttcggttgctgaatacttgcagg

SEQ ID NO: 3791 - DNA, 97 bp, Zea mays
  misc_feature: Incyte ID No: 700612262H1
  unsure 15, 27-28, 34-35, 41, 44, 46, 49, 65: a, t, c, g, or other
attaagacagagcanatgtggttttgnntaagcnncgtccngcncntcngaatgatctattgcgncgcatgtgtcatcacattcacattgtgatgaa

SEQ ID NO: 3792 - DNA, 140 bp, Zea mays
  misc_feature: Incyte ID No: 700612263H1
  unsure 54-55: a, t, c, g, or other
cccttcagcgtgcgtgttaaattgattagattgatttcatcactgcggtggatnntgtggtagattgattagattgatttcatcactgcggtggatgcagtcaatctaatcaatctaccacccccttcagcgtgcgtgtt

SEQ ID NO: 3793 - DNA, 283 bp, Zea mays
  misc_feature: Incyte ID No: 700612264H1
  unsure 3, 9, 20-21, 35, 42, 48, 58-59, 70, 79, 105-106, 113, 140, 174, 196, 227,: a, t, c, g, or other
ggnatacgntgcccaggagnnggaactggtgcagnttaagcncgaggnccgtttgaanngtggtttctangtgcagtanctgaggcaaagctgctctttgtggtnngcatccngggtattaatgccatgcaccctaagancaggaagatcttgcagcttctgcgattgaggcanatcttcaatgggtgtttctcanagtcaacaaggctactattaacatgctacgngggttgagccatatgttgcactgggtaccacattgaagatgtcatggattnactac

SEQ ID NO: 3794 - DNA, 284 bp, Zea mays
  misc_feature: Incyte ID No: 700612265H1
  unsure 26, 100, 194: a, t, c, g, or other
gagcaacctgaaccgcaccttctccntgctcaaggccaggggcatgatccagtctggggacctcgtgatcgccctctcggacatgctgcagtccatccangtgatgaacgtaccctgaggtagaagagccttacctttacctccatgccgcacggtcccgtatcggaaggaacacgcgtgttatcggcaccttngaaggacggtttcttccttccctgcgcctaaatcgtgccctttgttttcgctgtatcagatgctgctatgctatgctaggctctagtctg

SEQ ID NO: 3795 - DNA, 279 bp, Zea mays
  misc_feature: Incyte ID No: 700612266H1
  unsure 125-126: a, t, c, g, or other
aacgcaagaaggatccccaccccgaccgacctaccctaatcggcgatggcgacggtggcgatggacatctcgaagcccactccagtggcgtccggcgacgaggccgcggcggcggccaaggggannagcggcggagggggcgaggggctgcggcagtactacctgcagcacatccacgacctgcagctccagatccggcagaagacccacaacctcaaccgtctcgaggcccagcgcaatgacctcaactcccgagttagaatgctcagggaagattgc

SEQ ID NO: 3796 - DNA, 280 bp, Zea mays
  misc_feature: Incyte ID No: 700612268H1
  unsure 28, 82, 116, 118: a, t, c, g, or other
gcaggacaagcctgaggctccaccgganggccgccttcctgatgccacccaaggttctgatcaccttcaggcaggttttctnccacacagatgggtttgagcgaccaggacattgncnccgctttctggtggtcacaccctgggaagatgccacaaggacaggtctggatttgaggggcctggacgtccaaccctttgatctttgacaactacttacttcaaggagcttctgagcggagagaaggaaggccttctgcagctaccaagtgacaaagccctc

SEQ ID NO: 3797 - DNA, 265 bp, Zea mays
  misc_feature: Incyte ID No: 700612269H1
caatggtggccgtttcttgttccagctgctgctattgtcctaaaattgggtagaaagtgtatgacaaatactcaagtacatgcagttcgtcctgctgttcctggattgtttccttacatggtcccaaacagtgaatgttccttgctacttctgttgctggaaatatgccgtagttatatttggtgaatactagagtcttgattatgatatgtaggctttgggttatgacctggcagctaggatcaacttttattttgttagtttg

SEQ ID NO: 3798 - DNA, 274 bp, Zea mays
  misc_feature: Incyte ID No: 700612270H1
  unsure 51, 190, 268: a, t, c, g, or other
agcagaatcttaaggaccatggtattactggtgtttttggtcctgtattanaactggttgattgtgaagagaagttctttacagctgttgaggtcactgctgcaaatagcttgttccatgtggttgtcgagaatgatgacatatcaacaaagatcattcaaatattaactagagaaaaaggtggaagggngacatttataccattgaacagagtgaaagttcccagatctcagctgtccgcaaagtcctgattttgttccatgttganaaaatt

SEQ ID NO: 3799 - DNA, 275 bp, Zea mays
  misc_feature: Incyte ID No: 700612271H1
attgatcagactcttcaggcactttgtctgtacaaattccacagaagtctttccgttccttgagccttcgatttcatggagacatagccaataatgcagaaaatagtgctgtcaaaaggaaagaaggcacattaaccaacactactaccggagccgaaaatgatgttttggagaatgatgatgtcaataagtctactaaacatgcacattccatcttgcgcgacatccataagtccatatttgaggagcaggtttttgatttggtgatccaggag

SEQ ID NO: 3800 - DNA, 153 bp, Zea mays
  misc_feature: Incyte ID No: 700612272H1
  unsure 19, 34, 47, 62, 66, 72, 82, 85-86, 89, 95, 100, 104, 109, 116, 135, 151: a, t, c, g, or other
gtctcccctccactgcgantctccgtttccgagnatggctccggccnccgaattacctgtcngcgngcgccnctggttccantcnncgngcgctnttacngatnccgangcatctnttgctggcaattcagcatntacatctgcgcgctgnga

SEQ ID NO: 3801 - DNA, 271 bp, Zea mays
  misc_feature: Incyte ID No: 700612274H1
caactgggactgttgtcgcatacgcacttgagtacaatgatgagaagggaatatgtttcttcactgactttcttgtcgttggggagaaccaacaaacatttgatcttgaaggggacagtggaagcctcataatcttaacaggacaagacggtgagaagccgcaacctataggattatatggggtggtacagctaaccggggaaggttgaaacttaaaagtggccaggtccggagaactggacaagtggagttgatcttggccgcttcttga

SEQ ID NO: 3802 - DNA, 271 bp, Zea mays
  misc_feature: Incyte ID No: 700612275H1
  unsure 266: a, t, c, g, or other
gctacgagttgggttttcgtaggtacatttgggcgtgttttggaatgctgggaccgtgaaacacgtgaatatgttgccataaaagttgttcgcagtatccgcaagtaccgtgatgctgcaatgattgagatagatgtgctcaatcgccttgcagaaaatgagaaatacagatctctctgtgttcaaatacagagatggtttgactatcgtaatcatatatgcatgtttttgagaagcttgggccaagttgtatgatttccaaaggngaata

SEQ ID NO: 3803 - DNA, 274 bp, Zea mays
  misc_feature: Incyte ID No: 700612276H1
  unsure 144: a, t, c, g, or other
gacgcatgggaggaaggtgctggcggcgagtacctggagctaaggaaccggaggctcgagaagctgccgccgccgccgggaaccacgaggaggtcgggcgggaggaaagcggcagccgaggccgccgcaactaaggaggctgangcgtcgtacggggagaacatgctcgagttggaggccatggagaggattaccagggagacgacgccctgcagcttgattaacaccccagatgactagcattcctgggtccagagatccggccatcttgcca

SEQ ID NO: 3804 - DNA, 281 bp, Zea mays
  misc_feature: Incyte ID No: 700612278H1
  unsure 47: a, t, c, g, or other
gagcgtcagagcccgatcccgatccagcgaggcggcgaccctccctncctaccccttgcttcgctcgtccagccctgaccacccgcatccccgtcagtcatggcagcggcagcaggcggaggcgcggtgcgtgcgctgtcccagaaggagcaggacatacagatgatgctcgccgccgacgtccaccttggcaccaagaactgcgatttccagatggagcgctatgcctttaagcgccgcaccgacggcatctacatcatcaactttggcaagactgggag

SEQ ID NO: 3805 - DNA, 281 bp, Zea mays
  misc_feature: Incyte ID No: 700612279H1
  unsure 204, 279: a, t, c, g, or other
gtctaaatgaatagatggagacaacaattggaaagcactcgacagctataacagttggaaactgctcgacagccataacagtcaagaggagcttgactgtactacaaatagcaagttttctcctaaagaaataccatgtcctatggaacttgacggttttagtagcctgaagcttgtcagtcataacatcttggaagaacttgnataatcataactgtctaaaagagaacggtaatgaaaatagttctaaagagctggacaacatggaagtccaaaagntc

SEQ ID NO: 3806 - DNA, 282 bp, Zea mays
  misc_feature: Incyte ID No: 700612280H1
  unsure 57, 63, 151: a, t, c, g, or other
gagcatttcagaagcaatatgctatggtgcttgtgcagctaagagattctaatgatncaagtngctgcagctttgctttcgcttcgccaacgcaatacatatcatgggaattcagggcagtctaaatctatggaaaatggcatagcccttnctggagcaccagatccgtataaccttttcattatattaatccagagtctggttctcaagtgatcgaagttatcgagacttcaaagtccaggcaaaatgatggttgatgttgctatccaggctagtgcaaag

SEQ ID NO: 3807 - DNA, 280 bp, Zea mays
  misc_feature: Incyte ID No: 700612281H1
gataaaaaactatctaactccgaggcttttctgcgtagatcagagactcagcgaaaggctgagcaaaaggtccgcgaagaaagtgaaaggctgcgacagaaggaacgtgagcaaattgcagagaagcgtaaggcgcatatgacgcttcgcgctcgtgtagctgctaaggcggaagaaaagggttggagctgttgtacattcagtggactgagcaccataaaaggctgtccatttcttaaggttattttattctggtccaaaagtgtccatattgacaata

SEQ ID NO: 3808 - DNA, 278 bp, Zea mays
  misc_feature: Incyte ID No: 700612284H1
  unsure 15, 20, 26, 41, 52-53, 55, 70, 99, 104, 107, 111, 122, 152, 167, 192, 195,: a, t, c, g, or other
gaggcgctcagggantccancatgtntgggtacatgtcgtnccaagaagacnntngatattcaaccccgngaacgccatccatggaggagctccgcaancgtgncgncggntgacaagaacnacaagtccgttaaggaccttgtcatgctgntgttcgagacggcgntgctcacttctggctttagctgcgncgntcccaacacgtttggcagncgcntccaccgcatnntcaagctgggcctgagcntcgacgangacgnggnnntcccggagctna

SEQ ID NO: 3809 - DNA, 274 bp, Zea mays
  misc_feature: Incyte ID No: 700612285H1
  unsure 61, 73, 178, 205, 239, 253, 257: a, t, c, g, or other
gcattcaagactcccagtttgatatttgaattcgtcaacaacacagacttcaaagttttgnaccccacattgncggattatgacatccgctactacatatatgagctactcaaggcccttgattactgtcattctcaaggcatcatgcatcgagatgtcaagccccataatgaaatgntagatcatgagcttcgaaaacttcggntgatagactggggcttagctgagttctaccatcnaggcagggaatacntgtncgtgttgccacgaggta

SEQ ID NO: 3810 - DNA, 269 bp, Zea mays
  misc_feature: Incyte ID No: 700612287H1
  unsure 114, 117-118, 122, 266: a, t, c, g, or other
gataccgctataaaatattgagtgaactatcaaagtcattttgttatattactgaaggtaacctaggtaatcatatattgtggaccagatttcttatgtatacgattatacttnttnntctnatgtttattatactactattggtatgaatgtgagagttcaaatgaagaagatgaatactctccaaaggtgtgagcattttaagtcgccttgtccttttttttgacatccctaaactttattttgtatgatattctgatgttagnttt

SEQ ID NO: 3811 - DNA, 274 bp, Zea mays
  misc_feature: Incyte ID No: 700612288H1
  unsure 81: a, t, c, g, or other
ggccgtggaatgataaaaacactcgtttaatcacatgtgatcctcatgccagcaagcttgtggtaaactcagatactcctncaggaggttgaagccgggaaggaaatcatatttacctatgatgtaggcttcgaggagagtgatatcaagtgggcttctcgctgggacacctacttgttaatgatagatgatcaaattcactggttttctattgtgaactctctcatgatcgtactcttcttatctgggctggtggccatgattatgctccgca

SEQ ID NO: 3812 - DNA, 271 bp, Zea mays
  misc_feature: Incyte ID No: 700612289H1
gaatattcctagcttgagattgcaagaggtctccaagaggagggtaggggagccgagcgctcagctctaattttctccatctattgctaacagctctggccaatcatataaaaaaacgttggttacaagccaaatggcacttcctggtagctgctgattttctatcgacaagatcagagctcagacctcaggcaagggaggtacaatgccaagagcaaatgagatgttgagggcagttccagatgatggtggtctttggtgccttgtcatc

SEQ ID NO: 3813 - DNA, 275 bp, Zea mays
  misc_feature: Incyte ID No: 700612291H1
  unsure 201, 234, 242, 252, 257, 260, 267, 273-274: a, t, c, g, or other
agaagctgatttccagtgggtatgattataaagctgttagaagatggacaacaaaaaggaagttagggtacagtctaattgattgtgacaagatatttgttcccatacacaaggaagtccattggtgtttagcagtcatcaacatcagggaccaaaagtttcagtatctagatcacttggtggcatgggacatgaaggtcntggaatgtcttggcccagtatattgtggatganggccaagnccaaaattgnccacnagntggtgtngccctnnt

SEQ ID NO: 3814 - DNA, 273 bp, Zea mays
  misc_feature: Incyte ID No: 700612292H1
gagcatttcagaaagcaatatgctatggtgcttgtgcagctaagagattctaatgatcaagtggctgcagctttgctttcgcttcgccaacgcaatacatatcatgggaattcagggcagtctaaatctatggaaaatggcatagcccttgctggagcaccagatccgtataaccttttcagttatattaatccagagtctggttctcaagtgatcgaagttatcgagacttcaaagtccagggcaaaaatgatggttgatgttgctatccag

SEQ ID NO: 3815 - DNA, 105 bp, Zea mays
  misc_feature: Incyte ID No: 700612294H1
gttttgagttttgagatgtggctatgacaatgtgatgaagaaccctaaaccatcgtattagagtgaaacttgtttctatatagagttccaagtttcttgaacctc

SEQ ID NO: 3816 - DNA, 285 bp, Zea mays
  misc_feature: Incyte ID No: 700612296H1
  unsure 95, 126: a, t, c, g, or other
gctcaaccgcgtcctcgcacaacccgccgctgcccgcagaggatcccaaccttaccgcggccatgggcgacaaccctttcccgggcctgccacangcgccgccggtacgtggcacctccggaagtngcgagctccagcggcgcgggtgggtggtttgggggactgattggcaggaaggatgaagagaagaaatccagcgcgggcaagtcggagatcttggagagttcgacacgcccagcagtccgataccatcgttcgagtacaatgaggaaaagttggctgatg

SEQ ID NO: 3817 - DNA, 296 bp, Zea mays
  misc_feature: Incyte ID No: 700282203H1
  unsure 34, 48, 55, 62, 65-66, 90, 92, 100, 106, 129, 131, 141, 149, 237, 289: a, t, c, g, or other
gacaatgacaagagaagaaagcatggcaaagatncctcaaaagcaacngcattcncctttcnggnncccccaaggctcatccagttagtncngaatcacntcgagncccaagctgacatagagcaaacncnagctctcgtncgtaagcntgatgctgagaagggcattgatggcaatgtactgtcaagtggtgatcatgacaagtcagatgtagacaaatcacacataggatctatngggcctatagttataatcagaggtttaacgactgtcaaaggcctggaagcgntgagtcc

SEQ ID NO: 3818 - DNA, 311 bp, Zea mays
  misc_feature: Incyte ID No: 700282204H2
  unsure 14, 22, 68, 157, 170, 174, 183, 195, 226, 231, 269, 295: a, t, c, g, or other
ggaatcggcaagcnggtgttcngcggcggcgtggcggagatgtacagcctggaggagtgctgcgcgcntcggccgagacgctggggcgtggcgaggtaggcagcacgtacaaggcggtcatggagacggggttcatcgtgacggtgaagcggatgcncgacccgtcggcnggcngggtggggnccgccgagttcnggcggcgcgccgaggagctggggcgggtgcngcacnccaacgcatggcgctgcgggcctacttccaggccaganaggagcggctgctggtgtacgactanaacccaaacggaagcc

SEQ ID NO: 3819 - DNA, 310 bp, Zea mays
  misc_feature: Incyte ID No: 700282206H2
  unsure 7, 12, 50-51, 134, 138, 144, 150, 165, 258, 261: a, t, c, g, or other
tcccatnccacnaccacccatctcgtcgtccgccgattcgatccggttcnnccaacccaggggctgtgatggcgacgaagaggagcgtgggcaccctcggcgaggcggatctgaaggggaagaaggtgttcgtncgcnccgacntcaacntccctctcgacgacncccagaagatcaccgacgacacccgcatccgcgcctccgtccccaccatcaagttcctcctcgagaagggcgccaaggtcatcctcgccagcnacngggtcgtccaaaaggtgtcataccaaagtacagttgaagctcttgttcc

SEQ ID NO: 3820 - DNA, 308 bp, Zea mays
  misc_feature: Incyte ID No: 700282208H2
  unsure 307: a, t, c, g, or other
actacttgttggttggattctcttcagtctagcagctagtccagttaagtttcagacacacatggggagcattggcagaggcacggccaactgcgccaccgtgccgcagccgccgccgtcgacagggaagctcatcacgatcctgagcatcgatggcggcggcatccgcggccttatcccggcgaccatcattgcgtacctcgaggccaagctccaggagctggacggcccggacgctcggatcgccgactacttcgacgtgattgccgggacgagcaccggcgccctgctcgcgtcgatgctggcng

SEQ ID NO: 3821 - DNA, 294 bp, Zea mays
  misc_feature: Incyte ID No: 700282209H1
  unsure 21, 28, 87, 169, 188, 209, 243, 283: a, t, c, g, or other
gttaaagattgcctgcaaacngagagtnacaagtttctatgtaaatctgtatcattcggcagcaacccttgtgctttccctgatacngctgtaaacgatgacgacaaagcaacgccagaataagaaagttcatcagggaaagttaaagattgcctgcaaactgagagtnacaagtttctatgtaaatnctgtatcattcggcagcaacncttgtgcttctaaattccaagaaaatcgcctatnaccataccatgccctcatgcacgaacaatccctgataccngaccctggaga

SEQ ID NO: 3822 - DNA, 311 bp, Zea mays
  misc_feature: Incyte ID No: 700282210H2
  unsure 21, 52, 73: a, t, c, g, or other
cggctcccaccagcgtgagtnccgtgaccagccccaatgccctccaaacccnagtccacagctcctgtacccnggcggccatgccggatctgagcaccagctacctccctcccttccctgaactgtccctcgatgcgggggccctcgccgtcgaccacgcggggaatgctgcagccgccgcctcggccgatgcggcgtccgcgtacgcgtcttcgtctgcctctgtgggcagcggcgtagacgacctcgttattccagcggaatgccggtggaagggccatgtccgcaccttcgacatggcgggcgcgggc

SEQ ID NO: 3823 - DNA, 295 bp, Zea mays
  misc_feature: Incyte ID No: 700282212H2
  unsure 8, 24, 33, 138, 192, 207-228, 232: a, t, c, g, or other
gagaaacnccgccgcccgctcgcnccgtgcacngctcctccgccttagcccgtagccacagatcttggcgcaccagcctccatcgagtctggttagctagggatgtcaatctcgatccgcgacgccggcggtgcagtngcgagatagggacggcggacgggactctaccaccgttctgtttcagtttaaatnggacacatagatgcnnnnnnnnnnnnnnnnnnnnnntacnactcgggagcagcaagagttacaacttgatttggattcaacattgacagcagaggcggagggg

SEQ ID NO: 3824 - DNA, 270 bp, Zea mays
  misc_feature: Incyte ID No: 700282215H2
attcaaacagctgatagaattattgtgatggaaaatggtaatattgtggaggatggtaaacacattgatcttattgagaagggtggtctatattcaagattagccaggcgacaaaatgacgatctcaagtagccctggatcacagaatgtggtttagtgcacgccttctttttaaatggaatggcagaagggagagtcgtctgtcatagtgtattctttgcaagaactgacctggacccaggagctcgaataagctggcatgtttttccc

SEQ ID NO: 3825 - DNA, 309 bp, Zea mays
  misc_feature: Incyte ID No: 700282218H2
  unsure 8-10, 12, 14-15, 18, 20, 29, 54, 74, 92, 97, 113, 125, 128, 186, 188,: a, t, c, g, or other
ccgcctcnnncngnnccnancgcagctcnccctcaggtttagtgttcgcaatgncggccttcaacaagcttggnggccttctaaggcacagngctcnggtgagcggtatcacnggtggctcttcnccngcagtgttcaatgctgcacggctcatgtctaccaagctatttattggtggtcttgacncngggtgttgatgacgtgaaannagagaagcatttagcagctttggagaggttatgaagcgagggtgatcacagacagggagactgggagtccagaggctttggcttgtggacnaatccgacc

SEQ ID NO: 3826 - DNA, 304 bp, Zea mays
  misc_feature: Incyte ID No: 700282219H2
  unsure 150: a, t, c, g, or other
gagcatgtctaaggtggcagtgtcattcacacacataattaaaagcgcagaacctgcattcagtgttttggtgtcaaggttcttccttggggagacgtttccaattccagtatatctttctcttcttccaatcattggtggttgtgctcnagctgctgtcacagagctgaactttaatatggttggatttatgggtgccatgatatccaaccttgcatttgttttccgcaacatcttctcgaagaggggcatgaaggggaagtccgtcagtggcatgaatactacgctgcctgtcaatatgtcc

SEQ ID NO: 3827 - DNA, 309 bp, Zea mays
  misc_feature: Incyte ID No: 700282221H2
  unsure 37, 205, 294: a, t, c, g, or other
ctctcggcgatgtctggccgcggcaaggggcgggaanggtctgggcaagggcggcgccaagcgccaccgcaaggtgctgcgtgacaacatccagggcatcaccaagccggcgatccgcagttggcgaggaggggcggcgtcaagcgcatctccgggctcatctacgaggagacccgcggcgtgctcaagatcttcctcgagaacntcatccgcgacgccgtcacctcacaccgagcacgcccgccgcaagactgtgaccgccatggacgttgtctacgctctcaagcgccaggnccgcaccctctacgg

SEQ ID NO: 3828 - DNA, 280 bp, Zea mays
  misc_feature: Incyte ID No: 700282222H2
  unsure 121, 145, 159, 224, 270, 277: a, t, c, g, or other
ctgccctctaataacagcagcagcagccgccatggaaggcagcagcaagaagctccagccgttcctcctcacgctgctgttggtgtctccaccgccgtgacgcccatctctcgtgtcagtnccagacgacgagtagcctgcgacngcgacaaacccaangcgccaagccgtcgcacccgcccaagaccaagccctccacccgtcgcgtcgccgaagccaagaanccaagcaccagggcacaccggtaccagcgcgggcacaacgccaaancctctanccc

SEQ ID NO: 3829 - DNA, 301 bp, Zea mays
  misc_feature: Incyte ID No: 700282223H2
  unsure 56, 159: a, t, c, g, or other
gcgtcggtgtctgggcggtacccttggaagttgagcaaaaatttgtcccggagacntctccaggagtcgatggacaatgggggcaacctggtgtaccaggtgagggctggtccttcgagggcaatgatgaatgacttggccattgtggcgtcgtccccnccggatgatgcaacggcgacttgatagctcatgatgtactgtgcagggtcagtgctgccgttgtacttgggataggtacctgccctgaagttggcgggccatggtgttacttgcagatgaggtgccagggacttcgctcgtc

SEQ ID NO: 3830 - DNA, 306 bp, Zea mays
  misc_feature: Incyte ID No: 700282226H2
  unsure 53, 88, 117, 138, 189, 301: a, t, c, g, or other
aaaagaaagaggagatggaacaatttgaggttgagcttaaagcaatgcgtgangctgcggaatggagacgaatacaaggtgtatcacnccgcaggtgatgatgaacttttagcaggnccaaaagagtcacagagaccnacgagagatgaatggatgaccacattgccacctgagagaaaagcaggagtnccaatgcattcaactacatcatttagtatgaatggtaaagaaggacgtggagacacaagtgtctggactgtacccctcttgatagagcacaaaaagcacaacaaagctatcnagaag

SEQ ID NO: 3831 - DNA, 150 bp, Zea mays
  misc_feature: Incyte ID No: 700282230H1
  unsure 6, 20, 33, 47, 49, 58-59, 62, 74, 120: a, t, c, g, or other
gttggnggctcgtttatttnccgcgtcccggangagggttttgtggncntctgtcgtnngcnccatggccagcngctctgatgccccgaagcagtatggaataaccaagccgttgtcgtngctcggaccggtggaggccgacctccagag

SEQ ID NO: 3832 - DNA, 302 bp, Zea mays
  misc_feature: Incyte ID No: 700282231H2
  unsure 14, 21-22, 26, 33, 64, 85, 106, 120, 172, 184, 214, 286: a, t, c, g, or other
agcgactcgtttcncgtctcnncgcngcgagcnaggctcctgctcctcgcggtctcgcttcccncccaagttccaatccagcacngggcgccaccgctaatcagtnctgatatatgaacnccgcatttggacatttggtggtggcaaggcaacgccaaccttccctgttgcngctttgaatgtnctggtggttgtcggatggatcgccgcagtnggctctggaagcgcaagtcattggataagagccctggggagagcgatagctctggctctgcttcatcacacnctgagccttccttcga

SEQ ID NO: 3833 - DNA, 304 bp, Zea mays
  misc_feature: Incyte ID No: 700282232H2
gggcttggcagggcgccgcgaaggcgcaaactttttctagtaatatataatatctcaatcaaatatcacgtttaagatcatgtttggtcaaaccttgacttaaagaaaaaagagaattcaagcttattttatatcgcacgcatggactaagaaaactattaaagatggctactctatcacatcctttatactatttaaacacactatatataatgcatgcatgcaaagaataaaaatgaaataattattatgagtatgtatatccacacaaatactatatctaacgcatggatgcaaagaataa

SEQ ID NO: 3834 - DNA, 303 bp, Zea mays
  misc_feature: Incyte ID No: 700282233H2
agcagaaataccaaaggttgccaggagttgaagatgacctgtgcaaattgcttccatatgtcagtcgtcgtcgtcagacacctgaactttgtcgattgcttgggttgtcacagaaaatgccaggtgtcattgaagttctggtgaaaagtggaagaactattgatgcaattaatttagcttacgtgtttgagcttactgaacagtttgaaccagtgcaatgcttaaagcatatctgagggatgttaagaaactgtcacatgccaggaatgtcaaaatttctctggagcacagaatgagatgatg

SEQ ID NO: 3835 - DNA, 307 bp, Zea mays
  misc_feature: Incyte ID No: 700282234H2
  unsure 38, 84, 86, 93, 96, 102: a, t, c, g, or other
gccggcagccgacgtggaagccggtctccttgcccacntcaactcagcgggagaggtccccgacttcacgctctttcgcttccncnctcggcntcncccacntcgaacttgagggcgtcatcaagagcctctcagctttccgcatcgtcgacagcacagacatcatcaaggagacatgggtgctcaccgaggaggccaagggctacgccgccaagggctcccccgaggcacagctcgtcgccgcaatttcaccggagggtgcctctaaggacgcactcaaggcaatattgggagatgctttcgatgt

SEQ ID NO: 3836 - DNA, 305 bp, Zea mays
  misc_feature: Incyte ID No: 700282235H2
  unsure 7, 13, 31, 40, 43, 55, 78, 82, 90, 94, 104, 123, 155, 179, 199, 236, 249,: a, t, c, g, or other
cccagcngctgtnccccttatccagcgaatncttgaagcnacnggtgatgtagtnacggttcaatattatgagagacnatcncctttggncccncctgaaatcncccacttgggtctttctcnaacatcaaggcaggagattgtttagtaacatnctcaagacgtggaatttataaacncaagaaaagaattgaaaggnagggaaaacatctttgctctgtggtctatggttcatngccaccagaaacnccgaacanaacaggcgacaatgttcaatgatganaccngtgaccttaatgtgctag

SEQ ID NO: 3837 - DNA, 302 bp, Zea mays
  misc_feature: Incyte ID No: 700282236H2
  unsure 49, 64, 74, 134, 171, 180, 225-226, 269: a, t, c, g, or other
gcgcgtgatcggagaagtgttcagcgcgtctaagtccaggatccccgtnggggttgtgaacatnacccagctcncccgagtacaggaaggacgcgcacacccagatatacaagaagcagtggaacccgctgacnccggagcaggtcgcggaccctaagagctacgcggacngcacgcacnggtgcctgccggggctccaggacacgtggaacgagctgctctacnnccaagctctttttcccctgagttaaaggtttgagttgcgaggngcacggtgaagttggggtctctctctggcatgg

SEQ ID NO: 3838 - DNA, 296 bp, Zea mays
  misc_feature: Incyte ID No: 700282237H2
  unsure 58, 64: a, t, c, g, or other
cacaaagttgggtttctttttgcaccaatcgtatgcatttggcttgtctgcataagtncgattngcctctacaatatcatccgttgggatccccatgtttatcgagccctctcgccatactacatgtatcaattcctcaggaagactcaaactggtggctggatgtcactgggtggaatccttctttgtgtaacaggctctgaagctatgtatgcagatcttggacatttttcgcaatcatcaatccagattgcatttatatccgtggtttatcctgcacttgtatggctatatgg

SEQ ID NO: 3839 - DNA, 120 bp, Zea mays
  misc_feature: Incyte ID No: 700282240H1
  unsure 8, 19, 22, 31, 38, 105, 119: a, t, c, g, or other
gccaacanagatggtcacnccngataaaacngtcaccntcaatgggaggatgctcaggttttgagaccgaacctatatgtaaccaccaaaacaatattcctaatnggcaaggaaggtgna

SEQ ID NO: 3840 - DNA, 299 bp, Zea mays
  misc_feature: Incyte ID No: 700282242H2
  unsure 15, 86, 168: a, t, c, g, or other
ccacgaagcctcacnagggtttagcggcggcggcgagatggtgcagcgcctcacgtaccggaagcgtcacagctacgctacgaagnccaaccagacccgagtcgtcaagaccccaggcgggaagcttgtgtaccagtacaccaagaagagggcgagcgggcccaagtnccccgtcaccgggaagaaaatccaggggatccctcacttgaggcctgctgagtacaaaaggtccaggttgcctaggagccgcaggactgtgaaccgtccttatggtggagtactctctggaattgctgtta

SEQ ID NO: 3841 - DNA, 297 bp, Zea mays
  misc_feature: Incyte ID No: 700282243H2
  unsure 46, 70, 81, 83, 101, 107-108, 128, 134, 145, 195-196, 259, 281, 283: a, t, c, g, or other
ggcatgatcagcgccgtgcccgggatgaaggcgctcgacatgaacnccgccgaggacgagatcgtgcgcntcacgcgcgangnccgtgcccggcatgatcntcaccnngatggaggtcgccgagatcnacggcnccccgaggatnggcccgacgttcggcgccatgatgatctccggccagaaggcggcgcaccnngcgctgaaggcactgggcaggcccaacgccgtggacgggaccatccccgaggtgtcgccggcnctgcgcgaggagttcgtgattncntccaaggacgacga

SEQ ID NO: 3842 - DNA, 296 bp, Zea mays
  misc_feature: Incyte ID No: 700282244H2
  unsure 35, 67-68, 140, 168, 224, 233-234, 278: a, t, c, g, or other
gtttcttggaaagatccttgtggagaagatactcncgggtgcagcctgacgtgcgcaagatttaccnncttgtacgcgcggtcgacgagccatcagcgaacagcgcgtccaacaagaggtgatagacacggagctgttcngcctgctgagagagaaacacggcaaggncttccagcagttcgtagaggccaaggtcgtcgctttggccggagacatcgtatacnacggcctgnngctggaggcagccgtgctggacgcgctggccaaggacgtcgacntcatcgtcaacatcgcag

SEQ ID NO: 3843 - DNA, 296 bp, Zea mays
  misc_feature: Incyte ID No: 700282247H2
  unsure 9, 19-20, 70, 92-93, 98, 131, 143, 156, 179, 183, 191, 197, 220, 224, 232,: a, t, c, g, or other
ccgcccacngcccgccacnngattttagctaccgcccgtaccggcagctccagcaagagtagcaagagtnccactcacacacacgtcacacnncgtantgcgcaaggctccgaccttgatgcgcgtacccnccacggtccatngcctccgccgtcnccagtaacctccccgtcgccacnccanccgccgtnccggtnccttacgggaggctcagcccgcncgtntcattcanccgcgacncgcccaccnacctagtggatcccgtcgccatngcatngccacnccgnancccgcga

SEQ ID NO: 3844 - DNA, 296 bp, Zea mays
  misc_feature: Incyte ID No: 700282248H2
  unsure 31, 38, 160, 276: a, t, c, g, or other
gaaagttagctaggtttcagcctctcgcacngctcgtncctcgagcacaacggtggcggcgacgggcagcgggactgttctggccgacgaacggcatcgacgacgacgaggagtgttaaaacagctcgttgttttgggattgctgcctcaagtttcatcnagctacctccaacaaacccttcaatctccatggctacatcggacaagaaaacaaggggctatgtttccttggaatgatgagatggataaggtatccttgatacattgtggactatnacaataaaagtgatagatgg

SEQ ID NO: 3845 - DNA, 217 bp, Zea mays
  misc_feature: Incyte ID No: 700282249H2
  unsure 12, 27-28, 37, 45, 53, 67, 73, 123, 126, 132, 148, 160, 167, 181, 183: a, t, c, g, or other
aaatggtcgatnaccggcgacataacnnaccggaggnccgccacncgctcacnaggaggagcaagcnggaacncccggcatacggttcggtggtcctcggcggcacttttgaccgcctccacnacngccacngccgccttctcaaggntccgcggatttngggaganaccggatcgtggtngncgtctgcacgggactatgctcgccaagaaggata

SEQ ID NO: 3846 - DNA, 219 bp, Zea mays
  misc_feature: Incyte ID No: 700282250H2
  unsure 9, 14-15, 52, 73, 99, 106, 147, 156, 166, 216: a, t, c, g, or other
cttgatgtnccatnnagtaaacttggagacgagtctgcggaattatgaaccntcggatgtaccttttgatatntcatctgtttcgaaggaaacaaaatncccaacncccttgcggagaaaaagtctacaggcaagaaatcagcaggnccagcatcngctgtcagtngctctgtttctacagttgatgcttcgtatgagaagcttctttcgtccatnccg

SEQ ID NO: 3847 - DNA, 236 bp, Zea mays
  misc_feature: Incyte ID No: 700282252H2
  unsure 4, 60, 62, 77, 205, 231-232: a, t, c, g, or other
gccngctcatgcaggggctatgggccagaatcggttgaagaaaagcatagactttatacncntctaagaggtttaanttttaacggagagtctgcacccacatcaatgtctgagccttacacaccaacggctcagagctttggtggtgggaaccctgtggaggggtttattcacctgaacttagaggggaacttggtgctggacntctagaccttcacgctatgatgatanngagc

SEQ ID NO: 3848 - DNA, 305 bp, Zea mays
  misc_feature: Incyte ID No: 700282253H2
  unsure 25, 40, 44, 55, 96-98, 131, 135, 142, 168, 177, 189, 198, 216, 220, 222,: a, t, c, g, or other
tctcactctccgctggtcgctcacnccttgcagctccacnctgncactgcagtantagtctcttattagctctaggctctagctagccgcgccacnnncttcgtgtagccatcagccttctcatcgccacnaatngccactnccgaggtccagaccccgaccgtcgtngcggccgangaagcgcccgtngtggagacnccgccgccggccgtcgtncccnangantctncccccgccgaggccgaggccgaggccgaggctgctgctcctgctgatcccgangaacttcccgcngccnancaaca

SEQ ID NO: 3849 - DNA, 316 bp, Zea mays
  misc_feature: Incyte ID No: 700282254H2
gttctacgtccgagtcgtcgcatcaggtcccctcgattcgccggcgggccaccaaccaagctcatacatctgaattgactagtcaaactcagtgatctctttggggactaatcaaactcaagaactaagtttcatgtctgatctcgacgtccagcttccatctgcttttgatccgtttgcagaggcaaatgctgaggattccagtgctggtgctggatcaaaggactatgtgcacgtgcgtattcagcagcgcaacggaaggaagagtctgacaactgttcagggcttgaagaaagagtacagtacaacaagatct

SEQ ID NO: 3850 - DNA, 316 bp, Zea mays
  misc_feature: Incyte ID No: 700282257H2
  unsure 8-9, 20, 241, 263, 265, 305: a, t, c, g, or other
ccgcaacnnccgccgccacncccacgctcgcagccatgccgcccaagctcgacccgtcgcaggtggtggaggtgttcgtccgtgtgaccggcggcgaggtcggcgcaggtcttcgctggcccccaagatcggcccgctcggtctttcccccaagaagatcggagaggacatcgccaaggagacggccaaggactggaagggcctccgcgtcaccgtcaagctcaccgtccagaaccggcangccaaggtctccgtcgtccccnangccgcggcgctcgtcatcaaggcgtcaaggagccagaganggacgcaagaa

SEQ ID NO: 3851 - DNA, 259 bp, Zea mays
  misc_feature: Incyte ID No: 700282258H2
  unsure 145, 165, 190: a, t, c, g, or other
cttgaagcaatacgggcacaactgatatggagttttgaggaaaaaggtttcctatgtatggatttagcaacggtggtcttctattattttgttctatagtatctttggtaggcaagtttaatcatcattccacaaatttttttcngttgatgatgcaggtcagcngcctggtgtcaccgctcctattccnggggtggggtgcttccaaacttgtataatttggctgcaggacagccacaagccatgacacaacaggcta

SEQ ID NO: 3852 - DNA, 315 bp, Zea mays
  misc_feature: Incyte ID No: 700282259H2
  unsure 7, 51, 63, 107, 191, 205: a, t, c, g, or other
cacaacncacaagacccacacacccgtcggtaaatgcaaagatcgcaagtnccacggcccacnccccaaatcggccaatcttccacttcttaagctccctgtcgccnccgcctcctcgtcgtccggcctcccgcgccaccaccggggcctcgccgccacgaatggagtacgagcgcatccacgagccactnccgcgccgtcagtncggcggattctccccagctaagctgcgagcgatgcttcgcgggctagagaaacaccagcgcaacagcggcgaggacagtcgccggagggcaacgactccggcgagtcgac

SEQ ID NO: 3853 - DNA, 319 bp, Zea mays
  misc_feature: Incyte ID No: 700282260H2
  unsure 33, 64, 204, 217, 250: a, t, c, g, or other
cagctaataaggtaataaggggcgacgaaaatngctccaacgaccgccaccaaggacgacagtngctacggcgacgagcgccggcgcgagctgcaggcgttcgacgacacgaagctgggggtgaaaggcctggtggactccggcgtcaagtccatcccgtccatcttccaccacccgccggaagccctgagcgacataatttcncccggcgcctctnccgccgtcgtcgtcgccctccgccgccgccatnccggtggtggacctctcggtgacgcgccgcgaggacctagtcgagcaggtgaggcagcggccgggacgg

SEQ ID NO: 3854 - DNA, 214 bp, Zea mays
  misc_feature: Incyte ID No: 700282261H2
  unsure 7, 16, 18, 21, 23-24, 37, 199: a, t, c, g, or other
tctcgcnccaagcacncnacnanngccacagtgcacntcactctacagcaacgacagaaaagtgagcagcagcatcagctgctgccatggaggcgtggagatctctcctcgcgagcttcgtgctcgccgtgctggccgcgcaggccttggtggccgtggtcgagtccaggaccggccccgtggagcaggcgagccaagnttgacgacgtgaaga

SEQ ID NO: 3855 - DNA, 249 bp, Zea mays
  misc_feature: Incyte ID No: 700282262H2
  unsure 28, 58, 111, 142-143, 145, 148, 171, 226: a, t, c, g, or other
gtattttgaagagatcagtcaggatacngggaaatatgtctttggtgttgatgacacnctgaaggctcttgaaatgggtgctgtcgagaccctgattgtgtgggaaaatcnggatatcaacagatatgtgatcaagaacagnncnacnggggaaattattataaaacatcngaacaaagagcaggaagctgaccagagcaatttccgtgacccatctaccaatacngatctcgaagttcaggaaaaaat

SEQ ID NO: 3856 - DNA, 211 bp, Zea mays
  misc_feature: Incyte ID No: 700282265H2
  unsure 41, 60, 99, 116, 118, 135, 154: a, t, c, g, or other
aggaaggcccagaccggtgcgcggcctgcaggaagcgtgtngggctgacgggatttagcngccgatgcgggaacatgtactgttcggtgcaccgctacncccgacaaacatgactntnagttcgactatcggacngcagcaagggacgcgattnccaaggccaatcctgtggtgagggcggagaagctcgacaagatctgaggcgggcatt

SEQ ID NO: 3857 - DNA, 219 bp, Zea mays
  misc_feature: Incyte ID No: 700282266H2
  unsure 7, 24, 30-31, 47, 97, 100, 131, 145: a, t, c, g, or other
gctatcngacacctgaacggagtnccagtnncctctatcggcctganggcattgggttcttgatgggagacagcaggaagcacgaaccgtgggttanccnccaaccggatggctggctgcgcaagcctgcnttgggattgaacancctgatgcagattcccgataagattcagagctctcttaaggtgcaatttgggcgttcttgaacaaggatggtgc

SEQ ID NO: 3858 - DNA, 313 bp, Zea mays
  misc_feature: Incyte ID No: 700282267H2
  unsure 15, 38, 51, 108, 197, 238, 282: a, t, c, g, or other
aacaaattgattttnctaagatccatgctattgatgcnacagttagcagtncacaaggtcctgtgattagaaatgacaatcaagttcataaggcatcaactgtacatnggtcaagtgagagacaaggcatgaatggtcggcaaattacacaagtttccaatacagaacgagatgatgaagcaagaagtatttttccngaatcctcctcaggatacacatcataacatggatttgatcnggcagcaggcagacaccagtgggatctctgatgacaaaaatatnatggtttgctcgtggagagcaccaaaaaggg

SEQ ID NO: 3859 - DNA, 312 bp, Zea mays
  misc_feature: Incyte ID No: 700282268H2
  unsure 27, 97, 202: a, t, c, g, or other
atggcctgtacttagatggtcaacacngcgaactgggcaagcttttctcctacatgagaaaatcaggtatgatccctgatagctttacctatacacnactgatacgagggcagtgcatgcttggctatgtcttgaatgccatgatgctctatgctgatatgatgaagattggtgttaaaccaacaaggtacaagatagaatnccctgagatctggtcatgggcaccactgaatgacctccaaactgttgtaagttaagaaatggattttgactacatacttcagatttctagagcaaaagccagttcacagg

SEQ ID NO: 3860 - DNA, 317 bp, Zea mays
  misc_feature: Incyte ID No: 700282269H2
  unsure 23-24, 152, 188, 237: a, t, c, g, or other
cgactttcctctagaattcgatnnccctttcccaagaaaccaagaacccagccccccaccatgacgagctcctcctctcctttccagaaaggcgctgagcaagatcgcttgcaatcggctgcagaaagagctcgccgagtggcagcaaaacncccccgccgggttcaagcacaaggtctccgataacntcccaaaggtgggtaattgaggtcaccggagcggcgggcaccctttacnaccggcgaggcttaccagttgcaggttgacttccctgagcattatcctatggaggcactcaggtcattttctcaatccag

SEQ ID NO: 3861 - DNA, 308 bp, Zea mays
  misc_feature: Incyte ID No: 700282271H2
  unsure 6, 189, 251: a, t, c, g, or other
caagtncccagaagcactgaggcagttccttagcatcttacataccattccagttatcgtggtggactcacggagagaagttgatgaggtgaaggagttaatcgagatagtgagggagtatgtccttggtctgaggatggaactcaagagaaaggaactgagggatgatgtgacccgtcaacaggagtnggctgcttacttcacaaactgcaagcttcagagagttcacatgaggcttgtgctcgctagtnccatggctctttgcttcaagcagaaaaactatgcaatgcggcacatttgctaggatg

SEQ ID NO: 3862 - DNA, 309 bp, Zea mays
  misc_feature: Incyte ID No: 700282272H2
  unsure 84: a, t, c, g, or other
ctgataaccttcctagataatctcaactaatctcctaaataatctcaactaatcttctaatcttatctctaactatccttatcnaatcccccttagggcccatggctgctgctaccgcagcccctctgtgggcctccttaggtcctgacagtcgttttattctataggtgtttggttatcattcaacatttcttattgcaggtgaaggctgcagataatagagtgatacaagatcagctgaatgagaagttactcatctcaaagaacagctgtcccaagctcttgaagctaaggattggtgtcaaatag

SEQ ID NO: 3863 - DNA, 229 bp, Zea mays
  misc_feature: Incyte ID No: 700282273H2
  unsure 28, 35, 44, 60, 111, 189, 215: a, t, c, g, or other
caccgagttccccccgcgcgatttaacncctcgcntcgctcgcngcctccggttccctanaacgcgcacaccaaacgcgcacgcggcgttcgttcctcggccgctctcccnacccacgtccttctccccccacagatctccgcgggccgtgaagttccttgattcgccttctccggggctgccggatcnccgcgggcggctggggatgggcaatngtgcgtaacacgaa

SEQ ID NO: 3864 - DNA, 183 bp, Zea mays
  misc_feature: Incyte ID No: 700282274H2
  unsure 34: a, t, c, g, or other
gtaacgcggagtgctgagacgtcaattataaaangatccaacatacatcagatgccggcaggcagccacttctgatgtatgttggatcattttatacttgccttcgtactgtaacgcggagtgctgagacgtcaattaattttggccgtggtttacatggcctaatatgttatgagcaacaaa

SEQ ID NO: 3865 - DNA, 312 bp, Zea mays
  misc_feature: Incyte ID No: 700282275H2
  unsure 4, 14: a, t, c, g, or other
gatngccggagatntcgtccatggccacgaagctcttcaacaccgccgaggtggagtcgtcggacgcgcaagccctagtcgcggacatgcggaaggctatcggcaccatgaagtccctcgccgtagacttcgagagggacggcaagtctgacaaggtgaagaagcttgaggagacggttctggagttggtggcttcgtacgaggactgcgcggccatggcccaggcaattaaggcagtacctggagtgtatcagtcatctgatcagccaacggatttcaaaacattgatcggggtggacgtagcaagattag

SEQ ID NO: 3866 - DNA, 292 bp, Zea mays
  misc_feature: Incyte ID No: 700282277H1
  unsure 67: a, t, c, g, or other
gagacattcaccatcatggagctttcggtgggacaatcgcacacatatagaagacataatggaaatncctacttctgttttccaaccatagtagtggaagcattcggcctgatacaaagagtggttccattgccccgaccgaaggttttctaatggaaatagccttggaactagcccttccaatgtgtctcatggaacaaagtggcacaaatctgacaaaaaaatggaagcatctaaggttacaatggctgatcctcgagctgaccatccatgcaataatcttcccttgagg

SEQ ID NO: 3867 - DNA, 313 bp, Zea mays
  misc_feature: Incyte ID No: 700282279H2
  unsure 256: a, t, c, g, or other
cagaaatacattagaaaaaagagccaaagaggagaacaccggccggcgaggtggacgaagcggcccgccgaggaaatgggcgtcgatgcagagctggcgcaaggcctacggcgccatcaaggacaccaccaccgttagcctcgccaatctcaactcccgacttcaaggatctggatgtggcgatcgtgaaggcgactaaccacgtggagtgcccgcctaaggagcgacacctgcgcaggttgttgcggcgacgtcnatcaccaggcctcgggcagatgtcgctactgcatccacgcgttgcccgccgtcttgc

SEQ ID NO: 3868 - DNA, 235 bp, Zea mays
  misc_feature: Incyte ID No: 700282280H2
  unsure 24, 33, 89: a, t, c, g, or other
ggagcagcgagatcgtgcgcaccnccgagatcnccacgaattgtggtaacatggggtcaccttcacgaagctcttcagccggctcttcntccaagaaagagatgaggatccttatggttggtctcgatgcagctggtaagaccaccatcctctacaagctcaagctcggagaaatcgtggaccaccatccctaacaatcggggttaatgtggagactgttgaatacaagaacatt

SEQ ID NO: 3869 - DNA, 307 bp, Zea mays
  misc_feature: Incyte ID No: 700282282H2
  unsure 284: a, t, c, g, or other
tattgtacgagcgctcgtatgatgctcgcaaggctcttcagaaaaatggtatgcaactaagcaacagtctgatagttggagtaaagcctattgatgcagtgcaccggcagcagctggacaagggtttcactcaaagcaatcaaggtggatttatggtttccttgccttcaaagtcactgggcttgaagagcgcaggtgcatcaaaccagttaggagccttgccccgcccatatgacccgaaagctaacacgaatgtcagccgagatgctggccgtcgtgcaatngcagcgttgctgcaccaacaaaa

SEQ ID NO: 3870 - DNA, 307 bp, Zea mays
  misc_feature: Incyte ID No: 700282283H2
  unsure 37, 85, 100, 143, 161: a, t, c, g, or other
ggcgccgcaagatgaggtcgccgaggatgcggatgtngcggcgaaggacgcgtcgctgccgtcccatgaggtgaaggcttcaacnccgccgccggctgtngcggctgcggatgaggcggtcacagacgctagccccgtcgacnagctcagggatttgactnagcaaaaggtgttagagaagcaagccgcaccatcactctccccagtcaaatgttctcctattgtggcagcagttgtttccccacatgattcagtgaagtgttctccagttgtggcaggaggtgtttcagctctggattcagaactc

SEQ ID NO: 3871 - DNA, 305 bp, Zea mays
  misc_feature: Incyte ID No: 700282284H2
  unsure 7, 47, 58, 78, 97, 108, 114, 118, 123, 138, 141, 147, 162, 169-171, 177,: a, t, c, g, or other
gagcatnaccggcaccaatcaatcaggctggcagtggagtgacagcngcggcaacacnacgcccacgcggcgccgganccgatcccccgatggatcncccgccgctcncccacnaggncctcntcgccgccgtccganccnccgacncgcccgccgtccgcncggtccnnnccgacnccgaggcgtcggccacnnccttggccgcgctcncngccgctcagacngacnccggggaaaccncgctgtacgttnccgcggagnccggcagcgaggaagtcgtncncctcctcctccctctcnacgat

SEQ ID NO: 3872 - DNA, 306 bp, Zea mays
  misc_feature: Incyte ID No: 700282285H2
  unsure 37, 85, 101, 144: a, t, c, g, or other
ggcgccgcaagatgaggtcgccgaggatgcggatgtngcggcgaaggacgcgtcgctgccgtcccatgaggtgaaggcttcaacncccgccgccggctgtngcggctgcggatgaggcggtcacagacgctagccccgtcgacnagctcagggatttgactgagcaaaaggtgttagagaagcaagccgcaccatcacttctccccagtcaaatgttctcctattgtggcagcagttgtttccccacatgattcagtgaagtgttctccagttgtggcaggaggtgtttcagctctggattcagaa

SEQ ID NO: 3873 - DNA, 305 bp, Zea mays
  misc_feature: Incyte ID No: 700282286H2
  unsure 2, 21, 44, 55, 57, 82, 88, 119, 131, 135, 154, 163, 180, 200, 263, 270: a, t, c, g, or other
gnccgattctctgcgtgactnggggcgtcgtcgccgagttttcnccggccgaggncngcgcgaccggacaaccagcgtgagncgaccngcgacatgactcgcggcaaccagcgtgaccncgaccgtgagcncgcngcggcgcggaagcccaacnccaagaacncccaggacgggctcacnccggagcagcgccgcgaganggacaagaaagctctggaggagaaggcggccaagaaggcgcacaggcagcggccggcggcacnggtaccnaccacggacaacaacaagaacaaggcaggtggcaa

SEQ ID NO: 3874 - DNA, 95 bp, Zea mays
  misc_feature: Incyte ID No: 700282287H2
  unsure 9, 12, 26, 30, 37, 47, 61, 73, 86, 90, 93: a, t, c, g, or other
ccactttcnccntctcatcgagtcanaaanccaaacnctaattcacnggccgccggagatnggacaaggttcnacccggcgggatncggnaanca

SEQ ID NO: 3875 - DNA, 249 bp, Zea mays
  misc_feature: Incyte ID No: 700282290H2
  unsure 13, 78, 120: a, t, c, g, or other
cttgtatcgtacncccagctctcaaactgggacaagtgctcctcatgggagggttcaaggtgtcaccattcaccgcangagcgaggacattcagcttcgatgcaaatccatgcgattacntccagggtggcaagattaaagcaacgaccctctccctgtcagtcttggtggccattgagatgttcaactcatgaatgccctgtcagaggacggcagccttgtgagcatgccaccatgggttaatccgtg

SEQ ID NO: 3876 - DNA, 303 bp, Zea mays
  misc_feature: Incyte ID No: 700282291H2
  unsure 44, 85, 97, 113-114, 131, 181, 212-213, 255: a, t, c, g, or other
caggcgcaacaaggcactgaggaggatgtgtttcagtgcaaggngtgctgtgagcagcacgcagtgtgtgctcacatcagatgcnggcccagacacncttgtcgtccgaacannctttcggaggaattatnctgatcctaatgaagtcgctgccgtcattttgggtggtggtaccgggaancagctttccctctcacaagcacaaggggcanncctgctgttcctattggaggatgttacaggcttattgatatncccatgagcaactgtttcaacagtgggcataaacaagatattgttatg

SEQ ID NO: 3877 - DNA, 195 bp, Zea mays
  misc_feature: Incyte ID No: 700282293H2
  unsure 8, 87, 101, 113, 132, 142, 147, 182: a, t, c, g, or other
gcaacacnatgatctcatcattggaatggattggctttggcttatagccctattacagtgcattgggctaacacgtggttgacaccntccaaagggcatanatatgtcgtgcnttatgggatccagacttcngctgataatnggccnttggtccactttgcagcatgtcgacttgacagacnaagatcagttggg

SEQ ID NO: 3878 - DNA, 303 bp, Zea mays
  misc_feature: Incyte ID No: 700282294H2
  unsure 62, 156, 201, 236: a, t, c, g, or other
atgagctgaatgtgttgggtatcggggccctaaggcggatgaactgtgttatgcactccatncctacctcgtgccttgaggctggtggcactgttcccagccagctggacagcatccttgctcgctctactgatgagtcattggcagcattccttntccaagtcatctgttgtggaccggtctatgcgtttcagcagctcnagattctccgacatctcaatgagcagcagccgcangattggagacacggcatcgggagacaatgatgagtgcaaggagaggccattgattctccggaacaag

SEQ ID NO: 3879 - DNA, 165 bp, Zea mays
  misc_feature: Incyte ID No: 700282295H2
  unsure 103, 116: a, t, c, g, or other
cgttcgatggcccgtttggagtcatcatgaaccgtccgctctaacacaaagatcaagcacgtgaacccgatgttccgagaccaggcgacgcccttcggcgacntcccccctcttcntcggaggccccgtcgacatgagcatgttcctggtgaggaccgacgacag

SEQ ID NO: 3880 - DNA, 102 bp, Zea mays
  misc_feature: Incyte ID No: 700282296H2
ggaggagagtggagggagagggaggagcgaggcaccggtgagctcgggaggcggcgtggggcttgcacgccggccctacccccagctcattcaccacgctct

SEQ ID NO: 3881 - DNA, 320 bp, Zea mays
  misc_feature: Incyte ID No: 700282302H2
  unsure 313: a, t, c, g, or other
gtcagagcaaccctatctcttccccactccgctcctcgctcaccctctcaccaaatccttctcctccgcgccgccacagccgggcgcgcctccccgatcgagatccaggagatatgcctcgttatgatgatcgccatgggaatacacgcttgtatgttggaagattggcccctcgcacccgttcccgcgacctagaatatcttttcagcaaatatggaagaatacgtgaagtggagttgaagcgtgactatgcattcattgaattcagtgacccccgtgatgctgatgatgcgcagtacaacctagatggcanggaagtt

SEQ ID NO: 3882 - DNA, 317 bp, Zea mays
  misc_feature: Incyte ID No: 700282303H2
  unsure 286, 302: a, t, c, g, or other
cagaagcaccagcagcacgttgcatctgtggtccaaaggttagctcgtgaaaaggataagtggttgagctccagttccggatgcaatgaaaatcaacatggaattcttgcagcgctgcatattcccacgatgtgtttttagtatgcaagatgcagtgtattgtgctacatttgtccaaacactacactcccttggggactcccttctttaacacagtcaatcatatcgatggtcttgtctgtaaaaccctacagccaatgatatgctgttgcacagaattgaagcnggcaggcttggaaganttttcatgataggtg

SEQ ID NO: 3883 - DNA, 316 bp, Zea mays
  misc_feature: Incyte ID No: 700282305H2
  unsure 31, 142-163: a, t, c, g, or other
accgtttcttcctcgtctccgtctctacacngcggcgccgccgcggccagctgctgccaggagccaagcccaagcctgagcttaaaccatgccgattggttctcttttcgtgtcgaggctggccaggtctagccatgccctnnnnnnnnnnnnnnnnnnnnnnatctctcaggcgcccaggccccagcacatcgcatctcctatattctccggccttggagcagcggctcgtgatttcagctcaagggctctatggaagggagcattcgtcgatgccttcctggctagaataaagaagaacagagaaaacatgaat

SEQ ID NO: 3884 - DNA, 314 bp, Zea mays
  misc_feature: Incyte ID No: 700282307H2
  unsure 273, 308: a, t, c, g, or other
cgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggangccgagaagatgggactgactacatggatgttgangctctc

SEQ ID NO: 3885 - DNA, 317 bp, Zea mays
  misc_feature: Incyte ID No: 700282308H2
  unsure 6, 22, 212, 278: a, t, c, g, or other
cgaccnccctgccgagctcccnccctctccgttggtgatggcatctcagagctccaagaccgcggacaccgccgcgcctccgccggaggttgcagccaccggagaggcggctccgggcgcggcttcttcaacaccggcacaaaaccctaacgctgctgcaaccgcagtggccggggccacggatctagagaagaagatgcgccgcgcggagngtttgggatgccagtactgatgtcagaggaggaaaagcgcacagtcgcgccgagagatttgggacnggctcttcaagtgtaaaggaggaagagaagaagaagtcc

SEQ ID NO: 3886 - DNA, 316 bp, Zea mays
  misc_feature: Incyte ID No: 700282309H2
ggaatcatggattgtgtgaaaacaatatacagacaaaatggattgaaaggcatataccgtggcatggctccttcactatatggaatcttcccttactctggtcttaaattctacttctacgagaagatgaagagccacgttcctgaagagcacagaaaaggtatcatagcaaagctcggttgcggatcagttgcaggtttgctaggtcagacaataacataccccctagatgttgttaggcgacaaatgcaggttcaagccctttcgtcatccagccttgtgggtaggggaacatttgaaagcctggttatgatag

SEQ ID NO: 3887 - DNA, 317 bp, Zea mays
  misc_feature: Incyte ID No: 700282311H2
gcacgctataccacgtggaagaccttcccttccgcctcgaggacatgccgtccaactatggcggcttcagggaggccgtgaaggggttggaggtcagaaaggtgctggaggctcccgaggaggtcaagtgcgtgcccatgaagaatgtgctcgagcccggtgacatccccacgcttgctgagctcgggctcactgcgccaccagccatgtcacaggactcaaaacctgctgttggctctactctcattggtggtgagacagaagctctggagaggttgaagaagtttgctgcagaatgctctatgcagccaaacaaa

SEQ ID NO: 3888 - DNA, 316 bp, Zea mays
  misc_feature: Incyte ID No: 700282312H2
  unsure 11, 108: a, t, c, g, or other
aggagaaattncatgcatgatgggtgctcattccatggctcgtataaggagctttgcaagcatgtgaaatcgaagcaccctacagcaaaacctcgtgaagttgatccngctactgcagatgagtggaaaaggtttgaatgtgagagagagcggcaggatgccatcagcactatcaggtccatgaacccaggatctgtgatcatgggggattatgtccttgagttgaatggtggtggcaacaaccatttgctctcagatggagataactttgacttaggggaaaggctcaacttcttcacatcctagatcgtatttg

SEQ ID NO: 3889 - DNA, 305 bp, Zea mays
  misc_feature: Incyte ID No: 700282313H2
  unsure 9, 16, 35, 51, 54, 273: a, t, c, g, or other
gctcgatcncgcaccnagggtttcgtctcgccgcnctcgtcctccgcgaanatnccgaagaacaagggtaagggaggcaagaaccggaagcgaggaaagaacgaggctgacgacgacaagcgcgagctcgtcttcaaggaagacgggcaggagtacgcgcaggtgacccggatgctcggcaacgggcggtgcgaggccatctgcgtcgatggcacgcgccgcctctgccatatccggggtaagatgcacaagaagtctggatcgcggtggggncatcgtctcgtcggctgccgcgattacaggac

SEQ ID NO: 3890 - DNA, 279 bp, Zea mays
  misc_feature: Incyte ID No: 700282316H2
  unsure 32, 87, 120, 137: a, t, c, g, or other
ttagatccaaagaaacatctgcatcaccatcntggattacatgactccagtgacggtgatatatagtttgatttgaacatcgcgacnactcagtgcacgctctatatttcacggtatatncctttcctttccatccntccttgtgccttactacacctgaaggtcacaatccaactcagaagtgacggtagcgactttattacatccttgtgcctaggtctgtcggcaattatgtgaaaaccgagatcaaaagaaggaaaaaaacagatgctctctcgt

SEQ ID NO: 3891 - DNA, 309 bp, Zea mays
  misc_feature: Incyte ID No: 700282317H2
  unsure 245, 286: a, t, c, g, or other
cctcagggcacatttttactgttggaagccctgtgtatggacagcttggcaatccaaataatgatggaaggtatcctcgcctggtccaagagcagcttgggggtggcggtgttgtggaggttgcttgtgggtctatcatgtcgcggttttgacaaatgctggtgaagtttacacatggggtaagggtacaaatggaagattaggcatggtgatattgcggatcgtaaatgcctacactcgttgangcattgaaggatagtctgtaaaacgtgttgcttgtggatcnagctttacagcagccatctgtca

SEQ ID NO: 3892 - DNA, 315 bp, Zea mays
  misc_feature: Incyte ID No: 700282318H2
  unsure 12, 28, 41, 59, 76, 82, 109, 118, 136, 152-153, 158, 160, 170, 181, 189,: a, t, c, g, or other
cccgcttaaacncttaagcccgcacacngacgaggcgaacngaccagagtcggcgagcncccaggaggcgccgacnaccgcnttccggcttctgaccggtctttagacnccccctgcnccaggcgacgacgaaacnagcagcgctgcgcagnncgacnanaccgggaacntcacgatcaangggagatnctggtngcngcngccgcntcgccgtcgcagccgtgaacnggtttcnccaggnggganggattgggctcagattcggcggatcttgggctggtctcgtgcattcnanccgcggcanacgtctnggta

SEQ ID NO: 3893 - DNA, 272 bp, Zea mays
  misc_feature: Incyte ID No: 700282319H2
  unsure 15, 31, 40, 51, 152, 162, 253: a, t, c, g, or other
ccctaatcccgaatncctcccggcctccacngtctcgcgntcgattcgaantccgagtccctatcctgtcctgtgtttccactgcaatggaggacaacgcggtcgaagagcccgagttgagcggtgcggcggagttcgcgccggcgctcgtngccgcccacncacacggcaactccgtcgcgtcgccatcgggcccgagctccgcgtgtttgatctcagggctggtcatccatttcattgtcagatgattgtngtggcattctcattcagac

SEQ ID NO: 3894 - DNA, 308 bp, Zea mays
  misc_feature: Incyte ID No: 700282320H2
  unsure 15, 77, 137, 143, 179, 210, 255, 264, 273, 286, 290: a, t, c, g, or other
gtcttcgcttccacnccccacgttccccgcctgcttcctccaggccccggccagatccgcgcgcccgcggggaaganggcctcctctcctccctcctcccttggctcgcgctctggtcgaggaggcggaggccggtnccggcnggcgggcggggaggtaggtagcagcttgcggttgcnggagggaagctgcgcgcgctaggctgccatngcggtggagaagacgctgcccggcgcgagttcggggaagaccgtnctggtcacnggcggggcnggtacatcggtanccangccgtgctgcaactcctc

SEQ ID NO: 3895 - DNA, 309 bp, Zea mays
  misc_feature: Incyte ID No: 700282321H2
  unsure 18, 248: a, t, c, g, or other
gcaactctcatcctcacnccccccactcgcccgcatcttccggtctttcctcatggcgtcgagcgacctcgccgagagcctcctccccggcggcgggggcggagctccgcctcacatgacgaatacgaggagcgcgcgtacgactccgaggacaagatctccatcgccgtgtcggattccgacggcgaagacgacggcacgccggcgtcgcgcccgcccttctcgtggcggaagtctggcgcttcacnggcccgggttttctcatgtgcatcgcgttcctggacccgggcaatctggaaggggacctac

SEQ ID NO: 3896 - DNA, 307 bp, Zea mays
  misc_feature: Incyte ID No: 700282322H2
  unsure 15, 45, 93, 165, 178, 204: a, t, c, g, or other
cttgggaattgaccntccacctgagaaggtctttttgttcaaaantctgcgcttcacaagtgcaacatggctggaaagcctgctgttgttacncgtgtcgtggacagcatgactgacaacctcagacctactcgcgcagaggcaactgatgtggcaaatgcagtncttgatgggagtnacgccattctccttggtgctgagacnctccgtggtttatatccggtggagactatttcaacagtgggcagaattgtgctgaggcagagaaggtatttaaccaagattatatcacaagcggatgtgaatt

SEQ ID NO: 3897 - DNA, 256 bp, Zea mays
  misc_feature: Incyte ID No: 700282323H2
  unsure 29: a, t, c, g, or other
ccccggtggcactaatgcccatcgcgaanccctcgcaggaaagaagctctgcaagcggaccctcaagctcgtgcgacgagcctctgaggccaagtgcctcaagcgcggagtcaaagaggtagtcaagagcattcgccgcgggaacaaagggttgtgtgtgattgctggaaatatttctcctattgatgtgattacacacgttccaatactatgtgaggaatctaatgttccttacatatatgttccatccaaagag

SEQ ID NO: 3898 - DNA, 308 bp, Zea mays
  misc_feature: Incyte ID No: 700282325H2
  unsure 66, 94, 295: a, t, c, g, or other
ggaggacaaggccgcggagccgcctccaccgacgttgtggttcgcgctcaagcggtcgctgcactnccgctccgagctgtcggaggtccacgtnccgcgcgccaacaaggcctccggtccagtcgtcgcgagcggtggccacctgtcgtcgatcgtcaccaagcgcgcctccgcgcggtcggggtgctcgcgctccatcgccaacctgcgggacgtcatccacgggagcaagcgccacccggggcagccgcccagctgcagcccgcggtccatcggcagcacgagttcctcaacnccatcgcgcagag

SEQ ID NO: 3899 - DNA, 308 bp, Zea mays
  misc_feature: Incyte ID No: 700282326H2
ctccggcggcggcaactcgacggccaaccgcgccaccctgccgcggcagccatggtgcatgttaacttctaccgcaactatgggaagactttcaagaagccaaggcggccgtatgagaaggagcgcctagatgctgagctgaagctggttggtgagtatggcctgcggtgcaagcgcgagtgtggcgcgtgcagtatgccctgagccgtatcaggaatgcagccagggagctgctcaccctggatgagaagaacccacgccgtatctttgagggcgaggcgtcctccgccgcatgaacagatatggtc

SEQ ID NO: 3900 - DNA, 311 bp, Zea mays
  misc_feature: Incyte ID No: 700282327H2
  unsure 7, 9, 27, 35, 143, 145-146, 175, 177, 216, 221, 232, 261, 289, 297: a, t, c, g, or other
caaaacncncctcggtcctcgcaagcntcgccgcnccgcacagatcaaccgctcgaaatttgggggaagcaagcgagagcagcagtaagcctcatcgggaagtggagagatggaggcggcgggtcgcctcctcctcctcatcnanncctccctcctcctgctcttctcgccggancngccggcggaggccgcgccgccgcgaatccagccgctcgncaacnaccgcgctganccggctcttacgacacttccaactaaggnaagctgcagctcaacaacgggcttgcgnacataccnagaggggttgaaaa

SEQ ID NO: 3901 - DNA, 307 bp, Zea mays
  misc_feature: Incyte ID No: 700282329H2
  unsure 19, 183: a, t, c, g, or other
ggcaacaccgatgtgaggngcattgacctgaatgaaattgtcaggtttgaaaaacactatgtggtggtttatgaggatgagacttgtaagccacctgtagggcatggtcttaacaaagcagcagaaatatccttgctgctgaatctgaaggatcatccggagcccagtatccttgttgaagtnctaaggtgtcgtgcaagaaagcaaggttctaggtttctttcatcaatccagtgaatggaaaatggaaatttgaggttgatcatttagtagattgggctgtggatgaggacgaagagaatgctgt

SEQ ID NO: 3902 - DNA, 297 bp, Zea mays
  misc_feature: Incyte ID No: 700282331H2
  unsure 189: a, t, c, g, or other
cgcagttggtagggttctagccatggcgtggagcgccgccgccgtctccaggttcgcagccgcctccccacccgcggcacccatctccgtcaggcttggagccgccgttctcgtcgtccctgtcttctccagtgggcgccgacgcccgtggccgcgtccctctcgacctctgccaccgtgtaaaggagntgttcagacagagaaggcacaccagcattaggcccttattctcaggcatcaaagaaataatcttgtgttgtttggagtcttggttgaatccgagacaggaagttactc

SEQ ID NO: 3903 - DNA, 299 bp, Zea mays
  misc_feature: Incyte ID No: 700282335H2
  unsure 126, 185-216: a, t, c, g, or other
cccgcgcccagcggtggcgccgcgccgacgaacagccctgcctctgggagggtcgcgtctaggctactggcgggatggacattcctccccgcgtttcgccgacatgctccatcagtgttcagtacnagctctgtgttggagatgcggtgtcgcatccatccgttctgctcccgtctaccgcattnnnnnnnnnnnnnnnnnnnnnnnnnnnnnnnnccttttaaaatgcactgccctgtacactctgacatgcaagacaatggtatatggatggcttatttatgtatagtgagtcatat

SEQ ID NO: 3904 - DNA, 232 bp, Zea mays
  misc_feature: Incyte ID No: 700282336H2
  unsure 2: a, t, c, g, or other
tncggcatcacggcgaaccaagggttttacctcctgggcctggacaacacgtcgccgacgttcgcgtccgccatccagaactcggtcccggccatcaccttcgccatggccgcggcgctgcggatcgagaaggtccggctggaccgccgcgacggcgtagcaaggtggcgggcacgctggcgtgcgtggcgggggcatccgtcatcacgctctacaagggccccaccatctt

SEQ ID NO: 3905 - DNA, 303 bp, Zea mays
  misc_feature: Incyte ID No: 700282337H2
  unsure 52, 103: a, t, c, g, or other
caatgacagcacttctagtaaaaggcagaaaaaagcgctcgagtatgatacngatgaggatgaatccatgaagtcagacagtgaggaaaacagagatgaagantcagatgaagctggtgacaaacaggaaggtgactatgtatctgggaaagaaaaggcagggaagttctcagaggtaaaagaatcttcaggcaaaaagaaggcaaacacagggagtggccaccaatcaggtcctccaaagaaaattatcagaagtccggtaaaaaaagtatcatccaagattctgaggaaaaagaaagcccc

SEQ ID NO: 3906 - DNA, 303 bp, Zea mays
  misc_feature: Incyte ID No: 700282338H2
  unsure 6, 70, 95, 161, 186: a, t, c, g, or other
cgagangcagcgagccagcgaccggcaacagttttctcggaaggcagcctcttcctcgtcgccgccgacntcacccgccgcggctgtcggggatnccggtcagggtggtcgataccgccacgccttcctcgcagccctccccagggcaagaagcaaatacnggacacccatctcctcctagatgtncactccttaagtgctggaagatcttttgctggaactcagaatgtttcaagtctgcagaaggatgaagcatggaaagtgaatgtccgcatccatggttgtgatcttgaacagggttat

SEQ ID NO: 3907 - DNA, 299 bp, Zea mays
  misc_feature: Incyte ID No: 700282341H2
  unsure 23, 53, 60: a, t, c, g, or other
aatcagttgagaaagctggaggngacctttgggacaaacaccatgttgaaacngatcatngccaagataattgtctggaccaagaagttcctcaggaagccgaacgaacctctgataaatcaaataaatcaagtgggacagaggatgtgaaatctgatcttgctttggacaatgttgcagagtttgagatccaatgggaagaaatttctattggtgaacggatggcctggatcgtttggagaagtttatagaggagaatggcaggaacagaagttgctgtcaagaagtttttgcaacag

SEQ ID NO: 3908 - DNA, 302 bp, Zea mays
  misc_feature: Incyte ID No: 700282343H2
  unsure 30, 38, 50, 73, 85, 104, 224, 246, 259, 278, 281, 294: a, t, c, g, or other
gcggacatggtgttcatccgcaccatcacnagccagtnccagaccatccngggcatctcgctcatcgagatcntctccaagcacnacctccgaagaggtgtacntcggccagcgtgacgagcctgatcgctggacgtcagacgccaaggcgctggatgcgttcaaaagattcgggagccggctggtgcagattgagaatcggatcaagacgatgaacgacagtncggacttgaagaaccggaaggngcctgtggaaatnccgtacatgctgctgtacnccnacacgtcgggcgntacggcga

SEQ ID NO: 3909 - DNA, 306 bp, Zea mays
  misc_feature: Incyte ID No: 700282344H2
  unsure 7, 13, 16-17, 29, 40, 42, 62, 67, 73, 85, 92, 97, 106, 126, 169, 194, 224,: a, t, c, g, or other
gccggtnccggcnggnnggcacagcagtnccggtggagtncngcgcggggacggagagatcntcgtntcggtngagccagcaacnaccggcncggcngcgcggagnggacgccgcggctggggacncgccgggacagaggcagcagctcagtcccgggttgctcgatcnccatgctttcgacacggagctaatnccggattttcaagtaccagggatgtatganggtncccaaaagtttggctatngaggaagtctagatgaatctgntatnagnntcncagcnaacaagctgntnancnagtcnc

SEQ ID NO: 3910 - DNA, 286 bp, Zea mays
  misc_feature: Incyte ID No: 700282350H2
  unsure 36, 129, 132: a, t, c, g, or other
aaataagttactttattgagtttggaatttaacatntccaccactttccaaagttcagatataagcctatctcaaattcatagggtagaggatgagaaatgattttatgcattattagaatttgtttcnacnctgtcatgtcacttacatgacactcttcgtctcagttctctatagtaaaatgtaccacaaatatctccgatatcttactaataatagtatacaaatatattttgcataaaaccgaattaacttaattgatatatgcctaaattactattattag

SEQ ID NO: 3911 - DNA, 232 bp, Zea mays
  misc_feature: Incyte ID No: 700282351H2
  unsure 5, 11, 20, 31, 40, 65, 89, 108, 128, 146, 150, 161, 200, 203, 225: a, t, c, g, or other
gatcnggatcnagcgcagtngcagccgaacngctgctacngccatgggcaggctgagccccttcngcgagcgcatccagttcgtccagntcgtcatcgtagtcgagcncccacatgcacaggtttatncatccgggggctcaagtngggnaatcgacagcnggtgcacaaaccacatgacaggggagaagaagatgttcnccncctacgagaaaaaccaagatcnccaacga

SEQ ID NO: 3912 - DNA, 324 bp, Zea mays
  misc_feature: Incyte ID No: 700282352H2
  unsure 24, 30, 38, 41, 48, 54, 56, 100, 117, 142, 230: a, t, c, g, or other
gtattttggaggaaaaagtaaccnatcttncggaatcncangtttacntcagtntngcttactacctcccaacacagtcattatctcgagaaggctatcnaccacagaatctgtacngccttgactcatgttatggttcccncccatgagctaaaattgttgcttcataaaatgagcgaacataatgtaagggctatggcagatgttgttatcaaccatcgaattggaanactcaaggatccaatggcatgtataatcgttatgatggcatcccagtatcatgggatgaacatgctgttacatcttgttctggcgggaagggaa

SEQ ID NO: 3913 - DNA, 285 bp, Zea mays
  misc_feature: Incyte ID No: 700282355H2
  unsure 72, 119, 145, 167, 213: a, t, c, g, or other
gtggagggtgctgataattcttcaacagttgatacaactcatgtactgtctgacgaattagaaaaggatccnagtacatctgcagatggattgtaagaaaaaagttgagcttgatgatngggaagatgctgcagacatgtctacncccaaagcagccatcagattcngggaatcaggctagcatcacccaagtgttggattcagacgtaactncaagcaaatagcaggaagaaatactcacgggatttctgttaactttgcaacatcatataccggtcttccttt

SEQ ID NO: 3914 - DNA, 345 bp, Zea mays
  misc_feature: Incyte ID No: 700282356H2
  unsure 43, 111, 154, 164, 198, 215, 249, 255, 269, 271, 273, 315, 338, 344: a, t, c, g, or other
cttcctcataacccggaggacgcgctcgaggtattcgtggatngcaatgcggtgcggatccccaaggggttcaccgtgctccaggcatgcgaggtcgccggcgtcgacatnccgcgcttctgctaccatagccgactctccatcgctggaaacngccgcatgtntctcgtcgaggtcgagaagtcgcccaagcccgtngcttcctgtgccatgcncgcgctcccagggatgaagattaagacaaacacnccagtngcaaagaaggcaangnanggtgtcatggagttcttgctgatgaaccatccactcgattgncatctgtgatcaaggcgggcganttcganc

SEQ ID NO: 3915 - DNA, 342 bp, Zea mays
  misc_feature: Incyte ID No: 700282357H2
  unsure 202: a, t, c, g, or other
gagatagtgaacccattttgcttccagcagctctgaggctctcctgtggatgcatcaagacaacagcatgatggcgccaaacttgaggtcagcattgggcaagggcaactaccagagcagagaaaccaaataatataccatacctaactgttcgcctggaagttactcttcatggcaagtgtttgaattttctcttgttacngcgtgtcgaacaatcatgtagctgtagatatagtgattgtggaaggatgaagttgccaaattgacccgtggcgattccttctccagacaggaaaaattctgaacatccaggagtttctgtttgcaagtttcactatttaa

SEQ ID NO: 3916 - DNA, 93 bp, Zea mays
  misc_feature: Incyte ID No: 700282358H2
  unsure 25, 33, 48, 68, 81: a, t, c, g, or other
catttttcatgtataagaacttacnaagaatcntccattgactcggtnaaatgcaacataaaaaaatngcttcgctagatnaaagggcctttg

SEQ ID NO: 3917 - DNA, 281 bp, Zea mays
  misc_feature: Incyte ID No: 700282359H2
  unsure 9, 26, 33, 37, 49, 67, 76, 82, 86, 102, 104, 106, 125, 166, 173-174, 199,: a, t, c, g, or other
aagggaagnacagccgagcccccacnacgcgtncccngccgcgcgaccngatcgtacggccggggangctgccgcncctccngacntcgctttccgcctcgncncnccgaccggaccagcggccnccgtctgaagatgcagggcggcgtctccggattccagaacncgccggnnacgcgggcggtcgtcgtcgcgagcngcctcctgtccgtcgtcttcagcncgcaggcgcncccgcncccncggcatntcataccaggacatataacgaatttcgttta

SEQ ID NO: 3918 - DNA, 240 bp, Zea mays
  misc_feature: Incyte ID No: 700282360H2
  unsure 15, 30, 54, 74, 84, 110, 112: a, t, c, g, or other
tgtaatttgagaatnagggttcatcaaacnaggcagcaaagattttagattgtnacggatacaagaccattccnggacaattcnaataggaaaaaacaaggtcgtggaangngtcgtgctggtacaggccgaggccgtggctcaaagactgttgatcaaccacgactgactttgatttccgcagcagttgtaacaaatggtcaactagataaataaccaacaaggaaccccaatcgagtg

SEQ ID NO: 3919 - DNA, 284 bp, Zea mays
  misc_feature: Incyte ID No: 700282362H2
  unsure 13, 19, 33, 60, 63, 75, 98, 100, 102, 107, 117-118, 146, 162, 173, 179,: a, t, c, g, or other
ccttgttctttcntcgacncgcccccgggcatngcgaaccgcagtgttgccatgggcgtngcnctcgcgttcgtnagccatgaccgcgctctgttgcncncngggcnccgcggagtnncccaggctggaccacccggccaggatcnacggatcgctgaagcngctcgtcgtcngggacnagngacgcaaggngactcacaaccagtnccgggtcgccgaccagatgggaaggntcggggagaagctcgatatcgactttgttatatccaccggggacaattcta

SEQ ID NO: 3920 - DNA, 272 bp, Zea mays
  misc_feature: Incyte ID No: 700282363H2
  unsure 4, 12, 18, 26, 35, 46-47, 71, 85, 107, 143, 181, 205, 221, 228, 241, 253,: a, t, c, g, or other
cgcngcctcgcnggtgcncttccacntcctgcacnacagcgccatnncgctttccacggccagctaccgcngccggaatatacanggtggatctttagcaggttccnccggtccgatccaccgccagcttccgacgtcgtacncgggcggatcggttccacaatgggggaacggggagcanaggaggacggctcgggcggctccnccctctccctcatgtncctggangacggcgccgacntcgacgccggtngcnccgcngagancgccga

SEQ ID NO: 3921 - DNA, 182 bp, Zea mays
  misc_feature: Incyte ID No: 700282367H2
  unsure 4, 28, 37, 59-60, 64, 74, 86, 92, 109, 117, 140, 176: a, t, c, g, or other
attnacaaggaaggccaatgatgatttnccggacacncgcaatcctggactcgaaaaannctanaaatgcagcnagatctggtatnctgacnccgcaatatgagtatgnagatgagnacgatgattcatttgatgatctnggcttcagtgtggtagagtcaagttatgaggaaacngatggt

SEQ ID NO: 3922 - DNA, 259 bp, Zea mays
  misc_feature: Incyte ID No: 700282368H2
  unsure 12, 17, 19, 24, 31, 35, 44, 49, 51, 61, 69, 75, 81, 104-105, 196, 198, 205: a, t, c, g, or other
gctcgatccatntcacncnccgcnggtcgcncacncttgcagcnccacncntcactgcagncttagtcncttatnagctcnaggctctagctagccgcgccacnncttcgtgtagccatcagccttctcatcgccaccaatggccactgccgaggtccagaccccgaccgtcgtggcggccgaggaagcgcccgtngnggagacnccgccgccggccgtcgtgcccgaggatctgcccccgccgaggccgaggccgagg

SEQ ID NO: 3923 - DNA, 334 bp, Zea mays
  misc_feature: Incyte ID No: 700282369H2
  unsure 73: a, t, c, g, or other
agaagaagaaggcccgacgccctcgccgctgccaccaaaatcgcacgcgagccccaaagatccccaaaccctnacacccgcccgccggcgcacttcggggaccgtcgaatcgagcaggttgacggaggagaggaagcctcgaagatgttccggaaccagtacgacaccgacgtgacgacatggagcccccaggggcggctgttccaggtggagtacgccatggaggccgtcaagcagggctcagcctgcgtcgggctccggtccagcacccacgccgtctcgccgccgtcaacaagcccgcctccgagcttcctcctaccagggaagtgttccg

SEQ ID NO: 3924 - DNA, 333 bp, Zea mays
  misc_feature: Incyte ID No: 700282370H2
  unsure 14, 17, 34, 49, 58, 76, 99, 111, 215-216, 306: a, t, c, g, or other
gtagatcgccggcnccncgctcggctcggccatntcggccggctccacnggcgtcccnacctcgcggccgtcatcngccttgccctcgccgtgcttgcncccgtcgttccnggagatggtgccacattggaatcagttccagaccttgtgaaggcaatgtacctaaacgttgaaagcttcccttgtgtgaggctgttgaatctttctggtgaaanngctgttctaatcctggaagtgagaaggtcatgcaccaattgtaagacttagaaaaggcagtgatcaattggttcaaccatctactattcnccttccttagatcagatgtcagattct

SEQ ID NO: 3925 - DNA, 171 bp, Zea mays
  misc_feature: Incyte ID No: 700282372H2
  unsure 6, 18, 60, 68, 104, 145, 163, 170: a, t, c, g, or other
gctacngggaggagcacnccaagtgcctcactgtcgagtccatgatgctcgactcccgtnccgccgantcgacaaggaagagcgacccgagatcctgtctttgnttccctcttacaaagggaaatcagttctagaacttggtganggaataggacgctttacnggagatng

SEQ ID NO: 3926 - DNA, 258 bp, Zea mays
  misc_feature: Incyte ID No: 700282374H2
  unsure 19, 23, 25, 28, 42, 57, 76, 89, 126, 165, 178, 194, 218-219, 240: a, t, c, g, or other
gggcttttgcttgcttgcntccncntcnacccgtcgggcacncgggctcgtcagacngcggccgggcgccgaatcnccagacgggatcncgccccccatctgacgccaccggcgccggagcccacngcgaccgcgcgcctctgcctccgatctaaaagaaacatnggagaaccgtacngaacaaaataagtacnggtattcatcattgtctcggtatnncaataatgtggaaactcaatncctttggagtaagcacag

SEQ ID NO: 3927 - DNA, 120 bp, Zea mays
  misc_feature: Incyte ID No: 700282375H2
  unsure 24, 44, 52, 64, 71, 75, 78, 85, 88, 98, 100, 114: a, t, c, g, or other
tggtctcttggagcctcatcaatnggtaccatcagagaggagtncgactacnacagcagccggncctcgcngacngcnccgggcngcncccgccggancnggatcagcgacatnagcagc

SEQ ID NO: 3928 - DNA, 313 bp, Zea mays
  misc_feature: Incyte ID No: 700282376H2
  unsure 25, 41, 45, 63, 84, 136, 236, 292, 311: a, t, c, g, or other
agcatctccgctccggctgcgctcngccttgctttcctganaccngctctaagcgcgagcgantagaggtacggcggccgatcnggcggcgcaggcggagggctcggccggggccggcaagtcggcgccgaacatngggaggggccgggtcgagctcaagcggatcgagaacaagatcaaccgccaggtcaccttcgaccaagcgccgcaacggcctgctcaagaaggcgtacganctctcggtgctctgcgacgccgaagtcgcgctcatcatcttctccaaccgggcaanctctacgattctccagcangc

SEQ ID NO: 3929 - DNA, 258 bp, Zea mays
  misc_feature: Incyte ID No: 700282378H2
  unsure 3, 104, 144-145, 169, 243: a, t, c, g, or other
cgnaagatggaggaagaagctcggcacccggttccccgcgggctcgaatcaaaaagataatgcaagcagtgaggtgttggaaagattgcattagcggtgcctgnttagtctcgagggctcctgaattgttttacaagattaatnnaccggacttatgaaatactcttcnaagcggagcaaagacactgaattccttccacctgaagcaatgtgtgaagaggtacagttctttgattcctaacnggagttgtcagcaag

SEQ ID NO: 3930 - DNA, 332 bp, Zea mays
  misc_feature: Incyte ID No: 700282379H2
attttctcattttcatgatccaatttctagcaaggtagatttcatgtatcaattgactagaatagagaaagaagctaattgggtaattctaaccggcctggtggtggctaaaccaactgataacaagggccatggtgtaattaagtagctaaaaattcatactaactgcacttacgaagtcagaagaaaattcgtgtgacttcagaataacaatccctgaaatactggaggatgagtggttcaaaaagggctacaagcgcccggagtttgacgagaaatatgaccgccatggatgatgtggagctgcttcatgactcagaagagcacacgtg

SEQ ID NO: 3931 - DNA, 341 bp, Zea mays
  misc_feature: Incyte ID No: 700282380H2
  unsure 30, 53, 62, 86, 88, 93, 165: a, t, c, g, or other
aagagttttcttgtttgcaagaagaaaatngctacctctccagatctattatnctgtttttncccaactccattcaaacttttccngnagacngtgacaaacatgaaatttgatgaagaaccaaattactcaaagcttatttcccttttcgatgaattgattganccccagcatttgaggcctattagaattgatggtgcattgaaggctggacaaaaacgtggaagattacatgtaaatccagaagaagatgagcaaccgaagaagaaagttcgacttggaagcccagcaaatcagtggattcagtttataatgctagaaggccatgaagcagagatacc

SEQ ID NO: 3932 - DNA, 191 bp, Zea mays
  misc_feature: Incyte ID No: 700282381H2
  unsure 10, 26, 46, 56, 61, 64, 68, 72, 76-77, 118, 124, 151: a, t, c, g, or other
gcattttccnacacccaatctgatcngaccaagccctctgaacacncccgcccatnctccnccnaccnaccnccgnngccgccgcccaagatgggcttcgacgtgggcctcgtccccnacaacncccgacgggtggggtccacctgaagtngccgccgcgccgccttccctcggtggtggctcctcgtctg

SEQ ID NO: 3933 - DNA, 237 bp, Zea mays
  misc_feature: Incyte ID No: 700282384H2
  unsure 4, 50, 80, 160, 200, 221, 224: a, t, c, g, or other
cggngctgtttatgatgtcaatataggtggactcagtaacaatttgcacnccctagcaaggtgtgtaagttctgtgattnggggaagcgaatacactcgggtcgaaagggagcagcgaataaacactctttcaaatgtgcatacagatgagctgcaagangccgagttaccgagccgtgtctcagcagaagcaaatatcnaatcttgtatgcagatctacntcnaatgtctgcaggg

SEQ ID NO: 3934 - DNA, 324 bp, Zea mays
  misc_feature: Incyte ID No: 700282387H2
  unsure 221, 253: a, t, c, g, or other
gaagtttgtggtgaatcgaaattctctgaacttggtgcggattcgctggacacggttgagattgtgatgggccttgaggagcacttcgacattagcgtggaggagtccagcgcgcagacaattgccaccgttgaagacgccgctgacctcattgacaagcttgttgctgtgaaggcataggccgcatctcttctatcattgtcttaccactctaggtttcnatggtctgaagacttgtgattttctccgcacngctgttgctattcccgtgtcgtaataatacgagatgttttaagcggctgaacacacggtggtgtaatctgt

SEQ ID NO: 3935 - DNA, 321 bp, Zea mays
  misc_feature: Incyte ID No: 700282391H2
  unsure 22, 66, 70, 72, 75, 85, 91, 106, 147, 160, 162, 167, 200, 209, 239, 263,: a, t, c, g, or other
ggaggaagaggaagcgaaagcngctctaatgagcaggatacaacgcttgaccaagttgatacttgnttcnancanaaacaatatnctggcntgacagatggtcatnagcggcataattctgtcagcgagcaagataagttaagcacntcacaagatagcncnacacntgtccaaaatgagggcacaacaaaagaccaccncaccagacngccttagatgagatcaaccaattaagatcnggcagtggtgaacattcttcagcnacttgttctgtanagntcnatgcaggcaggatcaggcatcagatcatatggacngcgg

SEQ ID NO: 3936 - DNA, 302 bp, Zea mays
  misc_feature: Incyte ID No: 700282392H2
  unsure 12, 14, 25, 31, 38, 45, 74, 86, 197, 213, 282: a, t, c, g, or other
gtctcttccacncncccttgacctntctccnctcaccnggatgangctgtgccgctccgctaccggtggcatcngcatctgcatcnccataccctcgatctgtcttctctcagggtggaagaagcgtgacaatggaggctccacccgtggcgctgttcgacaccctcaaggcagccaaaccgttcttcttgttggcnggtcccaacgtgattnaatcggaggagcacgtcctgaagatggccaaacacatcaaagcaattacgaccaagcttggaatccacncgtgttcaagtccagtttga

SEQ ID NO: 3937 - DNA, 327 bp, Zea mays
  misc_feature: Incyte ID No: 700282393H2
  unsure 6, 12, 16, 20, 46, 48, 57, 60, 62, 65, 81, 102, 107, 113, 123, 160, 181,: a, t, c, g, or other
gaagancgtgtncgtnaccngcgctggcggcttcgtcgcgtcggancnggtgaagcnccncntcnacccggggccaatacncggtccgcggcaccgtgcgcnacccnggtgcnagcaagaatncccatctcaaggtgctggaaggagctgaggaaaggtngcagcttctcaaggctgatcngatggactacgacagcattgcatcagcagtngccggctgtnagggtgtcttccatgtagctagccctgtcctttcccatcgacccnacaaccctgaggtggangtcatagctcccgctgtaataggtacaaccaatgtgttaaagg

SEQ ID NO: 3938 - DNA, 328 bp, Zea mays
  misc_feature: Incyte ID No: 700282394H2
  unsure 51, 62, 209, 244, 246, 255, 303: a, t, c, g, or other
gcaagttgagcatccatccatccatggcgggaggcaagtccaccggcaatngccgcgcgcanaggaagcgcgtcgaggcaaccgtcctcaagcgctccagggacgggagcgccttcaccagatgcgaggcctgcaacaaggacgtccccgtcgtcctcatcgacatgcacagctgcagcctcgacgagaagatcaggatgacgctcgangcgcaggtcgtcgagaagaccgtcgaggtcgccantncggaccgcnaaaagtcctccgccaagggaagtggtaacaaggacgccaagcgcaacnctcggccaacggcttctttctcttc

SEQ ID NO: 3939 - DNA, 275 bp, Zea mays
  misc_feature: Incyte ID No: 700347401H1
  unsure 2, 5, 48, 60, 116-117, 125, 172, 214, 243, 254, 269: a, t, c, g, or other
antanaattcacagtttaacaagtagaattcacagtttaattttgtcnccaatacataanatagtgttatattatatctgataataaagataatgttgattttgcggaaataacgnntgcccagngtgtcgcacccattgtgcaagcagacgttcttgagggatgatcccanttatgatgcactgattgcagccctatatccagatattgatangtatgaggaagaggatttgctttcagtgngtaggagaggntcagaataaggaggncccccc

SEQ ID NO: 3940 - DNA, 288 bp, Zea mays
  misc_feature: Incyte ID No: 700347404H1
cgactctgccgtctccctcgcctctttcccctcgtctcgtctgcatccgcctccgccgccccaagacctcatcacctccccttcgccgtgaaccctaaccccgcgcccctcgccccctccttctcgtcgtcatcgccgcccgcttttccgggcccccatcgcctcttctcttccacgagtggttcaagcatggtggtcgtgggctccgcggactcttcaacagcatcttttccaaggtgcaagatgaaaagctaccagtgtcttttatacaggcggtgtggtgtggac

SEQ ID NO: 3941 - DNA, 154 bp, Zea mays
  misc_feature: Incyte ID No: 700347405H1
cactagtacgctacgcacctttccttcgtgtaataactccagctacttcctgtctagtgtctccgtcgctgccagccagccacagcaagctccgcacgaccgccggtccgccgcctaccagagcgagctcatccctcagccgcgccgggggggg

SEQ ID NO: 3942 - DNA, 283 bp, Zea mays
  misc_feature: Incyte ID No: 700347409H1
  unsure 19: a, t, c, g, or other
ggcatgttcatggtaaganggttctggtggtgaccaacacgaccgtcgcgccgctttacctggacaaggtgacatgggcactcacccacaacaacctgaatgtatcagtggaaagcgtgatcctgcccgacggtgaaaagtacaaaaatatggacacgctgatgaaggtgtttgacaaggcagtcgagtcccgttttgaccgccggtgcactttgtagcactgggtggtggtgtcttggggactgtgtggttttgcagctgtgcattcctccggggcgtcatt

SEQ ID NO: 3943 - DNA, 131 bp, Zea mays
  misc_feature: Incyte ID No: 700347412H1
  unsure 5, 8, 64, 71, 80, 82, 93: a, t, c, g, or other
gaacnggnatgggaggttcagtcgcgtgaacaatggcgccaagcaagctcctgtggtcgcgtanatgcatncaaggcggnangcttacatcanactaggaagcataaggctacattcaagtgagctgagtg

SEQ ID NO: 3944 - DNA, 289 bp, Zea mays
  misc_feature: Incyte ID No: 700347413H1
  unsure 42, 91, 97, 100, 111, 189-190, 204, 286: a, t, c, g, or other
agatcctctctggacgaacagaaaggttaccagcagcaccanggcgagatctccccttggcgggccaaaaccgacggcgagcttcaccggngttggnacngctccaatctnttcgccgttttattttcctcccaggttaaggttgcaggcttttagcttgggattctgaaagatggggacctcttctgnngcgaatttccattngcaacctcctccgacccaggggatgttgcctccaaggcatggtccacgcccctcagggttgcagacctcgctctcgctggcntct

SEQ ID NO: 3945 - DNA, 284 bp, Zea mays
  misc_feature: Incyte ID No: 700347414H1
  unsure 58: a, t, c, g, or other
gcgaggtgagctctgtagactgcactgctattcagccatttgacctaaaccatttttntggtgaagatggaaaaatatatggttacaaaaatcttaagataaatgtgtggataagtgcgaaatctttccatggatatgctgatgtttcatttgacgaaactcctgatggagggaaaggaataacagatctaaagcctgttcttcagaacatttttggagaaaactggtagaaaaagaggattcctgcatacattttcgaagaatgtgaatatatcagaactgca

SEQ ID NO: 3946 - DNA, 291 bp, Zea mays
  misc_feature: Incyte ID No: 700347418H1
  unsure 9, 11, 26, 59, 66, 68-69, 71, 75, 85-87, 93, 99, 106, 111, 158, 188,: a, t, c, g, or other
gagcacagngnacacgcactacacgnacggcacgcagatagtatatggagagaggtganctatagntnncncatntatttaactnnntaactnactggntagctanctcgntccgcagagcagagcgcaagcagcaagaagcaaagcaatggtgaacnctgcgagtgtgctagttctaccagcgcatntcaccannctcacgttcggaaanctgtagatccgnnggntccgggtcnngcagcagggtgatnnccgaggcatgcangttcganntggacaagngatacgtna

SEQ ID NO: 3947 - DNA, 280 bp, Zea mays
  misc_feature: Incyte ID No: 700347419H1
  unsure 136, 177: a, t, c, g, or other
tgttaactgctttggaaactttatcattttcctgggaaaggtgctggtggtgtgcttcagcgttttcgggggcctgatggcgtttaactacaaccgtgcgctccaggtatgggccatccctctgctgctggttgcnttttcgcctacttagcagctcacagtttcttatctgtgttngaaactgtgctggatacactttcctgtgctttgctgtcgacctggaaacaaatgatggatcgtcggagaaaccgtactttatggacccaggtttttgattttg

SEQ ID NO: 3948 - DNA, 196 bp, Zea mays
  misc_feature: Incyte ID No: 700347421H1
attcttcccgtcgaaagacggagagaggaaaagggacaagggcaaggcaagagagaggcgtcgtcgtttgatctgctgccggagtgcgaagaggaagaggaagaggagcgccggagttgtaaagatgttcctggtggactggttctatggggtgctggcatcgcttgggctgtggcagaaggaggctaagatcctc

SEQ ID NO: 3949 - DNA, 228 bp, Zea mays
  misc_feature: Incyte ID No: 700347423H1
gctggaagtacactcgtagggtttagcagagttcgatgagcttgtagggtagacgccctgaccccgttctgttgcagattcatctaaccaccgctccggatttgtttttttgttttattttgttttgtttatttaatatacatattaattcatttgtagcaccccccgtgtacagcagctgctggctaacttaaacctgctgtgccatattttattcattctattcac

SEQ ID NO: 3950 - DNA, 150 bp, Zea mays
  misc_feature: Incyte ID No: 700347424H1
  unsure 7, 25, 27, 63, 80, 89, 92, 96, 103, 133: a, t, c, g, or other
gtggtgnggcgtggtggagcgggangnccccggccgctacgactgatgaggcctacgccgagntcgtgcgcatggtggancgagccggnctncgantccaggncgtcatgtccttccaccagtgcggtggcancgtcggcgacacctgca

SEQ ID NO: 3951 - DNA, 282 bp, Zea mays
  misc_feature: Incyte ID No: 700347427H1
agacaatgatgaagatcatgggaaagataatcaggacacaatgaagccagtattgtccttggggaaggaaggctctgcctttttggccccaaaattacattacagcccatcttttgcttgtattccttatacttctgatgcttattatagtgcggttggggtcttgacaggatatcctccacatgccattgtccatccccagcaaaatgatacaacgaacactccgggtatgttacctgtggaacctgcagaagaaccaatatatgttaatgcaaaacaata

SEQ ID NO: 3952 - DNA, 281 bp, Zea mays
  misc_feature: Incyte ID No: 700347428H1
  unsure 72, 85: a, t, c, g, or other
gattattttgggtccctctacttctgatgccccgagttcaaaagatacatttcaggctgaaaatataaagtncaggtgagagtanagttctaatgtcttcatcttccaacaacaatatcactgtggcaaaggacaggctgcacaaagctcttcagacaacaaatactgtcagaagtttctctcatgtatggacacttaatcggacaaaatcctcgaaagaatctatgtgggagctagtcatatgaaggtctactcgtatacttccatggaaaagaaaaata

SEQ ID NO: 3953 - DNA, 282 bp, Zea mays
  misc_feature: Incyte ID No: 700347429H1
  unsure 15: a, t, c, g, or other
ccactttccactgcncctccgctgcccatcgccgtccccgaccgcagcgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaatcaaatacgagcttgacaagaaaactggactgatta

SEQ ID NO: 3954 - DNA, 284 bp, Zea mays
  misc_feature: Incyte ID No: 700347430H1
  unsure 151, 154, 156, 158: a, t, c, g, or other
ctgagctccttcgaagaagtggaaactctgttgaactccttgatgtttctagcgagctacctgaattggttcggcgtcctgggcttagcacttggaaggtacaagatcgagaatcttggtttcagagtcacgatgaagttccacacaatangangntnctagtacttccaagcatgtttcctgcaagtaatagaaccgaggaaagccataccgtgtgtggtgatgttgaagtgaacataaataatatgaaccaacttctcaagaaatatcaacatgaagaaaca

SEQ ID NO: 3955 - DNA, 280 bp, Zea mays
  misc_feature: Incyte ID No: 700347431H1
  unsure 178: a, t, c, g, or other
gttttccttcgaagcaagtcaatgtttccctgaattggttcattcaagatctgtgtccaaggatctacatggtgcaccacctggaagttttattcaccatttagcagtggttattggcagcattagttctgtgcacaagatggcatttttttggcagtcagttgttctgagttgaggncactatggtctgattggcaacctgtgcctcgtatgccactggaggttgctccagatttgaatctgtttactacatcaggaaatccaagttgtaaatgctgca

SEQ ID NO: 3956 - DNA, 194 bp, Zea mays
  misc_feature: Incyte ID No: 700347433H1
gttccaaatgaactgttggagcatgccaaagctgctgcccaggctgctcttgaggagatggatgccgactaagagacacgatgatttgcccagacttggtgttttcggtggtgttgatatctctgatccctttgggggggacccactaggggtaggcacatttcaaccgaaaaccgagccgaactggaatcaag

SEQ ID NO: 3957 - DNA, 109 bp, Zea mays
  misc_feature: Incyte ID No: 700347434H1
  unsure 3-6, 12, 45-47, 49, 52-53, 104: a, t, c, g, or other
aannnnaacgtnaaacccccaccacgccgtagcggatagaagagnnnanagnngcgcgcgatcgatgtcgggctccggcgatcgtcgcggcggcgggtctccangttct

SEQ ID NO: 3958 - DNA, 276 bp, Zea mays
  misc_feature: Incyte ID No: 700347435H1
  unsure 175, 273: a, t, c, g, or other
ggggaagcacgtcattggccttcaaatgggcagcaacagaggggcctcacaggctggcatgacaggctatgggcgaccccggcagatcatcagttagaaagggaaggccagctctgagctgcagcatcctgcttagcctgcctcacccacgcctatataggttcttagcccgganagctttgaggtatcactgggcaaagatgactgcacatgggcagtcccactatcctcagcctcagccccgcttttaccccagagccaccactgtctggncct

SEQ ID NO: 3959 - DNA, 274 bp, Zea mays
  misc_feature: Incyte ID No: 700347436H1
  unsure 271: a, t, c, g, or other
aaactaccaaagagctaataggcggcagatggagcttcaaacgcaagctctcggctcgcagtacacacagcatgagcattacaatgcgtcaccgagcacgtcatatggaagccaaccgctgacactggaagacttgtctcggcgtcatttccagcaagacttgcgcagcctttacgccctcaccctcgtgtcggtgtgctcggttcatgctgcagcaggagatcgcaaatggtctgggaactgcgggccgcatctgggtacagataggtgntgt

SEQ ID NO: 3960 - DNA, 235 bp, Zea mays
  misc_feature: Incyte ID No: 700347438H1
  unsure 56, 110: a, t, c, g, or other
cgcgtctcggcctggcttcctcctccttcaggaccgccgtgcaggagcggagtctncgccgcttctcctctccgccgtccgagaggctcgacccctgataccacgctganggcggtggtattaggagattagcgatggcgaggtggcggccggcggcgctgctggtagtggctctggcggcggttctatcggcggcgtggcgggcggatgcgctatcggttacgtgaccgacacc

SEQ ID NO: 3961 - DNA, 252 bp, Zea mays
  misc_feature: Incyte ID No: 700347439H1
  unsure 27, 60, 82, 132-134, 230: a, t, c, g, or other
gtttatgtgaacattcctatcaatccnaattccctctggagtttcatgttatgcctgttncaggcaaatgtaaagtctaganaataatgcaaatgtcacggctactctatatacttttgcttggttcatttnnnttcccttttagttaagcatgactttagatgggaagccgtgtatcgtggagaaacaagagaccaactttttcatccctgcccccatttcccagactngatttcagccaattcctttccg

SEQ ID NO: 3962 - DNA, 280 bp, Zea mays
  misc_feature: Incyte ID No: 700347440H1
  unsure 21, 50, 84, 207: a, t, c, g, or other
aaatttcccaaatccggtgcncccacaccggcatcctcacctcgtcagcnccgccggccttccttccattctccatccccgctncagtcggataggcgccggttggggaaaattctgttcggactgttcatcttgtcggcatgtctcattatcacagcgccgattttcgaagagatggaggatgagtacgacatgaacgagccagtngatgacatggagggggaggatgagtaccaagagctcgtgattagggactctgatgcggaggatgaagacgatc

SEQ ID NO: 3963 - DNA, 277 bp, Zea mays
  misc_feature: Incyte ID No: 700347441H1
  unsure 39: a, t, c, g, or other
gcgccacccgcacccaccaacgaggcaacgaaacccagnccggaagctagaccggcgacaagtgcagcgctcgccgcgatggaacctgactacggcgtgccgcgcgagctgtcggaggtgcagaagaagcgcgcgctctaccagcccgaggtgcccccctgcctccaggggactactgtcagggtggagtatggtgacgccgcaattgcagctgaccaggcaggcgctcatgtgatcagccatgcgttccctcacacctatgggcagccccttgcac

SEQ ID NO: 3964 - DNA, 259 bp, Zea mays
  misc_feature: Incyte ID No: 700347443H1
  unsure 214, 224-225, 229, 242: a, t, c, g, or other
actgcaggcatcggacgcgccccccgccgagaagctactgcgaatcccctccaaaattcggaggcgagagccactgatctatcgcaaaacccatcaaattacacaattcaaatgcagccaaccccacctacagccaccaattcgtgcgcatcaagtctagccccctaccccttcgcaatcagtgaacccccaatccacacacagcctgcaaatngctggatcanntttngtctcggactctngatccaccattccccga

SEQ ID NO: 3965 - DNA, 277 bp, Zea mays
  misc_feature: Incyte ID No: 700347445H1
gaaactgcgagagccggctgaagttgacgtcgctcctgttcaggccatcacgtcaagcaaccggtcacagatctatcttgccaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggtctcgatgatgttgtgaagcagtgcaggggcagg

SEQ ID NO: 3966 - DNA, 280 bp, Zea mays
  misc_feature: Incyte ID No: 700347447H1
  unsure 129, 138, 142, 149, 152, 155-156, 159, 163, 169, 175, 186, 205, 211: a, t, c, g, or other
cacgaggtttgcgcccctccccgctcgccatcggcccgtctcaacgcgcacgcaccctaccctctccacaaccaaccccagtaccccacgagatctgctcccatctcttcttctcccccatcgcacgangtttgcgcncctncccgctngcngtnngcntgtntcagcncctgancctccaccgcnaccgactccctctcttgcnaccganggaatttggatctaggagcccatgccactacagctctcccccgcccacgattagccctcggctcgggag

SEQ ID NO: 3967 - DNA, 246 bp, Zea mays
  misc_feature: Incyte ID No: 700347449H1
  unsure 8, 21-22, 87, 99, 102, 105, 108-109, 116, 121, 134, 167, 169, 173, 181,: a, t, c, g, or other
cccacggngaccatggccggnncgcaggagtccctctccctggtgggcacgatgcgcggccataacggcgaggtgacggcgatcgcnaccccgatcganagntgngcnntcatctntctcntcgcgggacaatnctgctggtgtgggacctgaccaacccggtccantncacnccggaatncggcgtcaccgcngactagggntannntttcannggtaaaagggaagtnnaantnttaanaanga

SEQ ID NO: 3968 - DNA, 288 bp, Zea mays
  misc_feature: Incyte ID No: 700347452H1
  unsure 240-241, 244, 250, 266, 268, 271, 279, 285, 287: a, t, c, g, or other
caaacatttcagtagaacggccattacctttgcttatgttcagccgttcactgtcgttggcttccgaactctgtactgatccatgccatcaatgaaggcagagcttgagcaggaaggttgtgcacgtgctgtccggcgtcctgttcatgtcatcttggcccctgttcaggtattccctgtccctggcatgcatcgaggttctcagattcataacgtttcacactgcaagccacaacaaanntgntttgcngaggaattcgaaaaancngtnttcgcggnggttcncnt

SEQ ID NO: 3969 - DNA, 298 bp, Zea mays
  misc_feature: Incyte ID No: 700347456H1
atttatttaatttacacacgacgatgatgagcgaattgaaataaaggataatggaggatggagcaggtacgtagctagcagtagctcccctgctattattcgaattaaatctgacgcaagtaaacaccgatagcatcgacgagcctggttcccgcccgcgcatagaatcccacgatgctgctgccgatgggcgccgtgacggagaaacgcgtcccgttctcgacaccccaggggccccaggttctgctgctggtgacgagcctgagcgaggtcagcgtagtggcaccttcaaatgcgc

SEQ ID NO: 3970 - DNA, 287 bp, Zea mays
  misc_feature: Incyte ID No: 700347457H1
  unsure 7, 221, 224, 229, 231-233, 237, 240-241, 245-246, 248-249, 253, 257, 260,: a, t, c, g, or other
gcgcggngcgcgggcttcgctcgtcgagagaggcgcgccgtccatggaggcgatggaggaggccaacaggacggcagtggagagctgccaccgggtgctggctctcctctccaacccgcacggccagctcgtccccagcagggagctcgtggccaccaccggggaggccgtagccaggttcggctcctggcggccaactctccagttccaacggcaatggnttnaggcnannngggnagnnagannannaccncccngcnggtttnaagnattttgnggggnaggng

SEQ ID NO: 3971 - DNA, 289 bp, Zea mays
  misc_feature: Incyte ID No: 700347458H1
  unsure 61, 73, 200, 202-203, 214, 216, 219, 228, 231, 236, 248, 250, 252-254,: a, t, c, g, or other
ctttccccctccactagggttccccgtcccgttccccctccggccgcatcagctgtttgangcggcaaccaanggccgcggaagcatctgcgtcgagccatggataaggggatcttcaccaacgatggctccttcatggagaggttcaagcagatgcagcaggaggcgcaggagaagaaggccgctgctgcctcggcttntnntcccaaaatcngnccnccccaaggnttnttttngggaaaaaaaanantnnntaaaaaaannnccnangaacanngatnnnnnttta

SEQ ID NO: 3972 - DNA, 292 bp, Zea mays
  misc_feature: Incyte ID No: 700347460H1
  unsure 84, 136, 197, 216, 261: a, t, c, g, or other
caaggggcaagtacaatattctctttgggttaacatctggtggaccctacaattacaatggaactagcaagtggctagaggttntgatcagcgtgtacgcgagagcattgactatgcaatttgcttgaacagtgtnggttccggagcaatgacctctggatgcatgtatcaaagcctccagaaaatccctatatcangcaaatctttgaagatttncggatgtctctaaagaaatgggtgtttcagttggaatcaagcacnagaagattaatgtctcaaatcctgagtagca

SEQ ID NO: 3973 - DNA, 293 bp, Zea mays
  misc_feature: Incyte ID No: 700347461H1
  unsure 68, 212, 219, 223, 225, 229, 241, 255, 257, 262-263, 267, 283, 291: a, t, c, g, or other
attgtagtcaaggacaaggatcttgtcaaggatgacttcattggccgtgttatatttgatctgaatgnggtcccaaagagagtgccacctgatagcccgttggctccacagtggtatcggttggaagaccgaaatgggcacaaggtgaagggggagttgatgttggctgtttggatgggcactcaagctgatgaagcattcccctgaagcangggattngaangnagcntcgtccctgttnatggcttgaaggcntnagatnnaaantgtatttactcaaagntttggtancc

SEQ ID NO: 3974 - DNA, 84 bp, Zea mays
  misc_feature: Incyte ID No: 700347462H1
  unsure 6, 23, 40, 44, 53, 66, 72, 77, 82-83: a, t, c, g, or other
ttcggnacgcaggctagcagcanagcaggcagccagagcncatncccctgctncctccgctaacgnttacgnttacntacgnng

SEQ ID NO: 3975 - DNA, 279 bp, Zea mays
  misc_feature: Incyte ID No: 700347464H1
  unsure 28, 60-89, 198, 217-218, 221, 236-241, 243, 249-250, 262, 265, 267, 275-276: a, t, c, g, or other
cagtcctcagttcctcacctagcggtangtggcgcgcggggagacgtagatggcggcttnnnnnnnnnnnnnnnnnnnnnnnnnnnnnntgacgccgacagaggggacggtgatcgcgatccacagcctggaggagtggagcatccagatcgaggaggccaacagcgccaagaagctggtggtgattgacttcactgnacatggtgtctcgtgccgnncanggcccaaattttggnnnnnncnaaaaannccccaaattttnttncnaaaaattnnggg

SEQ ID NO: 3976 - DNA, 287 bp, Zea mays
  misc_feature: Incyte ID No: 700347465H1
  unsure 22, 104-105, 210-211, 228, 244, 246-249, 255, 266, 269, 273: a, t, c, g, or other
cccacggcgaccatggccggcncgcaggagtccctctccctggtgggcacgatgcgcggccataacggcgaggtgacggcgatcgcgaccccgatcgacaactnngcctttcatcgtctcctcctcccgggacaagtccgtgctggtgtgggacctgaccaacccggtccactccaccccggaatccggcgtcaccgccgactacgggtnnccttcggcggttaaggnaattccatttgtcggnannnntcttanttcgagggcanttngaantttgccctgggggg

SEQ ID NO: 3977 - DNA, 263 bp, Zea mays
  misc_feature: Incyte ID No: 700347466H1
  unsure 13, 27, 44, 60, 69, 86, 119, 123, 139, 153, 220, 226, 234, 241, 243, 245,: a, t, c, g, or other
cagcagcggcagnagcatccgaagatngtgaagttcctcaagcncggcaaggccgttatnctcctccanggccgcttcgccggcangaaggcagttatcgtgcgcgtgttcgaggaggncacncgcgaccgcccctatngccactgcctcgtngcaggcctcgccaagtacccaaagaaggtgatccgcaaggactccgccaagaagactcgagaagtcncgagtnaatgcttnataaagntngnaanttcanaacnaagncc

SEQ ID NO: 3978 - DNA, 284 bp, Zea mays
  misc_feature: Incyte ID No: 700347469H1
agcgaacgctttgcaacaaattctgtcgaaatggctgatggaactagaaagacactaatattgcgagagattcctgaaggtgatgtgagatcgatactttctgacagagaatcattggcgccgtgtgatgtagcagtatttgtttacgatagctgtgatgaatattcatggcaaagagctagagactgctgtgcaagtggctacacatggagaaaatactggctacgaattccgtgctgatagttgctgcgaaagatgatctgaccaatctcacaagctctaca

SEQ ID NO: 3979 - DNA, 289 bp, Zea mays
  misc_feature: Incyte ID No: 700347471H1
  unsure 57, 80, 190, 200, 204, 208, 211, 222, 243, 252-253, 257, 260-261, 263, 265,: a, t, c, g, or other
atgcgctcacatggagactcccacacgaactcgaatcacctccgcctccgccacctncttcatcttcttccccagtagcngctgccaccaccactgcagcagccaaaccacgtgacacctcccgcgccgctcaaccccacagcatccgctgccaccgccgctcacctccccggcgctcccggctacaacnactgcaagcntagnaagnaanaaagggggganagaaggttgtttctagggganaagagttcnnaggngannangnaaaaaaacncnnncacnnggggng

SEQ ID NO: 3980 - DNA, 290 bp, Zea mays
  misc_feature: Incyte ID No: 700347473H1
  unsure 67, 208, 212, 234, 239, 242-245, 250, 252-255, 259-260, 262-263, 265,: a, t, c, g, or other
gccgccaaccaagcgacggctcctcttccacgcatcctagggcggcgacacctgccaagaacacccnccgccgcgctctcccgatggcgaccagcgatgagctcgcccagatcgacatctctaaggaggagaaggacaagctggtggcggaggtgatgcgctacgtgctcttcaagacgcaccagagctccgactggcccctcaagcnggangaactcacgggattatcccaanaattnccnnnnggggngnnnncccnntnntnannnggggnnanggnggnccccccc

SEQ ID NO: 3981 - DNA, 294 bp, Zea mays
  misc_feature: Incyte ID No: 700347474H1
  unsure 80, 95, 201-202, 205, 210-212, 214, 216, 218, 224, 228-229, 235, 239,: a, t, c, g, or other
ggcaaccgagagcccgagaccgcccaggcgcccaccactccaccagccaaccctagagcctctccagtactccactgctncggccgccgcctgcngcagcccgccgtccactggtcccgcctccctgcgtccgctccactactcctggcgtccgctccattgctaccatcgtccggcgttctgctcctgcgccctcccttnnatnggttnnnantnanagtgtngggnnattttnagtnatggaagcaagcaaggattgacgaagcgtgcgttccatggaacaaccatggnnaa

SEQ ID NO: 3982 - DNA, 289 bp, Zea mays
  misc_feature: Incyte ID No: 700347478H1
  unsure 44, 187: a, t, c, g, or other
agcgaccacagcgggagaagcagcactctagccgcctgtaagcnccaacctgggaggaagatgctaattaaagtgaagacgctgactggaaaggagattgagattgacatcgaacccacagacaaggtggaacgaatcaaggagcgtgtggaagaaaaagaaggaattcccccacaacagcagcggnccatctacagtggcaaacaaatgatgatgagaagacagcagtgttacagattctaggtggttccgtcctccactggtgttggctcttagaggaggtggtggc

SEQ ID NO: 3983 - DNA, 280 bp, Zea mays
  misc_feature: Incyte ID No: 700347479H1
  unsure 35, 170, 187, 197, 201, 203, 207-208, 216, 218, 222, 232-235, 237, 241,: a, t, c, g, or other
atcaagagcctcctgccacctctgggagtgaagangaacagcagcagcaggaacccacacaggcagagaatcaagagcctcctgccacctctgggagtgaagaggaacagcagcagcaggaacccacacaggcggagaatcaagagcctcctgccacctctgggagtgangaggaacacaagcagcnggatccacangggngnaatnnaaaccccnancccnttgggggaannnngnaatnccccngggggganaattgaanccccctntttgggngaaa

SEQ ID NO: 3984 - DNA, 286 bp, Zea mays
  misc_feature: Incyte ID No: 700347481H1
  unsure 98-126, 139, 250, 253-254, 261-262, 266-269, 271, 274, 276, 283, 285: a, t, c, g, or other
catccgcattccacgcgcactccgctgcctcactccgagactccgccgctgcttccaacttccgttgcgcacgagcgaaacatccggagctagcaagnnnnnnnnnnnnnnnnnnnnnnnnnnnnngcggggataaggncgactacgtcttcaaggtggtgctcatcggcgactccgctgtcggcaagtcgcagatccttgcgcgcttcgcccgcaacgagtttagcctcgactcgaagccacattgggncgnnttaaaannggannnntntantnaaaaaancng

SEQ ID NO: 3985 - DNA, 289 bp, Zea mays
  misc_feature: Incyte ID No: 700347482H1
  unsure 34, 128, 208: a, t, c, g, or other
cagtcagtcacagctcacagcaaacaccgcgaanccgcccccgctcccaaacccgaccgagcaaagcgcaaagccccccaaccgcggatcaatccgcagcatcgatggcgcccaaggcggagaaaaanccggcggcgaagaagcccgcggaggaggagcccgcgaccgagaaggcggagaaggctccggcagggaagaagccgaaggnagaaacgcctccccgcgggcaattcggcggccgcgagggcaagaagggcaagaagaaagccagaagagcgtggagacttaa

SEQ ID NO: 3986 - DNA, 282 bp, Zea mays
  misc_feature: Incyte ID No: 700347483H1
  unsure 68, 248-249, 277, 280: a, t, c, g, or other
gcgcttcaccagatttgagtgccttcgaagtgtacctgcatatgagaaggcgttgagggaagtttttnatacggtgtctagatcttatctatgccctagaacccgcaaaaagcgtataaatattgatcctgagtcactcaagcccaagttaccaagtaaaaaggatttgaggccatacccgaaaacttgttaccttgagttcaaggccatatgagtctgtgaaatccatttcggtcgaattacagggnntggcttgcatcggttcttgtgatggtanatncg

SEQ ID NO: 3987 - DNA, 279 bp, Zea mays
  misc_feature: Incyte ID No: 700347484H1
  unsure 50, 145, 149, 156, 166, 173, 182, 185, 188, 198-199, 201-202, 212, 225,: a, t, c, g, or other
ccactacctgcttctgctgcttgcttgcttgtgcggtggacgctgcgganggagcgcagaggtgaagaaggggatgaaggaggagatggtggtcgggctgtcggcgccggggccggtggggaggtggggcgccgcgccgccgcangatngctgganaggatgaagnactacgnccaggaggncgnctncgcgctctgnnannatctctcgcnccaaggacggganctcctcgtcgggacatcnagatntnactncanggntcaatcgantnncgccccc

SEQ ID NO: 3988 - DNA, 285 bp, Zea mays
  misc_feature: Incyte ID No: 700347485H1
  unsure 6, 26-27, 34, 60, 107, 128, 147, 155-156, 166, 179, 198, 241-242, 250, 252,: a, t, c, g, or other
ggctgnaggagctggcaaagtcaccnngtctgcncagagaagtacagaaggctaaatgantattatccctaacacctgccaccccagtcttaatcagtggtggaagnacggtctcagaactgtttgtntcaattggccatttaagtntaatagtnnaagacggttnatgataacaatgnatacgtagaaccttcaganggaaagaatgttttgtggaccattttttttgtgtgtggcagtnntaagttantngttttcnnaatcagtanttnttaaggnaacanc

SEQ ID NO: 3989 - DNA, 287 bp, Zea mays
  misc_feature: Incyte ID No: 700347486H1
  unsure 17, 34, 42, 44, 106, 136, 174, 286: a, t, c, g, or other
ccatgccgctaatcgangccgccgcctcggggtncgcgccgncncccaccccggcgagtggctcaactccgcttcttcagcactcgcagacccggaatcctatccntaactgccaccagctgctccccctcccctncgcccccggtcgctgcggaggtgcctgcggcgccacangaagcgaagtcgaagccgaggccacggcggtacccgaagcagtaccccggcgagtcggtgggcgttgctgaggagatgcgctttgtcgcaatgcgcctggtaacccaagcgnc

SEQ ID NO: 3990 - DNA, 223 bp, Zea mays
  misc_feature: Incyte ID No: 700347488H1
  unsure 6, 9, 12-13, 18-19, 21, 25, 29, 81, 85, 89, 94, 96, 102, 109, 123, 129,: a, t, c, g, or other
gcagcnttntgnntctgnnantggngatntgacatcaaatgttactctcagttcgtgcaccttctacatctgcgacttcancatnagtngttgngntcttgnaaaattnaatgaattctaganaagacnatgcaatgagcagcaacaacggtggtccanatagtggaggnaatgtggntattccgaaggngaactctacaagctcgctgcactcaaacnanct

SEQ ID NO: 3991 - DNA, 278 bp, Zea mays
  misc_feature: Incyte ID No: 700347491H1
  unsure 22, 149, 210, 213, 229, 231-234, 237, 239, 248-249, 252-253, 255, 257, 259,: a, t, c, g, or other
cttcacagcgtatcatcgtttnccatcgctcctactcctatcatccagaaaatctgagcggtattgatggcgcccaaggcggagaagaagccggcggcgaagaaggtggcggaggaggagccctcggagaaggcggctccggcggagancgcccccgcggggaagaagcccaaggcggagaagcggctacctgcgggcaagtccgccggnagnagggcggcaaaaggtngnnnnaanangccaaaaannggnngnancnaaatntnnntntggngggc

SEQ ID NO: 3992 - DNA, 282 bp, Zea mays
  misc_feature: Incyte ID No: 700347492H1
tgaaggccctgctggaactccatatgagaacggagtattcaggatgaagctattattgtcacgcgatttccctcaatctcccccaaaagggttcttcttgactaaaattttccatcctaacatagctactagtggtgagatatgtgtaaacacactgaagaaggattggaatccggccttggattaagacatgttcttctggttgtgagatgcctctgattgaaccattcctgaatctgcacttaatgaacaagctgggaagatgttacttgaaaattatga

SEQ ID NO: 3993 - DNA, 284 bp, Zea mays
  misc_feature: Incyte ID No: 700347494H1
  unsure 52, 189, 203, 209, 227, 240, 251, 254, 259, 264, 267, 278-279: a, t, c, g, or other
gggtaccagtcgtggggtccgctcttcggcaagctcttcttcgccttctggntgatcgttacacctgtacccgttcctcaagggtctcatgggtcggcagaaccgcaccccgaccatcgtggttgtactgggcgatcctgctggcgtcgatcttctccttgctgtgggttcgcatcgatccgttcaacnaccgggtaattggnccggantaccgaacgtgtggcatnaattgcaagggangttgaaggttntanaaacnaagantancagaatttgcnncccca

SEQ ID NO: 3994 - DNA, 148 bp, Zea mays
  misc_feature: Incyte ID No: 700347501H1
  unsure 133: a, t, c, g, or other
ccacagccggaaaagagaaagcaggagcaccaattcggcgcatagccaagccaaggaaatggcgcactaccaccccgtgtccgcggacacttaccaagacctcgaggctggcttctccggccactcctcttcncctctgaagccccgg

SEQ ID NO: 3995 - DNA, 120 bp, Zea mays
  misc_feature: Incyte ID No: 700347504H1
  unsure 11, 42, 49, 67, 119: a, t, c, g, or other
ctgctaatgcnccgcccacccagcgcagagactgcactgcanctcccancctgaggcctgcgtcggntctctggggacagtctcagtgctagtgccgttatttaaagaattctctccang

SEQ ID NO: 3996 - DNA, 114 bp, Zea mays
  misc_feature: Incyte ID No: 700347506H1
  unsure 15, 17-19, 21, 49, 54: a, t, c, g, or other
aagcttacgacgccnannntnggagacctgaaccacttgatcagtgcancaatngagtggagtgacttgctgcctccgtcttccctggacagctgaactcggacctgcgcaagt

SEQ ID NO: 3997 - DNA, 117 bp, Zea mays
  misc_feature: Incyte ID No: 700347507H1
  unsure 49, 64: a, t, c, g, or other
cgagaaaactcaaatcgaatccccaaatccttcgccggcgattccactnccaagttctgcgatnggaaaagcgcagaagagcaacggaatcccaattcccaaagggacaaggcaaag

SEQ ID NO: 3998 - DNA, 220 bp, Zea mays
  misc_feature: Incyte ID No: 700347508H1
  unsure 183: a, t, c, g, or other
cagagatcaactgaacaacctgttcaatgtttccttctattgcatatgtattctgttgtcatactatgtccaacaatgcatttatattgctacaatatgtttatacttgatgcatgtgatacaaatccgttatttatacatacaaagacaagctcttctgacaccataggggcgccgcggagncaccccttttttctagtaagttaacgtgcagttctga

SEQ ID NO: 3999 - DNA, 222 bp, Zea mays
  misc_feature: Incyte ID No: 700347509H1
gaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatt

SEQ ID NO: 4000 - DNA, 290 bp, Zea mays
  misc_feature: Incyte ID No: 700347510H1
  unsure 94: a, t, c, g, or other
gccaggcataacgactgatgaaattgataaagcagtgcaccaaatgataattgataatggagcatatccttcacctcttggttattgtggatanccaaagagtgtctgcacttcagtgaatgaatgcatctgtcatgggattccggattctcgtccccttgaggatggagatatcatcatattgatgttactgtctacctcaatgggctaaccatgggtgatacatctgctacatttctttgcgggtgatgttgatgacgagcctaagaaattaagttaaggtgaccagg

SEQ ID NO: 4001 - DNA, 292 bp, Zea mays
  misc_feature: Incyte ID No: 700347514H1
  unsure 13, 15, 271: a, t, c, g, or other
gaacgcagcgcangncggcggcgatagggagagaggagagagtctgcaggatccagcaggccgagggaggagtcagcggcgggccggagaatatgagcggcaacggcgcgaagaaggtggtcgatgcggcggtgaaggccggcaggacgatcatcgactgggacggcatggccaagttgcttcgtcaccgaacgaggcgcgcaaaggagttcgccgccctccgccgcgctttcgatgacgtcaaaccaccagctcccagaccaagttcctncccaggaaccccagccgattg

SEQ ID NO: 4002 - DNA, 221 bp, Zea mays
  misc_feature: Incyte ID No: 700347515H1
  unsure 186: a, t, c, g, or other
cgcacaccagcacggcagcacctgccctcctcgccgtcgctgcctccctccgcgcgaccgatctaccctccgccgccaccatgtcgctgatcgccggggaggacttccagcatatcctgcgtttgctgaacaccaacgtggatgggaagcagaagatcatgttcgccatgacctcaatcaagggtntcgggcgccgttctccaacatcgtctgcaagaagg

SEQ ID NO: 4003 - DNA, 225 bp, Zea mays
  misc_feature: Incyte ID No: 700347516H1
  unsure 84, 124: a, t, c, g, or other
gcaggatttgcctcagtagcccagggtatggaaggctgcgttcctagcaacaaagagacgggggcgtatggcatgccatcagcnaccaacaatccagatgcctctggtcagtccttcagcgaangtttgaagagctcgaggaagcctccgttgcagtacgatgcctccgaatctgcagactgtggcccaggtggtaagggcgcgaagaagaaaacgaagaaagga

SEQ ID NO: 4004 - DNA, 191 bp, Zea mays
  misc_feature: Incyte ID No: 700347521H1
  unsure 82: a, t, c, g, or other
tacgacgagaaccgccactcctcgaaatctccaaggattttctgcggcgaacccgtacgtttcctatcgctgttctcgcttnctcgcgggggaatcaaaccaaatcatccccttccccccatccgccccttggatttggaagcttcgtgacgtgacccaatgggagagggcttcgccgtcgaatcgccaag

SEQ ID NO: 4005 - DNA, 163 bp, Zea mays
  misc_feature: Incyte ID No: 700347522H1
  unsure 31, 87, 155: a, t, c, g, or other
cttctcttagcttagttgtgattgtgagacntgtgtgataaacttgtcttgaacttatgtttgttaaaaacttatgtttgagagttngtaatacttatgttggtaaaacttggtatgaacatagacatgtttatgaaaaacttgtgagatttgtncttttttg

SEQ ID NO: 4006 - DNA, 184 bp, Zea mays
  misc_feature: Incyte ID No: 700347523H1
  unsure 160: a, t, c, g, or other
gcggagggacttttgctcgctggacaagtacgtgtgggcgttcgtgaacaacaagccgctgtcgccgagctacaagtacagccggaagatcccggtgaagacgtccaagtcggagtccatcagcaaggacatggtccggcgcggcttccgcttcgtcggncccactgtcatccactcttcatgg

SEQ ID NO: 4007 - DNA, 185 bp, Zea mays
  misc_feature: Incyte ID No: 700347524H1
ggcctggaactggtagttcttccccaggttctgtcaagagaaaaacaactattcttggtcaaaagaataaaagattacggatggataatgaggaatcaatggagttgaagataacatgggaggaagctcaagaattgcttcgccctcctcctaaggccccatccattgttatgttgatggcccat

SEQ ID NO: 4008 - DNA, 243 bp, Zea mays
  misc_feature: Incyte ID No: 700347525H1
  unsure 224: a, t, c, g, or other
cccaatcagatccgatttcgtagagatgaagccggcagtagaggcggaggctgacgagcgagcggcggaggagatggcacctaagaaggcagcggctgccaagaaagcggccgaggaagttgaggtggaggaggtggtggacggggacgaggcggtcgatggggaggggcgacggtgacgaggacgacgatggggaaggccgtgacgaggaggtgattgatganggaagttggattggggaag

SEQ ID NO: 4009 - DNA, 280 bp, Zea mays
  misc_feature: Incyte ID No: 700347529H1
  unsure 226, 278: a, t, c, g, or other
cgttcccatctgcggcggggagtgagcacattgaggacggtctactcctcgttcgcgtgcggttcgtcccgagcgatccggcaaccatgaacatcttcaagaagaaggtcgaccccaaagaggctctcaggaccagcaaacgtgaaatggcggtcgccacgcggggagttgagagagagattggttcctgcaatggaggagaaaaagctggttgccagagataagnagattgccaagacttggaattgaaggttgcaaaccaaaatattagctcggcnac

SEQ ID NO: 4010 - DNA, 166 bp, Zea mays
  misc_feature: Incyte ID No: 700347530H1
  unsure 161, 164-165: a, t, c, g, or other
gtccacccacacgcaaggtccgcaggtcgcaacccgcgggcggaggggcaggcacaggaccgttgcgttgctgccgccgccagcacgagattcgaggagggatcccccgctctcacgccgctgccaggttcgaggggccgagcgagatggtgaacaccttnttnnt

SEQ ID NO: 4011 - DNA, 105 bp, Zea mays
  misc_feature: Incyte ID No: 700347533H1
  unsure 44, 98: a, t, c, g, or other
gctgatgcactgtacgcgcagtggctcgtgctacctgagaacancaagctggtaaagtctttgattgaggatgcaaagactggtgctgtgcttaatgntgctgga

SEQ ID NO: 4012 - DNA, 213 bp, Zea mays
  misc_feature: Incyte ID No: 700347536H1
  unsure 195, 210: a, t, c, g, or other
gatttgtgaaaaacgagcccttatacactgaggttgcagatggagtgtttgttggaggatggccttcttcggttgaacacctgccaccaggtgaccctgcaatcatagattgcacgtgtgagttgccaaaaagctcaactatatctaacaatgcatatctgtgtgttgctaactgggtacgaagggctctcaacnatcacaattgagttntgc

SEQ ID NO: 4013 - DNA, 158 bp, Zea mays
  misc_feature: Incyte ID No: 700347537H1
gagagaggaccgaggagggaaacagagaagatgacgacgaagcgcgacaccgagtcggacggcgaaggctccaaccccgttcggtggtggcgcgactccgccgcccctagccgccgcccctgtcgtatgcctcctccgctccgccggggatttcggtg

SEQ ID NO: 4014 - DNA, 274 bp, Zea mays
  misc_feature: Incyte ID No: 700347540H1
  unsure 76, 110, 206, 208, 217, 264: a, t, c, g, or other
ccactgagcagttctctcttctggcctggctcacttacccacactctcacgttcctcagcatggccacctgcagcngtcagttcacctcctccagctccatgaagagctnctgtggcatcggtggtggctctagccgcatgtcctccgtcctggctggaggatcctgccgggctcccagcacttatgggggcatgtcggtcactcntntcgcttctnctctggggcaagctgtggggattggaaggtggtataatgggggcttnagcagcagca

SEQ ID NO: 4015 - DNA, 278 bp, Zea mays
  misc_feature: Incyte ID No: 700347541H1
  unsure 32, 38, 125, 162, 236, 246, 248: a, t, c, g, or other
cgaaaatggtggaaccttgaagagtgcaagtncctgcntctcttctgaaagaagctatacatgtcattagttgtggttatgaagacaagactgattggggaaaagagattggctggatctatggntcagttacagaggatattctaactggtttcaagatgnatgtcatgggttggccggtcaattttactgcatacctaaacggctgcaattcaaaggttcgcagcctcctgaantctttcagancngtcttccaccaggtggcttcggtgggttcc

SEQ ID NO: 4016 - DNA, 272 bp, Zea mays
  misc_feature: Incyte ID No: 700347542H1
  unsure 205: a, t, c, g, or other
gagctccttcccatctcgatcgaaatggcgaagagaaacctcacgggaatatggaatttcactaaccccggcgtggtgagccacaacgagatactagagatgtacagagactacatcgatccaggcttctcctggaaaaacttcaacctggaggagcaggcaaaggtcatagtcgcaccgaggagcaacatgagcttgaccaganccaaactgaagagagagttcccggagcttttgtcgatcaaggaatccgctggtaaaatatgttttcg

SEQ ID NO: 4017 - DNA, 120 bp, Zea mays
  misc_feature: Incyte ID No: 700347543H1
attctcgatccaacaaccaggtcgttcagccgcagattagcaggccgcctgcgctcctcctttcccctcagcctcccctcctctccggtgtacgtctccgccgagatggccgccccgctc

SEQ ID NO: 4018 - DNA, 276 bp, Zea mays
  misc_feature: Incyte ID No: 700347544H1
  unsure 123, 220, 231, 250, 254: a, t, c, g, or other
atcgaaaacggagcgcctgatacgatagtagcagcacagctagctctcctccccagaatctcgccggattccgccccccgccgcgccctcgcttccgccgcagtagcgcgtctgtgcccgcgntgttgtactaccggcggacggcggtgttggtggtggttggtggagttgccgacgacggtaggctatggactaaccggccctccgacagcagcggaangatgatgaatnttccacaaatttccacaanaatnagtatcagaaggcaagccggag

SEQ ID NO: 4019 - DNA, 102 bp, Zea mays
  misc_feature: Incyte ID No: 700347545H1
  unsure 58-59, 79-80, 89-90, 94, 96-97, 99: a, t, c, g, or other
gacttctcgcttgcctgctccagatctcccttccgcagccggccagggaccccttcannagcggcgggagatggctgannccaggaggnnccantnncngtt

SEQ ID NO: 4020 - DNA, 276 bp, Zea mays
  misc_feature: Incyte ID No: 700347548H1
  unsure 70: a, t, c, g, or other
agctcttccaaagactgcagcgcctcagggcccaggtttcaacagattcttcaaaatgccatcccaaatnggagcatgccatggaaaccatgatgcttacatttcacaggtttgcaggggaaaaaaactacttgacaaaggaggacctgagagtgctcatggaaagggagttccctgggtttttggaaaattcaaaaggaccctctggctgtggacaaaataatgaaagacctggaccagtgccgagatggaaagtgggcttccagagctttctat

SEQ ID NO: 4021 - DNA, 310 bp, Zea mays
  misc_feature: Incyte ID No: 700347549H1
  unsure 109, 307, 309: a, t, c, g, or other
gctagttgagttttgtgatcagcgattcaggatcaaacttgataacgagagcctccctattgagcacatcacaaaaggagtcatgttccttgaccatgtgctgtgccgnccgagttgtgtacccaacactgcgttacactgctacaggaggcaagatcattagtgagaagggagttggtacactgctctcagtgacagctagtctgaagcagtgcatcaaacaattccggaagcttgagtttttgaaaggagaccgcgaaccagatccacaaccatgcttccgtatgttccacgccacacatctcanana

SEQ ID NO: 4022 - DNA, 304 bp, Zea mays
  misc_feature: Incyte ID No: 700347550H1
cactcctaccccacacagaagcggcggcggcggagcaaacgcaggcgaaggcgagggtgtgagggaaggagcaccagccatggtgcacgtcaacttctaccgcaactatggtaagacgttcaagaaaccaaggcgtccttatgagaaggagcgtcttgatgctgaactgaagctggtcggtgagtatgggctgaggtgcaagcgtgagtttggagggtccagtatgcatgagcaggatccgtaatgctgcaaggcacttgctcacccttgacgagaagaacccccgtcgtatctttgagggtga

SEQ ID NO: 4023 - DNA, 306 bp, Zea mays
  misc_feature: Incyte ID No: 700347553H1
  unsure 9, 23, 31, 49, 62, 66, 81, 84, 93, 95, 115, 223, 228: a, t, c, g, or other
cagagagcnagatgtgtgaatcngatcctanagaaatttctcaggccancccagcaacaaangcangccagggacccaagnaancctaccggncncgttcttcccagttctgagncaaggacgaaagcactgccctgcagtgggccgtcagaactgctcatcttcaccaacgcagagcctcccatttcctacagctgcaaccctttatactttgactttaaantttcnagaaacaaagatgctaaagtaaagggacagagaagccaaaagatgtcggagactcgtcaaagggtcatctccagagcc

SEQ ID NO: 4024 - DNA, 300 bp, Zea mays
  misc_feature: Incyte ID No: 700347554H1
  unsure 126, 182: a, t, c, g, or other
caacttctcagtgttctactacgagatcctcaactcccctgaccgtgcttgcaaccttgcaaagcaggcctttgatgaggcaatctccgaattagacagcctgggagaggagtctacaaggacagnactctgatcatgcagctcctgcgtgacaacttgaccctatggacttccgacacctncgaggacgccggagatgagatcaaggaagcagctgctgcccccaaagaatccgcccccgagggccagtaagacggatccgatctcccgacctgatgcgtgtctgctgatgtcggggat

SEQ ID NO: 4025 - DNA, 303 bp, Zea mays
  misc_feature: Incyte ID No: 700347555H1
  unsure 97, 138: a, t, c, g, or other
cctagtccgtgcacaggtgggcgcccgccgccacctgcggctcggtggactccggcatcgacacccctggcccccagcgccgcagatcgcaagcttntcagcaaaccacgtgcttggtaggaacccgtgccgaccgantctttctctgcgggacggtctcgagtttggtcgggagatgggtgacgggagctgctgcgtctgcaaggaggcgccgcccaagtacaagtgcccttcctgtcgcacgccttattgctctgtcacatgctttaaaaagcacaaagaggaatcttgtcaaaagatatt

SEQ ID NO: 4026 - DNA, 296 bp, Zea mays
  misc_feature: Incyte ID No: 700347558H1
  unsure 87: a, t, c, g, or other
actgggtgtacgtttccttggaaggccaatggttcgtccacagcgcgtggaacaaagcaaggcctcatgctttgatgttggagccantgttgatgcgtggtggcatggtggctggtgggagggaatcgtgctgtaccaggtgggcagtgggcgtctacaagtttattttccaggagaaaagcgaacagctgaatttggtgaagatgagctgaggtgttcccttgagtgggttggtaacaaatggaatcctttgaagggaagaaaagatgtcacaagcaagctgacctccatgcaga

SEQ ID NO: 4027 - DNA, 298 bp, Zea mays
  misc_feature: Incyte ID No: 700347561H1
  unsure 295: a, t, c, g, or other
cccgaccgccgatccatccaaatcacccttccccttccaccaccaccaggccgccgcctgcgtgtcctcaattctcctttcgaatttagaatccccgtgctgagagctgagtgctgccttggttgctccgtactggactcgattcctcatcgcagcagaagcatcccgtcccctccgcttctccttgctctgctctggtaacacacagacaaaaaaaaaatagcatcatgtcggaggtgaaggactccaatgtgcctgctgcacttgatggaaatcctcaacctatggaccaaantga

SEQ ID NO: 4028 - DNA, 295 bp, Zea mays
  misc_feature: Incyte ID No: 700347562H1
atgaagaggactatttcgggcatgttgggtctgcttccatctgatcagttccgtgtcattgtagaagctctttggaatcccttcttcaagttattggtatcttcaattatgactgggtatactctgcgaaatgctgaatacaggctgtcttttgaaagaaatcttgaactgtctgaagaagttgcagaatgcccaaagagtgatgtcattgaagataatcatcatgacatcaatttgggtacacctgtcactatttttagatagcagaagaagacatgccccaggaccctggaaa

SEQ ID NO: 4029 - DNA, 298 bp, Zea mays
  misc_feature: Incyte ID No: 700347564H1
gttcacagccaagcagaagctgaggtgcaggatattatggttcgtactagctgctcaatatctgaaattttagctcagaaaattaccagcaaagaacagccctcccaaaaaagcatagaagttggggatgagtgctttagaccttctcaagatatggattatgttatgatgtttgactccagcaaagatgagaatggaccaaatccagaaagattgacagctgaaggtgattgtggcgatcctcatgaacgtctggatttagtcacagtaggtgatatcggaaaattggttgtagaca

SEQ ID NO: 4030 - DNA, 300 bp, Zea mays
  misc_feature: Incyte ID No: 700347565H1
  unsure 2, 7-8, 29, 38, 44, 48, 75, 83, 89, 101, 120, 127, 142, 161, 268, 280, 285,: a, t, c, g, or other
gnagaannagaagttctctactcggcttnatctccgtntctgtnttgntggaggttaccatgttcttgacgagtntacaaaantacagnagtgacctgagnccaactgccaagcaactcnggaagcngtctattggtttgcntgaacttggtgtccttggngctcaagggattgttcccatgaaaactcgagatggaaaaggttcatcagacacctattgtgttgctaagtatgggtcaaaatgggtaaggacacggaccatcatgancaacccaatccnagatncatgaacagtncatt

SEQ ID NO: 4031 - DNA, 299 bp, Zea mays
  misc_feature: Incyte ID No: 700347566H1
  unsure 81: a, t, c, g, or other
agaagatggcagagaagaaccgcaaggatgccgaagattggttcttcaccaagacagaggagtgaaccgcgaagtggccancaacagcgaactggtgcagagcggcaagagcgagatctccgagctccggcgcacgatgcagaacctggagatcgagctgcagtcccagctcagcatgaaagcatccctggagaataacctggaggagaccaaaggccgttactgcatgcagctggcccagatccaggagatgatcggcagcgtggaggagcagctggctcagctgcgctgcgagatgg

SEQ ID NO: 4032 - DNA, 298 bp, Zea mays
  misc_feature: Incyte ID No: 700347567H1
  unsure 2, 26, 36, 59, 87, 90, 138, 143, 199, 271-272, 278, 284: a, t, c, g, or other
cncgcatcacctaccaacgccgacancatgggggcnttcgcgaaggaggagcaccagtnccctcgccgagctcggcctcgcgcaggnaancccgggcgcgttcgcatggggtgcgtggggcggctcaggtcccaccgnacacntccacgagcccgaccaacaatcaggtcatcgcagaggtcgtggaggcgtccgtgcncgactacgaggagggcatgcgcgcctgcttcgacgccgctaagacatggatggcgattctgctccaaagcgnngagagntcttangcaatcggtgatgc

SEQ ID NO: 4033 - DNA, 298 bp, Zea mays
  misc_feature: Incyte ID No: 700347568H1
  unsure 6, 30, 37, 55, 62, 85, 102, 109, 154, 172, 183, 222, 227, 257, 285: a, t, c, g, or other
accaanaggaagctgctagcagcaagcttntcaaacntaaagagtttaacctggnaaaattnggtataggtggattaagcgctgngattcactgagcatatntcgtagngcagtcgcttcaagagtctttccgcctcatgttgtcagtaagttnggcatcaaacatgttaanggtatattgcnatatggacctcctggtactggcaagactctaatggccanacaanttggaaagttactgaatggataagatcccnagattgtgaatggacctgaagttctgancaagtttgttgga

SEQ ID NO: 4034 - DNA, 296 bp, Zea mays
  misc_feature: Incyte ID No: 700347569H1
tggagatacccaagacaatgccatatgcaaaaggaatgcaaattgaagtttccaagttggaagacaattctgttgttgctggtcaccctgcagttgtcgccaaagactatctggaagaataacctattagtcgactacactctttcaaagtgttacggtactacattgtctgaggagattgttgatgtgaagcatgtgaggccttgcccaccacaagcatcagagattagtttctgcatcaatgatgaggttgaagcattccaaggtgattgctggtggctaggggtgattactaa

SEQ ID NO: 4035 - DNA, 267 bp, Zea mays
  misc_feature: Incyte ID No: 700347570H1
  unsure 21, 23, 33, 47, 52-53, 65, 71-73, 77-78, 91, 93, 115, 119-120, 123, 126,: a, t, c, g, or other
attacatagccgtataacacncncgagatgtanttctgctcagtgtntggcnnacattatcaggntgattnnntganncgtgtaggctgcnantttcagctcaacaagtgcagcntagnngancantcantcnccctgataatgngtaggctgcacttttcatctgaaatgtgtgtgcccaatcaatcagatgnttctgttggngtnccatgtcangngttgtngctnagtttctgtganaccggtgtgtggaggnttngatggaca

SEQ ID NO: 4036 - DNA, 294 bp, Zea mays
  misc_feature: Incyte ID No: 700347571H1
gacgcccaagaagtcagaggacagcagcccgctggggtcgatcagcaggctgaacgagcacggggccgagacccctgctccgctgaggcagaagtttaccaagacgacggcgctcaacggcaagcggaccctagcggtgaagagctccaccccgagctcctcatccaccaagaagaagctcaacacgaagctcatccacggcatcatggaggccatgccacagctggcgccatctacggcgcggtccgcgtccccgacggacatttcctgaggtctcggtatctccacgccgca

SEQ ID NO: 4037 - DNA, 293 bp, Zea mays
  misc_feature: Incyte ID No: 700347573H1
  unsure 60-61, 77-99: a, t, c, g, or other
gttgtgcgaagaaaccacggatctgctgcagaagttgtcgctggattcgcagcccaaggnngcgggtgcgacagagnnnnnnnnnnnnnnnnnnnnnnncaaggagggtgctgtgacaaaccagccgctgagtgtggccatcccgccagagcggtctatcacgccggtgcttcaggactttatggatcccaacctgttctatctaccagcgtattactatggaggctacgacagttccatgagcgagtgggatgattatccaagatatctaaattcagatggagtggagattg

SEQ ID NO: 4038 - DNA, 292 bp, Zea mays
  misc_feature: Incyte ID No: 700347574H1
  unsure 42, 47, 52, 56, 87-88, 97: a, t, c, g, or other
ggattcagttggtatcgtggccatttcgcatggttgccgtgncgttnctgcncgcncctgttcgtttggtgaatctagaaccaacannaggcatagngatcttgaaagatcgtccctcttggttccgtgattgccgaagtcttgaagtgtttacaaggtttccagctggaaatgggggaacaattgaacttatttacatgcagatgtatgccccaacaactttagtccctgcacgtgatttttggacactacgatacacgacaacaatggaagatggcagccttgtggtctg

SEQ ID NO: 4039 - DNA, 293 bp, Zea mays
  misc_feature: Incyte ID No: 700347576H1
  unsure 47: a, t, c, g, or other
cgccaccacagccgccagcagtccatcaccggttcacttcgaatggnccgcaagggacgcaaggctagggtttcgcgcgacgccgacgtcgacggcagcgaggatgagatggccgccgctcctgccgccgctgcgggcaggagcctctacgagatcttgggagttgagaagactgcttcacaacaagaaataaagaaggcatatcacaaattggctctgcgcctccatccagataagaatcctggggatgaggaagcgaaagagaagtttcagcagctgcagaaggttatatc

SEQ ID NO: 4040 - DNA, 291 bp, Zea mays
  misc_feature: Incyte ID No: 700347577H1
  unsure 135: a, t, c, g, or other
ccttcctctccccactccgaaccctagccaccgtgctcacttcccagctcgaacccgccgcgggcgagtccacggcagtgcaggacctgatcctgcggtctaggccgcggcggtgagatggtgatggtgtcaggnggcggagggaacgcgtgggcgaaggagatgaccctccgccgcaggatagccagcatattcaacaagacgcaggaacacttccctactctgaaggactacaacgattatctggaagaagttgaggacatgactttcaacctgatcgaagggatagat

SEQ ID NO: 4041 - DNA, 292 bp, Zea mays
  misc_feature: Incyte ID No: 700347579H1
cctcttccaccaccaagctcccgtctcttcccctcctgatctcagtgactccatcctctccctctccagatccccgccagctgttacctctccggctcatcgtcctcaggccaaggtcttgattcgcgatccgccgatttccatccagcgcttagggcgctaagcggtgtcccatcacctgcgggttttgctgtgcggggaggctgatccggcgagcgccttggatgaattcgcgtcggtctcggtcggtgaagctggtgtcagcacgcgccaacggggatgtgttccaggg

SEQ ID NO: 4042 - DNA, 292 bp, Zea mays
  misc_feature: Incyte ID No: 700347580H1
  unsure 3, 6, 8, 24, 27, 52, 132, 143, 155, 174: a, t, c, g, or other
tanccntntaacttcccctccgtngcnttcgctccgcatccatccgaccgtngcgagcttcaactgcgcgcaccggccaggaggctaaaccctaccgtgcgccgccatggactcggcggtgctctcactcanctgcgcgggcntcggcgcctcgnaggaggacgaggacggggncgtcatcggctacgccaagaggaccactgcttagataatctgaaggatctgcagagattcctgcgacgggacgacccgcagcggcggaaggttttcaagcagtctgcaagtggaagat

SEQ ID NO: 4043 - DNA, 296 bp, Zea mays
  misc_feature: Incyte ID No: 700347581H1
  unsure 72: a, t, c, g, or other
gagccaccggaagcggagacgtgagcactcgaccaaccccgtcgatccggctgcggcgcggcgtgctagatncgcttaccgaccatggtggtggaggagatcgccgagggggtgaagaacctaaccgtcaccggagatgcggcggcttcaggcggagaggggcagaggaggggcggcggcggcagcagcaaccgcatccaggtgtccaacaccaagaaacccctcttcttctacgtcaacctcgccaagaggtatatgcaacagcacggcgatgtagagtatccgctcttgggatg

SEQ ID NO: 4044 - DNA, 283 bp, Zea mays
  misc_feature: Incyte ID No: 700347582H1
  unsure 18: a, t, c, g, or other
gcacgtacggtctcaggngcatcggcctcgccgctgcacaacgccggagacgagacgacggcggctgcgggatgacgtcttccacttcctcaactgcgccttcctcaccttcggccctcacgtcgtctactactccgccacgcccctgtcagagtatgatacaatcggcacttctataaaagcagctgctgtttatcttggaactgcgcttgtaaagcttgtttgcttggcaacattgctcaaagtacctgagaatgatagctttgacccctatcaggagtta

SEQ ID NO: 4045 - DNA, 288 bp, Zea mays
  misc_feature: Incyte ID No: 700347583H1
  unsure 8, 62, 82, 85, 95, 162, 274, 280, 284: a, t, c, g, or other
aagcatcntgctgcaggcacagcagcaggtgcaaatgcagaaactcgtataccaagtcggangtgccctgccgacaaaagtngtntgcctgacanaggtagtgacagcagatgaactgagagatgatgaggaatacaatgacattgtggaggacatgagggngaaggacgcaaatatgtcccacataatgccattgcagagtgttttatagtccgaccctatgcaatattggcaatcgggctttaacccacagaagacactattcttttgagtntgattntcanatat

SEQ ID NO: 4046 - DNA, 291 bp, Zea mays
  misc_feature: Incyte ID No: 700347586H1
  unsure 92, 102, 117, 131, 165, 240: a, t, c, g, or other
ggttttttgattttagccgccgccgctgctcatctcacatccctcgagaagacgcctgctcctcgccgatcgatacgatggccgtcttctcngacgtccaanaccgccgacggcctnaagtccctcgaggntcacctcgccggcaaaacctatgtgtctggtgantccattactaaggatgacattaaggtcttcgccgcggtgccgtcgaagcctggcgctgagtttcctaatgccgcncgctggtacgagaccgtctctgcggctgtagcctcaagattccctggtaag

SEQ ID NO: 4047 - DNA, 288 bp, Zea mays
  misc_feature: Incyte ID No: 700347589H1
  unsure 250: a, t, c, g, or other
gtcctctcgcatccgcagcttccccagccagctagggtttgcagatgacgaccgcggcgcgccccacctgggcgccggccaagggcggcaacgagcaggggggcacccgcatcttcggcccctcccagaagttctcctcccgcgacctcgccgcgcacacctccctcaagccaagaaaagacggtcaacagacccaagaggagttacagaagaggaatctcagggaggaattgaggaacgtgagcgcaanactactcttccaaggataagtcctatgccgaagaaaga

SEQ ID NO: 4048 - DNA, 287 bp, Zea mays
  misc_feature: Incyte ID No: 700347590H1
  unsure 40: a, t, c, g, or other
gcaggcggctcggaaggggcacggtggagacgcagcgganccctcgcctcttctcctgctcctgctgcccggtactcgccgagggagacgctgctgacctgacgagctgagcccacggacgagaggggagacgagaaggaggggcacaccacgcaggagaccggaggagagcgcgcgcgcggatccacctcgatgttggcaagaccatcagcaccgcctttggtgactgctcaaactcctgaagtcggcatcttcattacagctcgcaacgtctcgggtgcactggt

SEQ ID NO: 4049 - DNA, 286 bp, Zea mays
  misc_feature: Incyte ID No: 700347592H1
  unsure 4, 17, 27, 33-35, 39, 46, 58, 67, 69, 76, 80, 97, 107, 123, 127, 242, 246,: a, t, c, g, or other
ctcncctcctctccttncacaaccgtncatcgnnnctcnctccggnctgcgctcccanagcctcacncntgcgtcnccgntcgattcgcgtcgcccnttgttggaangaacgatggagcagancttnatcatgatcaagcccgacggcgtccagcggggcctgatcggggacatcatcagtcgcttcgagaagaaagggttctacctcaaggggatgaattcatgaacgtggagaggtcttngcgnaaagcaactaggctgacntttcgganaggctttcttcccg

SEQ ID NO: 4050 - DNA, 287 bp, Zea mays
  misc_feature: Incyte ID No: 700347596H1
gccacaagtctgtgatgcgcaaggagttccgcaagatggccaaggctgtgaaaaaccaggttagtgacaactactacaggcctgatctgaccaagccagctcttgctaggctaagctcggtgtaccgcagcctccaggttgccaagtccggtgtcaagaagaagaacaggcagtcctaagcgctaagtttgtgttctgtcagggggcatgttggtgctcgtagtcccagcttatatttatctatgttccaacagttttgagacttgttagaactgagcaaccatgtt

SEQ ID NO: 4051 - DNA, 174 bp, Zea mays
  misc_feature: Incyte ID No: 700347601H1
  unsure 83: a, t, c, g, or other
ctttcagttatctgcaccgccactggtgtcctcattgcagcacttggagatttttcctttgacctatatggatactgcatggntctaacatcagtgcttcttccaggttgtgttatttccttgtgctttgttcttacaaatttattctatatgcttgagaggtttttaggcaag

SEQ ID NO: 4052 - DNA, 173 bp, Zea mays
  misc_feature: Incyte ID No: 700347602H1
  unsure 37, 49-50, 147: a, t, c, g, or other
cagggactgtacttctgatccttcacctatgggtgcnttcgccagctgnntgccttgccagtctgatcctgttccccccagcaggctcttcagctgctccaatccagctatggttcccaaatgacattgcccctcctctcactcggncccatcttgctgctgtcgttcttgtg

SEQ ID NO: 4053 - DNA, 314 bp, Zea mays
  misc_feature: Incyte ID No: 700347603H1
gataagggcgacctccaggcccttgcgaaccctagcgccgcaccctcccgcccaccgccgtcgccgcccaaccgcagtaaggaggaaggagcaggaagatgccggcggggcacgggctgcggtcgcggacccgcgacctgttcgcgcggcccttccgcaagaaggggtacatcccactcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatc

SEQ ID NO: 4054 - DNA, 312 bp, Zea mays
  misc_feature: Incyte ID No: 700347604H1
  unsure 28, 217: a, t, c, g, or other
caatacataccttgccagtaccaatctngtgaatgacagaaacacaaagcatatttattttctgatggactgcctggtagagctgtattctcttgatgttcagaaatcatatgagagggcaataatctccgtggagcaactgaatgctattcttagacaggcttctaaaaccaaggaaaaggaagatctcaggaagatagataactggcaatatatnagttgtgtcaacctatgggttcggtttctgtgttgtcactataaggattacaatctccatcccttattttctcaagttcttcaagtaataagagg

SEQ ID NO: 4055 - DNA, 307 bp, Zea mays
  misc_feature: Incyte ID No: 700347608H1
  unsure 49, 277: a, t, c, g, or other
gagttttgctcttaggagtcttattttgctttgattcaagcgatagggnacaaatgtgtttgtaatcgatctgaaactgtcaattatgctgaacttcagtttactcattttgtcttcccttctgctaagtgaacaaatctgtattttctgttcaaattggactctgtctgacgcttgcttaatatatagtctcaaatttcctggcgagaacttcatgaggaaagccacagcaggtgttgagtgaaacaggagaactaacaaggtgataactgacaanggccagcagatgtggcacatatgaggtagt

SEQ ID NO: 4056 - DNA, 252 bp, Zea mays
  misc_feature: Incyte ID No: 700347609H1
  unsure 193: a, t, c, g, or other
ggaggaggggagctctgatcgattcacccaagatgtctgaggtggtggcgatggcggggcaggcctacatgaagcagctgcaggcccacccgctgcgcaccaaggctatcacctccggcgtcctggccggctgcagcgacgccgtcgttcagaagatctccggtgtttccaagctccaactcaggaggctccncctcatcgcgctatatggatttgcatacgcgggaccgtttggacattctccacaagctc

SEQ ID NO: 4057 - DNA, 132 bp, Zea mays
  misc_feature: Incyte ID No: 700347611H1
  unsure 31, 43-45: a, t, c, g, or other
aaaggaatgataataaagttacttgctttanaaagaaccaagnnnaaattcacaacatatgtgaaacacaaacagctgtgaattttccttggttctttttaaaggaatgataataaagttacttgctttagg

SEQ ID NO: 4058 - DNA, 135 bp, Zea mays
  misc_feature: Incyte ID No: 700347612H1
  unsure 19, 23, 78: a, t, c, g, or other
ccgccgcgccgtggctgcnaagntctcgtcgccgtcggtcatcggcaccgccatgccgtcgctcgacttcgagacctnccgtcttcaagaaggaaaaggtgtccctggccggccatgaggagtatattgtgaggg

SEQ ID NO: 4059 - DNA, 306 bp, Zea mays
  misc_feature: Incyte ID No: 700347613H1
atggaatctgctggtatcgatgccgctttgatgggtaaaccaaatcgtgagcctcgtgttgttgtacaaactgttagtgaagttgatatcttggacgatgggtatcgttggcgcaaatatgggcagaaagtagtgaaaggaaatcccaacccacggagttactacaagtgcacaaatacaggatgcccggtcaggaagcatgttgagagagcatcacatgacccgaatcggtgatcacaacatatgaaggaaaacataaccatgaagtccctgttttccagaatgcaagccatgagatgtccacag

SEQ ID NO: 4060 - DNA, 245 bp, Zea mays
  misc_feature: Incyte ID No: 700347617H1
  unsure 33: a, t, c, g, or other
ctccgccacctcgccactcgcctcttctcgctntcgccaccgggccagggaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaagat

SEQ ID NO: 4061 - DNA, 251 bp, Zea mays
  misc_feature: Incyte ID No: 700347620H1
  unsure 22: a, t, c, g, or other
gtgactttgagtctggtcctgntgattgggaacagccagggggaggagaattaagagttcttgatatagagtaagccagagaggggggcgggaggaggggctcagtgagtggagctggggtgaactggggaagataagcagagcatgtagttgaacacttagactcaaacacacaggccaccttgctgaatcagggacctttctcctgaacttggaacctgctggagactgtgcatggtccaaatgaataa

SEQ ID NO: 4062 - DNA, 312 bp, Zea mays
  misc_feature: Incyte ID No: 700347621H1
  unsure 37, 56, 71, 200, 299: a, t, c, g, or other
cagcaagcagccgttccccccaaaaaggccagagctncagcagagccccgcaggcntcaaccgccgcaccnaccagaaaccccagtcgatcggcggcggcgatgtcgctgtcctcggtgaagatcggcgaggaggtttggctcacatgcctctcccacgccctcactaccgagaccgaggaggtcatgggcctcctcctncggcgacattcgagctttccagcaagggcgccaccgcccttatatggggagcgtctccgcagatgaggtgcgagcggaagaaggaccgcgtcgaggtcnacccggagttctc

SEQ ID NO: 4063 - DNA, 303 bp, Zea mays
  misc_feature: Incyte ID No: 700347623H1
  unsure 73, 85, 88, 98, 101, 116, 119, 279: a, t, c, g, or other
tactaagacaccagacatcacatccattgctcccattcccactattgctgaaggcgatgagtctgtatttgtnaactcccaattncanacagctcganggngcctcctgttctggngancaatgctgttgatcctcactgatgggctgacagatttggaatcctatatgaggtttcttatggatggcggtgcaagtgattcaattgatagccttctgaacctgatggatcacaggatcttggtagcatatggacctctgggaccttcgatgacatgccnatcgctggcgattcttctgaggaa

SEQ ID NO: 4064 - DNA, 302 bp, Zea mays
  misc_feature: Incyte ID No: 700347624H1
  unsure 280, 299, 301: a, t, c, g, or other
ggaggataagaagtgtaaaggtgaatctagattcccagcgcaggtgaggatctgcattaggaagctgtgcaagccgttggaagaggattccttcaggccagttttgcaccattatgatgggccaaagttgcgccttgagctctccatcgcggagacattgtcactgctagacctatgcgggaaggaaggcatctgagctgtcgaggaggtggtggtggttgcctgtgagcttctagtaaataccaatcatctttgtatgttttgtggatggtggttggcnacgttgtttattatgcgcnant

SEQ ID NO: 4065 - DNA, 169 bp, Zea mays
  misc_feature: Incyte ID No: 700347626H1
  unsure 18, 57, 85, 96, 109, 126, 135, 141, 146, 167: a, t, c, g, or other
gaactgcaaatgtccgangtaccagacatcggtacctctggcatgaatgaagagaancggcgatgactatattagagaatggganagtgaataatnggtcgatctgtanttaacaacttgtattgncgacatcgnaggcanattantcagggctaagatatggggtnct

SEQ ID NO: 4066 - DNA, 304 bp, Zea mays
  misc_feature: Incyte ID No: 700347630H1
  unsure 2, 188: a, t, c, g, or other
cnggcctcatcccgcacaccgtgtagaccaccggagcaccgaaccgtgagaataccgaagagggtgagctatccatggacagtccaggaacgccattctccggagcatgacaatcggaagagaaaggacgcgcatgagcaccggaactatgatcgtgatgaaagggaccttaaaaggctaaggtcatnagcgtcacacattctgtgggagtctcgtgttgtttgggctgtaacatgacgttgatatgctattggtgtgctgggggatttggactgttatattgatatgattatttggtgtgctg

SEQ ID NO: 4067 - DNA, 304 bp, Zea mays
  misc_feature: Incyte ID No: 700347631H1
  unsure 43-44, 158-160, 195: a, t, c, g, or other
gagagaaggagatgatgtcgagggagcgcaagaaggcggctgnncttcaggagaagctgaagatcctccgctccatcactcactcccacgctctgagcaacacgtcgataatcatggacgcgtcggcgtacatcaaggagctgaagcagaaggtggtnnnggctgaaccaggagattgcgtgcgcgcaggacgcnctgagacacaaggcatcatcctatcccacggtgaccgtggaagccctaggagtgcaggggtcgtcgttcctggtgaacgtgttctccgacaagagtgcccggggctgtt

SEQ ID NO: 4068 - DNA, 191 bp, Zea mays
  misc_feature: Incyte ID No: 700347632H1
  unsure 27, 37, 44, 62, 77, 79, 90, 94, 129-130, 174, 179, 182: a, t, c, g, or other
aacctctcctcactcactccgtccgangcccttcgtnaccagcntccttcctcgcgccgacngccgggatccggggncnccgtctacgcncgcntcggtctagatctctgagaaaatggcgagaagtgnnttagtaggaggcatgtggctcatcggatcaagtccacccatccnattcnttnataccgatg

SEQ ID NO: 4069 - DNA, 308 bp, Zea mays
  misc_feature: Incyte ID No: 700347633H1
  unsure 42, 70, 188, 247: a, t, c, g, or other
gttacaggtctggccgtgcgtccccatggtcaagccaggacnaccacatccacatggtcggcagccgacncagccaagaagcctaagaacacggggtactatgccgaagggtgtccgagagcatgctcggaagcaggaacgagagcagcagtgccatcaggcgtgagcaagaagaggtggtagagttnctgcagctcgttagaaaaggacggcgtgtctcaggggatctgagctgttcttcatagtnaactgagctgtttaggtcgccgatccgacgcgcggcatttaggtgcatcaccacttccgaa

SEQ ID NO: 4070 - DNA, 298 bp, Zea mays
  misc_feature: Incyte ID No: 700347635H1
  unsure 28, 64, 186, 293: a, t, c, g, or other
acgtcctcatcttaatctcccagttttnccctccaatcacccccaggtcttcctctcgcgagtngcggtctcgcggccccctccgccgaccgccgcctcctcacaaccgcggaagctgcttccctctccattggacgcggccagcttccatctctcggtcacctccctctacatcccacggccgcnaccaccttccctctacctcacacggccgccggctctccaaggtctgcacagcattcagcgacgcatttgcctatatcagcatgtggtcataactctaggagagaaangagaa

SEQ ID NO: 4071 - DNA, 187 bp, Zea mays
  misc_feature: Incyte ID No: 700347636H1
  unsure 49, 60-61, 75, 101, 120, 138: a, t, c, g, or other
ccatttcaacttggcttacaagacgccacatcacctatcatagaagaanttacaaacttnncatgaccacacccnaataattgtattcctcatcagctccntaggcactttatattattncactaatactaacaacanaactaacacacacaagcacaatagacgcccaagaagtagagacaatttg

SEQ ID NO: 4072 - DNA, 295 bp, Zea mays
  misc_feature: Incyte ID No: 700347639H1
  unsure 242, 283: a, t, c, g, or other
caacaaacttgctcgctggactgcccaggctttgcttgctggtgctgccatcatgaagttgggctatgtgtcacgggtgaacccccgtgatcagtacaaccattctgtgctcactgtgatgggatacaagccaagggattttgctgcacattcaacctcaacactgcaaacatgtggggaatcgtcaagtcaattgtggacatctgcatgaagtttgaagagggcaagtatgtgtttgtcanagatccagcaaagcccacagttgaggatctatgaggtaccnctgatgcgtttg

SEQ ID NO: 4073 - DNA, 294 bp, Zea mays
  misc_feature: Incyte ID No: 700347644H1
  unsure 189: a, t, c, g, or other
accaggccaagctgtcggtcgtgcgttcacaaatatatttaaatcttccgccatgaaattatttaaatcttacagttcaggcaccagctaagcctaagatgctgagtttccatatgtgataatgttggactgtcttgttcatatcggtgtggcatatcattatgcttgaggtggtggtatgtaccttcnattaggtaggcctcttgacaacttatgtctcagcaggatggctccctctagaattcatgtaacatgtgcattagtttatgggccttcaccaacaggaaggatcca

SEQ ID NO: 4074 - DNA, 218 bp, Zea mays
  misc_feature: Incyte ID No: 700347645H1
  unsure 52, 77, 173, 210-212, 214: a, t, c, g, or other
ccctgctccagcaccagcactagcatcagcgattccatacacgggagtctcncccttcatatccaccggtttcagcntatcctggtgcaaccgcataccctgcttacccaacttctagccatgcaccatataccactgctgaatatccaccacctccgcagcaaccataccancccccacctgctggataccctccatcctatccaccannncnatat

SEQ ID NO: 4075 - DNA, 297 bp, Zea mays
  misc_feature: Incyte ID No: 700347648H1
agaggacacgtcgaatgctcggcatcacaaactagatgacgcacaagaagacactggaaccaacttggatgatgaggaagcagcagcgttgcaagagcaagtcaggcagataaaggcgcaggaggaagagtttgaaacattcaatcttaagattgtgcatagaaaaaacagaactggctttgaagaagacaaaaacttccatgttgttctcaattctgtcattgctgggcgttatcatgtatcagagtatttgggttcagctgcattcagcaaagccatccaagcacatgatttact

SEQ ID NO: 4076 - DNA, 309 bp, Zea mays
  misc_feature: Incyte ID No: 700347649H1
  unsure 44, 130-150: a, t, c, g, or other
ctctcgtgcgagtgacatctaggtttccagacgccttcggtgantacagggaaggaagtcgccatggctgacgacgaacaggcggagaagaaggaggaggtccccgagcttgctccttttgacccaaccnnnnnnnnnnnnnnnnnnnnngtggtaatacaagagccatcagatgaggtggataacttggcagagaagacagagagcttgactgtaaccgagtctagtgagccaagctttgcgggcatgaaaaagagaagaagaacatgtggacttgattcttctcttaccgagaccggagatgttgat

SEQ ID NO: 4077 - DNA, 305 bp, Zea mays
  misc_feature: Incyte ID No: 700347650H1
  unsure 179-181, 267: a, t, c, g, or other
tcacatgacagtggttcctcgaaatctcgagaaagggaccgagaacgcgataagggcaaggatagggagcgtgacagggatcgtggccgagaaaaggggagggaccgagacagggataaggatcgtgaaagaagtgacagagatcgcgatcgccaccacagggaccatcgagagcgcannngaaaagggaacaccgtgatcgttctgatgatcgtgaccgtcaccgtgatggtcgtgaccgccaccgtgatgatctgattctgagangagaagagatcgtgacagagatggtcatcgtagcatcg

SEQ ID NO: 4078 - DNA, 305 bp, Zea mays
  misc_feature: Incyte ID No: 700347651H1
  unsure 99, 154: a, t, c, g, or other
gcctccgctccgcctcagcgcatcgccctccgccacagcgtaccgcgacctcatcgatcaccttcaactttcaattcatggcggacgtcgatgtcgaancggagttgccgccggcgctcccaagaagaggacgttccgcaagtacagctaccgngcgtcgacctagatgcgcttctcgacatgtccacggacgacctcgtccagctcttccccgcgcgcgccaggagaaggttccagaggggtctgaagaggaagcccatggcactcatcaagaagtgcgcaagcgaaaaaggatgctcctgctg

SEQ ID NO: 4079 - DNA, 306 bp, Zea mays
  misc_feature: Incyte ID No: 700347652H1
  unsure 13: a, t, c, g, or other
gcccacctccgcnccgctgcgtccgccaagacgctactgctcctcccgcgcagagcggccggtcctcctccagcttccgcctccgcctccgcctcggctgagttcccaggatccgttccagacagcgctcagatggcgccccgacggcggcggcgcggagcgtggccggcatcgaccaggacgaactcctcgatcccgaggccctcgcggaccccgacagcggcttctacgagatcaacggcgtgaggctgcaccacaaggtctgcagccacgaggatgaggactcgtccagcgaccagtccaccg

SEQ ID NO: 4080 - DNA, 111 bp, Zea mays
  misc_feature: Incyte ID No: 700347653H1
gcattcttttcttttaattacactagaagatgattttggtaggattcttatagaatctatctatcctatctatgcaccgagcgtttttaaccttttcacgctcgattttac

SEQ ID NO: 4081 - DNA, 301 bp, Zea mays
  misc_feature: Incyte ID No: 700347655H1
acttgacaaccagcgtaatgaactaatccaactccagcttacactgaccattgcatcctttggcatagctgccaacactttcattgttggagcttttgcaatgaacatcccgagctctctgtacaacaccgataacaccctcttctggccatttgtcgggggcacctcatccggctgctttgtgatcaccatcctcttgtttgggtatgcctggtggaagaagttgctgggtccttgaacacgaaacaagatggcagagggccttgtcatgtttgcagaaagggagcaggcgctcgaagat

SEQ ID NO: 4082 - DNA, 220 bp, Zea mays
  misc_feature: Incyte ID No: 700347656H1
cacaaaacttaatatttgattcatcaatgcaaccggttattcctacaaatgaaactgcgaagggtgcatcatccaaaaacatatccgtttcacatactgtttcatctggtgttcttcccagcctggcaccttctattgtttcttctccaatagcagttgtgagtgatggaaaacagaaggctgcttctagctctaagcgtggcacaacatcacaaaagtc

SEQ ID NO: 4083 - DNA, 300 bp, Zea mays
  misc_feature: Incyte ID No: 700347659H1
  unsure 18, 20, 88, 282, 287: a, t, c, g, or other
ctcgttcctgtcgcgcancncgacctccacttcacatctcccccggcggcggcgcggtcagttgaacaatggcggactccaaggccanctcggcggtcatcctccgcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaaggacccaaacaccatctttgtcttcaagttccgcacccattcggatnagganagtccactggttt

SEQ ID NO: 4084 - DNA, 227 bp, Zea mays
  misc_feature: Incyte ID No: 700347662H1
ggccattgctattcttggtttcaatgagatcatggtgcttattaggaatcccatttatctgttcttgctatttgtgggctacttgatggtcaaagctttggcgatgcagctagatgtcagcagagaattccagaatggagtggttcctggaataatctctgtgtcggtgaagctcctaccagcgatacagaacctggtgaacaaagtggcagccgagcagcaagctg

SEQ ID NO: 4085 - DNA, 302 bp, Zea mays
  misc_feature: Incyte ID No: 700347664H1
  unsure 2, 27, 106, 120, 130, 162, 189, 287: a, t, c, g, or other
anctcctcaacctccagcccaaccgcncagcccggaatcgagagcaatggcgctcgccaaggccaaggagatcgttgcctccgctcccctcgtcgtcttcagcaanacttcctgtccttnctgcgtccgngtgaagcagttgttcgagaagctcggagcaanctacaaggccattgagttggataaggncagtgatggagctgagctccagaatgccctgaaggagtggactggacagaggactgtcccaaatgtcttcatcaatgggaagcatattggcggctgtnatgatactatggcat

SEQ ID NO: 4086 - DNA, 294 bp, Zea mays
  misc_feature: Incyte ID No: 700347669H1
  unsure 54, 80, 84, 92-116, 140, 146-147, 158, 180, 187, 267: a, t, c, g, or other
ccagtgccaccactcgccagctcgccacttcctcccgtctcctcccttgcagangcggcgcgtaaaccccgatggccgcntctntcctccannnnnnnnnnnnnnnnnnnnnnnnntgagctccacccagcacgcccgcncggggnncgccgcctttnaccccctcgcgtgtgccccatnctacgcnttacgcgctcctcgttctcgaccaatcgccactcgagatttcatccgggcgatctcggccagtcgccgtttcgcggggangggggaaccgggaccgccacgttgtcg

SEQ ID NO: 4087 - DNA, 296 bp, Zea mays
  misc_feature: Incyte ID No: 700347673H1
aacagatccgggttcgagcgtccagtctcgccggacctccgactggcggtcgctgctatctctctggtaccgcggtctcttgcgcgcttctctccattcgctcccactcaccggcttgggggaatgaaggatgtggtagggagcccggggacctggagtggcatggcgctgcggttgtcgcaatgcgtgtccgctggcgcatccatgggcgctatggccacagcgtacggcttctccaactacactgctttctgctacttgattgcttcaatgggcctacaacttctttggagttt

SEQ ID NO: 4088 - DNA, 295 bp, Zea mays
  misc_feature: Incyte ID No: 700347674H1
ggctgcaggagatttcattgaccttttgcaagggctgctgaagtatgatccatcaagccgtttaacagcacgagaggccctgaggcatcccttcttcacccaagggttttggcgaagatgatgatactccttgcattctacctttgtctgacttgatgtcttgcatttgacagtttgtacttttcagtggtgtatgtaggcggtagatcaatctgtataaatccgtagtagagttgtttcagtcttgtttggaacgtcgtgcagctatagctgtagcataatggaagtcaaatcg

SEQ ID NO: 4089 - DNA, 294 bp, Zea mays
  misc_feature: Incyte ID No: 700347677H1
  unsure 2, 91, 133, 223, 229, 293: a, t, c, g, or other
cnccgccgacggttccgcccctgcgtactctaggtatcccgtgtccaacggtccacccccaccgcaaccgccgtccgtccgtccgcccgcngccgcaccctgctagggtttcggccaggccggatccgccgcngcctgtagattctcctatccgaccgcggcgcctcgagccgcaccggcaacctcggacctgaatacctgatacactgcacttcttcagtcngcaggntcacagcacgcacaattgttcttcaatctgcaggactgcagccgcgcacaagccgtagtgtttnc

SEQ ID NO: 4090 - DNA, 295 bp, Zea mays
  misc_feature: Incyte ID No: 700347679H1
gagaatccatcgagtcgaccaccgagcacggttagggcggcggggctcgccgtggccacagctcaggaatccaatcccccactcctcaccggcgcccgcggttttataaatagattccctcgtcactgtcgcggtcgcggcttgatcggattcaactcacctaccccaccccctcgattccttcccagctctggctacttcctacgccaccaccgcccgctccggcctcggctcctcgagcaagctgccatggctgccgccgcgctgagggagcaactcaacgctctcctctcct

SEQ ID NO: 4091 - DNA, 295 bp, Zea mays
  misc_feature: Incyte ID No: 700347680H1
  unsure 58, 196, 226, 234, 240, 251, 258, 270: a, t, c, g, or other
aaacttcttcctctctggatcttacacgaaacaggactacattgacagcatggaaggngcaactctctccggcaggcgaacgtcggcctacatctgcggtgccggggaggagctgctggccctccgaaagaagctactcatcgacgacggcgagaaaggcgctggggaacgttcaagtcctgcaggctagctgaanaacccctcctgcactgcagagaagcttggntctttccnaccacncatacatgctngaatggncaaaccaccaancattggcttttctcgcttcaaggtg

SEQ ID NO: 4092 - DNA, 291 bp, Zea mays
  misc_feature: Incyte ID No: 700347683H1
  unsure 57-58, 87, 113: a, t, c, g, or other
ctcggcggccggcctcttctcttcacggactcgcaggtcatcgagatgtcgtcggcnnaggcgaaggccgcggcgaaggcggtcccngagtctgtgctgcgcaacgcaagcgngaggagcagtgggcagcggacaagaaggagaaggccctcgcagacaggaaggaggcgcttgacagccgcaagatcatatttgctcgcgccaagcagtacgcccaggagtacgacgcccaggagaaggagcttgtgcagctcaagcgtgaggtcggttgaaggtgggttcttgtgagcc

SEQ ID NO: 4093 - DNA, 292 bp, Zea mays
  misc_feature: Incyte ID No: 700347688H1
  unsure 9, 16, 18, 28, 31, 34, 76, 133: a, t, c, g, or other
ctctctctngctcagntntgggactacnggngtnttgctgttttagaaatcagaaagaaaggaattcatacggggntgtttgaacaatggaaacaaagattcatgtgtaaagctttttttttgcatgtaagtnattgcatttcaaaggaccccgcccctttttttacgaaaagaacccttttttgcgcaactgtggacactatcaatggtgccttgaaatctatgacctcaacttttcaaaaagacttttttcaatgttattttaaccgtgtaaataaggtagatagaggaa

SEQ ID NO: 4094 - DNA, 280 bp, Zea mays
  misc_feature: Incyte ID No: 700347690H1
  unsure 31, 145, 189, 191: a, t, c, g, or other
gagaaatcgccatcccataggcaagcatggngggttcaatccggtccacattctccctccatgcttgcctatgggatggagggagaatgtggaccggattgaaccctcgcggaagagcactgatttctttgaaccctcgcgaaanagcacagaccaaaggaaaaaatcaaggtcaactcgagataagangngaaacatgaacatagtatagcaacgtcgagaagtagacagctaaagatatctttgatcgttcgagaattccagagagtgttgattcttc

SEQ ID NO: 4095 - DNA, 290 bp, Zea mays
  misc_feature: Incyte ID No: 700347691H1
  unsure 50, 90: a, t, c, g, or other
gagaaatacttcatacacaaccatttgtcatttacggtgaagtatcacanggacgataatttggaacattctagaatagtgggatttgancgtcaacccacacagtgtcaagcaccaggttgacgataaatggaatggtgtagacacccgcttgagcacttgtgatcctcatgcgagcaaatttgtaataaactctgattctcctcaggaagttgaagttggcaaggaaatcatattcacatatgatgttcgctttgaggagagtgagatcaagtgggcgtcacgctggg

SEQ ID NO: 4096 - DNA, 285 bp, Zea mays
  misc_feature: Incyte ID No: 700347693H1
  unsure 7, 9-12, 23, 44, 55, 57-58, 63, 65, 74, 95, 103, 113, 117, 182, 202, 221,: a, t, c, g, or other
ctgatcntnnnnctaaggaacanacttaagtatgccctgactgnagatgaagtanannagatntncatgcagcnattcattaagattgatggganagtcaggnccgatataanctancctgctgggtttatggatgtcatcagcattgacaagactggagagaacttccgtctgatctatgncaccaagggtcgcttgctgntcatcgaattacacctgangaggccaatacaagttgtgcanngtgagaaagatcttgtgggcacannaggaatcccacatctg

SEQ ID NO: 4097 - DNA, 289 bp, Zea mays
  misc_feature: Incyte ID No: 700347694H1
  unsure 57, 125-126: a, t, c, g, or other
gcaggatttgcctcagtagcccagggtatggaaggctgcgttcctagcaacaaaganacgggggcgtatggcatgccatcagccaccaacaatccagatgcctctggtcagtccttcagcgaagnntggaagagctcgaggaagcctccgttgcagtacgatgcctccgaatctgcagactgtggcccaggtggtaagggcgcgaagaagaaaacgaagaaaggaaagcagattgacccttctcttcttggtttcaaggtccacagtaaccggatcatgatgggcgaga

SEQ ID NO: 4098 - DNA, 289 bp, Zea mays
  misc_feature: Incyte ID No: 700347695H1
  unsure 29, 227: a, t, c, g, or other
atcagagctagatgcattccacgtgacantttggaacgaacacattgttatccacatggatggtgtaaatatcttggcagtcaattatggctctgttgatgggtgccaataccctaggcctatgaaattgccatcaaaatggacattcagctcttacactatcctaaagactgctgaacaggcaccaagaaccccatcgtttgcagatcagttaatagaagctgacnatggtcttggcgaagtaatgaaaccacctgagaaatctttctgggctaaatattggatgtac

SEQ ID NO: 4099 - DNA, 222 bp, Zea mays
  misc_feature: Incyte ID No: 700347701H1
  unsure 45: a, t, c, g, or other
atgtcatccggcgggttcgacacagaacagggatccgcatttgcntcgacggcaggcaacgtatgctacagcatggaagtaaaggacgcggttctgccgccatgggtggtctctgggctgtgcgccgccatgagcttggacgcgaccagctttgatctgacgatcgccacggagccgtcgtcgatgggcttgaacgtggctctcgactccatgggcacacca

SEQ ID NO: 4100 - DNA, 292 bp, Zea mays
  misc_feature: Incyte ID No: 700347704H1
cagcagcagaagagcagccccagagctccagcaataatggccgagaagggcgtgaaggtgttggggatgtgggcgagccccatggtgatcagggtggagtgggcgctgaggctgaagggcgtcgagtacgagtacgtcgacgaggacctcgccaacaagagcgccgacctgctccgccacaacccggtgaccaagaaggtgcccgtgcttcgtccacgacggcaagccggtcgcggagtccaccatcatcgtggagtacatcgacgaggtctggaagggcggctaccccatc

SEQ ID NO: 4101 - DNA, 291 bp, Zea mays
  misc_feature: Incyte ID No: 700347707H1
  unsure 172, 228, 239: a, t, c, g, or other
gcacgactctcttctctgagaaaacccaacaaaaaccctcgctcgcctcacttgttcgctcacctcggtgcggcgcgtcgttacggacacggagatacagcggcgattccggcgatggagtacgtgaaccccctcaccggcttccgcgtcgacggccgccgccccaacgagntgcggcaactcaagggcgaggtcggcgtcgttgcgcgcgcagacgggtcggcgtgntcgagatgggnaacaccagagtatcgccgccgtctacggcccgcgagaaggttcagaacaaag

SEQ ID NO: 4102 - DNA, 182 bp, Zea mays
  misc_feature: Incyte ID No: 700347709H1
  unsure 76, 93, 95, 99: a, t, c, g, or other
gctaagttcgatgatcccagcggcaattgtcttagtcctgcgggtgaatataatttacgcctgggtatcataaaanagttgcaccctgatatngntgcnacacatgcaagcagccctcaggtttttgaaggtcacccatttattgttgaagctgggataagcattggtggaaaagatgttaa

SEQ ID NO: 4103 - DNA, 240 bp, Zea mays
  misc_feature: Incyte ID No: 700347712H1
gaacggggaatgggaggttcagtcgcgtgaacaatggcgccaagcaagctcctgtggccgcgtagaggcatcaaggcggtaggcttacatcaaactaggaagcataaggctacattcaagtgagctgagtgcaaggattattcttagtaggagcattgctgtcagacagcttggttatttttttttgtgccgtgttgggtcgctaagagattagtagttgcagtcgtccgtggatggtag

SEQ ID NO: 4104 - DNA, 287 bp, Zea mays
  misc_feature: Incyte ID No: 700347714H1
  unsure 121: a, t, c, g, or other
tggtgcagcgcctcacgtaccggaagcgtcacagctacgctacgaagtccaaccagacccgagtccgtcaagaccccaggcgggaagcttgtgtaccagtacaccaagaagagggcgagcnggcccaagtgccccgtcaccgggaagaaaatccaggggatccctcacttgaggcctgctgagtacaaaaggtccaggttgcctaggagccgcaggactgtgaaccgtccttatgtggagtactctctggaattgctgttaggagagatcattcggcttttttggtc

SEQ ID NO: 4105 - DNA, 292 bp, Zea mays
  misc_feature: Incyte ID No: 700347716H1
  unsure 218, 282: a, t, c, g, or other
gtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtctggcctgctccttatctctgggcctttcaagatcaatggagtaccgatccgccgtgtgaaccagacctatgtcattgtaanatcaaccaaagttgacaatctctggtgtgatgtcgcaaagtttgatgacaagtacttgccaggnagaagaagca

SEQ ID NO: 4106 - DNA, 287 bp, Zea mays
  misc_feature: Incyte ID No: 700347718H1
  unsure 206, 223: a, t, c, g, or other
ccaaaccctccgtcgacccctcctcctcgatctacaccggcgatcggcggcgagtgatggggtgggcgacgcggttcctggcggcggtgtgcttctttgctgcgggtgtcctcttcgtccccgaggctctccttggttccccctccggcgcaggcgccgtcaccgctgccaagctggcccacgtcctctcctttgccacttcctgnggcgccgcctctgggcnactttatcggcggatcatcatgttcaagaacctgccgaggaaatgttcggcaatttgcaagaga

SEQ ID NO: 4107 - DNA, 284 bp, Zea mays
  misc_feature: Incyte ID No: 700347720H1
  unsure 8, 40, 49, 149, 151, 164, 214, 230, 234, 261, 272, 280: a, t, c, g, or other
caaccgtngtttccggctggtcctccactggccgctcctnagtcagtcncggattctcccttgggtctggagtggaatggaggttaatccgatcatggggtgatttcctcttttaactggatcagcgcaccggagctcaaaggtgcctntngagtttattacancaagaattttgggttcgacataatccccatgtcccccaacaagtcgggcnatgcttcaggccgtgnacgngttttctggtcgatagaatgaacgaanatctaattgantcgctgcntcac

SEQ ID NO: 4108 - DNA, 287 bp, Zea mays
  misc_feature: Incyte ID No: 700347721H1
  unsure 82, 214: a, t, c, g, or other
cgcagacggaggacggcgcctgcgtcaccttcgtcgggcccggcggcgccggcaacttcgtcaagatggtgcacaacgggancgagtacggcgacatgcagcaccatcgccgaggcgtacgacgtgctccgcaggctcgggggcctgtccaactccgagatcgccgatgtcttcgctgagtggaacaggggggagctcgagagcttcctggtcnagatcaccgccgacattttcaccgtggctgacccgttggacgggagcgggagtggcggcggggcgtggttgat

SEQ ID NO: 4109 - DNA, 135 bp, Zea mays
  misc_feature: Incyte ID No: 700347722H1
  unsure 8, 19, 44, 52, 69, 81, 88, 105, 129, 131: a, t, c, g, or other
cagccatnaggtgagccangatgtgtgcatacaaatacatccangagctgtngaggaagaagcagtccnacgtgatgcgcntccttcnaagggtccgctgctggnagtaccgccagctctctgcgctgnanaggg

SEQ ID NO: 4110 - DNA, 107 bp, Zea mays
  misc_feature: Incyte ID No: 700347727H1
  unsure 8-9, 31, 51, 75, 86, 89, 95, 102, 104: a, t, c, g, or other
cgcctcgnngtctcgcccctgcgcacccgcncctgcagctcccatgggctnctccgccgtgcgctggacactggngcccaacgctntcncccgcntccgcgncncgc

SEQ ID NO: 4111 - DNA, 285 bp, Zea mays
  misc_feature: Incyte ID No: 700347729H1
  unsure 157, 187, 227, 230, 284: a, t, c, g, or other
gcccatcgtacctgtctatgtaaatgatggtttaatgatgcccaattctgttgatgatgaagcaagtttgccgttagaggaaaccaatcctgccgaagtgttacagcacattggagcaggggaggagaatccctgtcctgctcaagagttcgagtcnattggagcaggtggggaggaagagttgaanctcctaagatctatgggctgggatgagaacgaagatgttnagnctcttcagcaggaggagattgctgattgtcctaaagcagaccgtcagctgcagna

SEQ ID NO: 4112 - DNA, 94 bp, Zea mays
  misc_feature: Incyte ID No: 700347731H1
  unsure 32, 47: a, t, c, g, or other
accgttctcccgcgtcccgcactcccgccccntttccttttgctccntccttcctcgggaagcctagggcttaggctttaagcgccgcgatgta

SEQ ID NO: 4113 - DNA, 136 bp, Zea mays
  misc_feature: Incyte ID No: 700347732H1
  unsure 82-83, 128: a, t, c, g, or other
gccggcacgtgcttccaggcagagtgggatgactctgtgcccaagctgcacgatcagctggctgggaagtaggggcgctgcnnagcccgcagccccggggaccccacagtacagtcaagtcgtataangcatgtgc

SEQ ID NO: 4114 - DNA, 282 bp, Zea mays
  misc_feature: Incyte ID No: 700347733H1
gatgagagaccttttgattggtgtaaattatctacatagccatgggctggcacacaccgagcttaggatagagaatgttcacgtgagcccaatagacaagcatgttaaagtcggtattcttggaaatgctgctgattttcaagacaatgatcttagcagcagtacaattgcaagtaacaatgacaggcggaaaatgatgatagcctttgacatgagatgtgttggcttcatcatgggcaaagatggtttgagagagctaatggatccttcgactttctttaa

SEQ ID NO: 4115 - DNA, 278 bp, Zea mays
  misc_feature: Incyte ID No: 700347736H1
gaaaagtgagcacattcttgcacgaagcttgccgccgccgagctggggaactgggaagaggaagagatcttgcctaggtctagcgaggaggaggtcgatcgatcgattggctaggactctaggaggaggagctggctcataagcagacctactgacccacccatcgactgtacttgttcggaggaagggatggccgatctgctgagcttcctgaagacgatcttggaggccgggttcagtataatgagcgcgctggagaaggctggccacaacgcgga

SEQ ID NO: 4116 - DNA, 92 bp, Zea mays
  misc_feature: Incyte ID No: 700347737H1
  unsure 35: a, t, c, g, or other
agctctgcagtctgcactctgcttagctccgagcntcagtgccttcgttgttagctgttagctccacagtccacagttccacacaacatacg

SEQ ID NO: 4117 - DNA, 277 bp, Zea mays
  misc_feature: Incyte ID No: 700347739H1
  unsure 27, 233, 237: a, t, c, g, or other
ctacatcatctctggccctgtggtggnccatggtctgggagggcaagagcgtcgtcacaactggccgcaagatcattggcgccaccaaccccctggcttctgagcccggcaccatcagtggcgactttgctgtcgacattggcaggaatgtcattcatggaagtgacagcattgagagtgctaataaggagattgccctgtggtttcccgagggccttgctgattggcagagnagcnagcacccctggatctacgagaagtaaacagtgaaagtttc

SEQ ID NO: 4118 - DNA, 92 bp, Zea mays
  misc_feature: Incyte ID No: 700347744H1
  unsure 8, 30, 63, 76: a, t, c, g, or other
acgatgangaatacaatgacattgtggagnacatgaggcaagaaggacgcaaatatggtaacntggtgaaagttgnaattccacgacctgag

SEQ ID NO: 4119 - DNA, 281 bp, Zea mays
  misc_feature: Incyte ID No: 700347745H1
accagaaggagctctttgtcgcagccgagggcatgtacacgggccagttcgtctactgcggtcgccgcgccaccctctccatcggcaacgtgctgcccctccgcgggatccctgagggtgccgtcgtctgcaacgtcgagcaccacgtcggtgaccgcggtgtcttcgccagggcctctggggactacgccattgtgatcagccacaaccctgacaaacggcacatcgaggattaagctgccctctggcgcaaagaagattgtccccagaagttgccgtgt

SEQ ID NO: 4120 - DNA, 281 bp, Zea mays
  misc_feature: Incyte ID No: 700347747H1
  unsure 262: a, t, c, g, or other
aacatcttcttttgatagaactattaaattatggaatgctgccgatcctggattctctttgcatacattcactgggcacaacggccaggtcacatcattagattttcatccaaagaaaacagaccttctatgctcttgtgatggcagtggtgaaatccggtactggaatgtgacccagtttgcatgcttgcgtgccataaagggtggtagtgcccaagtccggtttcagcctcatgttggacagttttagcgcagctgctgnaaaacgtggtttccataat

SEQ ID NO: 4121 - DNA, 81 bp, Zea mays
  misc_feature: Incyte ID No: 700347749H1
gccagtgttcgtggtttcaaacgaaattcagttaataagactaaatttgcgtattcaaatggattgcgtggctgcctggtt

SEQ ID NO: 4122 - DNA, 291 bp, Zea mays
  misc_feature: Incyte ID No: 700347750H1
  unsure 20, 97, 99, 114: a, t, c, g, or other
ctggatgttacaacccagtngaacaccacctatctgatgctgctggctgctttggattataagcagactttcactacactagaaacatgtgatgatnantacaatgaagctgcntcagcagaggattggaagaaagttgaggctgcctgtaattacctgaaactgctatacgattctgcacatagtatcatggcggcagcaaacccaactgcaaacatctttttccatgaagcctggaaacttcagctagagctggcaaatggcacaggccacgaagatcccactttcagt

SEQ ID NO: 4123 - DNA, 289 bp, Zea mays
  misc_feature: Incyte ID No: 700347754H1
  unsure 40, 91, 93, 101, 116, 118, 120, 125, 127-128, 132-133, 136, 140-141, 147,: a, t, c, g, or other
cgtccgccttgcccttcacgaaggcttggtcctcctcctngtatctccactccccccttccacagatccgttcctccagctagggttagcntncctctgcngcgatggcgatcaancngnctaangnngagnntantatnncttacnanangangctgtgcagcctgctcgatngagtacnccanggtgctcatcgccctggccgacaacgtcgttccaagcagctccaggacatccgccggggcctcaggggcgactcggtggtgctcatggggaagaacacgctcat

SEQ ID NO: 4124 - DNA, 285 bp, Zea mays
  misc_feature: Incyte ID No: 700347755H1
  unsure 9, 86, 180-198, 220, 235, 283: a, t, c, g, or other
gagcttgcngtccagcgttcatcggatagctcctgagctcgatctcgggtcgcgcacagctgctctccccttcctcccgctcagcncgctcttcggtgctgctctcgatcgtcgtctcgctccatcaccggcggtcgcttagcctccgcgatcccggccggtggtcttcttcgccgcatnnnnnnnnnnnnnnnnnnnaacacaaggacgatgtcgaacnggagtcccgcgcgtngacggtctcggaggaggagatcaacgagcttatctcgaggctgcagangc

SEQ ID NO: 4125 - DNA, 257 bp, Zea mays
  misc_feature: Incyte ID No: 700347756H1
  unsure 15, 47, 108: a, t, c, g, or other
cctcgatccgatccnccgagtgcacaccacctttccccactccgatngaatcgatggccgccgagggcgagaagaagatgataaccctcaaaagctccgatggcgagnagttcgaggtggaagaggcggtggcgatggagtcgcagaccatccgccacatgatcgaggatgactgcgccgacaacggtatccctcttcctaacgtcaactccaagatcctatccaaggtaatcgagtactgcaacaagcacgtacat

SEQ ID NO: 4126 - DNA, 282 bp, Zea mays
  misc_feature: Incyte ID No: 700347757H1
  unsure 45, 62, 88, 90, 183, 202, 222, 230, 237, 269, 271: a, t, c, g, or other
gatacatcgccctgacactccatccttgcacaaacgcaactacgngagagaaggacaagganaaaaacaggggacaagatcgagtgananagaggagatatggcgtccataataacaggagatttcgcggaggcctacgtacggaagaacgcctgcgaagaggagacgaggaaggcagaagcnagcaccgccggcggggtgncggcggcggcgacaccaggngacaaganggccgangctatgcatcatccgggaagaagttgcctagngnggtgcagctgg

SEQ ID NO: 4127 - DNA, 282 bp, Zea mays
  misc_feature: Incyte ID No: 700347758H1
  unsure 169, 171, 246, 253, 267, 278: a, t, c, g, or other
gacgttaacaccaagaacaagagccttggcatgggtaccaacatgtatccttcctctgcgctgctcggccaaaacaaggatgctacgcttgaagcgcttcctgtagatgagctcattgagaaggccgatggttttgccggagtcttccctgaacacaagtacgagatcntnaagagactgcaggagaagaagcacatcgttggtatgactggagatggtgtcaacgatgccccggctcttaagaangctgacntcggtattgctgtngggacgtactngggg

SEQ ID NO: 4128 - DNA, 284 bp, Zea mays
  misc_feature: Incyte ID No: 700347759H1
  unsure 60, 149, 182, 197-203, 206-207, 209, 215, 217, 220, 232, 235-236, 249, 265: a, t, c, g, or other
gggcctcctatccaggccttcctgtatcaaataccaatcattggttggattctgcagtanccattccagctggcttggtcagttgaggcgtaaacgcacctgaaatgttctgcaactgccaagatactctttgactcttcatggttaangtaccgtgttgttgtgatgtttatacatgattntcactggtacccttnnnnnnnacnngntgggtntnaanctctggtgcatnggnntactctgaggcantctggcattgtccctntttgcgagcaggcgatggt

SEQ ID NO: 4129 - DNA, 284 bp, Zea mays
  misc_feature: Incyte ID No: 700347760H1
  unsure 253, 257-258, 262-263: a, t, c, g, or other
agagcatcttgcgtgatgcagtcactgacttgtctctgcactatcttgctaaggcaaagattctggtggtgaaggacgtggagagggatgagatggagttcatcaccaagaccctaaactgccttcccattgccaacattgagcacttccgcacggataagtttgggtatgcagatgttgttgaggaagtctctgttggagagggcaaggttgtgaagatcactggaatcaaggacatgggtaggaccgaaanctgnntttnnggggggttcaaccatttggtt

SEQ ID NO: 4130 - DNA, 286 bp, Zea mays
  misc_feature: Incyte ID No: 700347762H1
  unsure 7, 9, 33-34, 95, 136, 142, 144, 209, 239, 249, 251, 266, 268, 274, 280: a, t, c, g, or other
gcgatgncngcgccgcgccgcgctctactcgtnntcgccgctctcctcctctccctctcccttggggccgcctccttccattccgacgagctccncctcaacgatgacgaagagttcgagggcgtcgtcgcccgcncctccncnccctccccgccggcggccccggtggtctcctcctcccgccgcagatcagcggacgcgccgttgcncgggtcaggcgagtccaacgcatgcagttnacgctcgagnangaccttggcgaaggnangggttnggtctnagctgg

SEQ ID NO: 4131 - DNA, 286 bp, Zea mays
  misc_feature: Incyte ID No: 700347763H1
  unsure 47, 60, 225, 230, 243, 246, 260, 272, 274, 281: a, t, c, g, or other
tttacaaaaccccaaaggttgatcctgaattgctcaaagagattganccagtggaacganagcacttaagaatgatgtgatcaaattttgccaagagaacaattttcattctggtttctttgatggaactgaaaacaacatggtagctgatgcctatgaattgaaggtgcgtcttgaacacatcattgaaaggatagccttgattctgatgctgcaaatacagancgacnttctctggtggtnaanaatggtccataggngggctctggctngnaggccangtacc

SEQ ID NO: 4132 - DNA, 287 bp, Zea mays
  misc_feature: Incyte ID No: 700347764H1
  unsure 23, 30, 32, 35, 47, 57, 63, 77-78, 135, 151, 169, 176, 181, 187, 199, 201,: a, t, c, g, or other
cgtaccttttcctttcataaacnccaagcngngcngcaatagctcgncccctcgttngcagcntctcctgctcctanngcagctctccctcaggtttagtgttcgcaatggcggccttcaacaagcttggtggcnttctaaggcacagtgntctggtgagcggtatcantggtggntcttntcctgnagtgttcaatgntncanggctcangtctaccaagctatttattggtggtnttnactggggtgttgatgacgtnaactaagagaancnttngnngtnggna

SEQ ID NO: 4133 - DNA, 278 bp, Zea mays
  misc_feature: Incyte ID No: 700347766H1
  unsure 224, 230-231, 249, 256, 259, 263, 268, 271, 275: a, t, c, g, or other
ggagggagagttcgaggaccgaggcggcgtcgggcgagatgaagcttaacgtcaagaccctcaagggcaccaacttcgagatcgaggcgagccccgatgcgtcggttgctgacgtgaagaggatcattgagaccactcagggtcagagtagctaccgggcggaccagcaaatgcttatataccaagggaaaattctcaaggatgagaccactttggaaagcaanggattnngagaacagcttccttganaaatttnccngggnaaggngcngggnggg

SEQ ID NO: 4134 - DNA, 288 bp, Zea mays
  misc_feature: Incyte ID No: 700347768H1
  unsure 57, 71, 98, 240: a, t, c, g, or other
cgtggctctcctctctcttctggcattgcatgcagcccagggagcagccctggggancgcctatggaaganaccacctccagtaattacccttcgggnacagagggccttagtgagttcctgaactttaacaagttacagtctgcctttaagtcggatgacttcctgaactggcacgtcctcactgatatgttcaaaaaagcgcttcctttcattaactgggaattcttccctaaggtgnaaggactgagaagcgcagttcctgattcccagtgaccattctctttaa

SEQ ID NO: 4135 - DNA, 286 bp, Zea mays
  misc_feature: Incyte ID No: 700347769H1
  unsure 5, 26, 56, 77-78, 103, 105, 172, 174, 209, 217, 221, 224, 227, 241, 267,: a, t, c, g, or other
tcaanttgcccaacacccctgcagtnttggacgcagggaatacttgaaaccccggntcccgatggatcatggatctnntctctgctgcgtacggtgctacctntnacgatgaggatgccgcggaccgacccttctccatgccggttgccaccaggtccgcctccttctctcnanctcccatgaagccgccgcggtgggaatctcacccntacctccntccnacncantgcttcccgcaacnacctctgcccgacgcagcgctgccantggcatntccatcnagcgg

SEQ ID NO: 4136 - DNA, 281 bp, Zea mays
  misc_feature: Incyte ID No: 700347771H1
  unsure 266, 270, 273, 278: a, t, c, g, or other
ggcgaccgccgccgtcctacgccaggtatcccgcgcttcaaggcggcaggcccttcgccggcgaagagcacccatccagattcccgagttgtttatcccagttatcttgcacaccgagggctccgtagcatcttattatgcttcaagacctgttctacctgttggatcagatgttcttagaaacgatgtaatttctcaaccaagaacgcatggttatgatggtccagcaagagtgaccaatcctgctttgctgcctgactggaccnccgncgngagtncgg

SEQ ID NO: 4137 - DNA, 278 bp, Zea mays
  misc_feature: Incyte ID No: 700347772H1
ctccactctcctctccctctcccgagcacctctccttcctccactttctccccaactccggtgagcgagagtgtggtcacgacacaatcatggcgctgcccgtggggccaatcgtcggtgcgcgagtccccttcggggtgagcatgtcaccgtcgagcgacctcttggcggtgccctagtgtcctgtgcgtggcgttatgtaccggtggctgcgttgtttctacccagtcgtctgcaaacaagattagcaggaagttacgaaatggtttgagttggtt

SEQ ID NO: 4138 - DNA, 279 bp, Zea mays
  misc_feature: Incyte ID No: 700347773H1
  unsure 23, 199, 236-237, 251, 259, 262-263: a, t, c, g, or other
gaatggcacttgtgccgcaagangaataacttggacgagccgtggatctatgtaatctgtagggaagcaggcatcaaatgctatgtgttggctccagatcctccaagccggtgctttcgaatcatgcatgtcattgaacccccatgctcagggaggaaaggtgttaccattgaagctttagacaaaaagctatttcttntgggtggctgcattccgtgtatgatgctacggatganntatatggttatgangcatcctnaanncgctggggctcagctg

SEQ ID NO: 4139 - DNA, 281 bp, Zea mays
  misc_feature: Incyte ID No: 700347776H1
  unsure 67, 139, 222, 265, 277: a, t, c, g, or other
cgatcggcctccctcccccaagatcctccactcgatcccaaacaaaccaacaaatccatccatcgcncatggacgcgttcttctcggcctcctccgcgtcggcgccctacggctacggcgccggcggatggagctacgnctcgctcaagaacttccgccagatcacccctgccgtccagacccgcgcaattagcatttcgtatttttttaaaaatatatatnagtcgctggtttcgtgcgttccagaaattctcctgcgggttgngtgtagtgatgngtaa

SEQ ID NO: 4140 - DNA, 177 bp, Zea mays
  misc_feature: Incyte ID No: 700347777H1
  unsure 36, 38, 43-44, 49-50, 53-54, 57-58, 76, 108, 130, 176: a, t, c, g, or other
gacgaaccgagcaccaccgccactagaaaaagccancncaaanncctanntcnnggnncgccaccgcgcagatgcnggtgctcccgcgcgatgtcggaggtggaagcngcggggtcgttgtcgaggcggngaatggaggacgaggagggggcggcggcgatggaggcggatgcggng

SEQ ID NO: 4141 - DNA, 268 bp, Zea mays
  misc_feature: Incyte ID No: 700347779H1
  unsure 235-237, 242-243, 250, 259-260, 262, 265: a, t, c, g, or other
gaaccctgcctggtccaagcgagtagcgattagcctgtcgttttctgcttcttgatttttcttcttttcttcaattttttctatggttgcgttccgttgttgctgcagttttttgagattcctggtatagtaatgagattcctgatatggtaatgcgattattttacattttctggttaggatcttgctgacgtgagaattgagatcgatctgaaaggcttgattgtgccttccnnnatcannccatctngaagtctcnngnaanccc

SEQ ID NO: 4142 - DNA, 289 bp, Zea mays
  misc_feature: Incyte ID No: 700347780H1
  unsure 16-17, 26, 160, 162-164, 208, 230, 233, 244, 253, 256, 266, 277, 281, 283,: a, t, c, g, or other
gaggtgatcgcgtggnncgcactggngcatccacagcaagccggtgggcctgctgaacgtggacgggtactacgacttcctgctggcgttcatcgacaaggcggtggacgacgggttcatcaagccctcccagcgccacatcttcgtcagcgcccccgangnnntggaactcgtccagaagctggaggggtacgaggccgtgcaggangaggacccggcgaggcccaggntgnggtgggaaatngagcaggtnggntaaaaacgcntgctcctgggngagntngccngg

SEQ ID NO: 4143 - DNA, 161 bp, Zea mays
  misc_feature: Incyte ID No: 700347781H1
  unsure 7, 14, 18: a, t, c, g, or other
gcttggngtccgcntcancccgccgccaggagagccggctcggtcggttcgtcgaagatcccggatctgctctgtcacgaggtctttcggcgggtgttgtctcgcgaggtgtagcgagccaaggtctggtcgcctgttcaggagagtttcgagaagctgat

SEQ ID NO: 4144 - DNA, 281 bp, Zea mays
  misc_feature: Incyte ID No: 700347784H1
gcgggcttggagacaccgaagaagggggagaggaagctgaaatgactccggcctccataaccatggtcttcatcatgccatctagaggctcaatcatgcagtacctatcggaacgcagcagaacgatcattctggtcagtcggaggcgagcaagcagcagcagcggtggcgacgctgaagccactgctccagacagcgaggaaggtgatgaccctatgccatcggcagaggcatctgctggttcacagcgttcttccgaacaagaggatgctgacggtgac

SEQ ID NO: 4145 - DNA, 277 bp, Zea mays
  misc_feature: Incyte ID No: 700347785H1
  unsure 169, 202: a, t, c, g, or other
tggatgtagaattgaagaaatcccaattattcttgaggaagataaaatccagttccgtcatctactgtgtggagattggagaaatagcacatggatcaaagccatcaagttttttggcagcattgtttgcttacttcatggaggatgccactgttcctaaatatcagtnccctcaaaactttcaccatctagaaatcttctngggactaatgctggcagccatatctcaacacttgatagattgtatttctgggagagcaagctttatgatgaggcc

SEQ ID NO: 4146 - DNA, 275 bp, Zea mays
  misc_feature: Incyte ID No: 700347786H1
  unsure 14, 271, 274: a, t, c, g, or other
aaacgaccgcgaancacaggtcgaaggcggcggcggcgatggggagcgacacggagacggagaagaaggcctcggtggcgctgatgtccatcgcgaaacccctcgctggaaagaagctctgcaagcggaccctcaagctcgtgcgacgagcctccgaggcgaagtgcctcaagcgcggagtcaaagaggtagtcaagagcattcgccgcgggaacaaaggattgtgtgtgatcgctggaaatatttctcctattgatgtgattcacatgtncgnt

SEQ ID NO: 4147 - DNA, 274 bp, Zea mays
  misc_feature: Incyte ID No: 700347791H1
cccgggttcagtactgctcagaaattggacaaacttggcatgagaggaagcgacacatgtgaacttgtttttgagaactgctttgtgccacgcgagaatgtcctcggtgaagaaggcaaaggtgtttatgtcatgatgtcagggcttgatctggaaaggcttgtattagctgcgggccctattggccttatgcaggcatgccttgatgttgtacttccatatgttagacagagggagcaattcgggcgtccaattggtgaatttcagttcatac

SEQ ID NO: 4148 - DNA, 311 bp, Zea mays
  misc_feature: Incyte ID No: 700347801H1
aatggggtttcgagaagctcgtcttccgtaattcgatcaccagagtcaggcgagaccgcaaatatgcgatccgagctcggaacgcgtactccacaggtgtacacatgtcccagaatgtcatcggtaggacaacccacaagacggagagcttgatcctatactaccactatcacaactcgatcaacgtcatgggggagccctgcagggaattcgtgccgagacccaacaatggaagcaaggtgatgtttgaggggataccgtatgtctacgatgaccaacatggagcgcgtggcaggggagatcaaacgttc

SEQ ID NO: 4149 - DNA, 102 bp, Zea mays
  misc_feature: Incyte ID No: 700347803H1
  unsure 2, 14, 46, 49, 63, 67, 81, 85, 89-90, 97-98: a, t, c, g, or other
tntaaacaatccanttattttttacttctacttatgttatattgtntantgtctacaagtggnaaangttccacacaacancacnactnntcgcagnngcag

SEQ ID NO: 4150 - DNA, 299 bp, Zea mays
  misc_feature: Incyte ID No: 700347808H1
  unsure 45, 272: a, t, c, g, or other
ccaccctctgtgcagagttaattaaccttgaggtttccgattgcncttcccttccgctcctctcgcccattcgcggcgagattcagcggcaaggatgcgcctgcacgcggaggtgcgggatgagatggaggaggggagcgaggtgggggctgtgacggcttcggcggggctgtcgccaccgccactcatcggtgcggcggcgccggttccccggctagtggtggggttcgccctcacgaagaagaaggtgaagagcttcctgcagcccaagntgctcctgctggccaggaagaatggaa

SEQ ID NO: 4151 - DNA, 142 bp, Zea mays
  misc_feature: Incyte ID No: 700347809H1
  unsure 4, 19, 32-33, 35, 41, 59, 65, 68-70, 73, 99, 117: a, t, c, g, or other
cgcngatcgcacaactgcngagacagtggttnncncactgntagtgcagcttcttttgnaaactntannngcnattgccacctggcactgtgaagtaantgatcaaagacgtgtccncatttgctgataagttgaaatggtc

SEQ ID NO: 4152 - DNA, 303 bp, Zea mays
  misc_feature: Incyte ID No: 700347814H1
agcaaataagagcaaatcatagctgaccgatccaaacaacacgcccccgctctctcccaggtccctaagtgaaccaccctgtctggctaggcatggcctattgcgcatttgctccatctgcaccacctcaatattctgagcttaagatgactctatacacaaacaaggaggtgtatcgttctgggccagatcaaaacggagtaaccatcacagagagatcaaacatgggcacaacctgggtcttctcgtggcctgtagccgatgggccaacacctgatgcgaacatcgtcggccaacttccag

SEQ ID NO: 4153 - DNA, 301 bp, Zea mays
  misc_feature: Incyte ID No: 700347816H1
gctagatggtgtcagctggcctccaaggtatgctgttggcttggacaacttcaggaatctgaggttctgcgaagtgggtacaacactcgagtttagtatgggcgccatgccaaggcttgaagagctgcaatttggagtttatgcagggtattggagttgggaagagaatggtgtgtcgttcgagcagttcccaacaaaggatgtggtcaaagttcttgacttgggcctagataacctccttttacttgagcaagtcagcgtccttgtcgacggctcaggtgctactgccgcacaagtgcag

SEQ ID NO: 4154 - DNA, 291 bp, Zea mays
  misc_feature: Incyte ID No: 700347823H1
  unsure 153: a, t, c, g, or other
aaaatagtgtggacaccctaatcgtcatcccaaatgataagttgctgtctgctgtttctccaaatacacctgtaactgaagcatttaatctggctgatgatattcttcgtcaaggcattcgtggcatatctgatataattacggttcctgggnaggttaatgttgattttgctgacgtacgtgctatcatgcaaaatgcagggtcatccttgatgggtatagggactgctacaggaaagtcaagagcaagggatgctgctcttaacgccatccagtcgccgctgcttgata

SEQ ID NO: 4155 - DNA, 294 bp, Zea mays
  misc_feature: Incyte ID No: 700347824H1
  unsure 242, 255: a, t, c, g, or other
cggctgattcttccaaggcagctacaccgggagctttatttgaggataaaccccaatctgcaaatgatacatggagaaaactccactctgatcctctactcctaataaggcagcgggagcaggatgcgatttcaaggattaaaaacaatccaatcaagatggccgagataaagaaatctgttgaagctgagaaaaagcaaaaagaagagaagaaagcgaagaaaaagcacaagaagcatcancaccataagtcanagagtaagaggcatcactcagatgagaattctgattcag

SEQ ID NO: 4156 - DNA, 295 bp, Zea mays
  misc_feature: Incyte ID No: 700347829H1
agaaattgggatagaagtggtggctttgacggcaggcacaagggtgtttaaataataatagcaagagtggtatcttaagtaccaaatggcaaccagtgatatccttcatgtgaccttatccaatgccgagggtatttcaatccagctgagcatggctcttatgattccaccatgtgtccatgaccactcttccataatgctacttcaccctgcgacagaggctatggcgattcctctccatctgcacttccatttcaagcattgcacctctctgtctgcttgtttgttacatgtc

SEQ ID NO: 4157 - DNA, 277 bp, Zea mays
  misc_feature: Incyte ID No: 700347830H1
  unsure 6, 74, 146-165: a, t, c, g, or other
gcgaantgctagtgcttgtatctactatcttcatcaggtacttcgcgatcctactgaagtattccccgccgccnctgccatggccaccctcaaccctttcgaactccttggcgccgacgacaacgacgacccgacgcagctgattnnnnnnnnnnnnnnnnnnnntcagaaagccgagacgaagaagtccgccgtggcgcctgctgggaaggctgcccagcctgcggcgaccaccaagttcccgaccaagcccgctcctccctcgcagacggttcgg

SEQ ID NO: 4158 - DNA, 289 bp, Zea mays
  misc_feature: Incyte ID No: 700347835H1
  unsure 36: a, t, c, g, or other
gcaattttgctcagtagatcatggcgaaagctatgngatatttggagggaaaggcatagaagtgaacttgtgggatatcacatctagtagtaagacatggtctgctaaatctccccgagcaaatagtcttggcatattcactcgaccttggttcactgctggaaccttcttgtgcaagaatgatcatcgtaaaattgttgcctgcacaaataatcatcaggtccgcttatatgatactgcattgcaaagaagacctgccgtctctgttgattttagggagtcaccaatc

SEQ ID NO: 4159 - DNA, 291 bp, Zea mays
  misc_feature: Incyte ID No: 700347836H1
  unsure 64, 125, 137, 158, 174, 178, 276: a, t, c, g, or other
cagtaaacaacttgattcccatccccaccagcaccagcacacggacccggcggacggtgggcgntggcgcacccacaccccagcaccagcaagcaggtgcagtcagtgtgaggtgcggcccggcngaagatttggcncatgcacactcactcactcantccagtgcccactgcncgangaggaagtttcacgatctcaacccctataaatcgacgccgcgagggggagcgacgagcgatccccgtaattaacctgtcccagccgcaccgatccacnccccctcggcctcgg

SEQ ID NO: 4160 - DNA, 285 bp, Zea mays
  misc_feature: Incyte ID No: 700347839H1
  unsure 155: a, t, c, g, or other
gaaggataaggctttggcccgccgcttccagccagtactagtagatgagcctagtcaggaagatgctgtgaagatattactgggtcttcgtgaaaaatatgaagcttaccataaatgcaaattcacattggaagccatcaatgcagcagtttatntgtcagcaagatacattcctgacagacagcttcctgataaggctattgatctgattgatgaggctggaagtagagctcggatggaatcatttaataggaagaaggaagggcagtcttcgattctcttgaa

SEQ ID NO: 4161 - DNA, 287 bp, Zea mays
  misc_feature: Incyte ID No: 700347841H1
  unsure 28, 237: a, t, c, g, or other
ctcagacctcgtttccggggcgcggganacggagtaccgccgcccgccgacgaagcagagcgacacgaccgcgctgatgtactcgtccggcacgacgggggcgagcaagggcgtaatcctgacacaccgcaacttcatctcggcggcggccatgatgacagcggaccaggacgcgctcggagaggggcccaacgtcttcctctgcttcctgcccatgttccacatcttcggcttgtncgtcatcacgttcgcgcagatgcagcgtggcaattccgtcgtcgtgatgt

SEQ ID NO: 4162 - DNA, 289 bp, Zea mays
  misc_feature: Incyte ID No: 700347843H1
  unsure 75: a, t, c, g, or other
agtggatggtattcgatatttcctttcactgttacagagtcctgcggcatcagttgtgccaaccttaagtctgcntttcttcttgacattattgttctggtcatcacaacgtacactactgtaacatccgtgcaagaacctcaaacttttggaagtgatgaagcacaaaatccaggtgctgaacaggaagctttcctctgggaactttttgggtcattaagatacttcaccctaccaatttggatggtcttaattgtcactgcccttacttggatggcatggtttcctt

SEQ ID NO: 4163 - DNA, 291 bp, Zea mays
  misc_feature: Incyte ID No: 700347848H1
atggcgtccatcctcgaggtcgatgactgcaggaatcacacatttattcagtttgagccagctcctaggagaggtgaaccagacgtgacgcggaggacacctgattatttcctttgagttatctgccagaccatttttggaatttgcccaatgttggaatagtgatgctagccagtaacaatttttgttggatctatatgataacttaaccgaccagcaacagtaagaaaatgtggaagctgcatctgtcattgcaagaggtgctcgctaacagtaacaggtcgacgacct

SEQ ID NO: 4164 - DNA, 295 bp, Zea mays
  misc_feature: Incyte ID No: 700347850H1
  unsure 260, 281, 284-285, 293: a, t, c, g, or other
gggagtttacaaggatagcacaattatgatgcagcttctgaaggacaacttagcattgtggacatcagaactaactggaggtgaagcatccaagggtagcgacgatgtggacatggagggttgatacattctccatgttttaaggaaacacagaaagcacgcaaaaatatccaggctgtgatgctagcgaacctgggtcctcaagttttttctgcatcggaactcagaggagccttgtgtatttctgaagttctgtccgnccgggttttttttgggggctnttnncccctttngg

SEQ ID NO: 4165 - DNA, 298 bp, Zea mays
  misc_feature: Incyte ID No: 700347853H1
  unsure 43, 57-58: a, t, c, g, or other
gctgtcgactacatcatcgatcatgccgagatcgatgttgtcntcatacaggacaanncaaataaaagagatactgtccccaaactgcaagtctgccaagagactgaaagcattggtggcgttcacttcggcgacaactgaacagaacaaagaagcggatcaaattcggatcaaaatgtatgcctgggacgatttcttgaaagtggggaaggataatcctcgtcaaccttgccctccgcaagcaagtgacatctgcactgtcatgtacacgagtgggacaagcggacagcccaaaggt

SEQ ID NO: 4166 - DNA, 291 bp, Zea mays
  misc_feature: Incyte ID No: 700347855H1
  unsure 54, 90, 105, 109, 134, 165, 180, 195-196, 202, 208, 219, 221, 225-226,: a, t, c, g, or other
ggcctgctcctcgccaacccgcgggtccaggtcgtgcccagtgccacctttcangctcctgatcaagctgcgtcttcgcgctcttcctcncctgcctcatcttcntccncctcggcaagtgcggtcaccatagncaacgtcctgcactggtggttcatccccgtnaacgtgctcatcagnactgccatcgggtgnncccttngggacntcttgtcctgnancggnngnnntgtgggnnttgtngtngngggggtgtntangtttgtnggggnaattnnggtttggngttgt

SEQ ID NO: 4167 - DNA, 298 bp, Zea mays
  misc_feature: Incyte ID No: 700347860H1
  unsure 46, 54, 68, 166, 187-188, 203, 244, 266, 272, 281: a, t, c, g, or other
ccgacgcccaccctcccacgatccccacatcgctctctccctcgcncaccagcncttcccgtcctcgnaggcgctctgcaacttccaccctcgccgcgacgagctcggccggccgagctccgcgccaacctccagcttgatctcctcgccatgagccttgccaacntctcgcgccgagctacgcgtnncccccgcagatctcntcaccatgatctccttgccatgatctttccctcgctctgcnatctgcccccaaattcccctcnccgctngctcgcgtnggatagaaagaaaggga

SEQ ID NO: 4168 - DNA, 294 bp, Zea mays
  misc_feature: Incyte ID No: 700347861H1
  unsure 11, 28, 117, 156: a, t, c, g, or other
cgtcaagtganacttttcatgtggttgncctacgactttggtatcaagcataatattttgagacgattgacatcatatggatgcaaaataacagttgttccagcaaattggcctgcntcagaggtactcaatttgaagcctgatggtgttcttttnagcaatggtcctggggatccagctgcagttccctatgctgtgaagacggtacaggaaataattgggaaggttcctgtttttggcatctgtatgggccaccaattgattgggcaggctcttggtgggaagacatttaaa

SEQ ID NO: 4169 - DNA, 281 bp, Zea mays
  misc_feature: Incyte ID No: 700347863H1
  unsure 145, 148, 152, 154, 156, 158, 169, 196, 220, 226, 230, 232, 235, 240,: a, t, c, g, or other
ccctgctattggaccaaagatgggtcttaacttcagtgtactcaacacattcggagtcccagggctgaggggggcgactaccaagcaggtttatgagcagcatttcgcgaacaaggaaaccaaggagttcaaagatttccacatnacntacntngngnctgcaagtatntcaacacggtgatgcccggtcaggatnttgacactccatctactacggtgnttcggnattntnggnggggnggnncngnggnnngtgnnnngngnngtnnganttntgggnt

SEQ ID NO: 4170 - DNA, 295 bp, Zea mays
  misc_feature: Incyte ID No: 700347868H1
  unsure 7, 24, 37, 39, 59-60, 130, 138, 157, 195, 202, 267, 279: a, t, c, g, or other
ccatctncgtgaccttcgtaggcngcgagcacccacnangagaaggcatggcttgcacnnatgacaccttccaagaggccttttcagagaagatcttcagactacgatggccggggcaagtggcagaagncgaagcanccttctccacataaatctnagttcaaaatcgagcctggtgttcccatgttccgtatnctctgcncggcttcaaaatctggtaatgtgattggcaaaggaggtgccattattgcagagatacgtcaaganaccaggatgagnatcatggttgataggc

SEQ ID NO: 4171 - DNA, 288 bp, Zea mays
  misc_feature: Incyte ID No: 700347871H1
  unsure 71, 121-122, 148, 179, 236, 243, 272, 276-277, 280: a, t, c, g, or other
gcaacctccgggaccatcttctcggccatctcctgcttctgggacctgccagcaccgtttttgtggttagntccttcttgccaaccaaccatgagctcccagattcgtcagaattattccnncgacgtggaggcagccgtcaacagcntggtcaatttgtacctgcaggcctcctacanctacctctctctgggcttctatttcgaccgcgatgatgtggctctggaaggcgtgancacttcntccgcgaattggccgaggagaagcgcganggannagngtctttgg

SEQ ID NO: 4172 - DNA, 288 bp, Zea mays
  misc_feature: Incyte ID No: 700347874H1
ggagagttgtatactcatgggtcggtgatgatccttgtgggcatggtgatctacccccctggtctggtgtgacatgttctcagcaaggggattacagagttgtgacggaactggaagtctatgctgtatcaatagttggtcctttcccaacagcagtaactaacctgttggatctaagaagattggatctccacaataacaagttgacaggaccaattcccccacagattggacggttgaaacatctcaggatattgaacctgaggtggaataagcttcaagatgtgc

SEQ ID NO: 4173 - DNA, 291 bp, Zea mays
  misc_feature: Incyte ID No: 700347875H1
gcataagctcagccaccctaatgttacaaagtttgttggtgcatctatggggaccacagaccttaagattccatcaaacaattccaatggtgctgcacgtacaaatttgccagcaagagcatgttgtgttgtggtagagtatcttgctggaggaactttgaagcaatatttgataaagaatagccgacggaagcttgcttataaagttgtggtccagcttgcattggatttggccagaggattgagctatctgcactccagaaagattgtacatcgggatgtgaaaagcga

SEQ ID NO: 4174 - DNA, 288 bp, Zea mays
  misc_feature: Incyte ID No: 700347878H1
  unsure 36-37, 63, 150-151: a, t, c, g, or other
aggagctgagggatggacgcgaacaggcgccagagnnggatccagcagttgctggctgcgganaggaggctcagcaaattgtgaatgccgctagagctggtagtgttttctcatcttttttgttccaagccattgcagatctagcgtagnntagacagcaacaaccttgtgaatgagttcgttccattcacttagacatctttcactgatcctcaattaatgtttgtagagcgagattgaaggtaatgcactgctacgtttctgaactgtagcaaaaaaaaaaaacgg

SEQ ID NO: 4175 - DNA, 253 bp, Zea mays
  misc_feature: Incyte ID No: 700347879H1
  unsure 223, 227, 231, 242-243, 250, 252: a, t, c, g, or other
tgatagctccagcgccctcgccgtcggctgcccggctgccgtcctcccgctacgagctaggcatctccttcgccgatccagcatgggtaagacacgtggtatgggagctgggcgcaactcaagacccacaggaggaaccagaggtgggctgacaaagcctacaagaagagccatcttggcaacgagtggaagaaacctttgctggatcatctcacccaagggntctnctcnaaaattggatnngggcaananc

SEQ ID NO: 4176 - DNA, 289 bp, Zea mays
  misc_feature: Incyte ID No: 700347886H1
  unsure 2, 10, 61: a, t, c, g, or other
cnccgccggngaattcggcgactccccttgcgacgggaggaagcagccacgccgccgtctncggcgactgccctgacgactgcctctccggtctcgaacgcgatctggcccatggtggctctggcgccgttggttcgtgagatctagggttgtcgagcgccgcggagtgggagcggatggggcgccggaagatgtccgcagcggcgccgcctcccggagctggtccaacgttggcgggagcgtaatccccgaactacttgcaaaacacaaaatggacttggaaaatttg

SEQ ID NO: 4177 - DNA, 283 bp, Zea mays
  misc_feature: Incyte ID No: 700347888H1
  unsure 15, 269, 281: a, t, c, g, or other
gtcgcgccgccgccnccgccgaaacagcacatcgctctctcgatctcagccatggcggaggtggagcagccccaggacgcggtgaagctcttcaaccgctggaccttcgacgatgtccaggtgaacgatatctcgctgaacgactacctggctgtgactgcggcgaacacgcgacattcctgccgcactccgcggggcgctactccaagaagcggttccgcaaggcgcagtgcgccatcgtcgagcgcctcaccaactcgtcatgatgnagggggaaaaangg

SEQ ID NO: 4178 - DNA, 287 bp, Zea mays
  misc_feature: Incyte ID No: 700347890H1
  unsure 10, 45, 55, 93, 95, 177, 194, 259, 269: a, t, c, g, or other
ggccgagcangaggcgccatcatgggagtggacatccgccataanaaggaccganaggttcggcgcaaggagcccaagagccatgatatctancngccggctgttggtcaagttatacaggtttctggccagaagaaccaactccacattcaaccaggttgtgttgaagaggttgtntatgagttcgcaccaancggccgcctctgtccctttcccggatgatccggaagatgaagcttcctggccgggaaaacaaganggccgtggtntggggaccataactgatg

SEQ ID NO: 4179 - DNA, 284 bp, Zea mays
  misc_feature: Incyte ID No: 700347892H1
gacgcgcaggtcagtacaatgagaggatcgatgttctgcggcggagatctccggtggtggatgttggccatcttcttcctctgcacactaattgctgccgcggaggagcgcgtcgtcacccatctccccggcttccagggaccactccccttccagctccgaactgggtacgtggaggtggacgaggacaatggcgtccgcctcttctactacttcaccctctccgagggctcctcagccgacgacccggtcatgctctggctcagcggcggccccggatgcac

SEQ ID NO: 4180 - DNA, 282 bp, Zea mays
  misc_feature: Incyte ID No: 700347894H1
  unsure 71, 93-125, 146, 209, 235, 245, 247, 249-250, 254, 256, 260, 270: a, t, c, g, or other
agcccggatccggagctagggttccgtcctaggcggcaccaccatggagtgggacagcgagtccgacggcnccggcagcgtcgacgccggctnnnnnnnnnnnnnnnnnnnnnnnnnnnnnnnnngaggcgagggtggaggtggcncacgccgggggcggcggtgggatgttcacgttcgcgattgaaggcatgctgcgctcctccggnccctgcgggctagtcgtcaccgacgngctcgagccngntnncccntntttnttaaaccggntttaggggcccg

SEQ ID NO: 4181 - DNA, 162 bp, Zea mays
  misc_feature: Incyte ID No: 700347895H1
  unsure 16, 21, 26, 28-29, 31, 37, 41, 66-67, 85, 130: a, t, c, g, or other
gtgtatatgattccgntggcnttgcntnntncacctntccncaatagttgttgcttcccttgctgnnggcagtagaagcatgganaaaacagctcataagttgataggcgacggtaaaacagatggcatngctgatatttcgcagaacaagggtggatcatg

SEQ ID NO: 4182 - DNA, 276 bp, Zea mays
  misc_feature: Incyte ID No: 700347901H1
  unsure 2, 70, 232: a, t, c, g, or other
cnaagagcatggacggagtagatatatagagtagataaataaacagctggtttgtactactatgcaaggnttaggttcaagatcgtttcaaggaaacgacctgaggtccaggtaaccggagtccgcccagcacctcgcgtgctattgtctgattctgtagctgtacagtgctctgctaccttattatccgtgatgtgaaacaatttgtgtcgtccagtcttgctgtaaatcntcatcgcgtatattgtaaacctgagtcggtatgctgagttgctt

SEQ ID NO: 4183 - DNA, 291 bp, Zea mays
  misc_feature: Incyte ID No: 700347906H1
  unsure 29, 35, 237: a, t, c, g, or other
ggcgttccctccgagttgcagatctggcncatcangtggtggtgagggcgacgaggaagagccaatgttcgaccccgcgtggtgccacctgcagcttgtttatgagctcctgctgaaatttatcggatcctcgtccttggacgcgaaggtagggaagaagcactttgatcactcattcatcgtgaagctccttaatcttcttgactccgaggatccaagagaaagggattgcttganaactattctgcacagggtatatgggagttcatggtacaccgtccttcatccgca

SEQ ID NO: 4184 - DNA, 218 bp, Zea mays
  misc_feature: Incyte ID No: 700347908H1
  unsure 6, 79, 105, 123, 165, 176-177, 205, 212: a, t, c, g, or other
cccagntctcatcttgaattgtagttcctgtaatacctacatgtcgtgggagggacccaatgggaggtgactgaatcgnggtggtggttactgccatgatgttcncatgacagtgagtgagtnctcatgatctgatggttttataaggggcttttcccctttggntcagcacttcnngttgctgccatgtgaagagggatagttngcttccncttctg

SEQ ID NO: 4185 - DNA, 289 bp, Zea mays
  misc_feature: Incyte ID No: 700347909H1
  unsure 62, 123-124, 146, 241, 246-247, 253, 258, 283: a, t, c, g, or other
cgcgtttcctcttcaaccgccgccacaatctttgcggcgccctcacacaccaccgccgccgntatagcctagggccgtaatcgtaacagccacccctgagactgagatggatacagcggaggnngctgggcaggaagtagtcagcnctgttggggaggatagtatcccggaagctgccgcctgcagcagggaggagaggaaggaggaagaggaggaagaagtggaggtgagcttcgatggnctggnntggacnagcantgaagagtgctttgaggaataaggngtctcc

SEQ ID NO: 4186 - DNA, 291 bp, Zea mays
  misc_feature: Incyte ID No: 700347910H1
  unsure 79, 262, 290: a, t, c, g, or other
gagaagtgcaaggaagcaggcggccaccatggtgaagggacgcacgggacagcgcgtcaggctctacgtccggggcacnatcctcggatacaagaggtccaagtcgaaccagtacgagaccacgtcgctcgttcagatcgagggggtgaacaccaaggaggacgtcgcgtggtacgctggcaagcgcatggcgtacatctacaaggctaagaccaagagcagcgagacccgctacaggtgcatctggggcaaggtcacccgnccgcacggaactcgggcgtcgtcgcgcna

SEQ ID NO: 4187 - DNA, 292 bp, Zea mays
  misc_feature: Incyte ID No: 700347914H1
cccagaggcacagacgagacgacagagatgaaggacggaacgtcgtcggggggaggggcgttcgctgcgggcagcgattccaaggcagccgtcgacggcgaagcatacgcgccgccgaagctgtcgccccaggacctacccatcgactatgcaggcttcctcgccgtcgccttcggcgtcctcggcgtcatgctccgctacaaggtgtgctcgtggatcgcaatcatcttctgcgctcagtcgttggcaaacatgaagaactttgagaacgatctgaagcagttctatggct

SEQ ID NO: 4188 - DNA, 294 bp, Zea mays
  misc_feature: Incyte ID No: 700347916H1
  unsure 277: a, t, c, g, or other
ccaccctgattactgagcttgagctgcccttatcagactgggatgagaagtgggtggacatttacctgaacagcagtgtgaagctgctggacatctgcattgccctgagctcggagctctctcggttggatcaagggcagctgcttgtgcgatatctcctgaatgtgttgaactctgggagcgacatgccatcccaggagcagctcaggagagctgaggtgtctcttaaggaatggatagagcgagcaaagtgaaaggtctcccaggcttgatagtngcttggcagcgtacaag

SEQ ID NO: 4189 - DNA, 289 bp, Zea mays
  misc_feature: Incyte ID No: 700347920H1
ggcattcaagagggtgatgttgtgaccatgtatgcttgggtctcgctacaacggcgcaatggactgactgctgctcttcctcattgtcccaacttcctgttccacaaggaagaaaacttctggctgcttctagccaacgtggcatctaatgatgtctggttgtcacagaaagtcagcttcatggatgaggccacggcccataactgcagcatcaaaagctataccaagagacccaggaagcactaggtgcaagtgcaaaggaataggaaatgcagttagggaggcagtt

SEQ ID NO: 4190 - DNA, 283 bp, Zea mays
  misc_feature: Incyte ID No: 700347921H1
cttcctgtgaatgggattgggatactcctgttgaagtcgacttactcggcccgccggccctccgggacgcgtatctgtcacacatcggctgcgacacccgcctcgacaccgagcataacatgctctacccttccttgtgcctcgacgtcgtgctagcccggatcctgactatttgctccgtcgtcttgctgcatgttgattcactcagctggctcgacccattcaaagacatgccgaactagaagagttgcagtgctgatggatacgaaggtactgcttgagg

SEQ ID NO: 4191 - DNA, 283 bp, Zea mays
  misc_feature: Incyte ID No: 700347924H1
  unsure 3, 51, 157, 167, 204, 232, 245, 252: a, t, c, g, or other
atnctggggcttgattttagcaaggtaacccactgcacaacccgctgctcngcctcgagcgcatgtgctgagagtggctcggcgtcatcttcgagtgggagggggtcatcgttgaggatgatgccgaattggaaaggcaggcgtggttgaccctggnacaggagganggcaagtcgctgcctccctcttttgtgttgcggagantcgaagggatgaagaacgagcaggcganttctgaagttctntgctggnctcgggatcctcgagcttagaagtttatcac

SEQ ID NO: 4192 - DNA, 213 bp, Zea mays
  misc_feature: Incyte ID No: 700347925H1
  unsure 25, 29, 47, 71, 148, 184: a, t, c, g, or other
gcattcacacactcgattcagctgntctntccctcttcctctccccngcggcggagcataaaccctaggcntcgccgtcgtcggaggcgccgccgcgatgtcgcactttggaaggacgggtccgccggacatccgcgacaccttctanctgctcgtcctcaacatcagcttccgaaccacggcngacgaccttttcccgctcttcgagcgtgc

SEQ ID NO: 4193 - DNA, 287 bp, Zea mays
  misc_feature: Incyte ID No: 700347929H1
aagaagacttaggaagttggggacatcactgtgacccatcaactgtacctgatactatactgcagtgttctgctggcgaagaggtttcttttgttttcaccaatcaggttgacggaaaacttgttccagttgaatctatggtgcgatcagcagctcatcaacaaaacggaatagcagccaccggagaaaaaggagtgcagatacccaaatctcctagcaaacctggaaagcaatccttaaatggcaagaatttgaagatgggatttcatttaaagaattcgtctttg

SEQ ID NO: 4194 - DNA, 278 bp, Zea mays
  misc_feature: Incyte ID No: 700347930H1
  unsure 36, 39, 131, 200: a, t, c, g, or other
cccgctcagtcacaaagcctcagatctcagtcgccngcnccgccgcttcgtaccgtgtggaggggagaagacaggaaatggcggcgactgagggcgtgctcttggggatgggcaaccccctcctcgacatntccgccgtcgtcgatgacgccttcctgacaaagtatgacatcaagctgaacaatgctattctcgctgangagaagcacttgcctatgtatgacgagttggctagcaagagcaatgttgaatatattgccggagagccacccagaact

SEQ ID NO: 4195 - DNA, 288 bp, Zea mays
  misc_feature: Incyte ID No: 700347931H1
gttttcctcactctctcctccagctcagggtccggcggcgaagggaaggcaagatgtacaccgcgaggaagaagatccagaaggagaagggtcttgagccctccgagttcgaggactccgttgcccaggctttctttgatctggagaacgggaaccaggagctcaagagcgacctcaaggacctgtacatcaacaatgctatccagatggatgttaccgggagtaggaaggctgttgtcattcacgtcccataccgcctgcgcaaggccttcaggaagatccatgtca

SEQ ID NO: 4196 - DNA, 215 bp, Zea mays
  misc_feature: Incyte ID No: 700347935H1
  unsure 46, 104, 111, 134, 149, 152, 154, 166, 170-171, 175, 186, 188, 190, 195,: a, t, c, g, or other
agaaacgtcgaaaccagcacccggaaacccagacaaagcacgagcnacgcacgccccgctgtctccctcccgccgtcccgccgccaccgcagcaccgctactgncggagtntctcgccaccgtcgttgctctcncgccttcaccgtgcnaantngcctccttggcntcgnncgcngtttcagtcgntncnactcntcatngctttcgnctggtna

SEQ ID NO: 4197 - DNA, 109 bp, Zea mays
  misc_feature: Incyte ID No: 700347939H1
gttggcgtcgtctcttcgtgctccccgtgtgttgttgtaaaacaagaagatgttttctggtgtctttggcggaataacagatcgtccgaacgacaacctttttttgggt

SEQ ID NO: 4198 - DNA, 279 bp, Zea mays
  misc_feature: Incyte ID No: 700347941H1
tcgagggtaagagccagcagtagaagaattagcaaagtcaatgaaaaggttgctggtagagtgaattcattgcaacaactaaatcagggtccgcgtacaacgttgcaagattttgcagttgctgtgcaatctgatccacatttgcttggtccaaattggcccacacaaatcgagaaggtacaggcaatgtcatttggaggagaatgatacatagtggcctgttatagctgatgaacatgaacttctctaaaggagatgctgtttgctggcattgaagta

SEQ ID NO: 4199 - DNA, 278 bp, Zea mays
  misc_feature: Incyte ID No: 700347944H1
  unsure 31, 246: a, t, c, g, or other
cggagtcattccacaggcgaatggctcagcncggtgttaggttgggggccactgaaataatcgctagtgtcaaggctgaactaggaaaaccaagcattcttcaccctgacaaaggaaaagttgctatttttgtcgactgtagtccaaccgctgagcctctgtttgagggtagaggctctgaagaattgtctgctgagctctctgtttccctgcaaagatgcttgttgggtggtaaaagcggtgctngtgctgcaattgatctgtcatcctaattgttg

SEQ ID NO: 4200 - DNA, 232 bp, Zea mays
  misc_feature: Incyte ID No: 700347945H1
  unsure 27, 97, 125, 128, 156, 187, 193, 209: a, t, c, g, or other
ccccatctcccagatccaattcgcganttctccctcctctgcggccatggcgctctctgtggagaagacctcgtctggacgggagtacaaggtcaangatctctcgcaggcggacttcggccgcntcnatattgagctggccgaggtcgaaatgcncggcctcatagcgtgccgcgccgatttcggnccgtcnaagcccttcgccgggngctaggatctcggggtctctcca

SEQ ID NO: 4201 - DNA, 283 bp, Zea mays
  misc_feature: Incyte ID No: 700347948H1
  unsure 14, 41, 118, 224, 240, 256: a, t, c, g, or other
aaggtccgcaaggnccttggctctgcttttctgtacctgcngtcggggacctgctcggggatcaaggtgggtaggctggacatggagcaagaggtgatcgtggacaatgtgatggccncagtggaggaggctgtcgagaaggtgccaaagaagtgggccaacgttagggcactgcatctgaaggctgtggattcagttgctctaccaatttacccaggttgtancagagttgggtatganaatcgaggtgcctganattattggatctggggaggttatgatt

SEQ ID NO: 4202 - DNA, 118 bp, Zea mays
  misc_feature: Incyte ID No: 700347949H1
  unsure 9, 16, 20, 30, 48, 60-61, 81, 87, 101, 104, 106-107, 110: a, t, c, g, or other
cccgctcgncctcctnctcncctcctgganagcagagcacagcacaanacaccgagaaannagaacgcagaccgccaccgnagctcngaaccaccatcagnagnannacncccggtca

SEQ ID NO: 4203 - DNA, 281 bp, Zea mays
  misc_feature: Incyte ID No: 700347955H1
  unsure 132, 156: a, t, c, g, or other
cactacaaggagaagcaccccaatgtgaagcaagtctccctgattggcaaggctggtggtgacaagtggaagtccctgtctgatgccgagaaggctccctacgtgtctaaggcagagaagctcaaggctgantacaccaagaagatcgacgcttanagcaacaagcagtctggagaccccacggcgtctggtgattccgacaagtccaagtccgaggtgaacgacgaggacgaggagggtgacgagtgatgtatgacggatgaaactctgtccaagtgttt

SEQ ID NO: 4204 - DNA, 278 bp, Zea mays
  misc_feature: Incyte ID No: 700347956H1
gacaatgaaaggatggaactgctgctgtcccaactgagcggtaaggacatcaccgagctcattgccgcgggcagagagaagtttgcttcagtcccatgtggcggcggcggtgtggctgttgcggcaggtgcacctgctgctggcggagctgctcctgcagctgaggcaaagaaagaagagaaggtggaagagaaggaagaaagcgatgatgatatgggcttcagcctcttcgactaggttgcacagtcatcacagtattgtttcgggcagtgaaatca

SEQ ID NO: 4205 - DNA, 72 bp, Zea mays
  misc_feature: Incyte ID No: 700347959H1
  unsure 62: a, t, c, g, or other
ggtatataaaagggataatgaatcaacttggccttgttgttcgagaagatgctgttggtaanatatttggcc

SEQ ID NO: 4206 - DNA, 281 bp, Zea mays
  misc_feature: Incyte ID No: 700347960H1
  unsure 24, 61, 72, 98, 191: a, t, c, g, or other
gccacagcaagctccgcacgaccnccggtccgccgcctaccagagcgagctcatctctcanccgcgccgggnggcctcctcgtcacgccggcgcagcncgcgcttcgttccaccgtagtttgcccggccgtgctggggcaaaaaaaggtccgggcccacgtgttcccagacggagcgagaggacgtcgatncgtcaggccatcagggaccagaccagacaaagccaaaggggccgcggatcggtaggcggccggcgcggatcggaggaagaagggaggagg

SEQ ID NO: 4207 - DNA, 281 bp, Zea mays
  misc_feature: Incyte ID No: 700347961H1
  unsure 22, 30, 33, 41, 53, 62, 68, 80, 91-92, 95, 103, 117, 147-148, 205, 219,: a, t, c, g, or other
ccagggccgtaagtagagcggnggtggtgncgncggaggcnttggcagctcgngactgagcnccaagnatcagcatgatncttcagacgcnntcncaggttcncctctgtcattcgntcagccgtctcagtccatttgcggaggaannttggtgttacagcagtggcatttagataaggaacttgatcctattcagaaactctgngtggacaagattanagaatacaaatctaagcnananacatctggaggacctgttnatgctagttcagagtatcanc

SEQ ID NO: 4208 - DNA, 280 bp, Zea mays
  misc_feature: Incyte ID No: 700347962H1
  unsure 40: a, t, c, g, or other
ctgaaccacgtcgcgagccagccatacaccgctgagcgcncgccgcccgcgtccgtgagctcctccacggtgggcagcgggtcgccgcagctcgtcaggacgccgtccagaaggagaggcggtactggtaggaggagcgcgcagtgcgcttagggcttaggcccacaggctgcattgttgcacgcatgtctggaagagcagcaagatacgtcgtcagctcagtcagatcagatgaggccgggtaggaggaggtagggatgaaaacggtcgaaaacgatcg

SEQ ID NO: 4209 - DNA, 278 bp, Zea mays
  misc_feature: Incyte ID No: 700347966H1
  unsure 226, 250: a, t, c, g, or other
atcacgcgccgccatcgattgaccttgaccgacccgaccacccatcacgcttcttgttgccgccgctgttgcttgccgatacgcggtggctgcgctcgccggcggggaagaggggtcgcgggctgcgcgcctccagtctttcttcgcctccgtgctctcgggcctcttcttcggccaggccgatcaggacgaggaccaagagatggcctcgcgcaaccacaacgcngccgctccgcagcttcaccatcanaaccgagccggtgttcccgctcttggaa

SEQ ID NO: 4210 - DNA, 201 bp, Zea mays
  misc_feature: Incyte ID No: 700347969H1
  unsure 38, 46, 51, 77, 118, 160, 172, 192: a, t, c, g, or other
ccttcaacctccccgcaaaaacctccgctggcacaggntccctgtnattcnacagggcgagggagtcgcagaagtcnagggccaggatggtgacggtgcgggcggaggcggttgacangaccatcagcccgcgggtgaatgcgctcaggccgtccaagancatggccatcancgaccaggccacggcgctgngacaggccg

SEQ ID NO: 4211 - DNA, 277 bp, Zea mays
  misc_feature: Incyte ID No: 700347970H1
  unsure 261: a, t, c, g, or other
ctggaacctcctccactcccagcttccgccgacgctcgcttcagctgctgctttccttcccatccttcaacaggtgcaatttgcatttcccatggagctcactgattaataacgtgtgagctgaacttgcttttctgtggacaatttggaacttcagtactagtttccgataggattcagggagaaatgatctcttttaacaatttattttggagctcccttcagccttctttcaagttttacagaaagtgcctgacaaantgcccatattttgcag

SEQ ID NO: 4212 - DNA, 273 bp, Zea mays
  misc_feature: Incyte ID No: 700347976H1
  unsure 9, 13, 21, 24-25, 37, 48, 65, 113, 130, 140, 181, 269: a, t, c, g, or other
aacaacacncagntctgcccnagnncgcaacagcacnttcccgcatcnccctctggtccggtcanaggagctccgagacctctccaatgggcggttaagatctacgttgtgtnctattccatgtatgggnatgttggcanactagctgatgagatcaagaaaggtgccttatctgttgaangtgttgaggctaaaatatggcaggtccctgaaattctctctgaagaagtgcttggaaagatgggcgcgccccctaagcccgacgtgcnagtc

SEQ ID NO: 4213 - DNA, 278 bp, Zea mays
  misc_feature: Incyte ID No: 700347978H1
  unsure 18: a, t, c, g, or other
ccgcctcacccgcaagcnccgcctcatcgcgctcctcaggcgcttcccgggcgtcttcgacgtcgtcgaggagggcgtctactccctccgcttccgcctcacgccggccgccgagcgcctctacctcgacgagctccgcctcaggaacgagtccgagggcctcgccgtcgccaagctccgcaagctgctcatgatgtcgcaggagaagcgcatcctcatcgagaaggtcgcgcacctcaagcacgacctcggcctcccgcccgagttccgcgacaccg

SEQ ID NO: 4214 - DNA, 275 bp, Zea mays
  misc_feature: Incyte ID No: 700347979H1
  unsure 3, 14: a, t, c, g, or other
ganaagcttgaganatttaacaaggagaagttgctagatttttgtgaaatactggacgttattgtaaaagtacctatgaagaaggaagaagtttctgccaagctcttggaatttttggagtctccttgtgttactcgggatgttgttctcactgataaaaagaaggggaagaaacggggaagaaaatctaaagtaggtcgtgaggcaactgctgaaggtgcttctgcagagaagaaaaggaaaagagcccataaacaagcagctgaagatggtaa

SEQ ID NO: 4215 - DNA, 275 bp, Zea mays
  misc_feature: Incyte ID No: 700347980H1
actttctcttagctactataaatggattatttttaaccttgaagtggtgctaccgttacaaataaaagttacttgagccaaatgcttgctctggaatcacttcggactatcacctagagcagttgccacatgcagcaccaagattacttgcacgttacaaattggctaggactgacagacaaccttgttattgctatcctccatgtagtatcgctggtaggtgaatcagctcctccagaaatgcttcagaagttgacatatctggctatcagaca

SEQ ID NO: 4216 - DNA, 274 bp, Zea mays
  misc_feature: Incyte ID No: 700347981H1
  unsure 118, 125, 128, 130, 135-136, 138, 140, 178: a, t, c, g, or other
gccactccctgacatcgagaccggctgcccgaccccggtccggcgatccctctgcacccctttctttgcgctgccagccccaatctctcgcatccctgtcaaccatggcggcgtcagnggcggangtncngtgcnncncngtgcccagaaggagcaggacatacagatgatgctcgcngccgacgtccacctcggcaccaagaactgcgatttccagatggagcggtatgtctttaagcgtcgcaccgacggcatctacatcatcaacctgggc

SEQ ID NO: 4217 - DNA, 270 bp, Zea mays
  misc_feature: Incyte ID No: 700347982H1
  unsure 21: a, t, c, g, or other
cctctgctagccgctagcgancgggcccttcgccgggcgacgagcacaccggccctgttaccatggcagcgatgaatactggtatgggaggtttaggtggcaggccgatacatccacaagcaaatccttttggacctgctttgcaggtgctggaccaggattgatccgtactgggctagaaacatatggcggaaggattttagattcaagttctgagtttatgcagagcaatataacacaatatttgtccgaccctcagtactactttca

SEQ ID NO: 4218 - DNA, 273 bp, Zea mays
  misc_feature: Incyte ID No: 700347985H1
  unsure 38, 170, 256: a, t, c, g, or other
actgcatacctggcattaagaaggacctttaggcagangctcgtggaattctacagggagcaccctgagggagatgacattccagagcacgagctgccacacccattcaaccgagcgagatcgagcttgccccaggacgaacaaaggactgctcctgaatcttcgtcccnactcaagccatctgatgtcaatggacagcagcagaccgctgctgtgatgtcgcacatgtcacagtcgttcaagaggaggttctcgnagagatctccgatcggc

SEQ ID NO: 4219 - DNA, 273 bp, Zea mays
  misc_feature: Incyte ID No: 700347986H1
cattgacgaggagatccgcaagcttgatgagaaaattgctgatgcggaggagaacttgggtgagagcgaagtccgtgaagcacatcttgccaaatctttgtactttataagggtcggtgagaaggaaaaggccctggaacagcttaaagtcactgaaggaaaaactgtagctgttggccaaaagatggatcttgtgttccacactttgcagattggttttttctacatggattttgatctgatatcaaaatccatcgataaggcaaagaactt

SEQ ID NO: 4220 - DNA, 273 bp, Zea mays
  misc_feature: Incyte ID No: 700347988H1
  unsure 16, 22, 44, 60, 78-79, 81-82, 112-113, 135, 153, 201, 229-230, 237,: a, t, c, g, or other
ctggcaccctcctgantggaancccagagtacctcctgtgtggnagggtccctggatttnccctaacacccaccctcnncnnccttcagccatgctgatggcagagaagatnngaacttggagcccatttctcantggagaggaaaacttgtnatctggctttgcggagaaggttccaccttacgctcgtagtacattatntttactatgtgctaggatatcatatttnnaaggacnannaantgtagaatacttgantgagcttgtattata

SEQ ID NO: 4221 - DNA, 276 bp, Zea mays
  misc_feature: Incyte ID No: 700347989H1
  unsure 16, 24, 26, 29-30, 36, 79: a, t, c, g, or other
gatgatgggagcaaanatcatctncngcnncctgangccttctttgtcctgtgtagacctggcatgtgaaggcctcagncacgcagcagatgatggggagcaaacatcaagcaccacaagcactacatcctaccccccactggttataaaagatccctggcaaatggacacctgcaagcggacactgatcaggaatccaagcctagaccttacccctccgcaaaaaccctttcctggcatctgtcttcggagaacagcaccaaagcaaacgcacat

SEQ ID NO: 4222 - DNA, 271 bp, Zea mays
  misc_feature: Incyte ID No: 700347992H1
aacaacacccagctctgccccagcccgccacaggagttcccgcatctccctctggtccggtcacaggagctccgagacctctccaatggcggttaagatctacgttgtgtactattccatgtatgggcatgttggcaaactagctgatgagatcaagaaaggtgccttatctgttgaaggtgttgaggctaaaatatggcaggtccctgaaattctctctgaagaagtgcttggaaagatgggcgcgccccctaagcccgacgtgccagtc

SEQ ID NO: 4223 - DNA, 273 bp, Zea mays
  misc_feature: Incyte ID No: 700347993H1
  unsure 31, 49, 53, 77, 98, 106, 122, 158, 160, 193, 206, 208, 222, 235, 266, 268: a, t, c, g, or other
gacctccgccatcatgggtcgcatgcacgcncccgggaagggcctgtcncagnccggcgctgccctaccgccgtagngtgcccacgtggctgaagttnacgtctgnacgacgtgaaggaacnaatttacaagtaggccaagaaaggcctgactccttncnagataggacgtgattctgagggactcacatggngtggcacaggtcngntttgtgaccggaantaaaatcttgagnatccttaagtccaaaggccttgcccctgatntncctga

SEQ ID NO: 4224 - DNA, 272 bp, Zea mays
  misc_feature: Incyte ID No: 700347994H1
  unsure 13: a, t, c, g, or other
tccgtcggaaggnctggcgctaagggacgatccctccgtcagcccgtccgttcgacgggacctcggttggtttcgtcggtcgctgggaggacaggtgacggaacggtgatatgaggcggtggttatgttgtaactgccactatgacgtcgaggaagatgaccacgccaaggaacaggccaaagctcagagcaataagaccgactccaagcagaagtcttcaaagcctcctggtagtcaacctgagccagagttctcccctcctacaattgat

SEQ ID NO: 4225 - DNA, 271 bp, Zea mays
  misc_feature: Incyte ID No: 700347995H1
  unsure 2, 71, 155: a, t, c, g, or other
cnacggacagaggcggttgcgcccgtggaaggccaaggtgtatgaaatgaatcatgtggtggctcctcctngagtcaaggagggtcccgggggcgatgacggatgaagaattcttttcatcttgcaatgacaatgatatagagagtgaggggttngatgatgttctgacagaggaggagaagaagcagttggaggctgcgctaaaaatggattctccggatgccggtggggaagaccaatctgactcatttgctggccctcgacatagttg

SEQ ID NO: 4226 - DNA, 268 bp, Zea mays
  misc_feature: Incyte ID No: 700347996H1
caaaagggcgtgtttgagactagcggaccgaccttgaagttgaagttgaaaaggtcggcctgcgcggcgatggatgtcaagtgccggcgtctggaggggaaggtggccatcgtgacggcgtccacgatggggatcggcctcgccatcgccgagcgcctcggtctggagggcgccgccgtcgtcatctcctcccgcaagcagaagaacgtgaacgaggcggtggaggggctcagggccaagggtatcaccgcggttggtgccgtctgcc

SEQ ID NO: 4227 - DNA, 231 bp, Zea mays
  misc_feature: Incyte ID No: 700348005H1
  unsure 6, 8, 13-14, 16-17, 19, 99, 101, 106, 123, 145, 173, 224-225: a, t, c, g, or other
actcancnacagnncnnancaattattcctgtctcgtatcctctctcgccgctccgatggcccgcacgaagcaaacacccaaggaagtcggccccggcnancggcngcgtgaaaaagccccancgcttccaccccggcaccgtcncgctccggagatccgcaagtaccagaanaacactgagctgctcatccgcaatctccccttccagcgcctcgtccgcganntcacgg

SEQ ID NO: 4228 - DNA, 108 bp, Zea mays
  misc_feature: Incyte ID No: 700348006H1
  unsure 11-12, 27, 32, 43, 46-47, 49, 102-103, 105: a, t, c, g, or other
cgacccgccannatgggccgcgttcgnaccanaaccgtgaagnagnngncccgggtcatcatagaaaagtactacacgcgcctgggcaacgacttccacacnncntac

SEQ ID NO: 4229 - DNA, 303 bp, Zea mays
  misc_feature: Incyte ID No: 700348008H1
ctgccctcctcgccgtcgctgcctccctccgcgcgaccgatctaccctccgccgccaccatgtcgctgatcgccggggaggacttccagcatatcctgcgtttgctgaacaccaacgtggatgggaagcagaagatcatgttcgccatgacctcaatcaagggtgtcgggcgccgcttctccaacatcgtctgcaagaaggccgacatcgacatgaacaagagggccggcgagctgacgcctgatgagctggagcgcctgatgacggtcgtggccaaccctaggcaattcaaggtgccggact

SEQ ID NO: 4230 - DNA, 285 bp, Zea mays
  misc_feature: Incyte ID No: 700348009H1
  unsure 18, 139, 249, 259, 272, 278: a, t, c, g, or other
tccccgttttccactttngcctccgccccaattcggataacaaacccctcaccctcgtcgcgtctcctcccagccgagccgatccggtagagagagggagagggagggactgagggaggaggagctgggttccggtccnggccgcccggccggctgcgcgattcgattgcagctctcgtccccgggcggcgtccaggatggtgcggggcaagacgcagatgaagcggatagagaacccgaccagccgcnagtcaccttntcaagggcgaaangcttgntaaaaag

SEQ ID NO: 4231 - DNA, 299 bp, Zea mays
  misc_feature: Incyte ID No: 700348013H1
  unsure 19, 21, 26, 32, 35, 79, 81, 116, 184: a, t, c, g, or other
actacctcgatagattccncnccacncaccanctngctgaaggcagagcttggatgactcagctcttggcagtggcttncntgtctttggcttcgaaaatcgaagagacttttgtnccactccccttggatttgcaggtagcggaggcaaagtttgtttttgagggaaggaccataaaaagganggagcttctggtgctaagcaccttaaagtggaggatgcatgctgttactgcttgctcatttgttgaatactttcttcataaattgagtgatcatggtgcaccctccttgcttgca

SEQ ID NO: 4232 - DNA, 57 bp, Zea mays
  misc_feature: Incyte ID No: 700348015H1
  unsure 31, 40, 47, 54-55: a, t, c, g, or other
gaagggacagcgtcaccgtggaggacattgntttcaaagnagccagnacccttnnca

SEQ ID NO: 4233 - DNA, 211 bp, Zea mays
  misc_feature: Incyte ID No: 700348020H1
  unsure 10, 99, 208: a, t, c, g, or other
gacgagaggnaactactggtgccagtaggggttcagcagccacatgcatatgctaggagcttggcacgatttgcatcaaaattgggcccagttggctgngatgtggcagcaaatcgtatcagaagggcactcccccctgggacaagtttcggcccaggatgggttgtagatggtgaaccacctcaaaactctcagtgggctctgcagntcg

(The sequence listing continues in the following parts.)

What is claimed is:

1. A purified polynucleotide consisting of a nucleic acid sequence of SEQ ID NO:505 1 or the complete complement of the nucleic acid sequence.

2. An expression vector containing the polynucleotide of claim 1.

3. A host cell containing the expression vector of claim 2.

4. A method for detecting a polynucleotide in a sample, the method comprising the steps of:

a) providing a sample containing nucleic acids, b) hybridizing a polynucleotide of claim 1 to the nucleic acids, thereby forming a hybridization complex; and c) detecting the hybridization complex, wherein the presence of the hybridization complex correlates with the presence of the polynucleotide in the sample.

5. The method of claim 4 wherein the nucleic acids of the sample are amplified prior to hybridization.

* * * * *

UNITED STATES PATENT AND TRADEMARK OFFICE
CERTIFICATE OF CORRECTION

PATENT NO.    : 6,476,212 B1
DATED         : November 5, 2002
INVENTOR(S)   : Lalgudi et al.

It is certified that error appears in the above-identified patent and that said Letters Patent is hereby corrected as shown below:

Column 777,
Line 30, replace "SEQ ID NO:505 1" with -- SEQ ID NO: 5051 --.

Signed and Sealed this

Tenth Day of June, 2003

JAMES E. ROGAN
*Director of the United States Patent and Trademark Office*